United States Patent 11,459,587 (MATERIALS AND METHODS FOR TREATMENT OF PAIN RELATED DISORDERS) - sequence listing, part 7

SEQ ID NO: 93213 - DNA, 20 bp, Artificial Sequence
  Description of Artificial Sequence: Synthetic oligonucleotide
  Target: SCN9A; (+) strand; PAM type: YTN; PAM sequence: TTG
ttgttgtaaaaaatttgcat

SEQ ID NO: 93214 - DNA, 20 bp, Artificial Sequence
  Description of Artificial Sequence: Synthetic oligonucleotide
  Target: SCN9A; (+) strand; PAM type: YTN; PAM sequence: TTG
ttgtaaaaaatttgcatgta

SEQ ID NO: 93215 - DNA, 20 bp, Artificial Sequence
  Description of Artificial Sequence: Synthetic oligonucleotide
  Target: SCN9A; (+) strand; PAM type: YTN; PAM sequence: TTG
taaaaaatttgcatgtatca

SEQ ID NO: 93216 - DNA, 20 bp, Artificial Sequence
  Description of Artificial Sequence: Synthetic oligonucleotide
  Target: SCN9A; (+) strand; PAM type: YTN; PAM sequence: TTT
gcatgtatcacaatcactta

SEQ ID NO: 93217 - DNA, 20 bp, Artificial Sequence
  Description of Artificial Sequence: Synthetic oligonucleotide
  Target: SCN9A; (+) strand; PAM type: YTN; PAM sequence: TTG
catgtatcacaatcacttat

SEQ ID NO: 93218 - DNA, 20 bp, Artificial Sequence
  Description of Artificial Sequence: Synthetic oligonucleotide
  Target: SCN9A; (+) strand; PAM type: YTN; PAM sequence: CTT
atgttgaaatggattacagt

SEQ ID NO: 93219 - DNA, 20 bp, Artificial Sequence
  Description of Artificial Sequence: Synthetic oligonucleotide
  Target: SCN9A; (+) strand; PAM type: YTN; PAM sequence: TTA
tgttgaaatggattacagta

SEQ ID NO: 93220 - DNA, 20 bp, Artificial Sequence
  Description of Artificial Sequence: Synthetic oligonucleotide
  Target: SCN9A; (+) strand; PAM type: YTN; PAM sequence: TTG
aaatggattacagtattatt

SEQ ID NO: 93221 - DNA, 20 bp, Artificial Sequence
  Description of Artificial Sequence: Synthetic oligonucleotide
  Target: SCN9A; (+) strand; PAM type: YTN; PAM sequence: TTA
cagtattattcagtgattat

SEQ ID NO: 93222 - DNA, 20 bp, Artificial Sequence
  Description of Artificial Sequence: Synthetic oligonucleotide
  Target: SCN9A; (+) strand; PAM type: YTN; PAM sequence: TTA
ttcagtgattataattctat

SEQ ID NO: 93223 - DNA, 20 bp, Artificial Sequence
  Description of Artificial Sequence: Synthetic oligonucleotide
  Target: SCN9A; (+) strand; PAM type: YTN; PAM sequence: TTC
agtgattataattctatttt

SEQ ID NO: 93224 - DNA, 20 bp, Artificial Sequence
  Description of Artificial Sequence: Synthetic oligonucleotide
  Target: SCN9A; (+) strand; PAM type: YTN; PAM sequence: TTA
taattctattttgcagagtg

SEQ ID NO: 93225 - DNA, 20 bp, Artificial Sequence
  Description of Artificial Sequence: Synthetic oligonucleotide
  Target: SCN9A; (+) strand; PAM type: YTN; PAM sequence: TTC
tattttgcagagtggctatt

SEQ ID NO: 93226 - DNA, 20 bp, Artificial Sequence
  Description of Artificial Sequence: Synthetic oligonucleotide
  Target: SCN9A; (+) strand; PAM type: YTN; PAM sequence: CTA
ttttgcagagtggctattgc

SEQ ID NO: 93227 - DNA, 20 bp, Artificial Sequence
  Description of Artificial Sequence: Synthetic oligonucleotide
  Target: SCN9A; (+) strand; PAM type: YTN; PAM sequence: TTT
tgcagagtggctattgcaac

SEQ ID NO: 93228 - DNA, 20 bp, Artificial Sequence
  Description of Artificial Sequence: Synthetic oligonucleotide
  Target: SCN9A; (+) strand; PAM type: YTN; PAM sequence: TTT
gcagagtggctattgcaact

SEQ ID NO: 93229 - DNA, 20 bp, Artificial Sequence
  Description of Artificial Sequence: Synthetic oligonucleotide
  Target: SCN9A; (+) strand; PAM type: YTN; PAM sequence: TTG
cagagtggctattgcaacta

SEQ ID NO: 93230 - DNA, 20 bp, Artificial Sequence
  Description of Artificial Sequence: Synthetic oligonucleotide
  Target: SCN9A; (+) strand; PAM type: YTN; PAM sequence: CTA
ttgcaactatcagtacaaaa

SEQ ID NO: 93231 - DNA, 20 bp, Artificial Sequence
  Description of Artificial Sequence: Synthetic oligonucleotide
  Target: SCN9A; (+) strand; PAM type: YTN; PAM sequence: TTG
caactatcagtacaaaagtc

SEQ ID NO: 93232 - DNA, 20 bp, Artificial Sequence
  Description of Artificial Sequence: Synthetic oligonucleotide
  Target: SCN9A; (+) strand; PAM type: YTN; PAM sequence: CTA
tcagtacaaaagtcccaagg

SEQ ID NO: 93233 - DNA, 20 bp, Artificial Sequence
  Description of Artificial Sequence: Synthetic oligonucleotide
  Target: SCN9A; (+) strand; PAM type: YTN; PAM sequence: CTA
ttttacaccttttacatgct

SEQ ID NO: 93234 - DNA, 20 bp, Artificial Sequence
  Description of Artificial Sequence: Synthetic oligonucleotide
  Target: SCN9A; (+) strand; PAM type: YTN; PAM sequence: TTT
tacaccttttacatgctatt

SEQ ID NO: 93235 - DNA, 20 bp, Artificial Sequence
  Description of Artificial Sequence: Synthetic oligonucleotide
  Target: SCN9A; (+) strand; PAM type: YTN; PAM sequence: TTT
acaccttttacatgctatta

SEQ ID NO: 93236 - DNA, 20 bp, Artificial Sequence
  Description of Artificial Sequence: Synthetic oligonucleotide
  Target: SCN9A; (+) strand; PAM type: YTN; PAM sequence: TTA
caccttttacatgctattaa

SEQ ID NO: 93237 - DNA, 20 bp, Artificial Sequence
  Description of Artificial Sequence: Synthetic oligonucleotide
  Target: SCN9A; (+) strand; PAM type: YTN; PAM sequence: CTT
ttacatgctattaagataac

SEQ ID NO: 93238 - DNA, 20 bp, Artificial Sequence
  Description of Artificial Sequence: Synthetic oligonucleotide
  Target: SCN9A; (+) strand; PAM type: YTN; PAM sequence: TTT
tacatgctattaagataaca

SEQ ID NO: 93239 - DNA, 20 bp, Artificial Sequence
  Description of Artificial Sequence: Synthetic oligonucleotide
  Target: SCN9A; (+) strand; PAM type: YTN; PAM sequence: TTT
acatgctattaagataacat

SEQ ID NO: 93240 - DNA, 20 bp, Artificial Sequence
  Description of Artificial Sequence: Synthetic oligonucleotide
  Target: SCN9A; (+) strand; PAM type: YTN; PAM sequence: TTA
catgctattaagataacata

SEQ ID NO: 93241 - DNA, 20 bp, Artificial Sequence
  Description of Artificial Sequence: Synthetic oligonucleotide
  Target: SCN9A; (+) strand; PAM type: YTN; PAM sequence: CTA
ttaagataacataaaagttg

SEQ ID NO: 93242 - DNA, 20 bp, Artificial Sequence
  Description of Artificial Sequence: Synthetic oligonucleotide
  Target: SCN9A; (+) strand; PAM type: YTN; PAM sequence: TTA
agataacataaaagttgaaa

SEQ ID NO: 93243 - DNA, 20 bp, Artificial Sequence
  Description of Artificial Sequence: Synthetic oligonucleotide
  Target: SCN9A; (+) strand; PAM type: YTN; PAM sequence: TTG
aaataatggcctagtatggc

SEQ ID NO: 93244 - DNA, 20 bp, Artificial Sequence
  Description of Artificial Sequence: Synthetic oligonucleotide
  Target: SCN9A; (+) strand; PAM type: YTN; PAM sequence: CTA
gtatggcaattatttttaga

SEQ ID NO: 93245 - DNA, 20 bp, Artificial Sequence
  Description of Artificial Sequence: Synthetic oligonucleotide
  Target: SCN9A; (+) strand; PAM type: YTN; PAM sequence: TTA
tttttagaatatcttaccta

SEQ ID NO: 93246 - DNA, 20 bp, Artificial Sequence
  Description of Artificial Sequence: Synthetic oligonucleotide
  Target: SCN9A; (+) strand; PAM type: YTN; PAM sequence: TTT
ttagaatatcttacctaatg

SEQ ID NO: 93247 - DNA, 20 bp, Artificial Sequence
  Description of Artificial Sequence: Synthetic oligonucleotide
  Target: SCN9A; (+) strand; PAM type: YTN; PAM sequence: TTT
tagaatatcttacctaatga

SEQ ID NO: 93248 - DNA, 20 bp, Artificial Sequence
  Description of Artificial Sequence: Synthetic oligonucleotide
  Target: SCN9A; (+) strand; PAM type: YTN; PAM sequence: TTT
agaatatcttacctaatgac

SEQ ID NO: 93249 - DNA, 20 bp, Artificial Sequence
  Description of Artificial Sequence: Synthetic oligonucleotide
  Target: SCN9A; (+) strand; PAM type: YTN; PAM sequence: TTA
gaatatcttacctaatgacc

SEQ ID NO: 93250 - DNA, 20 bp, Artificial Sequence
  Description of Artificial Sequence: Synthetic oligonucleotide
  Target: SCN9A; (+) strand; PAM type: YTN; PAM sequence: CTT
acctaatgaccatcaacagg

SEQ ID NO: 93251 - DNA, 20 bp, Artificial Sequence
  Description of Artificial Sequence: Synthetic oligonucleotide
  Target: SCN9A; (+) strand; PAM type: YTN; PAM sequence: TTA
cctaatgaccatcaacagga

SEQ ID NO: 93252 - DNA, 20 bp, Artificial Sequence
  Description of Artificial Sequence: Synthetic oligonucleotide
  Target: SCN9A; (+) strand; PAM type: YTN; PAM sequence: CTA
atgaccatcaacaggacttg

SEQ ID NO: 93253 - DNA, 20 bp, Artificial Sequence
  Description of Artificial Sequence: Synthetic oligonucleotide
  Target: SCN9A; (+) strand; PAM type: YTN; PAM sequence: CTT
gatgcttatagctaaagtag

SEQ ID NO: 93254 - DNA, 20 bp, Artificial Sequence
  Description of Artificial Sequence: Synthetic oligonucleotide
  Target: SCN9A; (+) strand; PAM type: YTN; PAM sequence: TTG
atgcttatagctaaagtaga

SEQ ID NO: 93255 - DNA, 20 bp, Artificial Sequence
  Description of Artificial Sequence: Synthetic oligonucleotide
  Target: SCN9A; (+) strand; PAM type: YTN; PAM sequence: CTT
atagctaaagtagagggttg

SEQ ID NO: 93256 - DNA, 20 bp, Artificial Sequence
  Description of Artificial Sequence: Synthetic oligonucleotide
  Target: SCN9A; (+) strand; PAM type: YTN; PAM sequence: TTA
tagctaaagtagagggttgt

SEQ ID NO: 93257 - DNA, 20 bp, Artificial Sequence
  Description of Artificial Sequence: Synthetic oligonucleotide
  Target: SCN9A; (+) strand; PAM type: YTN; PAM sequence: CTA
aagtagagggttgtattaat

SEQ ID NO: 93258 - DNA, 20 bp, Artificial Sequence
  Description of Artificial Sequence: Synthetic oligonucleotide
  Target: SCN9A; (+) strand; PAM type: YTN; PAM sequence: TTG
tattaattactcagctaaaa

SEQ ID NO: 93259 - DNA, 20 bp, Artificial Sequence
  Description of Artificial Sequence: Synthetic oligonucleotide
  Target: SCN9A; (+) strand; PAM type: YTN; PAM sequence: TTA
attactcagctaaaaatggt

SEQ ID NO: 93260 - DNA, 20 bp, Artificial Sequence
  Description of Artificial Sequence: Synthetic oligonucleotide
  Target: SCN9A; (+) strand; PAM type: YTN; PAM sequence: TTA
ctcagctaaaaatggtaaga

SEQ ID NO: 93261 - DNA, 20 bp, Artificial Sequence
  Description of Artificial Sequence: Synthetic oligonucleotide
  Target: SCN9A; (+) strand; PAM type: YTN; PAM sequence: CTC
agctaaaaatggtaagaacc

SEQ ID NO: 93262 - DNA, 20 bp, Artificial Sequence
  Description of Artificial Sequence: Synthetic oligonucleotide
  Target: SCN9A; (+) strand; PAM type: YTN; PAM sequence: CTA
aaaatggtaagaaccacctc

SEQ ID NO: 93263 - DNA, 20 bp, Artificial Sequence
  Description of Artificial Sequence: Synthetic oligonucleotide
  Target: SCN9A; (+) strand; PAM type: YTN; PAM sequence: CTC
cactttttggaaataagcta

SEQ ID NO: 93264 - DNA, 20 bp, Artificial Sequence
  Description of Artificial Sequence: Synthetic oligonucleotide
  Target: SCN9A; (+) strand; PAM type: YTN; PAM sequence: CTT
tttggaaataagctagacct

SEQ ID NO: 93265 - DNA, 20 bp, Artificial Sequence
  Description of Artificial Sequence: Synthetic oligonucleotide
  Target: SCN9A; (+) strand; PAM type: YTN; PAM sequence: TTT
ttggaaataagctagacctt

SEQ ID NO: 93266 - DNA, 20 bp, Artificial Sequence
  Description of Artificial Sequence: Synthetic oligonucleotide
  Target: SCN9A; (+) strand; PAM type: YTN; PAM sequence: TTT
tggaaataagctagaccttt

SEQ ID NO: 93267 - DNA, 20 bp, Artificial Sequence
  Description of Artificial Sequence: Synthetic oligonucleotide
  Target: SCN9A; (+) strand; PAM type: YTN; PAM sequence: TTT
ggaaataagctagaccttta

SEQ ID NO: 93268 - DNA, 20 bp, Artificial Sequence
  Description of Artificial Sequence: Synthetic oligonucleotide
  Target: SCN9A; (+) strand; PAM type: YTN; PAM sequence: TTG
gaaataagctagacctttat

SEQ ID NO: 93269 - DNA, 20 bp, Artificial Sequence
  Description of Artificial Sequence: Synthetic oligonucleotide
  Target: SCN9A; (+) strand; PAM type: YTN; PAM sequence: CTA
gacctttataaatgtgcata

SEQ ID NO: 93270 - DNA, 20 bp, Artificial Sequence
  Description of Artificial Sequence: Synthetic oligonucleotide
  Target: SCN9A; (+) strand; PAM type: YTN; PAM sequence: CTT
tataaatgtgcatatttcct

SEQ ID NO: 93271 - DNA, 20 bp, Artificial Sequence
  Description of Artificial Sequence: Synthetic oligonucleotide
  Target: SCN9A; (+) strand; PAM type: YTN; PAM sequence: TTT
ataaatgtgcatatttcctg

SEQ ID NO: 93272 - DNA, 20 bp, Artificial Sequence
  Description of Artificial Sequence: Synthetic oligonucleotide
  Target: SCN9A; (+) strand; PAM type: YTN; PAM sequence: TTA
taaatgtgcatatttcctga

SEQ ID NO: 93273 - DNA, 20 bp, Artificial Sequence
  Description of Artificial Sequence: Synthetic oligonucleotide
  Target: SCN9A; (+) strand; PAM type: YTN; PAM sequence: TTT
cctgattttaatatgttgtt

SEQ ID NO: 93274 - DNA, 20 bp, Artificial Sequence
  Description of Artificial Sequence: Synthetic oligonucleotide
  Target: SCN9A; (+) strand; PAM type: YTN; PAM sequence: TTC
ctgattttaatatgttgttt

SEQ ID NO: 93275 - DNA, 20 bp, Artificial Sequence
  Description of Artificial Sequence: Synthetic oligonucleotide
  Target: SCN9A; (+) strand; PAM type: YTN; PAM sequence: CTG
attttaatatgttgtttgaa

SEQ ID NO: 93276 - DNA, 20 bp, Artificial Sequence
  Description of Artificial Sequence: Synthetic oligonucleotide
  Target: SCN9A; (+) strand; PAM type: YTN; PAM sequence: TTT
taatatgttgtttgaattca

SEQ ID NO: 93277 - DNA, 20 bp, Artificial Sequence
  Description of Artificial Sequence: Synthetic oligonucleotide
  Target: SCN9A; (+) strand; PAM type: YTN; PAM sequence: TTT
aatatgttgtttgaattcat

SEQ ID NO: 93278 - DNA, 20 bp, Artificial Sequence
  Description of Artificial Sequence: Synthetic oligonucleotide
  Target: SCN9A; (+) strand; PAM type: YTN; PAM sequence: TTA
atatgttgtttgaattcata

SEQ ID NO: 93279 - DNA, 20 bp, Artificial Sequence
  Description of Artificial Sequence: Synthetic oligonucleotide
  Target: SCN9A; (+) strand; PAM type: YTN; PAM sequence: TTG
tttgaattcataaatctcaa

SEQ ID NO: 93280 - DNA, 20 bp, Artificial Sequence
  Description of Artificial Sequence: Synthetic oligonucleotide
  Target: SCN9A; (+) strand; PAM type: YTN; PAM sequence: TTT
gaattcataaatctcaaaag

SEQ ID NO: 93281 - DNA, 20 bp, Artificial Sequence
  Description of Artificial Sequence: Synthetic oligonucleotide
  Target: SCN9A; (+) strand; PAM type: YTN; PAM sequence: TTG
aattcataaatctcaaaagt

SEQ ID NO: 93282 - DNA, 20 bp, Artificial Sequence
  Description of Artificial Sequence: Synthetic oligonucleotide
  Target: SCN9A; (+) strand; PAM type: YTN; PAM sequence: TTC
ataaatctcaaaagtagcta

SEQ ID NO: 93283 - DNA, 20 bp, Artificial Sequence
  Description of Artificial Sequence: Synthetic oligonucleotide
  Target: SCN9A; (+) strand; PAM type: YTN; PAM sequence: CTC
aaaagtagctaaattttgaa

SEQ ID NO: 93284 - DNA, 20 bp, Artificial Sequence
  Description of Artificial Sequence: Synthetic oligonucleotide
  Target: SCN9A; (+) strand; PAM type: YTN; PAM sequence: CTA
aattttgaaatatttggtgt

SEQ ID NO: 93285 - DNA, 20 bp, Artificial Sequence
  Description of Artificial Sequence: Synthetic oligonucleotide
  Target: SCN9A; (+) strand; PAM type: YTN; PAM sequence: TTT
tgaaatatttggtgtatatg

SEQ ID NO: 93286 - DNA, 20 bp, Artificial Sequence
  Description of Artificial Sequence: Synthetic oligonucleotide
  Target: SCN9A; (+) strand; PAM type: YTN; PAM sequence: TTT
gaaatatttggtgtatatgc

SEQ ID NO: 93287 - DNA, 20 bp, Artificial Sequence
  Description of Artificial Sequence: Synthetic oligonucleotide
  Target: SCN9A; (+) strand; PAM type: YTN; PAM sequence: TTG
aaatatttggtgtatatgcc

SEQ ID NO: 93288 - DNA, 20 bp, Artificial Sequence
  Description of Artificial Sequence: Synthetic oligonucleotide
  Target: SCN9A; (+) strand; PAM type: YTN; PAM sequence: TTT
ggtgtatatgccacatcact

SEQ ID NO: 93289 - DNA, 20 bp, Artificial Sequence
  Description of Artificial Sequence: Synthetic oligonucleotide
  Target: SCN9A; (+) strand; PAM type: YTN; PAM sequence: TTG
gtgtatatgccacatcacta

SEQ ID NO: 93290 - DNA, 20 bp, Artificial Sequence
  Description of Artificial Sequence: Synthetic oligonucleotide
  Target: SCN9A; (+) strand; PAM type: YTN; PAM sequence: CTA
aatatttactacctaccaat

SEQ ID NO: 93291 - DNA, 20 bp, Artificial Sequence
  Description of Artificial Sequence: Synthetic oligonucleotide
  Target: SCN9A; (+) strand; PAM type: YTN; PAM sequence: TTT
actacctaccaatgggtgca

SEQ ID NO: 93292 - DNA, 20 bp, Artificial Sequence
  Description of Artificial Sequence: Synthetic oligonucleotide
  Target: SCN9A; (+) strand; PAM type: YTN; PAM sequence: TTA
ctacctaccaatgggtgcat

SEQ ID NO: 93293 - DNA, 20 bp, Artificial Sequence
  Description of Artificial Sequence: Synthetic oligonucleotide
  Target: SCN9A; (+) strand; PAM type: YTN; PAM sequence: CTA
cctaccaatgggtgcataaa

SEQ ID NO: 93294 - DNA, 20 bp, Artificial Sequence
  Description of Artificial Sequence: Synthetic oligonucleotide
  Target: SCN9A; (+) strand; PAM type: YTN; PAM sequence: CTA
ccaatgggtgcataaaactc

SEQ ID NO: 93295 - DNA, 20 bp, Artificial Sequence
  Description of Artificial Sequence: Synthetic oligonucleotide
  Target: SCN9A; (+) strand; PAM type: YTN; PAM sequence: CTC
ttttgggcactatagttata

SEQ ID NO: 93296 - DNA, 20 bp, Artificial Sequence
  Description of Artificial Sequence: Synthetic oligonucleotide
  Target: SCN9A; (+) strand; PAM type: YTN; PAM sequence: CTT
ttgggcactatagttatact

SEQ ID NO: 93297 - DNA, 20 bp, Artificial Sequence
  Description of Artificial Sequence: Synthetic oligonucleotide
  Target: SCN9A; (+) strand; PAM type: YTN; PAM sequence: TTT
tgggcactatagttatactt

SEQ ID NO: 93298 - DNA, 20 bp, Artificial Sequence
  Description of Artificial Sequence: Synthetic oligonucleotide
  Target: SCN9A; (+) strand; PAM type: YTN; PAM sequence: TTT
gggcactatagttatactta

SEQ ID NO: 93299 - DNA, 20 bp, Artificial Sequence
  Description of Artificial Sequence: Synthetic oligonucleotide
  Target: SCN9A; (+) strand; PAM type: YTN; PAM sequence: TTG
ggcactatagttatacttac

SEQ ID NO: 93300 - DNA, 20 bp, Artificial Sequence
  Description of Artificial Sequence: Synthetic oligonucleotide
  Target: SCN9A; (+) strand; PAM type: YTN; PAM sequence: CTA
tagttatacttacccatata

SEQ ID NO: 93301 - DNA, 20 bp, Artificial Sequence
  Description of Artificial Sequence: Synthetic oligonucleotide
  Target: SCN9A; (+) strand; PAM type: YTN; PAM sequence: TTA
tacttacccatataaaatag

SEQ ID NO: 93302 - DNA, 20 bp, Artificial Sequence
  Description of Artificial Sequence: Synthetic oligonucleotide
  Target: SCN9A; (+) strand; PAM type: YTN; PAM sequence: CTT
acccatataaaatagagaaa

SEQ ID NO: 93303 - DNA, 20 bp, Artificial Sequence
  Description of Artificial Sequence: Synthetic oligonucleotide
  Target: SCN9A; (+) strand; PAM type: YTN; PAM sequence: TTA
cccatataaaatagagaaaa

SEQ ID NO: 93304 - DNA, 20 bp, Artificial Sequence
  Description of Artificial Sequence: Synthetic oligonucleotide
  Target: SCN9A; (+) strand; PAM type: YTN; PAM sequence: TTG
tcattatttaacattcatga

SEQ ID NO: 93305 - DNA, 20 bp, Artificial Sequence
  Description of Artificial Sequence: Synthetic oligonucleotide
  Target: SCN9A; (+) strand; PAM type: YTN; PAM sequence: TTA
tttaacattcatgaagagtg

SEQ ID NO: 93306 - DNA, 20 bp, Artificial Sequence
  Description of Artificial Sequence: Synthetic oligonucleotide
  Target: SCN9A; (+) strand; PAM type: YTN; PAM sequence: TTT
aacattcatgaagagtgcat

SEQ ID NO: 93307 - DNA, 20 bp, Artificial Sequence
  Description of Artificial Sequence: Synthetic oligonucleotide
  Target: SCN9A; (+) strand; PAM type: YTN; PAM sequence: TTA
acattcatgaagagtgcatt

SEQ ID NO: 93308 - DNA, 20 bp, Artificial Sequence
  Description of Artificial Sequence: Synthetic oligonucleotide
  Target: SCN9A; (+) strand; PAM type: YTN; PAM sequence: TTC
atgaagagtgcattgttcct

SEQ ID NO: 93309 - DNA, 20 bp, Artificial Sequence
  Description of Artificial Sequence: Synthetic oligonucleotide
  Target: SCN9A; (+) strand; PAM type: YTN; PAM sequence: TTG
ttcctgtatgatacagaggt

SEQ ID NO: 93310 - DNA, 20 bp, Artificial Sequence
  Description of Artificial Sequence: Synthetic oligonucleotide
  Target: SCN9A; (+) strand; PAM type: YTN; PAM sequence: TTC
ctgtatgatacagaggtagc

SEQ ID NO: 93311 - DNA, 20 bp, Artificial Sequence
  Description of Artificial Sequence: Synthetic oligonucleotide
  Target: SCN9A; (+) strand; PAM type: YTN; PAM sequence: CTG
tatgatacagaggtagcctg

SEQ ID NO: 93312 - DNA, 20 bp, Artificial Sequence
  Description of Artificial Sequence: Synthetic oligonucleotide
  Target: SCN9A; (+) strand; PAM type: YTN; PAM sequence: CTG
ggttcttacatttttagtag

SEQ ID NO: 93313 - DNA, 20 bp, Artificial Sequence
  Description of Artificial Sequence: Synthetic oligonucleotide
  Target: SCN9A; (+) strand; PAM type: YTN; PAM sequence: TTC
ttacatttttagtagcaaat

SEQ ID NO: 93314 - DNA, 20 bp, Artificial Sequence
  Description of Artificial Sequence: Synthetic oligonucleotide
  Target: SCN9A; (+) strand; PAM type: YTN; PAM sequence: CTT
acatttttagtagcaaatta

SEQ ID NO: 93315 - DNA, 20 bp, Artificial Sequence
  Description of Artificial Sequence: Synthetic oligonucleotide
  Target: SCN9A; (+) strand; PAM type: YTN; PAM sequence: TTA
catttttagtagcaaattaa

SEQ ID NO: 93316 - DNA, 20 bp, Artificial Sequence
  Description of Artificial Sequence: Synthetic oligonucleotide
  Target: SCN9A; (+) strand; PAM type: YTN; PAM sequence: TTT
ttagtagcaaattaattgcc

SEQ ID NO: 93317 - DNA, 20 bp, Artificial Sequence
  Description of Artificial Sequence: Synthetic oligonucleotide
  Target: SCN9A; (+) strand; PAM type: YTN; PAM sequence: TTT
tagtagcaaattaattgcca

SEQ ID NO: 93318 - DNA, 20 bp, Artificial Sequence
  Description of Artificial Sequence: Synthetic oligonucleotide
  Target: SCN9A; (+) strand; PAM type: YTN; PAM sequence: TTT
agtagcaaattaattgccat

SEQ ID NO: 93319 - DNA, 20 bp, Artificial Sequence
  Description of Artificial Sequence: Synthetic oligonucleotide
  Target: SCN9A; (+) strand; PAM type: YTN; PAM sequence: TTA
gtagcaaattaattgccata

SEQ ID NO: 93320 - DNA, 20 bp, Artificial Sequence
  Description of Artificial Sequence: Synthetic oligonucleotide
  Target: SCN9A; (+) strand; PAM type: YTN; PAM sequence: TTA
attgccatactaactactct

SEQ ID NO: 93321 - DNA, 20 bp, Artificial Sequence
  Description of Artificial Sequence: Synthetic oligonucleotide
  Target: SCN9A; (+) strand; PAM type: YTN; PAM sequence: TTG
ccatactaactactcttact

SEQ ID NO: 93322 - DNA, 20 bp, Artificial Sequence
  Description of Artificial Sequence: Synthetic oligonucleotide
  Target: SCN9A; (+) strand; PAM type: YTN; PAM sequence: CTA
actactcttactactaatat

SEQ ID NO: 93323 - DNA, 20 bp, Artificial Sequence
  Description of Artificial Sequence: Synthetic oligonucleotide
  Target: SCN9A; (+) strand; PAM type: YTN; PAM sequence: CTA
ctcttactactaatataaat

SEQ ID NO: 93324 - DNA, 20 bp, Artificial Sequence
  Description of Artificial Sequence: Synthetic oligonucleotide
  Target: SCN9A; (+) strand; PAM type: YTN; PAM sequence: CTC
ttactactaatataaatttt

SEQ ID NO: 93325 - DNA, 20 bp, Artificial Sequence
  Description of Artificial Sequence: Synthetic oligonucleotide
  Target: SCN9A; (+) strand; PAM type: YTN; PAM sequence: CTT
actactaatataaattttca

SEQ ID NO: 93326 - DNA, 20 bp, Artificial Sequence
  Description of Artificial Sequence: Synthetic oligonucleotide
  Target: SCN9A; (+) strand; PAM type: YTN; PAM sequence: TTA
ctactaatataaattttcaa

SEQ ID NO: 93327 - DNA, 20 bp, Artificial Sequence
  Description of Artificial Sequence: Synthetic oligonucleotide
  Target: SCN9A; (+) strand; PAM type: YTN; PAM sequence: CTA
ctaatataaattttcaatgt

SEQ ID NO: 93328 - DNA, 20 bp, Artificial Sequence
  Description of Artificial Sequence: Synthetic oligonucleotide
  Target: SCN9A; (+) strand; PAM type: YTN; PAM sequence: CTA
atataaattttcaatgtgtt

SEQ ID NO: 93329 - DNA, 20 bp, Artificial Sequence
  Description of Artificial Sequence: Synthetic oligonucleotide
  Target: SCN9A; (+) strand; PAM type: YTN; PAM sequence: TTT
tcaatgtgttttcagtcatt

SEQ ID NO: 93330 - DNA, 20 bp, Artificial Sequence
  Description of Artificial Sequence: Synthetic oligonucleotide
  Target: SCN9A; (+) strand; PAM type: YTN; PAM sequence: TTT
caatgtgttttcagtcattg

SEQ ID NO: 93331 - DNA, 20 bp, Artificial Sequence
  Description of Artificial Sequence: Synthetic oligonucleotide
  Target: SCN9A; (+) strand; PAM type: YTN; PAM sequence: TTC
aatgtgttttcagtcattgt

SEQ ID NO: 93332 - DNA, 20 bp, Artificial Sequence
  Description of Artificial Sequence: Synthetic oligonucleotide
  Target: SCN9A; (+) strand; PAM type: YTN; PAM sequence: TTT
tcagtcattgttttaatttc

SEQ ID NO: 93333 - DNA, 20 bp, Artificial Sequence
  Description of Artificial Sequence: Synthetic oligonucleotide
  Target: SCN9A; (+) strand; PAM type: YTN; PAM sequence: TTT
cagtcattgttttaatttct

SEQ ID NO: 93334 - DNA, 20 bp, Artificial Sequence
  Description of Artificial Sequence: Synthetic oligonucleotide
  Target: SCN9A; (+) strand; PAM type: YTN; PAM sequence: TTC
agtcattgttttaatttctt

SEQ ID NO: 93335 - DNA, 20 bp, Artificial Sequence
  Description of Artificial Sequence: Synthetic oligonucleotide
  Target: SCN9A; (+) strand; PAM type: YTN; PAM sequence: TTG
ttttaatttcttcatgaagc

SEQ ID NO: 93336 - DNA, 20 bp, Artificial Sequence
  Description of Artificial Sequence: Synthetic oligonucleotide
  Target: SCN9A; (+) strand; PAM type: YTN; PAM sequence: TTT
taatttcttcatgaagcttg

SEQ ID NO: 93337 - DNA, 20 bp, Artificial Sequence
  Description of Artificial Sequence: Synthetic oligonucleotide
  Target: SCN9A; (+) strand; PAM type: YTN; PAM sequence: TTT
aatttcttcatgaagcttgt

SEQ ID NO: 93338 - DNA, 20 bp, Artificial Sequence
  Description of Artificial Sequence: Synthetic oligonucleotide
  Target: SCN9A; (+) strand; PAM type: YTN; PAM sequence: TTA
atttcttcatgaagcttgtc

SEQ ID NO: 93339 - DNA, 20 bp, Artificial Sequence
  Description of Artificial Sequence: Synthetic oligonucleotide
  Target: SCN9A; (+) strand; PAM type: YTN; PAM sequence: TTT
cttcatgaagcttgtctcat

SEQ ID NO: 93340 - DNA, 20 bp, Artificial Sequence
  Description of Artificial Sequence: Synthetic oligonucleotide
  Target: SCN9A; (+) strand; PAM type: YTN; PAM sequence: TTC
ttcatgaagcttgtctcatt

SEQ ID NO: 93341 - DNA, 20 bp, Artificial Sequence
  Description of Artificial Sequence: Synthetic oligonucleotide
  Target: SCN9A; (+) strand; PAM type: YTN; PAM sequence: CTT
catgaagcttgtctcattct

SEQ ID NO: 93342 - DNA, 20 bp, Artificial Sequence
  Description of Artificial Sequence: Synthetic oligonucleotide
  Target: SCN9A; (+) strand; PAM type: YTN; PAM sequence: TTC
atgaagcttgtctcattcta

SEQ ID NO: 93343 - DNA, 20 bp, Artificial Sequence
  Description of Artificial Sequence: Synthetic oligonucleotide
  Target: SCN9A; (+) strand; PAM type: YTN; PAM sequence: CTT
gtctcattctatcattacaa

SEQ ID NO: 93344 - DNA, 20 bp, Artificial Sequence
  Description of Artificial Sequence: Synthetic oligonucleotide
  Target: SCN9A; (+) strand; PAM type: YTN; PAM sequence: TTG
tctcattctatcattacaac

SEQ ID NO: 93345 - DNA, 20 bp, Artificial Sequence
  Description of Artificial Sequence: Synthetic oligonucleotide
  Target: SCN9A; (+) strand; PAM type: YTN; PAM sequence: CTC
attctatcattacaaccaca

SEQ ID NO: 93346 - DNA, 20 bp, Artificial Sequence
  Description of Artificial Sequence: Synthetic oligonucleotide
  Target: SCN9A; (+) strand; PAM type: YTN; PAM sequence: TTC
tatcattacaaccacataat

SEQ ID NO: 93347 - DNA, 20 bp, Artificial Sequence
  Description of Artificial Sequence: Synthetic oligonucleotide
  Target: SCN9A; (+) strand; PAM type: YTN; PAM sequence: CTA
tcattacaaccacataatga

SEQ ID NO: 93348 - DNA, 20 bp, Artificial Sequence
  Description of Artificial Sequence: Synthetic oligonucleotide
  Target: SCN9A; (+) strand; PAM type: YTN; PAM sequence: TTA
caaccacataatgaagtagt

SEQ ID NO: 93349 - DNA, 20 bp, Artificial Sequence
  Description of Artificial Sequence: Synthetic oligonucleotide
  Target: SCN9A; (+) strand; PAM type: YTN; PAM sequence: CTC
ttctcctcattttatagata

SEQ ID NO: 93350 - DNA, 20 bp, Artificial Sequence
  Description of Artificial Sequence: Synthetic oligonucleotide
  Target: SCN9A; (+) strand; PAM type: YTN; PAM sequence: CTT
ctcctcattttatagataag

SEQ ID NO: 93351 - DNA, 20 bp, Artificial Sequence
  Description of Artificial Sequence: Synthetic oligonucleotide
  Target: SCN9A; (+) strand; PAM type: YTN; PAM sequence: TTC
tcctcattttatagataaga

SEQ ID NO: 93352 - DNA, 20 bp, Artificial Sequence
  Description of Artificial Sequence: Synthetic oligonucleotide
  Target: SCN9A; (+) strand; PAM type: YTN; PAM sequence: CTC
ctcattttatagataagaaa

SEQ ID NO: 93353 - DNA, 20 bp, Artificial Sequence
  Description of Artificial Sequence: Synthetic oligonucleotide
  Target: SCN9A; (+) strand; PAM type: YTN; PAM sequence: CTC
attttatagataagaaagtt

SEQ ID NO: 93354 - DNA, 20 bp, Artificial Sequence
  Description of Artificial Sequence: Synthetic oligonucleotide
  Target: SCN9A; (+) strand; PAM type: YTN; PAM sequence: TTT
tatagataagaaagttgagg

SEQ ID NO: 93355 - DNA, 20 bp, Artificial Sequence
  Description of Artificial Sequence: Synthetic oligonucleotide
  Target: SCN9A; (+) strand; PAM type: YTN; PAM sequence: TTT
atagataagaaagttgaggc

SEQ ID NO: 93356 - DNA, 20 bp, Artificial Sequence
  Description of Artificial Sequence: Synthetic oligonucleotide
  Target: SCN9A; (+) strand; PAM type: YTN; PAM sequence: TTA
tagataagaaagttgaggcc

SEQ ID NO: 93357 - DNA, 20 bp, Artificial Sequence
  Description of Artificial Sequence: Synthetic oligonucleotide
  Target: SCN9A; (+) strand; PAM type: YTN; PAM sequence: TTG
aggcccatataggttaaaga

SEQ ID NO: 93358 - DNA, 20 bp, Artificial Sequence
  Description of Artificial Sequence: Synthetic oligonucleotide
  Target: SCN9A; (+) strand; PAM type: YTN; PAM sequence: TTA
aagaatgtattcagcaaact

SEQ ID NO: 93359 - DNA, 20 bp, Artificial Sequence
  Description of Artificial Sequence: Synthetic oligonucleotide
  Target: SCN9A; (+) strand; PAM type: YTN; PAM sequence: TTC
agcaaactcatagggtcatg

SEQ ID NO: 93360 - DNA, 20 bp, Artificial Sequence
  Description of Artificial Sequence: Synthetic oligonucleotide
  Target: SCN9A; (+) strand; PAM type: YTN; PAM sequence: CTC
atagggtcatggcttaactg

SEQ ID NO: 93361 - DNA, 20 bp, Artificial Sequence
  Description of Artificial Sequence: Synthetic oligonucleotide
  Target: SCN9A; (+) strand; PAM type: YTN; PAM sequence: CTT
aactgggatacaaatatagt

SEQ ID NO: 93362 - DNA, 20 bp, Artificial Sequence
  Description of Artificial Sequence: Synthetic oligonucleotide
  Target: SCN9A; (+) strand; PAM type: YTN; PAM sequence: TTA
actgggatacaaatatagtt

SEQ ID NO: 93363 - DNA, 20 bp, Artificial Sequence
  Description of Artificial Sequence: Synthetic oligonucleotide
  Target: SCN9A; (+) strand; PAM type: YTN; PAM sequence: CTG
ggatacaaatatagttctag

SEQ ID NO: 93364 - DNA, 20 bp, Artificial Sequence
  Description of Artificial Sequence: Synthetic oligonucleotide
  Target: SCN9A; (+) strand; PAM type: YTN; PAM sequence: TTC
tagtcttagaacccatgctc

SEQ ID NO: 93365 - DNA, 20 bp, Artificial Sequence
  Description of Artificial Sequence: Synthetic oligonucleotide
  Target: SCN9A; (+) strand; PAM type: YTN; PAM sequence: CTA
gtcttagaacccatgctctt

SEQ ID NO: 93366 - DNA, 20 bp, Artificial Sequence
  Description of Artificial Sequence: Synthetic oligonucleotide
  Target: SCN9A; (+) strand; PAM type: YTN; PAM sequence: CTT
agaacccatgctcttagcca

SEQ ID NO: 93367 - DNA, 20 bp, Artificial Sequence
  Description of Artificial Sequence: Synthetic oligonucleotide
  Target: SCN9A; (+) strand; PAM type: YTN; PAM sequence: TTA
gaacccatgctcttagccat

SEQ ID NO: 93368 - DNA, 20 bp, Artificial Sequence
  Description of Artificial Sequence: Synthetic oligonucleotide
  Target: SCN9A; (+) strand; PAM type: YTN; PAM sequence: CTC
ttagccattatgtatgctat

SEQ ID NO: 93369 - DNA, 20 bp, Artificial Sequence
  Description of Artificial Sequence: Synthetic oligonucleotide
  Target: SCN9A; (+) strand; PAM type: YTN; PAM sequence: CTT
agccattatgtatgctatat

SEQ ID NO: 93370 - DNA, 20 bp, Artificial Sequence
  Description of Artificial Sequence: Synthetic oligonucleotide
  Target: SCN9A; (+) strand; PAM type: YTN; PAM sequence: TTA
gccattatgtatgctatatc

SEQ ID NO: 93371 - DNA, 20 bp, Artificial Sequence
  Description of Artificial Sequence: Synthetic oligonucleotide
  Target: SCN9A; (+) strand; PAM type: YTN; PAM sequence: TTA
tgtatgctatatcacctctt

SEQ ID NO: 93372 - DNA, 20 bp, Artificial Sequence
  Description of Artificial Sequence: Synthetic oligonucleotide
  Target: SCN9A; (+) strand; PAM type: YTN; PAM sequence: CTA
tatcacctcttaagagctgg

SEQ ID NO: 93373 - DNA, 20 bp, Artificial Sequence
  Description of Artificial Sequence: Synthetic oligonucleotide
  Target: SCN9A; (+) strand; PAM type: YTN; PAM sequence: CTC
ttaagagctggtacagcttt

SEQ ID NO: 93374 - DNA, 20 bp, Artificial Sequence
  Description of Artificial Sequence: Synthetic oligonucleotide
  Target: SCN9A; (+) strand; PAM type: YTN; PAM sequence: CTT
aagagctggtacagctttcc

SEQ ID NO: 93375 - DNA, 20 bp, Artificial Sequence
  Description of Artificial Sequence: Synthetic oligonucleotide
  Target: SCN9A; (+) strand; PAM type: YTN; PAM sequence: TTA
agagctggtacagctttccc

SEQ ID NO: 93376 - DNA, 20 bp, Artificial Sequence
  Description of Artificial Sequence: Synthetic oligonucleotide
  Target: SCN9A; (+) strand; PAM type: YTN; PAM sequence: CTG
gtacagctttcccatctgta

SEQ ID NO: 93377 - DNA, 20 bp, Artificial Sequence
  Description of Artificial Sequence: Synthetic oligonucleotide
  Target: SCN9A; (+) strand; PAM type: YTN; PAM sequence: CTT
tcccatctgtaaaatgagaa

SEQ ID NO: 93378 - DNA, 20 bp, Artificial Sequence
  Description of Artificial Sequence: Synthetic oligonucleotide
  Target: SCN9A; (+) strand; PAM type: YTN; PAM sequence: TTT
cccatctgtaaaatgagaaa

SEQ ID NO: 93379 - DNA, 20 bp, Artificial Sequence
  Description of Artificial Sequence: Synthetic oligonucleotide
  Target: SCN9A; (+) strand; PAM type: YTN; PAM sequence: TTC
ccatctgtaaaatgagaaaa

SEQ ID NO: 93380 - DNA, 20 bp, Artificial Sequence
  Description of Artificial Sequence: Synthetic oligonucleotide
  Target: SCN9A; (+) strand; PAM type: YTN; PAM sequence: CTG
taaaatgagaaaaagagtaa

SEQ ID NO: 93381 - DNA, 20 bp, Artificial Sequence
  Description of Artificial Sequence: Synthetic oligonucleotide
  Target: SCN9A; (+) strand; PAM type: YTN; PAM sequence: CTC
catgtggttgtaagggtaga

SEQ ID NO: 93382 - DNA, 20 bp, Artificial Sequence
  Description of Artificial Sequence: Synthetic oligonucleotide
  Target: SCN9A; (+) strand; PAM type: YTN; PAM sequence: TTG
taagggtagaatgagacaag

SEQ ID NO: 93383 - DNA, 20 bp, Artificial Sequence
  Description of Artificial Sequence: Synthetic oligonucleotide
  Target: SCN9A; (+) strand; PAM type: YTN; PAM sequence: CTA
cacaaagaaattagaacaat

SEQ ID NO: 93384 - DNA, 20 bp, Artificial Sequence
  Description of Artificial Sequence: Synthetic oligonucleotide
  Target: SCN9A; (+) strand; PAM type: YTN; PAM sequence: TTA
gaacaatgacaatacagaat

SEQ ID NO: 93385 - DNA, 20 bp, Artificial Sequence
  Description of Artificial Sequence: Synthetic oligonucleotide
  Target: SCN9A; (+) strand; PAM type: YTN; PAM sequence: TTT
atattagtagtaatagtagt

SEQ ID NO: 93386 - DNA, 20 bp, Artificial Sequence
  Description of Artificial Sequence: Synthetic oligonucleotide
  Target: SCN9A; (+) strand; PAM type: YTN; PAM sequence: TTA
tattagtagtaatagtagtt

SEQ ID NO: 93387 - DNA, 20 bp, Artificial Sequence
  Description of Artificial Sequence: Synthetic oligonucleotide
  Target: SCN9A; (+) strand; PAM type: YTN; PAM sequence: TTA
gtagtaatagtagttagtat

SEQ ID NO: 93388 - DNA, 20 bp, Artificial Sequence
  Description of Artificial Sequence: Synthetic oligonucleotide
  Target: SCN9A; (+) strand; PAM type: YTN; PAM sequence: TTA
gtatgacaaccaatttgcta

SEQ ID NO: 93389 - DNA, 20 bp, Artificial Sequence
  Description of Artificial Sequence: Synthetic oligonucleotide
  Target: SCN9A; (+) strand; PAM type: YTN; PAM sequence: TTT
gctactaaaaatgtaagaat

SEQ ID NO: 93390 - DNA, 20 bp, Artificial Sequence
  Description of Artificial Sequence: Synthetic oligonucleotide
  Target: SCN9A; (+) strand; PAM type: YTN; PAM sequence: TTG
ctactaaaaatgtaagaatc

SEQ ID NO: 93391 - DNA, 20 bp, Artificial Sequence
  Description of Artificial Sequence: Synthetic oligonucleotide
  Target: SCN9A; (+) strand; PAM type: YTN; PAM sequence: CTA
ctaaaaatgtaagaatccag

SEQ ID NO: 93392 - DNA, 20 bp, Artificial Sequence
  Description of Artificial Sequence: Synthetic oligonucleotide
  Target: SCN9A; (+) strand; PAM type: YTN; PAM sequence: CTA
aaaatgtaagaatccaggct

SEQ ID NO: 93393 - DNA, 20 bp, Artificial Sequence
  Description of Artificial Sequence: Synthetic oligonucleotide
  Target: SCN9A; (+) strand; PAM type: YTN; PAM sequence: CTA
cttctgtgtcatacaggaac

SEQ ID NO: 93394 - DNA, 20 bp, Artificial Sequence
  Description of Artificial Sequence: Synthetic oligonucleotide
  Target: SCN9A; (+) strand; PAM type: YTN; PAM sequence: CTT
ctgtgtcatacaggaacaat

SEQ ID NO: 93395 - DNA, 20 bp, Artificial Sequence
  Description of Artificial Sequence: Synthetic oligonucleotide
  Target: SCN9A; (+) strand; PAM type: YTN; PAM sequence: TTC
tgtgtcatacaggaacaatg

SEQ ID NO: 93396 - DNA, 20 bp, Artificial Sequence
  Description of Artificial Sequence: Synthetic oligonucleotide
  Target: SCN9A; (+) strand; PAM type: YTN; PAM sequence: CTG
tgtcatacaggaacaatgca

SEQ ID NO: 93397 - DNA, 20 bp, Artificial Sequence
  Description of Artificial Sequence: Synthetic oligonucleotide
  Target: SCN9A; (+) strand; PAM type: YTN; PAM sequence: CTC
catgaaccaaagctcttagc

SEQ ID NO: 93398 - DNA, 20 bp, Artificial Sequence
  Description of Artificial Sequence: Synthetic oligonucleotide
  Target: SCN9A; (+) strand; PAM type: YTN; PAM sequence: CTC
ttagccattatgtatgctac

SEQ ID NO: 93399 - DNA, 20 bp, Artificial Sequence
  Description of Artificial Sequence: Synthetic oligonucleotide
  Target: SCN9A; (+) strand; PAM type: YTN; PAM sequence: CTT
agccattatgtatgctacac

SEQ ID NO: 93400 - DNA, 20 bp, Artificial Sequence
  Description of Artificial Sequence: Synthetic oligonucleotide
  Target: SCN9A; (+) strand; PAM type: YTN; PAM sequence: TTA
gccattatgtatgctacacc

SEQ ID NO: 93401 - DNA, 20 bp, Artificial Sequence
  Description of Artificial Sequence: Synthetic oligonucleotide
  Target: SCN9A; (+) strand; PAM type: YTN; PAM sequence: TTA
tgtatgctacaccacctctt

SEQ ID NO: 93402 - DNA, 20 bp, Artificial Sequence
  Description of Artificial Sequence: Synthetic oligonucleotide
  Target: SCN9A; (+) strand; PAM type: YTN; PAM sequence: CTA
caccacctcttaatgctatt

SEQ ID NO: 93403 - DNA, 20 bp, Artificial Sequence
  Description of Artificial Sequence: Synthetic oligonucleotide
  Target: SCN9A; (+) strand; PAM type: YTN; PAM sequence: CTC
ttaatgctattacacaaaaa

SEQ ID NO: 93404 - DNA, 20 bp, Artificial Sequence
  Description of Artificial Sequence: Synthetic oligonucleotide
  Target: SCN9A; (+) strand; PAM type: YTN; PAM sequence: CTT
aatgctattacacaaaaatg

SEQ ID NO: 93405 - DNA, 20 bp, Artificial Sequence
  Description of Artificial Sequence: Synthetic oligonucleotide
  Target: SCN9A; (+) strand; PAM type: YTN; PAM sequence: TTA
atgctattacacaaaaatgt

SEQ ID NO: 93406 - DNA, 20 bp, Artificial Sequence
  Description of Artificial Sequence: Synthetic oligonucleotide
  Target: SCN9A; (+) strand; PAM type: YTN; PAM sequence: CTA
ttacacaaaaatgtagacat

SEQ ID NO: 93407 - DNA, 20 bp, Artificial Sequence
  Description of Artificial Sequence: Synthetic oligonucleotide
  Target: SCN9A; (+) strand; PAM type: YTN; PAM sequence: TTA
cacaaaaatgtagacatcgc

SEQ ID NO: 93408 - DNA, 20 bp, Artificial Sequence
  Description of Artificial Sequence: Synthetic oligonucleotide
  Target: SCN9A; (+) strand; PAM type: YTN; PAM sequence: CTG
tgtggctagatgtttgcata

SEQ ID NO: 93409 - DNA, 20 bp, Artificial Sequence
  Description of Artificial Sequence: Synthetic oligonucleotide
  Target: SCN9A; (+) strand; PAM type: YTN; PAM sequence: CTA
gatgtttgcatatttttgct

SEQ ID NO: 93410 - DNA, 20 bp, Artificial Sequence
  Description of Artificial Sequence: Synthetic oligonucleotide
  Target: SCN9A; (+) strand; PAM type: YTN; PAM sequence: TTT
gcatatttttgcttcctgtc

SEQ ID NO: 93411 - DNA, 20 bp, Artificial Sequence
  Description of Artificial Sequence: Synthetic oligonucleotide
  Target: SCN9A; (+) strand; PAM type: YTN; PAM sequence: TTG
catatttttgcttcctgtct

SEQ ID NO: 93412 - DNA, 20 bp, Artificial Sequence
  Description of Artificial Sequence: Synthetic oligonucleotide
  Target: SCN9A; (+) strand; PAM type: YTN; PAM sequence: TTT
ttgcttcctgtctcaatttt

SEQ ID NO: 93413 - DNA, 20 bp, Artificial Sequence
  Description of Artificial Sequence: Synthetic oligonucleotide
  Target: SCN9A; (+) strand; PAM type: YTN; PAM sequence: TTT
tgcttcctgtctcaattttc

SEQ ID NO: 93414 - DNA, 20 bp, Artificial Sequence
  Description of Artificial Sequence: Synthetic oligonucleotide
  Target: SCN9A; (+) strand; PAM type: YTN; PAM sequence: TTT
gcttcctgtctcaattttct

SEQ ID NO: 93415 - DNA, 20 bp, Artificial Sequence
  Description of Artificial Sequence: Synthetic oligonucleotide
  Target: SCN9A; (+) strand; PAM type: YTN; PAM sequence: TTG
cttcctgtctcaattttctc

SEQ ID NO: 93416 - DNA, 20 bp, Artificial Sequence
  Description of Artificial Sequence: Synthetic oligonucleotide
  Target: SCN9A; (+) strand; PAM type: YTN; PAM sequence: CTT
cctgtctcaattttctccct

SEQ ID NO: 93417 - DNA, 20 bp, Artificial Sequence
  Description of Artificial Sequence: Synthetic oligonucleotide
  Target: SCN9A; (+) strand; PAM type: YTN; PAM sequence: TTC
ctgtctcaattttctccctt

SEQ ID NO: 93418 - DNA, 20 bp, Artificial Sequence
  Description of Artificial Sequence: Synthetic oligonucleotide
  Target: SCN9A; (+) strand; PAM type: YTN; PAM sequence: CTG
tctcaattttctccctttgc

SEQ ID NO: 93419 - DNA, 20 bp, Artificial Sequence
  Description of Artificial Sequence: Synthetic oligonucleotide
  Target: SCN9A; (+) strand; PAM type: YTN; PAM sequence: CTC
aattttctccctttgcacaa

SEQ ID NO: 93420 - DNA, 20 bp, Artificial Sequence
  Description of Artificial Sequence: Synthetic oligonucleotide
  Target: SCN9A; (+) strand; PAM type: YTN; PAM sequence: TTT
tctccctttgcacaaacctt

SEQ ID NO: 93421 - DNA, 20 bp, Artificial Sequence
  Description of Artificial Sequence: Synthetic oligonucleotide
  Target: SCN9A; (+) strand; PAM type: YTN; PAM sequence: TTT
ctccctttgcacaaaccttg

SEQ ID NO: 93422 - DNA, 20 bp, Artificial Sequence
  Description of Artificial Sequence: Synthetic oligonucleotide
  Target: SCN9A; (+) strand; PAM type: YTN; PAM sequence: TTC
tccctttgcacaaaccttga

SEQ ID NO: 93423 - DNA, 20 bp, Artificial Sequence
  Description of Artificial Sequence: Synthetic oligonucleotide
  Target: SCN9A; (+) strand; PAM type: YTN; PAM sequence: CTC
cctttgcacaaaccttgatg

SEQ ID NO: 93424 - DNA, 20 bp, Artificial Sequence
  Description of Artificial Sequence: Synthetic oligonucleotide
  Target: SCN9A; (+) strand; PAM type: YTN; PAM sequence: CTT
tgcacaaaccttgatgtgga

SEQ ID NO: 93425 - DNA, 20 bp, Artificial Sequence
  Description of Artificial Sequence: Synthetic oligonucleotide
  Target: SCN9A; (+) strand; PAM type: YTN; PAM sequence: TTT
gcacaaaccttgatgtggat

SEQ ID NO: 93426 - DNA, 20 bp, Artificial Sequence
  Description of Artificial Sequence: Synthetic oligonucleotide
  Target: SCN9A; (+) strand; PAM type: YTN; PAM sequence: TTG
cacaaaccttgatgtggatt

SEQ ID NO: 93427 - DNA, 20 bp, Artificial Sequence
  Description of Artificial Sequence: Synthetic oligonucleotide
  Target: SCN9A; (+) strand; PAM type: YTN; PAM sequence: CTT
gatgtggatttcaagaaatt

SEQ ID NO: 93428 - DNA, 20 bp, Artificial Sequence
  Description of Artificial Sequence: Synthetic oligonucleotide
  Target: SCN9A; (+) strand; PAM type: YTN; PAM sequence: TTG
atgtggatttcaagaaatta

SEQ ID NO: 93429 - DNA, 20 bp, Artificial Sequence
  Description of Artificial Sequence: Synthetic oligonucleotide
  Target: SCN9A; (+) strand; PAM type: YTN; PAM sequence: TTT
caagaaattactttggaact

SEQ ID NO: 93430 - DNA, 20 bp, Artificial Sequence
  Description of Artificial Sequence: Synthetic oligonucleotide
  Target: SCN9A; (+) strand; PAM type: YTN; PAM sequence: TTC
aagaaattactttggaactc

SEQ ID NO: 93431 - DNA, 20 bp, Artificial Sequence
  Description of Artificial Sequence: Synthetic oligonucleotide
  Target: SCN9A; (+) strand; PAM type: YTN; PAM sequence: TTA
ctttggaactctagattctt

SEQ ID NO: 93432 - DNA, 20 bp, Artificial Sequence
  Description of Artificial Sequence: Synthetic oligonucleotide
  Target: SCN9A; (+) strand; PAM type: YTN; PAM sequence: CTT
tggaactctagattctttgt

SEQ ID NO: 93433 - DNA, 20 bp, Artificial Sequence
  Description of Artificial Sequence: Synthetic oligonucleotide
  Target: SCN9A; (+) strand; PAM type: YTN; PAM sequence: TTT
ggaactctagattctttgtc

SEQ ID NO: 93434 - DNA, 20 bp, Artificial Sequence
  Description of Artificial Sequence: Synthetic oligonucleotide
  Target: SCN9A; (+) strand; PAM type: YTN; PAM sequence: TTG
gaactctagattctttgtcc

SEQ ID NO: 93435 - DNA, 20 bp, Artificial Sequence
  Description of Artificial Sequence: Synthetic oligonucleotide
  Target: SCN9A; (+) strand; PAM type: YTN; PAM sequence: CTC
tagattctttgtccttgtct

SEQ ID NO: 93436 - DNA, 20 bp, Artificial Sequence
  Description of Artificial Sequence: Synthetic oligonucleotide
  Target: SCN9A; (+) strand; PAM type: YTN; PAM sequence: CTA
gattctttgtccttgtcttt

SEQ ID NO: 93437 - DNA, 20 bp, Artificial Sequence
  Description of Artificial Sequence: Synthetic oligonucleotide
  Target: SCN9A; (+) strand; PAM type: YTN; PAM sequence: TTC
tttgtccttgtctttgtttc

SEQ ID NO: 93438 - DNA, 20 bp, Artificial Sequence
  Description of Artificial Sequence: Synthetic oligonucleotide
  Target: SCN9A; (+) strand; PAM type: YTN; PAM sequence: CTT
tgtccttgtctttgtttccc

SEQ ID NO: 93439 - DNA, 20 bp, Artificial Sequence
  Description of Artificial Sequence: Synthetic oligonucleotide
  Target: SCN9A; (+) strand; PAM type: YTN; PAM sequence: TTT
gtccttgtctttgtttcccg

SEQ ID NO: 93440 - DNA, 20 bp, Artificial Sequence
  Description of Artificial Sequence: Synthetic oligonucleotide
  Target: SCN9A; (+) strand; PAM type: YTN; PAM sequence: TTG
tccttgtctttgtttcccgg

SEQ ID NO: 93441 - DNA, 20 bp, Artificial Sequence
  Description of Artificial Sequence: Synthetic oligonucleotide
  Target: SCN9A; (+) strand; PAM type: YTN; PAM sequence: CTT
gtctttgtttcccgggaaca

SEQ ID NO: 93442 - DNA, 20 bp, Artificial Sequence
  Description of Artificial Sequence: Synthetic oligonucleotide
  Target: SCN9A; (+) strand; PAM type: YTN; PAM sequence: TTG
tctttgtttcccgggaacac

SEQ ID NO: 93443 - DNA, 20 bp, Artificial Sequence
  Description of Artificial Sequence: Synthetic oligonucleotide
  Target: SCN9A; (+) strand; PAM type: YTN; PAM sequence: CTT
tgtttcccgggaacacttct

SEQ ID NO: 93444 - DNA, 20 bp, Artificial Sequence
  Description of Artificial Sequence: Synthetic oligonucleotide
  Target: SCN9A; (+) strand; PAM type: YTN; PAM sequence: TTT
gtttcccgggaacacttctt

SEQ ID NO: 93445 - DNA, 20 bp, Artificial Sequence
  Description of Artificial Sequence: Synthetic oligonucleotide
  Target: SCN9A; (+) strand; PAM type: YTN; PAM sequence: TTG
tttcccgggaacacttctta

SEQ ID NO: 93446 - DNA, 20 bp, Artificial Sequence
  Description of Artificial Sequence: Synthetic oligonucleotide
  Target: SCN9A; (+) strand; PAM type: YTN; PAM sequence: TTT
cccgggaacacttcttatgg

SEQ ID NO: 93447 - DNA, 20 bp, Artificial Sequence
  Description of Artificial Sequence: Synthetic oligonucleotide
  Target: SCN9A; (+) strand; PAM type: YTN; PAM sequence: TTC
ccgggaacacttcttatgga

SEQ ID NO: 93448 - DNA, 20 bp, Artificial Sequence
  Description of Artificial Sequence: Synthetic oligonucleotide
  Target: SCN9A; (+) strand; PAM type: YTN; PAM sequence: CTT
cttatggaggacatttgaag

SEQ ID NO: 93449 - DNA, 20 bp, Artificial Sequence
  Description of Artificial Sequence: Synthetic oligonucleotide
  Target: SCN9A; (+) strand; PAM type: YTN; PAM sequence: TTC
ttatggaggacatttgaagc

SEQ ID NO: 93450 - DNA, 20 bp, Artificial Sequence
  Description of Artificial Sequence: Synthetic oligonucleotide
  Target: SCN9A; (+) strand; PAM type: YTN; PAM sequence: CTT
atggaggacatttgaagctg

SEQ ID NO: 93451 - DNA, 20 bp, Artificial Sequence
  Description of Artificial Sequence: Synthetic oligonucleotide
  Target: SCN9A; (+) strand; PAM type: YTN; PAM sequence: TTA
tggaggacatttgaagctgt

SEQ ID NO: 93452 - DNA, 20 bp, Artificial Sequence
  Description of Artificial Sequence: Synthetic oligonucleotide
  Target: SCN9A; (+) strand; PAM type: YTN; PAM sequence: TTT
gaagctgtcctttcaatgaa

SEQ ID NO: 93453 - DNA, 20 bp, Artificial Sequence
  Description of Artificial Sequence: Synthetic oligonucleotide
  Target: SCN9A; (+) strand; PAM type: YTN; PAM sequence: TTG
aagctgtcctttcaatgaaa

SEQ ID NO: 93454 - DNA, 20 bp, Artificial Sequence
  Description of Artificial Sequence: Synthetic oligonucleotide
  Target: SCN9A; (+) strand; PAM type: YTN; PAM sequence: CTG
tcctttcaatgaaaaggaaa

SEQ ID NO: 93455 - DNA, 20 bp, Artificial Sequence
  Description of Artificial Sequence: Synthetic oligonucleotide
  Target: SCN9A; (+) strand; PAM type: YTN; PAM sequence: CTT
tcaatgaaaaggaaaaagct

SEQ ID NO: 93456 - DNA, 20 bp, Artificial Sequence
  Description of Artificial Sequence: Synthetic oligonucleotide
  Target: SCN9A; (+) strand; PAM type: YTN; PAM sequence: TTT
caatgaaaaggaaaaagcta

SEQ ID NO: 93457 - DNA, 20 bp, Artificial Sequence
  Description of Artificial Sequence: Synthetic oligonucleotide
  Target: SCN9A; (+) strand; PAM type: YTN; PAM sequence: TTC
aatgaaaaggaaaaagctat

SEQ ID NO: 93458 - DNA, 20 bp, Artificial Sequence
  Description of Artificial Sequence: Synthetic oligonucleotide
  Target: SCN9A; (+) strand; PAM type: YTN; PAM sequence: CTA
tcagttgttgcaacttattt

SEQ ID NO: 93459 - DNA, 20 bp, Artificial Sequence
  Description of Artificial Sequence: Synthetic oligonucleotide
  Target: SCN9A; (+) strand; PAM type: YTN; PAM sequence: TTG
ttgcaacttatttagatatc

SEQ ID NO: 93460 - DNA, 20 bp, Artificial Sequence
  Description of Artificial Sequence: Synthetic oligonucleotide
  Target: SCN9A; (+) strand; PAM type: YTN; PAM sequence: TTG
caacttatttagatatccac

SEQ ID NO: 93461 - DNA, 20 bp, Artificial Sequence
  Description of Artificial Sequence: Synthetic oligonucleotide
  Target: SCN9A; (+) strand; PAM type: YTN; PAM sequence: CTT
atttagatatccactgactt

SEQ ID NO: 93462 - DNA, 20 bp, Artificial Sequence
  Description of Artificial Sequence: Synthetic oligonucleotide
  Target: SCN9A; (+) strand; PAM type: YTN; PAM sequence: TTA
tttagatatccactgacttt

SEQ ID NO: 93463 - DNA, 20 bp, Artificial Sequence
  Description of Artificial Sequence: Synthetic oligonucleotide
  Target: SCN9A; (+) strand; PAM type: YTN; PAM sequence: TTT
agatatccactgactttacc

SEQ ID NO: 93464 - DNA, 20 bp, Artificial Sequence
  Description of Artificial Sequence: Synthetic oligonucleotide
  Target: SCN9A; (+) strand; PAM type: YTN; PAM sequence: TTA
gatatccactgactttaccc

SEQ ID NO: 93465 - DNA, 20 bp, Artificial Sequence
  Description of Artificial Sequence: Synthetic oligonucleotide
  Target: SCN9A; (+) strand; PAM type: YTN; PAM sequence: CTG
actttacccacctatggtta

SEQ ID NO: 93466 - DNA, 20 bp, Artificial Sequence
  Description of Artificial Sequence: Synthetic oligonucleotide
  Target: SCN9A; (+) strand; PAM type: YTN; PAM sequence: CTT
tacccacctatggttattct

SEQ ID NO: 93467 - DNA, 20 bp, Artificial Sequence
  Description of Artificial Sequence: Synthetic oligonucleotide
  Target: SCN9A; (+) strand; PAM type: YTN; PAM sequence: TTT
acccacctatggttattcta

SEQ ID NO: 93468 - DNA, 20 bp, Artificial Sequence
  Description of Artificial Sequence: Synthetic oligonucleotide
  Target: SCN9A; (+) strand; PAM type: YTN; PAM sequence: TTA
cccacctatggttattctaa

SEQ ID NO: 93469 - DNA, 20 bp, Artificial Sequence
  Description of Artificial Sequence: Synthetic oligonucleotide
  Target: SCN9A; (+) strand; PAM type: YTN; PAM sequence: CTA
tggttattctaactgaaaca

SEQ ID NO: 93470 - DNA, 20 bp, Artificial Sequence
  Description of Artificial Sequence: Synthetic oligonucleotide
  Target: SCN9A; (+) strand; PAM type: YTN; PAM sequence: TTA
ttctaactgaaacagaaaat

SEQ ID NO: 93471 - DNA, 20 bp, Artificial Sequence
  Description of Artificial Sequence: Synthetic oligonucleotide
  Target: SCN9A; (+) strand; PAM type: YTN; PAM sequence: TTC
taactgaaacagaaaatacg

SEQ ID NO: 93472 - DNA, 20 bp, Artificial Sequence
  Description of Artificial Sequence: Synthetic oligonucleotide
  Target: SCN9A; (+) strand; PAM type: YTN; PAM sequence: CTA
actgaaacagaaaatacgtg

SEQ ID NO: 93473 - DNA, 20 bp, Artificial Sequence
  Description of Artificial Sequence: Synthetic oligonucleotide
  Target: SCN9A; (+) strand; PAM type: YTN; PAM sequence: CTG
aaacagaaaatacgtgtaaa

SEQ ID NO: 93474 - DNA, 20 bp, Artificial Sequence
  Description of Artificial Sequence: Synthetic oligonucleotide
  Target: SCN9A; (+) strand; PAM type: YTN; PAM sequence: TTT
tattttgtataacttttatt

SEQ ID NO: 93475 - DNA, 20 bp, Artificial Sequence
  Description of Artificial Sequence: Synthetic oligonucleotide
  Target: SCN9A; (+) strand; PAM type: YTN; PAM sequence: TTT
attttgtataacttttattc

SEQ ID NO: 93476 - DNA, 20 bp, Artificial Sequence
  Description of Artificial Sequence: Synthetic oligonucleotide
  Target: SCN9A; (+) strand; PAM type: YTN; PAM sequence: TTA
ttttgtataacttttattct

SEQ ID NO: 93477 - DNA, 20 bp, Artificial Sequence
  Description of Artificial Sequence: Synthetic oligonucleotide
  Target: SCN9A; (+) strand; PAM type: YTN; PAM sequence: TTT
tgtataacttttattcttag

SEQ ID NO: 93478 - DNA, 20 bp, Artificial Sequence
  Description of Artificial Sequence: Synthetic oligonucleotide
  Target: SCN9A; (+) strand; PAM type: YTN; PAM sequence: TTT
gtataacttttattcttaga

SEQ ID NO: 93479 - DNA, 20 bp, Artificial Sequence
  Description of Artificial Sequence: Synthetic oligonucleotide
  Target: SCN9A; (+) strand; PAM type: YTN; PAM sequence: TTG
tataacttttattcttagat

SEQ ID NO: 93480 - DNA, 20 bp, Artificial Sequence
  Description of Artificial Sequence: Synthetic oligonucleotide
  Target: SCN9A; (+) strand; PAM type: YTN; PAM sequence: CTT
ttattcttagattatattac

SEQ ID NO: 93481 - DNA, 20 bp, Artificial Sequence
  Description of Artificial Sequence: Synthetic oligonucleotide
  Target: SCN9A; (+) strand; PAM type: YTN; PAM sequence: TTT
tattcttagattatattaca

SEQ ID NO: 93482 - DNA, 20 bp, Artificial Sequence
  Description of Artificial Sequence: Synthetic oligonucleotide
  Target: SCN9A; (+) strand; PAM type: YTN; PAM sequence: TTT
attcttagattatattacaa

SEQ ID NO: 93483 - DNA, 20 bp, Artificial Sequence
  Description of Artificial Sequence: Synthetic oligonucleotide
  Target: SCN9A; (+) strand; PAM type: YTN; PAM sequence: TTA
ttcttagattatattacaat

SEQ ID NO: 93484 - DNA, 20 bp, Artificial Sequence
  Description of Artificial Sequence: Synthetic oligonucleotide
  Target: SCN9A; (+) strand; PAM type: YTN; PAM sequence: TTC
ttagattatattacaatgtg

SEQ ID NO: 93485 - DNA, 20 bp, Artificial Sequence
  Description of Artificial Sequence: Synthetic oligonucleotide
  Target: SCN9A; (+) strand; PAM type: YTN; PAM sequence: CTT
agattatattacaatgtgtc

SEQ ID NO: 93486 - DNA, 20 bp, Artificial Sequence
  Description of Artificial Sequence: Synthetic oligonucleotide
  Target: SCN9A; (+) strand; PAM type: YTN; PAM sequence: TTA
gattatattacaatgtgtca

SEQ ID NO: 93487 - DNA, 20 bp, Artificial Sequence
  Description of Artificial Sequence: Synthetic oligonucleotide
  Target: SCN9A; (+) strand; PAM type: YTN; PAM sequence: TTA
tattacaatgtgtcagtctc

SEQ ID NO: 93488 - DNA, 20 bp, Artificial Sequence
  Description of Artificial Sequence: Synthetic oligonucleotide
  Target: SCN9A; (+) strand; PAM type: YTN; PAM sequence: TTA
caatgtgtcagtctcaagta

SEQ ID NO: 93489 - DNA, 20 bp, Artificial Sequence
  Description of Artificial Sequence: Synthetic oligonucleotide
  Target: SCN9A; (+) strand; PAM type: YTN; PAM sequence: CTC
aagtataactacaatataac

SEQ ID NO: 93490 - DNA, 20 bp, Artificial Sequence
  Description of Artificial Sequence: Synthetic oligonucleotide
  Target: SCN9A; (+) strand; PAM type: YTN; PAM sequence: CTA
caatataactacaatataat

SEQ ID NO: 93491 - DNA, 20 bp, Artificial Sequence
  Description of Artificial Sequence: Synthetic oligonucleotide
  Target: SCN9A; (+) strand; PAM type: YTN; PAM sequence: CTA
caatataatttatggcaaac

SEQ ID NO: 93492 - DNA, 20 bp, Artificial Sequence
  Description of Artificial Sequence: Synthetic oligonucleotide
  Target: SCN9A; (+) strand; PAM type: YTN; PAM sequence: TTT
atggcaaactcaaacatttt

SEQ ID NO: 93493 - DNA, 20 bp, Artificial Sequence
  Description of Artificial Sequence: Synthetic oligonucleotide
  Target: SCN9A; (+) strand; PAM type: YTN; PAM sequence: TTA
tggcaaactcaaacattttg

SEQ ID NO: 93494 - DNA, 20 bp, Artificial Sequence
  Description of Artificial Sequence: Synthetic oligonucleotide
  Target: SCN9A; (+) strand; PAM type: YTN; PAM sequence: CTC
aaacattttgagcattcata

SEQ ID NO: 93495 - DNA, 20 bp, Artificial Sequence
  Description of Artificial Sequence: Synthetic oligonucleotide
  Target: SCN9A; (+) strand; PAM type: YTN; PAM sequence: TTT
tgagcattcatagatctatg

SEQ ID NO: 93496 - DNA, 20 bp, Artificial Sequence
  Description of Artificial Sequence: Synthetic oligonucleotide
  Target: SCN9A; (+) strand; PAM type: YTN; PAM sequence: TTT
gagcattcatagatctatga

SEQ ID NO: 93497 - DNA, 20 bp, Artificial Sequence
  Description of Artificial Sequence: Synthetic oligonucleotide
  Target: SCN9A; (+) strand; PAM type: YTN; PAM sequence: TTG
agcattcatagatctatgaa

SEQ ID NO: 93498 - DNA, 20 bp, Artificial Sequence
  Description of Artificial Sequence: Synthetic oligonucleotide
  Target: SCN9A; (+) strand; PAM type: YTN; PAM sequence: TTC
atagatctatgaaatttgta

SEQ ID NO: 93499 - DNA, 20 bp, Artificial Sequence
  Description of Artificial Sequence: Synthetic oligonucleotide
  Target: SCN9A; (+) strand; PAM type: YTN; PAM sequence: CTA
tgaaatttgtaaagaatcct

SEQ ID NO: 93500 - DNA, 20 bp, Artificial Sequence
  Description of Artificial Sequence: Synthetic oligonucleotide
  Target: SCN9A; (+) strand; PAM type: YTN; PAM sequence: TTT
gtaaagaatcctatgtaaac

SEQ ID NO: 93501 - DNA, 20 bp, Artificial Sequence
  Description of Artificial Sequence: Synthetic oligonucleotide
  Target: SCN9A; (+) strand; PAM type: YTN; PAM sequence: TTG
taaagaatcctatgtaaaca

SEQ ID NO: 93502 - DNA, 20 bp, Artificial Sequence
  Description of Artificial Sequence: Synthetic oligonucleotide
  Target: SCN9A; (+) strand; PAM type: YTN; PAM sequence: CTA
tgtaaacagctttatgatat

SEQ ID NO: 93503 - DNA, 20 bp, Artificial Sequence
  Description of Artificial Sequence: Synthetic oligonucleotide
  Target: SCN9A; (+) strand; PAM type: YTN; PAM sequence: CTT
tatgatattcatggctattt

SEQ ID NO: 93504 - DNA, 20 bp, Artificial Sequence
  Description of Artificial Sequence: Synthetic oligonucleotide
  Target: SCN9A; (+) strand; PAM type: YTN; PAM sequence: TTT
atgatattcatggctattta

SEQ ID NO: 93505 - DNA, 20 bp, Artificial Sequence
  Description of Artificial Sequence: Synthetic oligonucleotide
  Target: SCN9A; (+) strand; PAM type: YTN; PAM sequence: TTA
tgatattcatggctatttat

SEQ ID NO: 93506 - DNA, 20 bp, Artificial Sequence
  Description of Artificial Sequence: Synthetic oligonucleotide
  Target: SCN9A; (+) strand; PAM type: YTN; PAM sequence: TTC
atggctatttatttattttc

SEQ ID NO: 93507 - DNA, 20 bp, Artificial Sequence
  Description of Artificial Sequence: Synthetic oligonucleotide
  Target: SCN9A; (+) strand; PAM type: YTN; PAM sequence: CTA
tttatttattttcatgaagc

SEQ ID NO: 93508 - DNA, 20 bp, Artificial Sequence
  Description of Artificial Sequence: Synthetic oligonucleotide
  Target: SCN9A; (+) strand; PAM type: YTN; PAM sequence: TTT
atttattttcatgaagcaat

SEQ ID NO: 93509 - DNA, 20 bp, Artificial Sequence
  Description of Artificial Sequence: Synthetic oligonucleotide
  Target: SCN9A; (+) strand; PAM type: YTN; PAM sequence: TTA
tttattttcatgaagcaatt

SEQ ID NO: 93510 - DNA, 20 bp, Artificial Sequence
  Description of Artificial Sequence: Synthetic oligonucleotide
  Target: SCN9A; (+) strand; PAM type: YTN; PAM sequence: TTT
attttcatgaagcaattctt

SEQ ID NO: 93511 - DNA, 20 bp, Artificial Sequence
  Description of Artificial Sequence: Synthetic oligonucleotide
  Target: SCN9A; (+) strand; PAM type: YTN; PAM sequence: TTA
ttttcatgaagcaattcttg

SEQ ID NO: 93512 - DNA, 20 bp, Artificial Sequence
  Description of Artificial Sequence: Synthetic oligonucleotide
  Target: SCN9A; (+) strand; PAM type: YTN; PAM sequence: TTT
tcatgaagcaattcttgatt

SEQ ID NO: 93513 - DNA, 20 bp, Artificial Sequence
  Description of Artificial Sequence: Synthetic oligonucleotide
  Target: SCN9A; (+) strand; PAM type: YTN; PAM sequence: TTT
catgaagcaattcttgattg

SEQ ID NO: 93514 - DNA, 20 bp, Artificial Sequence
  Description of Artificial Sequence: Synthetic oligonucleotide
  Target: SCN9A; (+) strand; PAM type: YTN; PAM sequence: TTC
atgaagcaattcttgattgt

SEQ ID NO: 93515 - DNA, 20 bp, Artificial Sequence
  Description of Artificial Sequence: Synthetic oligonucleotide
  Target: SCN9A; (+) strand; PAM type: YTN; PAM sequence: TTC
ttgattgttttcctcaagaa

SEQ ID NO: 93516 - DNA, 20 bp, Artificial Sequence
  Description of Artificial Sequence: Synthetic oligonucleotide
  Target: SCN9A; (+) strand; PAM type: YTN; PAM sequence: CTT
gattgttttcctcaagaaga

SEQ ID NO: 93517 - DNA, 20 bp, Artificial Sequence
  Description of Artificial Sequence: Synthetic oligonucleotide
  Target: SCN9A; (+) strand; PAM type: YTN; PAM sequence: TTG
attgttttcctcaagaagat

SEQ ID NO: 93518 - DNA, 20 bp, Artificial Sequence
  Description of Artificial Sequence: Synthetic oligonucleotide
  Target: SCN9A; (+) strand; PAM type: YTN; PAM sequence: TTG
ttttcctcaagaagataata

SEQ ID NO: 93519 - DNA, 20 bp, Artificial Sequence
  Description of Artificial Sequence: Synthetic oligonucleotide
  Target: SCN9A; (+) strand; PAM type: YTN; PAM sequence: TTT
tcctcaagaagataataaca

SEQ ID NO: 93520 - DNA, 20 bp, Artificial Sequence
  Description of Artificial Sequence: Synthetic oligonucleotide
  Target: SCN9A; (+) strand; PAM type: YTN; PAM sequence: TTT
cctcaagaagataataacat

SEQ ID NO: 93521 - DNA, 20 bp, Artificial Sequence
  Description of Artificial Sequence: Synthetic oligonucleotide
  Target: SCN9A; (+) strand; PAM type: YTN; PAM sequence: TTC
ctcaagaagataataacata

SEQ ID NO: 93522 - DNA, 20 bp, Artificial Sequence
  Description of Artificial Sequence: Synthetic oligonucleotide
  Target: SCN9A; (+) strand; PAM type: YTN; PAM sequence: CTC
aagaagataataacataata

SEQ ID NO: 93523 - DNA, 20 bp, Artificial Sequence
  Description of Artificial Sequence: Synthetic oligonucleotide
  Target: SCN9A; (+) strand; PAM type: YTN; PAM sequence: TTT
ttaaaaaattggtggccttc

SEQ ID NO: 93524 - DNA, 20 bp, Artificial Sequence
  Description of Artificial Sequence: Synthetic oligonucleotide
  Target: SCN9A; (+) strand; PAM type: YTN; PAM sequence: TTT
taaaaaattggtggccttca

SEQ ID NO: 93525 - DNA, 20 bp, Artificial Sequence
  Description of Artificial Sequence: Synthetic oligonucleotide
  Target: SCN9A; (+) strand; PAM type: YTN; PAM sequence: TTT
aaaaaattggtggccttcat

SEQ ID NO: 93526 - DNA, 20 bp, Artificial Sequence
  Description of Artificial Sequence: Synthetic oligonucleotide
  Target: SCN9A; (+) strand; PAM type: YTN; PAM sequence: TTA
aaaaattggtggccttcata

SEQ ID NO: 93527 - DNA, 20 bp, Artificial Sequence
  Description of Artificial Sequence: Synthetic oligonucleotide
  Target: SCN9A; (+) strand; PAM type: YTN; PAM sequence: TTG
gtggccttcatacataggtc

SEQ ID NO: 93528 - DNA, 20 bp, Artificial Sequence
  Description of Artificial Sequence: Synthetic oligonucleotide
  Target: SCN9A; (+) strand; PAM type: YTN; PAM sequence: CTT
catacataggtcctaaaccc

SEQ ID NO: 93529 - DNA, 20 bp, Artificial Sequence
  Description of Artificial Sequence: Synthetic oligonucleotide
  Target: SCN9A; (+) strand; PAM type: YTN; PAM sequence: TTC
atacataggtcctaaaccca

SEQ ID NO: 93530 - DNA, 20 bp, Artificial Sequence
  Description of Artificial Sequence: Synthetic oligonucleotide
  Target: SCN9A; (+) strand; PAM type: YTN; PAM sequence: CTA
aacccaggccaattccctgg

SEQ ID NO: 93531 - DNA, 20 bp, Artificial Sequence
  Description of Artificial Sequence: Synthetic oligonucleotide
  Target: SCN9A; (+) strand; PAM type: YTN; PAM sequence: TTC
cctggccatcctaatttagt

SEQ ID NO: 93532 - DNA, 20 bp, Artificial Sequence
  Description of Artificial Sequence: Synthetic oligonucleotide
  Target: SCN9A; (+) strand; PAM type: YTN; PAM sequence: CTG
gccatcctaatttagttggc

SEQ ID NO: 93533 - DNA, 20 bp, Artificial Sequence
  Description of Artificial Sequence: Synthetic oligonucleotide
  Target: SCN9A; (+) strand; PAM type: YTN; PAM sequence: CTA
atttagttggcccttctttc

SEQ ID NO: 93534 - DNA, 20 bp, Artificial Sequence
  Description of Artificial Sequence: Synthetic oligonucleotide
  Target: SCN9A; (+) strand; PAM type: YTN; PAM sequence: TTT
agttggcccttctttcagca

SEQ ID NO: 93535 - DNA, 20 bp, Artificial Sequence
  Description of Artificial Sequence: Synthetic oligonucleotide
  Target: SCN9A; (+) strand; PAM type: YTN; PAM sequence: TTA
gttggcccttctttcagcac

SEQ ID NO: 93536 - DNA, 20 bp, Artificial Sequence
  Description of Artificial Sequence: Synthetic oligonucleotide
  Target: SCN9A; (+) strand; PAM type: YTN; PAM sequence: TTG
gcccttctttcagcacttct

SEQ ID NO: 93537 - DNA, 20 bp, Artificial Sequence
  Description of Artificial Sequence: Synthetic oligonucleotide
  Target: SCN9A; (+) strand; PAM type: YTN; PAM sequence: CTT
ctttcagcacttctattaac

SEQ ID NO: 93538 - DNA, 20 bp, Artificial Sequence
  Description of Artificial Sequence: Synthetic oligonucleotide
  Target: SCN9A; (+) strand; PAM type: YTN; PAM sequence: TTC
tttcagcacttctattaaca

SEQ ID NO: 93539 - DNA, 20 bp, Artificial Sequence
  Description of Artificial Sequence: Synthetic oligonucleotide
  Target: SCN9A; (+) strand; PAM type: YTN; PAM sequence: CTT
tcagcacttctattaacatt

SEQ ID NO: 93540 - DNA, 20 bp, Artificial Sequence
  Description of Artificial Sequence: Synthetic oligonucleotide
  Target: SCN9A; (+) strand; PAM type: YTN; PAM sequence: TTT
cagcacttctattaacattt

SEQ ID NO: 93541 - DNA, 20 bp, Artificial Sequence
  Description of Artificial Sequence: Synthetic oligonucleotide
  Target: SCN9A; (+) strand; PAM type: YTN; PAM sequence: TTC
agcacttctattaacatttc

SEQ ID NO: 93542 - DNA, 20 bp, Artificial Sequence
  Description of Artificial Sequence: Synthetic oligonucleotide
  Target: SCN9A; (+) strand; PAM type: YTN; PAM sequence: CTT
ctattaacatttctctgaaa

SEQ ID NO: 93543 - DNA, 20 bp, Artificial Sequence
  Description of Artificial Sequence: Synthetic oligonucleotide
  Target: SCN9A; (+) strand; PAM type: YTN; PAM sequence: TTC
tattaacatttctctgaaat

SEQ ID NO: 93544 - DNA, 20 bp, Artificial Sequence
  Description of Artificial Sequence: Synthetic oligonucleotide
  Target: SCN9A; (+) strand; PAM type: YTN; PAM sequence: CTA
ttaacatttctctgaaatag

SEQ ID NO: 93545 - DNA, 20 bp, Artificial Sequence
  Description of Artificial Sequence: Synthetic oligonucleotide
  Target: SCN9A; (+) strand; PAM type: YTN; PAM sequence: TTA
acatttctctgaaatagcta

SEQ ID NO: 93546 - DNA, 20 bp, Artificial Sequence
  Description of Artificial Sequence: Synthetic oligonucleotide
  Target: SCN9A; (+) strand; PAM type: YTN; PAM sequence: TTT
ctctgaaatagctatttaga

SEQ ID NO: 93547 - DNA, 20 bp, Artificial Sequence
  Description of Artificial Sequence: Synthetic oligonucleotide
  Target: SCN9A; (+) strand; PAM type: YTN; PAM sequence: TTC
tctgaaatagctatttagaa

SEQ ID NO: 93548 - DNA, 20 bp, Artificial Sequence
  Description of Artificial Sequence: Synthetic oligonucleotide
  Target: SCN9A; (+) strand; PAM type: YTN; PAM sequence: CTC
tgaaatagctatttagaact

SEQ ID NO: 93549 - DNA, 20 bp, Artificial Sequence
  Description of Artificial Sequence: Synthetic oligonucleotide
  Target: SCN9A; (+) strand; PAM type: YTN; PAM sequence: CTG
aaatagctatttagaactgc

SEQ ID NO: 93550 - DNA, 20 bp, Artificial Sequence
  Description of Artificial Sequence: Synthetic oligonucleotide
  Target: SCN9A; (+) strand; PAM type: YTN; PAM sequence: CTA
tttagaactgctttatttac

SEQ ID NO: 93551 - DNA, 20 bp, Artificial Sequence
  Description of Artificial Sequence: Synthetic oligonucleotide
  Target: SCN9A; (+) strand; PAM type: YTN; PAM sequence: TTT
agaactgctttatttacata

SEQ ID NO: 93552 - DNA, 20 bp, Artificial Sequence
  Description of Artificial Sequence: Synthetic oligonucleotide
  Target: SCN9A; (+) strand; PAM type: YTN; PAM sequence: TTA
gaactgctttatttacatat

SEQ ID NO: 93553 - DNA, 20 bp, Artificial Sequence
  Description of Artificial Sequence: Synthetic oligonucleotide
  Target: SCN9A; (+) strand; PAM type: YTN; PAM sequence: CTG
ctttatttacatatgcattt

SEQ ID NO: 93554 - DNA, 20 bp, Artificial Sequence
  Description of Artificial Sequence: Synthetic oligonucleotide
  Target: SCN9A; (+) strand; PAM type: YTN; PAM sequence: CTT
tatttacatatgcattttat

SEQ ID NO: 93555 - DNA, 20 bp, Artificial Sequence
  Description of Artificial Sequence: Synthetic oligonucleotide
  Target: SCN9A; (+) strand; PAM type: YTN; PAM sequence: TTT
atttacatatgcattttatt

SEQ ID NO: 93556 - DNA, 20 bp, Artificial Sequence
  Description of Artificial Sequence: Synthetic oligonucleotide
  Target: SCN9A; (+) strand; PAM type: YTN; PAM sequence: TTA
tttacatatgcattttattt

SEQ ID NO: 93557 - DNA, 20 bp, Artificial Sequence
  Description of Artificial Sequence: Synthetic oligonucleotide
  Target: SCN9A; (+) strand; PAM type: YTN; PAM sequence: TTT
acatatgcattttattttca

SEQ ID NO: 93558 - DNA, 20 bp, Artificial Sequence
  Description of Artificial Sequence: Synthetic oligonucleotide
  Target: SCN9A; (+) strand; PAM type: YTN; PAM sequence: TTA
catatgcattttattttcac

SEQ ID NO: 93559 - DNA, 20 bp, Artificial Sequence
  Description of Artificial Sequence: Synthetic oligonucleotide
  Target: SCN9A; (+) strand; PAM type: YTN; PAM sequence: TTT
tattttcactctttttaata

SEQ ID NO: 93560 - DNA, 20 bp, Artificial Sequence
  Description of Artificial Sequence: Synthetic oligonucleotide
  Target: SCN9A; (+) strand; PAM type: YTN; PAM sequence: TTT
attttcactctttttaataa

SEQ ID NO: 93561 - DNA, 20 bp, Artificial Sequence
  Description of Artificial Sequence: Synthetic oligonucleotide
  Target: SCN9A; (+) strand; PAM type: YTN; PAM sequence: TTA
ttttcactctttttaataaa

SEQ ID NO: 93562 - DNA, 20 bp, Artificial Sequence
  Description of Artificial Sequence: Synthetic oligonucleotide
  Target: SCN9A; (+) strand; PAM type: YTN; PAM sequence: TTT
tcactctttttaataaagct

SEQ ID NO: 93563 - DNA, 20 bp, Artificial Sequence
  Description of Artificial Sequence: Synthetic oligonucleotide
  Target: SCN9A; (+) strand; PAM type: YTN; PAM sequence: TTT
cactctttttaataaagcta

SEQ ID NO: 93564 - DNA, 20 bp, Artificial Sequence
  Description of Artificial Sequence: Synthetic oligonucleotide
  Target: SCN9A; (+) strand; PAM type: YTN; PAM sequence: TTC
actctttttaataaagctat

SEQ ID NO: 93565 - DNA, 20 bp, Artificial Sequence
  Description of Artificial Sequence: Synthetic oligonucleotide
  Target: SCN9A; (+) strand; PAM type: YTN; PAM sequence: CTC
tttttaataaagctatcaaa

SEQ ID NO: 93566 - DNA, 20 bp, Artificial Sequence
  Description of Artificial Sequence: Synthetic oligonucleotide
  Target: SCN9A; (+) strand; PAM type: YTN; PAM sequence: CTT
tttaataaagctatcaaaac

SEQ ID NO: 93567 - DNA, 20 bp, Artificial Sequence
  Description of Artificial Sequence: Synthetic oligonucleotide
  Target: SCN9A; (+) strand; PAM type: YTN; PAM sequence: TTT
ttaataaagctatcaaaact

SEQ ID NO: 93568 - DNA, 20 bp, Artificial Sequence
  Description of Artificial Sequence: Synthetic oligonucleotide
  Target: SCN9A; (+) strand; PAM type: YTN; PAM sequence: TTT
taataaagctatcaaaactc

SEQ ID NO: 93569 - DNA, 20 bp, Artificial Sequence
  Description of Artificial Sequence: Synthetic oligonucleotide
  Target: SCN9A; (+) strand; PAM type: YTN; PAM sequence: TTT
aataaagctatcaaaactct

SEQ ID NO: 93570 - DNA, 20 bp, Artificial Sequence
  Description of Artificial Sequence: Synthetic oligonucleotide
  Target: SCN9A; (+) strand; PAM type: YTN; PAM sequence: TTA
ataaagctatcaaaactcta

SEQ ID NO: 93571 - DNA, 20 bp, Artificial Sequence
  Description of Artificial Sequence: Synthetic oligonucleotide
  Target: SCN9A; (+) strand; PAM type: YTN; PAM sequence: CTA
tcaaaactctataaaatcat

SEQ ID NO: 93572 - DNA, 20 bp, Artificial Sequence
  Description of Artificial Sequence: Synthetic oligonucleotide
  Target: SCN9A; (+) strand; PAM type: YTN; PAM sequence: CTC
tataaaatcatgctaagtat

SEQ ID NO: 93573 - DNA, 20 bp, Artificial Sequence
  Description of Artificial Sequence: Synthetic oligonucleotide
  Target: SCN9A; (+) strand; PAM type: YTN; PAM sequence: CTA
taaaatcatgctaagtattt

SEQ ID NO: 93574 - DNA, 20 bp, Artificial Sequence
  Description of Artificial Sequence: Synthetic oligonucleotide
  Target: SCN9A; (+) strand; PAM type: YTN; PAM sequence: CTA
agtattttgggttgtgatgt

SEQ ID NO: 93575 - DNA, 20 bp, Artificial Sequence
  Description of Artificial Sequence: Synthetic oligonucleotide
  Target: SCN9A; (+) strand; PAM type: YTN; PAM sequence: TTT
tgggttgtgatgttcaacaa

SEQ ID NO: 93576 - DNA, 20 bp, Artificial Sequence
  Description of Artificial Sequence: Synthetic oligonucleotide
  Target: SCN9A; (+) strand; PAM type: YTN; PAM sequence: TTT
gggttgtgatgttcaacaat

SEQ ID NO: 93577 - DNA, 20 bp, Artificial Sequence
  Description of Artificial Sequence: Synthetic oligonucleotide
  Target: SCN9A; (+) strand; PAM type: YTN; PAM sequence: TTG
ggttgtgatgttcaacaatc

SEQ ID NO: 93578 - DNA, 20 bp, Artificial Sequence
  Description of Artificial Sequence: Synthetic oligonucleotide
  Target: SCN9A; (+) strand; PAM type: YTN; PAM sequence: TTG
tgatgttcaacaatcagcat

SEQ ID NO: 93579 - DNA, 20 bp, Artificial Sequence
  Description of Artificial Sequence: Synthetic oligonucleotide
  Target: SCN9A; (+) strand; PAM type: YTN; PAM sequence: TTC
aacaatcagcatttaaaaac

SEQ ID NO: 93580 - DNA, 20 bp, Artificial Sequence
  Description of Artificial Sequence: Synthetic oligonucleotide
  Target: SCN9A; (+) strand; PAM type: YTN; PAM sequence: TTT
aaaaacagctcacaagtcac

SEQ ID NO: 93581 - DNA, 20 bp, Artificial Sequence
  Description of Artificial Sequence: Synthetic oligonucleotide
  Target: SCN9A; (+) strand; PAM type: YTN; PAM sequence: TTA
aaaacagctcacaagtcacc

SEQ ID NO: 93582 - DNA, 20 bp, Artificial Sequence
  Description of Artificial Sequence: Synthetic oligonucleotide
  Target: SCN9A; (+) strand; PAM type: YTN; PAM sequence: CTC
acaagtcacccaaatctttt

SEQ ID NO: 93583 - DNA, 20 bp, Artificial Sequence
  Description of Artificial Sequence: Synthetic oligonucleotide
  Target: SCN9A; (+) strand; PAM type: YTN; PAM sequence: CTT
ttgcaaactaggtaactatc

SEQ ID NO: 93584 - DNA, 20 bp, Artificial Sequence
  Description of Artificial Sequence: Synthetic oligonucleotide
  Target: SCN9A; (+) strand; PAM type: YTN; PAM sequence: TTT
tgcaaactaggtaactatca

SEQ ID NO: 93585 - DNA, 20 bp, Artificial Sequence
  Description of Artificial Sequence: Synthetic oligonucleotide
  Target: SCN9A; (+) strand; PAM type: YTN; PAM sequence: TTT
gcaaactaggtaactatcaa

SEQ ID NO: 93586 - DNA, 20 bp, Artificial Sequence
  Description of Artificial Sequence: Synthetic oligonucleotide
  Target: SCN9A; (+) strand; PAM type: YTN; PAM sequence: TTG
caaactaggtaactatcaaa

SEQ ID NO: 93587 - DNA, 20 bp, Artificial Sequence
  Description of Artificial Sequence: Synthetic oligonucleotide
  Target: SCN9A; (+) strand; PAM type: YTN; PAM sequence: CTA
ggtaactatcaaaaagctaa

SEQ ID NO: 93588 - DNA, 20 bp, Artificial Sequence
  Description of Artificial Sequence: Synthetic oligonucleotide
  Target: SCN9A; (+) strand; PAM type: YTN; PAM sequence: CTA
tcaaaaagctaaaattaggt

SEQ ID NO: 93589 - DNA, 20 bp, Artificial Sequence
  Description of Artificial Sequence: Synthetic oligonucleotide
  Target: SCN9A; (+) strand; PAM type: YTN; PAM sequence: CTA
aaattaggttctctaatttt

SEQ ID NO: 93590 - DNA, 20 bp, Artificial Sequence
  Description of Artificial Sequence: Synthetic oligonucleotide
  Target: SCN9A; (+) strand; PAM type: YTN; PAM sequence: TTA
ggttctctaattttcatccg

SEQ ID NO: 93591 - DNA, 20 bp, Artificial Sequence
  Description of Artificial Sequence: Synthetic oligonucleotide
  Target: SCN9A; (+) strand; PAM type: YTN; PAM sequence: TTC
tctaattttcatccgaaaga

SEQ ID NO: 93592 - DNA, 20 bp, Artificial Sequence
  Description of Artificial Sequence: Synthetic oligonucleotide
  Target: SCN9A; (+) strand; PAM type: YTN; PAM sequence: CTC
taattttcatccgaaagatt

SEQ ID NO: 93593 - DNA, 20 bp, Artificial Sequence
  Description of Artificial Sequence: Synthetic oligonucleotide
  Target: SCN9A; (+) strand; PAM type: YTN; PAM sequence: CTA
attttcatccgaaagatttg

SEQ ID NO: 93594 - DNA, 20 bp, Artificial Sequence
  Description of Artificial Sequence: Synthetic oligonucleotide
  Target: SCN9A; (+) strand; PAM type: YTN; PAM sequence: TTT
tcatccgaaagatttgtgtt

SEQ ID NO: 93595 - DNA, 20 bp, Artificial Sequence
  Description of Artificial Sequence: Synthetic oligonucleotide
  Target: SCN9A; (+) strand; PAM type: YTN; PAM sequence: TTT
catccgaaagatttgtgttc

SEQ ID NO: 93596 - DNA, 20 bp, Artificial Sequence
  Description of Artificial Sequence: Synthetic oligonucleotide
  Target: SCN9A; (+) strand; PAM type: YTN; PAM sequence: TTC
atccgaaagatttgtgttca

SEQ ID NO: 93597 - DNA, 20 bp, Artificial Sequence
  Description of Artificial Sequence: Synthetic oligonucleotide
  Target: SCN9A; (+) strand; PAM type: YTN; PAM sequence: TTT
gtgttcaaacctgtttgggg

SEQ ID NO: 93598 - DNA, 20 bp, Artificial Sequence
  Description of Artificial Sequence: Synthetic oligonucleotide
  Target: SCN9A; (+) strand; PAM type: YTN; PAM sequence: TTG
tgttcaaacctgtttggggc

SEQ ID NO: 93599 - DNA, 20 bp, Artificial Sequence
  Description of Artificial Sequence: Synthetic oligonucleotide
  Target: SCN9A; (+) strand; PAM type: YTN; PAM sequence: TTC
aaacctgtttggggcatggt

SEQ ID NO: 93600 - DNA, 20 bp, Artificial Sequence
  Description of Artificial Sequence: Synthetic oligonucleotide
  Target: SCN9A; (+) strand; PAM type: YTN; PAM sequence: CTG
tttggggcatggtggctcat

SEQ ID NO: 93601 - DNA, 20 bp, Artificial Sequence
  Description of Artificial Sequence: Synthetic oligonucleotide
  Target: SCN9A; (+) strand; PAM type: YTN; PAM sequence: TTT
ggggcatggtggctcatgcc

SEQ ID NO: 93602 - DNA, 20 bp, Artificial Sequence
  Description of Artificial Sequence: Synthetic oligonucleotide
  Target: SCN9A; (+) strand; PAM type: YTN; PAM sequence: TTG
gggcatggtggctcatgcct

SEQ ID NO: 93603 - DNA, 20 bp, Artificial Sequence
  Description of Artificial Sequence: Synthetic oligonucleotide
  Target: SCN9A; (+) strand; PAM type: YTN; PAM sequence: CTC
atgcctgtaaccccagcatg

SEQ ID NO: 93604 - DNA, 20 bp, Artificial Sequence
  Description of Artificial Sequence: Synthetic oligonucleotide
  Target: SCN9A; (+) strand; PAM type: YTN; PAM sequence: CTG
taaccccagcatgttggcag

SEQ ID NO: 93605 - DNA, 20 bp, Artificial Sequence
  Description of Artificial Sequence: Synthetic oligonucleotide
  Target: SCN9A; (+) strand; PAM type: YTN; PAM sequence: TTG
gcaggtcatgacagtaggaa

SEQ ID NO: 93606 - DNA, 20 bp, Artificial Sequence
  Description of Artificial Sequence: Synthetic oligonucleotide
  Target: SCN9A; (+) strand; PAM type: YTN; PAM sequence: CTT
gaagccaggagtttgagact

SEQ ID NO: 93607 - DNA, 20 bp, Artificial Sequence
  Description of Artificial Sequence: Synthetic oligonucleotide
  Target: SCN9A; (+) strand; PAM type: YTN; PAM sequence: TTG
aagccaggagtttgagacta

SEQ ID NO: 93608 - DNA, 20 bp, Artificial Sequence
  Description of Artificial Sequence: Synthetic oligonucleotide
  Target: SCN9A; (+) strand; PAM type: YTN; PAM sequence: TTT
gagactagcctgggcaacat

SEQ ID NO: 93609 - DNA, 20 bp, Artificial Sequence
  Description of Artificial Sequence: Synthetic oligonucleotide
  Target: SCN9A; (+) strand; PAM type: YTN; PAM sequence: TTG
agactagcctgggcaacata

SEQ ID NO: 93610 - DNA, 20 bp, Artificial Sequence
  Description of Artificial Sequence: Synthetic oligonucleotide
  Target: SCN9A; (+) strand; PAM type: YTN; PAM sequence: CTA
gcctgggcaacatagcaaga

SEQ ID NO: 93611 - DNA, 20 bp, Artificial Sequence
  Description of Artificial Sequence: Synthetic oligonucleotide
  Target: SCN9A; (+) strand; PAM type: YTN; PAM sequence: CTG
ggcaacatagcaagacccct

SEQ ID NO: 93612 - DNA, 20 bp, Artificial Sequence
  Description of Artificial Sequence: Synthetic oligonucleotide
  Target: SCN9A; (+) strand; PAM type: YTN; PAM sequence: CTT
atctacaaaaatttaaatat

SEQ ID NO: 93613 - DNA, 20 bp, Artificial Sequence
  Description of Artificial Sequence: Synthetic oligonucleotide
  Target: SCN9A; (+) strand; PAM type: YTN; PAM sequence: TTA
tctacaaaaatttaaatatt

SEQ ID NO: 93614 - DNA, 20 bp, Artificial Sequence
  Description of Artificial Sequence: Synthetic oligonucleotide
  Target: SCN9A; (+) strand; PAM type: YTN; PAM sequence: CTA
caaaaatttaaatattagcc

SEQ ID NO: 93615 - DNA, 20 bp, Artificial Sequence
  Description of Artificial Sequence: Synthetic oligonucleotide
  Target: SCN9A; (+) strand; PAM type: YTN; PAM sequence: TTT
aaatattagccaggcatggt

SEQ ID NO: 93616 - DNA, 20 bp, Artificial Sequence
  Description of Artificial Sequence: Synthetic oligonucleotide
  Target: SCN9A; (+) strand; PAM type: YTN; PAM sequence: TTA
aatattagccaggcatggtg

SEQ ID NO: 93617 - DNA, 20 bp, Artificial Sequence
  Description of Artificial Sequence: Synthetic oligonucleotide
  Target: SCN9A; (+) strand; PAM type: YTN; PAM sequence: TTA
gccaggcatggtggcatgta

SEQ ID NO: 93618 - DNA, 20 bp, Artificial Sequence
  Description of Artificial Sequence: Synthetic oligonucleotide
  Target: SCN9A; (+) strand; PAM type: YTN; PAM sequence: CTG
tagtcttagctacttgggag

SEQ ID NO: 93619 - DNA, 20 bp, Artificial Sequence
  Description of Artificial Sequence: Synthetic oligonucleotide
  Target: SCN9A; (+) strand; PAM type: YTN; PAM sequence: CTT
agctacttgggaggctgagg

SEQ ID NO: 93620 - DNA, 20 bp, Artificial Sequence
  Description of Artificial Sequence: Synthetic oligonucleotide
  Target: SCN9A; (+) strand; PAM type: YTN; PAM sequence: TTA
gctacttgggaggctgaggc

SEQ ID NO: 93621 - DNA, 20 bp, Artificial Sequence
  Description of Artificial Sequence: Synthetic oligonucleotide
  Target: SCN9A; (+) strand; PAM type: YTN; PAM sequence: CTA
cttgggaggctgaggcagga

SEQ ID NO: 93622 - DNA, 20 bp, Artificial Sequence
  Description of Artificial Sequence: Synthetic oligonucleotide
  Target: SCN9A; (+) strand; PAM type: YTN; PAM sequence: CTT
gggaggctgaggcaggaggg

SEQ ID NO: 93623 - DNA, 20 bp, Artificial Sequence
  Description of Artificial Sequence: Synthetic oligonucleotide
  Target: SCN9A; (+) strand; PAM type: YTN; PAM sequence: TTG
ggaggctgaggcaggagggt

SEQ ID NO: 93624 - DNA, 20 bp, Artificial Sequence
  Description of Artificial Sequence: Synthetic oligonucleotide
  Target: SCN9A; (+) strand; PAM type: YTN; PAM sequence: CTG
aggcaggagggttgcttgag

SEQ ID NO: 93625 - DNA, 20 bp, Artificial Sequence
  Description of Artificial Sequence: Synthetic oligonucleotide
  Target: SCN9A; (+) strand; PAM type: YTN; PAM sequence: TTG
cttgagcccagagttgaggc

SEQ ID NO: 93626 - DNA, 20 bp, Artificial Sequence
  Description of Artificial Sequence: Synthetic oligonucleotide
  Target: SCN9A; (+) strand; PAM type: YTN; PAM sequence: CTT
gagcccagagttgaggctgc

SEQ ID NO: 93627 - DNA, 20 bp, Artificial Sequence
  Description of Artificial Sequence: Synthetic oligonucleotide
  Target: SCN9A; (+) strand; PAM type: YTN; PAM sequence: TTG
agcccagagttgaggctgca

SEQ ID NO: 93628 - DNA, 20 bp, Artificial Sequence
  Description of Artificial Sequence: Synthetic oligonucleotide
  Target: SCN9A; (+) strand; PAM type: YTN; PAM sequence: TTG
aggctgcagagagctatgat

SEQ ID NO: 93629 - DNA, 20 bp, Artificial Sequence
  Description of Artificial Sequence: Synthetic oligonucleotide
  Target: SCN9A; (+) strand; PAM type: YTN; PAM sequence: CTG
cagagagctatgatcatgcc

SEQ ID NO: 93630 - DNA, 20 bp, Artificial Sequence
  Description of Artificial Sequence: Synthetic oligonucleotide
  Target: SCN9A; (+) strand; PAM type: YTN; PAM sequence: CTA
tgatcatgccattgcactct

SEQ ID NO: 93631 - DNA, 20 bp, Artificial Sequence
  Description of Artificial Sequence: Synthetic oligonucleotide
  Target: SCN9A; (+) strand; PAM type: YTN; PAM sequence: TTG
cactctagcctgggtgacag

SEQ ID NO: 93632 - DNA, 20 bp, Artificial Sequence
  Description of Artificial Sequence: Synthetic oligonucleotide
  Target: SCN9A; (+) strand; PAM type: YTN; PAM sequence: CTC
tagcctgggtgacagagcga

SEQ ID NO: 93633 - DNA, 20 bp, Artificial Sequence
  Description of Artificial Sequence: Synthetic oligonucleotide
  Target: SCN9A; (+) strand; PAM type: YTN; PAM sequence: CTA
gcctgggtgacagagcgaga

SEQ ID NO: 93634 - DNA, 20 bp, Artificial Sequence
  Description of Artificial Sequence: Synthetic oligonucleotide
  Target: SCN9A; (+) strand; PAM type: YTN; PAM sequence: CTG
ggtgacagagcgagacctgg

SEQ ID NO: 93635 - DNA, 20 bp, Artificial Sequence
  Description of Artificial Sequence: Synthetic oligonucleotide
  Target: SCN9A; (+) strand; PAM type: YTN; PAM sequence: CTG
gtcacttaaaaaagttttta

SEQ ID NO: 93636 - DNA, 20 bp, Artificial Sequence
  Description of Artificial Sequence: Synthetic oligonucleotide
  Target: SCN9A; (+) strand; PAM type: YTN; PAM sequence: CTT
aaaaaagtttttagaaaacc

SEQ ID NO: 93637 - DNA, 20 bp, Artificial Sequence
  Description of Artificial Sequence: Synthetic oligonucleotide
  Target: SCN9A; (+) strand; PAM type: YTN; PAM sequence: TTA
aaaaagtttttagaaaacct

SEQ ID NO: 93638 - DNA, 20 bp, Artificial Sequence
  Description of Artificial Sequence: Synthetic oligonucleotide
  Target: SCN9A; (+) strand; PAM type: YTN; PAM sequence: TTT
ttagaaaacctgtttgcttc

SEQ ID NO: 93639 - DNA, 20 bp, Artificial Sequence
  Description of Artificial Sequence: Synthetic oligonucleotide
  Target: SCN9A; (+) strand; PAM type: YTN; PAM sequence: TTT
tagaaaacctgtttgcttcc

SEQ ID NO: 93640 - DNA, 20 bp, Artificial Sequence
  Description of Artificial Sequence: Synthetic oligonucleotide
  Target: SCN9A; (+) strand; PAM type: YTN; PAM sequence: TTT
agaaaacctgtttgcttcca

SEQ ID NO: 93641 - DNA, 20 bp, Artificial Sequence
  Description of Artificial Sequence: Synthetic oligonucleotide
  Target: SCN9A; (+) strand; PAM type: YTN; PAM sequence: TTA
gaaaacctgtttgcttccat

SEQ ID NO: 93642 - DNA, 20 bp, Artificial Sequence
  Description of Artificial Sequence: Synthetic oligonucleotide
  Target: SCN9A; (+) strand; PAM type: YTN; PAM sequence: CTG
tttgcttccattttattcta

SEQ ID NO: 93643 - DNA, 20 bp, Artificial Sequence
  Description of Artificial Sequence: Synthetic oligonucleotide
  Target: SCN9A; (+) strand; PAM type: YTN; PAM sequence: TTT
gcttccattttattctaagt

SEQ ID NO: 93644 - DNA, 20 bp, Artificial Sequence
  Description of Artificial Sequence: Synthetic oligonucleotide
  Target: SCN9A; (+) strand; PAM type: YTN; PAM sequence: TTG
cttccattttattctaagtt

SEQ ID NO: 93645 - DNA, 20 bp, Artificial Sequence
  Description of Artificial Sequence: Synthetic oligonucleotide
  Target: SCN9A; (+) strand; PAM type: YTN; PAM sequence: CTT
ccattttattctaagttaag

SEQ ID NO: 93646 - DNA, 20 bp, Artificial Sequence
  Description of Artificial Sequence: Synthetic oligonucleotide
  Target: SCN9A; (+) strand; PAM type: YTN; PAM sequence: TTC
cattttattctaagttaagt

SEQ ID NO: 93647 - DNA, 20 bp, Artificial Sequence
  Description of Artificial Sequence: Synthetic oligonucleotide
  Target: SCN9A; (+) strand; PAM type: YTN; PAM sequence: TTT
tattctaagttaagttcttc

SEQ ID NO: 93648 - DNA, 20 bp, Artificial Sequence
  Description of Artificial Sequence: Synthetic oligonucleotide
  Target: SCN9A; (+) strand; PAM type: YTN; PAM sequence: TTT
attctaagttaagttcttca

SEQ ID NO: 93649 - DNA, 20 bp, Artificial Sequence
  Description of Artificial Sequence: Synthetic oligonucleotide
  Target: SCN9A; (+) strand; PAM type: YTN; PAM sequence: TTA
ttctaagttaagttcttcag

SEQ ID NO: 93650 - DNA, 20 bp, Artificial Sequence
  Description of Artificial Sequence: Synthetic oligonucleotide
  Target: SCN9A; (+) strand; PAM type: YTN; PAM sequence: TTC
taagttaagttcttcagtgt

SEQ ID NO: 93651 - DNA, 20 bp, Artificial Sequence
  Description of Artificial Sequence: Synthetic oligonucleotide
  Target: SCN9A; (+) strand; PAM type: YTN; PAM sequence: CTA
agttaagttcttcagtgtaa

SEQ ID NO: 93652 - DNA, 20 bp, Artificial Sequence
  Description of Artificial Sequence: Synthetic oligonucleotide
  Target: SCN9A; (+) strand; PAM type: YTN; PAM sequence: TTA
agttcttcagtgtaactgcc

SEQ ID NO: 93653 - DNA, 20 bp, Artificial Sequence
  Description of Artificial Sequence: Synthetic oligonucleotide
  Target: SCN9A; (+) strand; PAM type: YTN; PAM sequence: TTC
ttcagtgtaactgcctttct

SEQ ID NO: 93654 - DNA, 20 bp, Artificial Sequence
  Description of Artificial Sequence: Synthetic oligonucleotide
  Target: SCN9A; (+) strand; PAM type: YTN; PAM sequence: CTT
cagtgtaactgcctttctgt

SEQ ID NO: 93655 - DNA, 20 bp, Artificial Sequence
  Description of Artificial Sequence: Synthetic oligonucleotide
  Target: SCN9A; (+) strand; PAM type: YTN; PAM sequence: TTC
agtgtaactgcctttctgta

SEQ ID NO: 93656 - DNA, 20 bp, Artificial Sequence
  Description of Artificial Sequence: Synthetic oligonucleotide
  Target: SCN9A; (+) strand; PAM type: YTN; PAM sequence: CTG
cctttctgtattgttgggtg

SEQ ID NO: 93657 - DNA, 20 bp, Artificial Sequence
  Description of Artificial Sequence: Synthetic oligonucleotide
  Target: SCN9A; (+) strand; PAM type: YTN; PAM sequence: CTT
tctgtattgttgggtgtaat

SEQ ID NO: 93658 - DNA, 20 bp, Artificial Sequence
  Description of Artificial Sequence: Synthetic oligonucleotide
  Target: SCN9A; (+) strand; PAM type: YTN; PAM sequence: TTT
ctgtattgttgggtgtaata

SEQ ID NO: 93659 - DNA, 20 bp, Artificial Sequence
  Description of Artificial Sequence: Synthetic oligonucleotide
  Target: SCN9A; (+) strand; PAM type: YTN; PAM sequence: TTC
tgtattgttgggtgtaataa

SEQ ID NO: 93660 - DNA, 20 bp, Artificial Sequence
  Description of Artificial Sequence: Synthetic oligonucleotide
  Target: SCN9A; (+) strand; PAM type: YTN; PAM sequence: CTG
tattgttgggtgtaataagt

SEQ ID NO: 93661 - DNA, 20 bp, Artificial Sequence
  Description of Artificial Sequence: Synthetic oligonucleotide
  Target: SCN9A; (+) strand; PAM type: YTN; PAM sequence: TTG
ttgggtgtaataagttcagc

SEQ ID NO: 93662 - DNA, 20 bp, Artificial Sequence
  Description of Artificial Sequence: Synthetic oligonucleotide
  Target: SCN9A; (+) strand; PAM type: YTN; PAM sequence: TTG
ggtgtaataagttcagcgat

SEQ ID NO: 93663 - DNA, 20 bp, Artificial Sequence
  Description of Artificial Sequence: Synthetic oligonucleotide
  Target: SCN9A; (+) strand; PAM type: YTN; PAM sequence: TTC
agcgattataaaatttaaat

SEQ ID NO: 93664 - DNA, 20 bp, Artificial Sequence
  Description of Artificial Sequence: Synthetic oligonucleotide
  Target: SCN9A; (+) strand; PAM type: YTN; PAM sequence: TTA
taaaatttaaatattaatat

SEQ ID NO: 93665 - DNA, 20 bp, Artificial Sequence
  Description of Artificial Sequence: Synthetic oligonucleotide
  Target: SCN9A; (+) strand; PAM type: YTN; PAM sequence: TTT
aaatattaatatgacagtgc

SEQ ID NO: 93666 - DNA, 20 bp, Artificial Sequence
  Description of Artificial Sequence: Synthetic oligonucleotide
  Target: SCN9A; (+) strand; PAM type: YTN; PAM sequence: TTA
aatattaatatgacagtgcc

SEQ ID NO: 93667 - DNA, 20 bp, Artificial Sequence
  Description of Artificial Sequence: Synthetic oligonucleotide
  Target: SCN9A; (+) strand; PAM type: YTN; PAM sequence: TTA
atatgacagtgccttctgaa

SEQ ID NO: 93668 - DNA, 20 bp, Artificial Sequence
  Description of Artificial Sequence: Synthetic oligonucleotide
  Target: SCN9A; (+) strand; PAM type: YTN; PAM sequence: CTT
ctgaagggtgaaaccatcag

SEQ ID NO: 93669 - DNA, 20 bp, Artificial Sequence
  Description of Artificial Sequence: Synthetic oligonucleotide
  Target: SCN9A; (+) strand; PAM type: YTN; PAM sequence: TTC
tgaagggtgaaaccatcagt

SEQ ID NO: 93670 - DNA, 20 bp, Artificial Sequence
  Description of Artificial Sequence: Synthetic oligonucleotide
  Target: SCN9A; (+) strand; PAM type: YTN; PAM sequence: CTG
aagggtgaaaccatcagtac

SEQ ID NO: 93671 - DNA, 20 bp, Artificial Sequence
  Description of Artificial Sequence: Synthetic oligonucleotide
  Target: SCN9A; (+) strand; PAM type: YTN; PAM sequence: CTA
catggaaagagaggtctaat

SEQ ID NO: 93672 - DNA, 20 bp, Artificial Sequence
  Description of Artificial Sequence: Synthetic oligonucleotide
  Target: SCN9A; (+) strand; PAM type: YTN; PAM sequence: CTA
attttacttcaagcttatac

SEQ ID NO: 93673 - DNA, 20 bp, Artificial Sequence
  Description of Artificial Sequence: Synthetic oligonucleotide
  Target: SCN9A; (+) strand; PAM type: YTN; PAM sequence: TTT
tacttcaagcttatacttaa

SEQ ID NO: 93674 - DNA, 20 bp, Artificial Sequence
  Description of Artificial Sequence: Synthetic oligonucleotide
  Target: SCN9A; (+) strand; PAM type: YTN; PAM sequence: TTT
acttcaagcttatacttaat

SEQ ID NO: 93675 - DNA, 20 bp, Artificial Sequence
  Description of Artificial Sequence: Synthetic oligonucleotide
  Target: SCN9A; (+) strand; PAM type: YTN; PAM sequence: TTA
cttcaagcttatacttaata

SEQ ID NO: 93676 - DNA, 20 bp, Artificial Sequence
  Description of Artificial Sequence: Synthetic oligonucleotide
  Target: SCN9A; (+) strand; PAM type: YTN; PAM sequence: CTT
caagcttatacttaataagc

SEQ ID NO: 93677 - DNA, 20 bp, Artificial Sequence
  Description of Artificial Sequence: Synthetic oligonucleotide
  Target: SCN9A; (+) strand; PAM type: YTN; PAM sequence: TTC
aagcttatacttaataagct

SEQ ID NO: 93678 - DNA, 20 bp, Artificial Sequence
  Description of Artificial Sequence: Synthetic oligonucleotide
  Target: SCN9A; (+) strand; PAM type: YTN; PAM sequence: CTT
atacttaataagctctttct

SEQ ID NO: 93679 - DNA, 20 bp, Artificial Sequence
  Description of Artificial Sequence: Synthetic oligonucleotide
  Target: SCN9A; (+) strand; PAM type: YTN; PAM sequence: TTA
tacttaataagctctttctt

SEQ ID NO: 93680 - DNA, 20 bp, Artificial Sequence
  Description of Artificial Sequence: Synthetic oligonucleotide
  Target: SCN9A; (+) strand; PAM type: YTN; PAM sequence: CTT
aataagctctttcttccaaa

SEQ ID NO: 93681 - DNA, 20 bp, Artificial Sequence
  Description of Artificial Sequence: Synthetic oligonucleotide
  Target: SCN9A; (+) strand; PAM type: YTN; PAM sequence: TTA
ataagctctttcttccaaat

SEQ ID NO: 93682 - DNA, 20 bp, Artificial Sequence
  Description of Artificial Sequence: Synthetic oligonucleotide
  Target: SCN9A; (+) strand; PAM type: YTN; PAM sequence: CTC
tttcttccaaatattatttt

SEQ ID NO: 93683 - DNA, 20 bp, Artificial Sequence
  Description of Artificial Sequence: Synthetic oligonucleotide
  Target: SCN9A; (+) strand; PAM type: YTN; PAM sequence: CTT
tcttccaaatattattttta

SEQ ID NO: 93684 - DNA, 20 bp, Artificial Sequence
  Description of Artificial Sequence: Synthetic oligonucleotide
  Target: SCN9A; (+) strand; PAM type: YTN; PAM sequence: TTT
cttccaaatattatttttaa

SEQ ID NO: 93685 - DNA, 20 bp, Artificial Sequence
  Description of Artificial Sequence: Synthetic oligonucleotide
  Target: SCN9A; (+) strand; PAM type: YTN; PAM sequence: TTC
ttccaaatattatttttaat

SEQ ID NO: 93686 - DNA, 20 bp, Artificial Sequence
  Description of Artificial Sequence: Synthetic oligonucleotide
  Target: SCN9A; (+) strand; PAM type: YTN; PAM sequence: CTT
ccaaatattatttttaattg

SEQ ID NO: 93687 - DNA, 20 bp, Artificial Sequence
  Description of Artificial Sequence: Synthetic oligonucleotide
  Target: SCN9A; (+) strand; PAM type: YTN; PAM sequence: TTC
caaatattatttttaattga

SEQ ID NO: 93688 - DNA, 20 bp, Artificial Sequence
  Description of Artificial Sequence: Synthetic oligonucleotide
  Target: SCN9A; (+) strand; PAM type: YTN; PAM sequence: TTA
tttttaattgataaaaagtc

SEQ ID NO: 93689 - DNA, 20 bp, Artificial Sequence
  Description of Artificial Sequence: Synthetic oligonucleotide
  Target: SCN9A; (+) strand; PAM type: YTN; PAM sequence: TTT
ttaattgataaaaagtcaca

SEQ ID NO: 93690 - DNA, 20 bp, Artificial Sequence
  Description of Artificial Sequence: Synthetic oligonucleotide
  Target: SCN9A; (+) strand; PAM type: YTN; PAM sequence: TTT
taattgataaaaagtcacaa

SEQ ID NO: 93691 - DNA, 20 bp, Artificial Sequence
  Description of Artificial Sequence: Synthetic oligonucleotide
  Target: SCN9A; (+) strand; PAM type: YTN; PAM sequence: TTT
aattgataaaaagtcacaag

SEQ ID NO: 93692 - DNA, 20 bp, Artificial Sequence
  Description of Artificial Sequence: Synthetic oligonucleotide
  Target: SCN9A; (+) strand; PAM type: YTN; PAM sequence: TTA
attgataaaaagtcacaagt

SEQ ID NO: 93693 - DNA, 20 bp, Artificial Sequence
  Description of Artificial Sequence: Synthetic oligonucleotide
  Target: SCN9A; (+) strand; PAM type: YTN; PAM sequence: TTG
ataaaaagtcacaagtagac

SEQ ID NO: 93694 - DNA, 20 bp, Artificial Sequence
  Description of Artificial Sequence: Synthetic oligonucleotide
  Target: SCN9A; (+) strand; PAM type: YTN; PAM sequence: TTC
ctgaaacaaacgtaaatata

SEQ ID NO: 93695 - DNA, 20 bp, Artificial Sequence
  Description of Artificial Sequence: Synthetic oligonucleotide
  Target: SCN9A; (+) strand; PAM type: YTN; PAM sequence: CTG
aaacaaacgtaaatatatat

SEQ ID NO: 93696 - DNA, 20 bp, Artificial Sequence
  Description of Artificial Sequence: Synthetic oligonucleotide
  Target: SCN9A; (+) strand; PAM type: YTN; PAM sequence: CTT
aaccatgttattttaaaaaa

SEQ ID NO: 93697 - DNA, 20 bp, Artificial Sequence
  Description of Artificial Sequence: Synthetic oligonucleotide
  Target: SCN9A; (+) strand; PAM type: YTN; PAM sequence: TTA
accatgttattttaaaaaaa

SEQ ID NO: 93698 - DNA, 20 bp, Artificial Sequence
  Description of Artificial Sequence: Synthetic oligonucleotide
  Target: SCN9A; (+) strand; PAM type: YTN; PAM sequence: TTA
ttttaaaaaaaaacatagtt

SEQ ID NO: 93699 - DNA, 20 bp, Artificial Sequence
  Description of Artificial Sequence: Synthetic oligonucleotide
  Target: SCN9A; (+) strand; PAM type: YTN; PAM sequence: TTT
taaaaaaaaacatagttcat

SEQ ID NO: 93700 - DNA, 20 bp, Artificial Sequence
  Description of Artificial Sequence: Synthetic oligonucleotide
  Target: SCN9A; (+) strand; PAM type: YTN; PAM sequence: TTT
aaaaaaaaacatagttcatg

SEQ ID NO: 93701 - DNA, 20 bp, Artificial Sequence
  Description of Artificial Sequence: Synthetic oligonucleotide
  Target: SCN9A; (+) strand; PAM type: YTN; PAM sequence: TTA
aaaaaaaacatagttcatga

SEQ ID NO: 93702 - DNA, 20 bp, Artificial Sequence
  Description of Artificial Sequence: Synthetic oligonucleotide
  Target: SCN9A; (+) strand; PAM type: YTN; PAM sequence: TTC
atgaaataggaaaaagaaca

SEQ ID NO: 93703 - DNA, 20 bp, Artificial Sequence
  Description of Artificial Sequence: Synthetic oligonucleotide
  Target: SCN9A; (+) strand; PAM type: YTN; PAM sequence: CTT
tatatatatttttgaaatgc

SEQ ID NO: 93704 - DNA, 20 bp, Artificial Sequence
  Description of Artificial Sequence: Synthetic oligonucleotide
  Target: SCN9A; (+) strand; PAM type: YTN; PAM sequence: TTT
atatatatttttgaaatgct

SEQ ID NO: 93705 - DNA, 20 bp, Artificial Sequence
  Description of Artificial Sequence: Synthetic oligonucleotide
  Target: SCN9A; (+) strand; PAM type: YTN; PAM sequence: TTA
tatatatttttgaaatgcta

SEQ ID NO: 93706 - DNA, 20 bp, Artificial Sequence
  Description of Artificial Sequence: Synthetic oligonucleotide
  Target: SCN9A; (+) strand; PAM type: YTN; PAM sequence: TTT
ttgaaatgctaagaagaaat

SEQ ID NO: 93707 - DNA, 20 bp, Artificial Sequence
  Description of Artificial Sequence: Synthetic oligonucleotide
  Target: SCN9A; (+) strand; PAM type: YTN; PAM sequence: TTT
tgaaatgctaagaagaaatt

SEQ ID NO: 93708 - DNA, 20 bp, Artificial Sequence
  Description of Artificial Sequence: Synthetic oligonucleotide
  Target: SCN9A; (+) strand; PAM type: YTN; PAM sequence: TTT
gaaatgctaagaagaaattg

SEQ ID NO: 93709 - DNA, 20 bp, Artificial Sequence
  Description of Artificial Sequence: Synthetic oligonucleotide
  Target: SCN9A; (+) strand; PAM type: YTN; PAM sequence: TTG
aaatgctaagaagaaattgt

SEQ ID NO: 93710 - DNA, 20 bp, Artificial Sequence
  Description of Artificial Sequence: Synthetic oligonucleotide
  Target: SCN9A; (+) strand; PAM type: YTN; PAM sequence: CTA
agaagaaattgtgttgttaa

SEQ ID NO: 93711 - DNA, 20 bp, Artificial Sequence
  Description of Artificial Sequence: Synthetic oligonucleotide
  Target: SCN9A; (+) strand; PAM type: YTN; PAM sequence: TTG
tgttgttaacaaaccagttg

SEQ ID NO: 93712 - DNA, 20 bp, Artificial Sequence
  Description of Artificial Sequence: Synthetic oligonucleotide
  Target: SCN9A; (+) strand; PAM type: YTN; PAM sequence: TTG
ttaacaaaccagttgcccat

SEQ ID NO: 93713 - DNA, 20 bp, Artificial Sequence
  Description of Artificial Sequence: Synthetic oligonucleotide
  Target: SCN9A; (+) strand; PAM type: YTN; PAM sequence: TTA
acaaaccagttgcccatatt

SEQ ID NO: 93714 - DNA, 20 bp, Artificial Sequence
  Description of Artificial Sequence: Synthetic oligonucleotide
  Target: SCN9A; (+) strand; PAM type: YTN; PAM sequence: TTG
cccatattttttattttaca

SEQ ID NO: 93715 - DNA, 20 bp, Artificial Sequence
  Description of Artificial Sequence: Synthetic oligonucleotide
  Target: SCN9A; (+) strand; PAM type: YTN; PAM sequence: TTT
tttattttacataaaaacaa

SEQ ID NO: 93716 - DNA, 20 bp, Artificial Sequence
  Description of Artificial Sequence: Synthetic oligonucleotide
  Target: SCN9A; (+) strand; PAM type: YTN; PAM sequence: TTT
ttattttacataaaaacaag

SEQ ID NO: 93717 - DNA, 20 bp, Artificial Sequence
  Description of Artificial Sequence: Synthetic oligonucleotide
  Target: SCN9A; (+) strand; PAM type: YTN; PAM sequence: TTT
tattttacataaaaacaagg

SEQ ID NO: 93718 - DNA, 20 bp, Artificial Sequence
  Description of Artificial Sequence: Synthetic oligonucleotide
  Target: SCN9A; (+) strand; PAM type: YTN; PAM sequence: TTT
attttacataaaaacaaggc

SEQ ID NO: 93719 - DNA, 20 bp, Artificial Sequence
  Description of Artificial Sequence: Synthetic oligonucleotide
  Target: SCN9A; (+) strand; PAM type: YTN; PAM sequence: TTA
ttttacataaaaacaaggca

SEQ ID NO: 93720 - DNA, 20 bp, Artificial Sequence
  Description of Artificial Sequence: Synthetic oligonucleotide
  Target: SCN9A; (+) strand; PAM type: YTN; PAM sequence: TTT
tacataaaaacaaggcaatg

SEQ ID NO: 93721 - DNA, 20 bp, Artificial Sequence
  Description of Artificial Sequence: Synthetic oligonucleotide
  Target: SCN9A; (+) strand; PAM type: YTN; PAM sequence: TTT
acataaaaacaaggcaatgt

SEQ ID NO: 93722 - DNA, 20 bp, Artificial Sequence
  Description of Artificial Sequence: Synthetic oligonucleotide
  Target: SCN9A; (+) strand; PAM type: YTN; PAM sequence: TTA
cataaaaacaaggcaatgta

SEQ ID NO: 93723 - DNA, 20 bp, Artificial Sequence
  Description of Artificial Sequence: Synthetic oligonucleotide
  Target: SCN9A; (+) strand; PAM type: YTN; PAM sequence: TTA
atagaaaattacacacgaac

SEQ ID NO: 93724 - DNA, 20 bp, Artificial Sequence
  Description of Artificial Sequence: Synthetic oligonucleotide
  Target: SCN9A; (+) strand; PAM type: YTN; PAM sequence: TTA
cacacgaacctgtcaaacat

SEQ ID NO: 93725 - DNA, 20 bp, Artificial Sequence
  Description of Artificial Sequence: Synthetic oligonucleotide
  Target: SCN9A; (+) strand; PAM type: YTN; PAM sequence: CTG
tcaaacatcttgtcttacta

SEQ ID NO: 93726 - DNA, 20 bp, Artificial Sequence
  Description of Artificial Sequence: Synthetic oligonucleotide
  Target: SCN9A; (+) strand; PAM type: YTN; PAM sequence: CTT
gtcttactacattatgtaag

SEQ ID NO: 93727 - DNA, 20 bp, Artificial Sequence
  Description of Artificial Sequence: Synthetic oligonucleotide
  Target: SCN9A; (+) strand; PAM type: YTN; PAM sequence: TTG
tcttactacattatgtaagt

SEQ ID NO: 93728 - DNA, 20 bp, Artificial Sequence
  Description of Artificial Sequence: Synthetic oligonucleotide
  Target: SCN9A; (+) strand; PAM type: YTN; PAM sequence: CTT
actacattatgtaagtattc

SEQ ID NO: 93729 - DNA, 20 bp, Artificial Sequence
  Description of Artificial Sequence: Synthetic oligonucleotide
  Target: SCN9A; (+) strand; PAM type: YTN; PAM sequence: TTA
ctacattatgtaagtattca

SEQ ID NO: 93730 - DNA, 20 bp, Artificial Sequence
  Description of Artificial Sequence: Synthetic oligonucleotide
  Target: SCN9A; (+) strand; PAM type: YTN; PAM sequence: CTA
cattatgtaagtattcataa

SEQ ID NO: 93731 - DNA, 20 bp, Artificial Sequence
  Description of Artificial Sequence: Synthetic oligonucleotide
  Target: SCN9A; (+) strand; PAM type: YTN; PAM sequence: TTA
tgtaagtattcataatgcag

SEQ ID NO: 93732 - DNA, 20 bp, Artificial Sequence
  Description of Artificial Sequence: Synthetic oligonucleotide
  Target: SCN9A; (+) strand; PAM type: YTN; PAM sequence: TTC
ataatgcagttatatttgtg

SEQ ID NO: 93733 - DNA, 20 bp, Artificial Sequence
  Description of Artificial Sequence: Synthetic oligonucleotide
  Target: SCN9A; (+) strand; PAM type: YTN; PAM sequence: TTA
tatttgtgagtttgaaataa

SEQ ID NO: 93734 - DNA, 20 bp, Artificial Sequence
  Description of Artificial Sequence: Synthetic oligonucleotide
  Target: SCN9A; (+) strand; PAM type: YTN; PAM sequence: TTT
gtgagtttgaaataacggta

SEQ ID NO: 93735 - DNA, 20 bp, Artificial Sequence
  Description of Artificial Sequence: Synthetic oligonucleotide
  Target: SCN9A; (+) strand; PAM type: YTN; PAM sequence: TTG
tgagtttgaaataacggtag

SEQ ID NO: 93736 - DNA, 20 bp, Artificial Sequence
  Description of Artificial Sequence: Synthetic oligonucleotide
  Target: SCN9A; (+) strand; PAM type: YTN; PAM sequence: TTT
gaaataacggtagattgaat

SEQ ID NO: 93737 - DNA, 20 bp, Artificial Sequence
  Description of Artificial Sequence: Synthetic oligonucleotide
  Target: SCN9A; (+) strand; PAM type: YTN; PAM sequence: TTG
aaataacggtagattgaatt

SEQ ID NO: 93738 - DNA, 20 bp, Artificial Sequence
  Description of Artificial Sequence: Synthetic oligonucleotide
  Target: SCN9A; (+) strand; PAM type: YTN; PAM sequence: TTG
aattcaaatttaaggtgatg

SEQ ID NO: 93739 - DNA, 20 bp, Artificial Sequence
  Description of Artificial Sequence: Synthetic oligonucleotide
  Target: SCN9A; (+) strand; PAM type: YTN; PAM sequence: TTC
aaatttaaggtgatgttaaa

SEQ ID NO: 93740 - DNA, 20 bp, Artificial Sequence
  Description of Artificial Sequence: Synthetic oligonucleotide
  Target: SCN9A; (+) strand; PAM type: YTN; PAM sequence: TTT
aaggtgatgttaaattctta

SEQ ID NO: 93741 - DNA, 20 bp, Artificial Sequence
  Description of Artificial Sequence: Synthetic oligonucleotide
  Target: SCN9A; (+) strand; PAM type: YTN; PAM sequence: TTA
aggtgatgttaaattcttaa

SEQ ID NO: 93742 - DNA, 20 bp, Artificial Sequence
  Description of Artificial Sequence: Synthetic oligonucleotide
  Target: SCN9A; (+) strand; PAM type: YTN; PAM sequence: TTA
aattcttaattgaatgtatt

SEQ ID NO: 93743 - DNA, 20 bp, Artificial Sequence
  Description of Artificial Sequence: Synthetic oligonucleotide
  Target: SCN9A; (+) strand; PAM type: YTN; PAM sequence: TTC
ttaattgaatgtatttaaaa

SEQ ID NO: 93744 - DNA, 20 bp, Artificial Sequence
  Description of Artificial Sequence: Synthetic oligonucleotide
  Target: SCN9A; (+) strand; PAM type: YTN; PAM sequence: CTT
aattgaatgtatttaaaaat

SEQ ID NO: 93745 - DNA, 20 bp, Artificial Sequence
  Description of Artificial Sequence: Synthetic oligonucleotide
  Target: SCN9A; (+) strand; PAM type: YTN; PAM sequence: TTA
attgaatgtatttaaaaatc

SEQ ID NO: 93746 - DNA, 20 bp, Artificial Sequence
  Description of Artificial Sequence: Synthetic oligonucleotide
  Target: SCN9A; (+) strand; PAM type: YTN; PAM sequence: TTG
aatgtatttaaaaatctgat

SEQ ID NO: 93747 - DNA, 20 bp, Artificial Sequence
  Description of Artificial Sequence: Synthetic oligonucleotide
  Target: SCN9A; (+) strand; PAM type: YTN; PAM sequence: TTT
aaaaatctgataaatgtaat

SEQ ID NO: 93748 - DNA, 20 bp, Artificial Sequence
  Description of Artificial Sequence: Synthetic oligonucleotide
  Target: SCN9A; (+) strand; PAM type: YTN; PAM sequence: TTA
aaaatctgataaatgtaata

SEQ ID NO: 93749 - DNA, 20 bp, Artificial Sequence
  Description of Artificial Sequence: Synthetic oligonucleotide
  Target: SCN9A; (+) strand; PAM type: YTN; PAM sequence: CTG
ataaatgtaatatattttgt

SEQ ID NO: 93750 - DNA, 20 bp, Artificial Sequence
  Description of Artificial Sequence: Synthetic oligonucleotide
  Target: SCN9A; (+) strand; PAM type: YTN; PAM sequence: TTT
tgtataggtccctacttaaa

SEQ ID NO: 93751 - DNA, 20 bp, Artificial Sequence
  Description of Artificial Sequence: Synthetic oligonucleotide
  Target: SCN9A; (+) strand; PAM type: YTN; PAM sequence: TTT
gtataggtccctacttaaat

SEQ ID NO: 93752 - DNA, 20 bp, Artificial Sequence
  Description of Artificial Sequence: Synthetic oligonucleotide
  Target: SCN9A; (+) strand; PAM type: YTN; PAM sequence: TTG
tataggtccctacttaaatt

SEQ ID NO: 93753 - DNA, 20 bp, Artificial Sequence
  Description of Artificial Sequence: Synthetic oligonucleotide
  Target: SCN9A; (+) strand; PAM type: YTN; PAM sequence: CTA
cttaaattatcaaaacctat

SEQ ID NO: 93754 - DNA, 20 bp, Artificial Sequence
  Description of Artificial Sequence: Synthetic oligonucleotide
  Target: SCN9A; (+) strand; PAM type: YTN; PAM sequence: CTT
aaattatcaaaacctatttc

SEQ ID NO: 93755 - DNA, 20 bp, Artificial Sequence
  Description of Artificial Sequence: Synthetic oligonucleotide
  Target: SCN9A; (+) strand; PAM type: YTN; PAM sequence: TTA
aattatcaaaacctatttcc

SEQ ID NO: 93756 - DNA, 20 bp, Artificial Sequence
  Description of Artificial Sequence: Synthetic oligonucleotide
  Target: SCN9A; (+) strand; PAM type: YTN; PAM sequence: TTA
tcaaaacctatttccaacag

SEQ ID NO: 93757 - DNA, 20 bp, Artificial Sequence
  Description of Artificial Sequence: Synthetic oligonucleotide
  Target: SCN9A; (+) strand; PAM type: YTN; PAM sequence: CTA
tttccaacaggcttggtagg

SEQ ID NO: 93758 - DNA, 20 bp, Artificial Sequence
  Description of Artificial Sequence: Synthetic oligonucleotide
  Target: SCN9A; (+) strand; PAM type: YTN; PAM sequence: TTT
ccaacaggcttggtaggtat

SEQ ID NO: 93759 - DNA, 20 bp, Artificial Sequence
  Description of Artificial Sequence: Synthetic oligonucleotide
  Target: SCN9A; (+) strand; PAM type: YTN; PAM sequence: TTC
caacaggcttggtaggtatg

SEQ ID NO: 93760 - DNA, 20 bp, Artificial Sequence
  Description of Artificial Sequence: Synthetic oligonucleotide
  Target: SCN9A; (+) strand; PAM type: YTN; PAM sequence: CTT
ggtaggtatgtgataaaatg

SEQ ID NO: 93761 - DNA, 20 bp, Artificial Sequence
  Description of Artificial Sequence: Synthetic oligonucleotide
  Target: SCN9A; (+) strand; PAM type: YTN; PAM sequence: TTG
gtaggtatgtgataaaatga

SEQ ID NO: 93762 - DNA, 20 bp, Artificial Sequence
  Description of Artificial Sequence: Synthetic oligonucleotide
  Target: SCN9A; (+) strand; PAM type: YTN; PAM sequence: CTA
tgtagtctcggaaaacactg

SEQ ID NO: 93763 - DNA, 20 bp, Artificial Sequence
  Description of Artificial Sequence: Synthetic oligonucleotide
  Target: SCN9A; (+) strand; PAM type: YTN; PAM sequence: CTC
ggaaaacactgcatggtgtc

SEQ ID NO: 93764 - DNA, 20 bp, Artificial Sequence
  Description of Artificial Sequence: Synthetic oligonucleotide
  Target: SCN9A; (+) strand; PAM type: YTN; PAM sequence: CTG
catggtgtctttcatattaa

SEQ ID NO: 93765 - DNA, 20 bp, Artificial Sequence
  Description of Artificial Sequence: Synthetic oligonucleotide
  Target: SCN9A; (+) strand; PAM type: YTN; PAM sequence: CTT
tcatattaaattaaaaagtg

SEQ ID NO: 93766 - DNA, 20 bp, Artificial Sequence
  Description of Artificial Sequence: Synthetic oligonucleotide
  Target: SCN9A; (+) strand; PAM type: YTN; PAM sequence: TTT
catattaaattaaaaagtgg

SEQ ID NO: 93767 - DNA, 20 bp, Artificial Sequence
  Description of Artificial Sequence: Synthetic oligonucleotide
  Target: SCN9A; (+) strand; PAM type: YTN; PAM sequence: TTC
atattaaattaaaaagtggt

SEQ ID NO: 93768 - DNA, 20 bp, Artificial Sequence
  Description of Artificial Sequence: Synthetic oligonucleotide
  Target: SCN9A; (+) strand; PAM type: YTN; PAM sequence: TTA
aattaaaaagtggttcaaat

SEQ ID NO: 93769 - DNA, 20 bp, Artificial Sequence
  Description of Artificial Sequence: Synthetic oligonucleotide
  Target: SCN9A; (+) strand; PAM type: YTN; PAM sequence: TTA
aaaagtggttcaaatagcct

SEQ ID NO: 93770 - DNA, 20 bp, Artificial Sequence
  Description of Artificial Sequence: Synthetic oligonucleotide
  Target: SCN9A; (+) strand; PAM type: YTN; PAM sequence: TTC
aaatagcctaagatgaatga

SEQ ID NO: 93771 - DNA, 20 bp, Artificial Sequence
  Description of Artificial Sequence: Synthetic oligonucleotide
  Target: SCN9A; (+) strand; PAM type: YTN; PAM sequence: CTA
agatgaatgaacctaagatg

SEQ ID NO: 93772 - DNA, 20 bp, Artificial Sequence
  Description of Artificial Sequence: Synthetic oligonucleotide
  Target: SCN9A; (+) strand; PAM type: YTN; PAM sequence: CTA
agatggtataaagaatcttt

SEQ ID NO: 93773 - DNA, 20 bp, Artificial Sequence
  Description of Artificial Sequence: Synthetic oligonucleotide
  Target: SCN9A; (+) strand; PAM type: YTN; PAM sequence: CTT
tagccctagattgagtttta

SEQ ID NO: 93774 - DNA, 20 bp, Artificial Sequence
  Description of Artificial Sequence: Synthetic oligonucleotide
  Target: SCN9A; (+) strand; PAM type: YTN; PAM sequence: TTT
agccctagattgagttttat

SEQ ID NO: 93775 - DNA, 20 bp, Artificial Sequence
  Description of Artificial Sequence: Synthetic oligonucleotide
  Target: SCN9A; (+) strand; PAM type: YTN; PAM sequence: TTA
gccctagattgagttttata

SEQ ID NO: 93776 - DNA, 20 bp, Artificial Sequence
  Description of Artificial Sequence: Synthetic oligonucleotide
  Target: SCN9A; (+) strand; PAM type: YTN; PAM sequence: CTA
gattgagttttatacgtaga

SEQ ID NO: 93777 - DNA, 20 bp, Artificial Sequence
  Description of Artificial Sequence: Synthetic oligonucleotide
  Target: SCN9A; (+) strand; PAM type: YTN; PAM sequence: TTG
agttttatacgtagattagg

SEQ ID NO: 93778 - DNA, 20 bp, Artificial Sequence
  Description of Artificial Sequence: Synthetic oligonucleotide
  Target: SCN9A; (+) strand; PAM type: YTN; PAM sequence: TTT
tatacgtagattaggacaaa

SEQ ID NO: 93779 - DNA, 20 bp, Artificial Sequence
  Description of Artificial Sequence: Synthetic oligonucleotide
  Target: SCN9A; (+) strand; PAM type: YTN; PAM sequence: TTT
atacgtagattaggacaaat

SEQ ID NO: 93780 - DNA, 20 bp, Artificial Sequence
  Description of Artificial Sequence: Synthetic oligonucleotide
  Target: SCN9A; (+) strand; PAM type: YTN; PAM sequence: TTA
tacgtagattaggacaaatg

SEQ ID NO: 93781 - DNA, 20 bp, Artificial Sequence
  Description of Artificial Sequence: Synthetic oligonucleotide
  Target: SCN9A; (+) strand; PAM type: YTN; PAM sequence: TTA
ggacaaatgtctcaaagtaa

SEQ ID NO: 93782 - DNA, 20 bp, Artificial Sequence
  Description of Artificial Sequence: Synthetic oligonucleotide
  Target: SCN9A; (+) strand; PAM type: YTN; PAM sequence: CTC
aaagtaataacggatgttgt

SEQ ID NO: 93783 - DNA, 20 bp, Artificial Sequence
  Description of Artificial Sequence: Synthetic oligonucleotide
  Target: SCN9A; (+) strand; PAM type: YTN; PAM sequence: TTG
taaaatatatcacaatttaa

SEQ ID NO: 93784 - DNA, 20 bp, Artificial Sequence
  Description of Artificial Sequence: Synthetic oligonucleotide
  Target: SCN9A; (+) strand; PAM type: YTN; PAM sequence: TTT
aaaaacattctagacttctg

SEQ ID NO: 93785 - DNA, 20 bp, Artificial Sequence
  Description of Artificial Sequence: Synthetic oligonucleotide
  Target: SCN9A; (+) strand; PAM type: YTN; PAM sequence: TTA
aaaacattctagacttctga

SEQ ID NO: 93786 - DNA, 20 bp, Artificial Sequence
  Description of Artificial Sequence: Synthetic oligonucleotide
  Target: SCN9A; (+) strand; PAM type: YTN; PAM sequence: TTC
tagacttctgatctcattct

SEQ ID NO: 93787 - DNA, 20 bp, Artificial Sequence
  Description of Artificial Sequence: Synthetic oligonucleotide
  Target: SCN9A; (+) strand; PAM type: YTN; PAM sequence: CTA
gacttctgatctcattcttt

SEQ ID NO: 93788 - DNA, 20 bp, Artificial Sequence
  Description of Artificial Sequence: Synthetic oligonucleotide
  Target: SCN9A; (+) strand; PAM type: YTN; PAM sequence: CTT
ctgatctcattctttaacca

SEQ ID NO: 93789 - DNA, 20 bp, Artificial Sequence
  Description of Artificial Sequence: Synthetic oligonucleotide
  Target: SCN9A; (+) strand; PAM type: YTN; PAM sequence: TTC
tgatctcattctttaaccat

SEQ ID NO: 93790 - DNA, 20 bp, Artificial Sequence
  Description of Artificial Sequence: Synthetic oligonucleotide
  Target: SCN9A; (+) strand; PAM type: YTN; PAM sequence: CTG
atctcattctttaaccataa

SEQ ID NO: 93791 - DNA, 20 bp, Artificial Sequence
  Description of Artificial Sequence: Synthetic oligonucleotide
  Target: SCN9A; (+) strand; PAM type: YTN; PAM sequence: CTC
attctttaaccataaatctt

SEQ ID NO: 93792 - DNA, 20 bp, Artificial Sequence
  Description of Artificial Sequence: Synthetic oligonucleotide
  Target: SCN9A; (+) strand; PAM type: YTN; PAM sequence: TTC
tttaaccataaatctttgtt

SEQ ID NO: 93793 - DNA, 20 bp, Artificial Sequence
  Description of Artificial Sequence: Synthetic oligonucleotide
  Target: SCN9A; (+) strand; PAM type: YTN; PAM sequence: CTT
taaccataaatctttgtttc

SEQ ID NO: 93794 - DNA, 20 bp, Artificial Sequence
  Description of Artificial Sequence: Synthetic oligonucleotide
  Target: SCN9A; (+) strand; PAM type: YTN; PAM sequence: TTT
aaccataaatctttgtttct

SEQ ID NO: 93795 - DNA, 20 bp, Artificial Sequence
  Description of Artificial Sequence: Synthetic oligonucleotide
  Target: SCN9A; (+) strand; PAM type: YTN; PAM sequence: TTA
accataaatctttgtttcta

SEQ ID NO: 93796 - DNA, 20 bp, Artificial Sequence
  Description of Artificial Sequence: Synthetic oligonucleotide
  Target: SCN9A; (+) strand; PAM type: YTN; PAM sequence: CTT
tgtttctataggtacgttta

SEQ ID NO: 93797 - DNA, 20 bp, Artificial Sequence
  Description of Artificial Sequence: Synthetic oligonucleotide
  Target: SCN9A; (+) strand; PAM type: YTN; PAM sequence: TTT
gtttctataggtacgtttaa

SEQ ID NO: 93798 - DNA, 20 bp, Artificial Sequence
  Description of Artificial Sequence: Synthetic oligonucleotide
  Target: SCN9A; (+) strand; PAM type: YTN; PAM sequence: TTG
tttctataggtacgtttaaa

SEQ ID NO: 93799 - DNA, 20 bp, Artificial Sequence
  Description of Artificial Sequence: Synthetic oligonucleotide
  Target: SCN9A; (+) strand; PAM type: YTN; PAM sequence: TTT
ctataggtacgtttaaatcc

SEQ ID NO: 93800 - DNA, 20 bp, Artificial Sequence
  Description of Artificial Sequence: Synthetic oligonucleotide
  Target: SCN9A; (+) strand; PAM type: YTN; PAM sequence: TTC
tataggtacgtttaaatcct

SEQ ID NO: 93801 - DNA, 20 bp, Artificial Sequence
  Description of Artificial Sequence: Synthetic oligonucleotide
  Target: SCN9A; (+) strand; PAM type: YTN; PAM sequence: CTA
taggtacgtttaaatcctct

SEQ ID NO: 93802 - DNA, 20 bp, Artificial Sequence
  Description of Artificial Sequence: Synthetic oligonucleotide
  Target: SCN9A; (+) strand; PAM type: YTN; PAM sequence: TTT
aaatcctctttctttttaaa

SEQ ID NO: 93803 - DNA, 20 bp, Artificial Sequence
  Description of Artificial Sequence: Synthetic oligonucleotide
  Target: SCN9A; (+) strand; PAM type: YTN; PAM sequence: TTA
aatcctctttctttttaaat

SEQ ID NO: 93804 - DNA, 20 bp, Artificial Sequence
  Description of Artificial Sequence: Synthetic oligonucleotide
  Target: SCN9A; (+) strand; PAM type: YTN; PAM sequence: CTC
tttctttttaaattgccaga

SEQ ID NO: 93805 - DNA, 20 bp, Artificial Sequence
  Description of Artificial Sequence: Synthetic oligonucleotide
  Target: SCN9A; (+) strand; PAM type: YTN; PAM sequence: CTT
tctttttaaattgccagaac

SEQ ID NO: 93806 - DNA, 20 bp, Artificial Sequence
  Description of Artificial Sequence: Synthetic oligonucleotide
  Target: SCN9A; (+) strand; PAM type: YTN; PAM sequence: TTT
ctttttaaattgccagaaca

SEQ ID NO: 93807 - DNA, 20 bp, Artificial Sequence
  Description of Artificial Sequence: Synthetic oligonucleotide
  Target: SCN9A; (+) strand; PAM type: YTN; PAM sequence: TTC
tttttaaattgccagaacaa

SEQ ID NO: 93808 - DNA, 20 bp, Artificial Sequence
  Description of Artificial Sequence: Synthetic oligonucleotide
  Target: SCN9A; (+) strand; PAM type: YTN; PAM sequence: CTT
tttaaattgccagaacaaca

SEQ ID NO: 93809 - DNA, 20 bp, Artificial Sequence
  Description of Artificial Sequence: Synthetic oligonucleotide
  Target: SCN9A; (+) strand; PAM type: YTN; PAM sequence: TTT
ttaaattgccagaacaacaa

SEQ ID NO: 93810 - DNA, 20 bp, Artificial Sequence
  Description of Artificial Sequence: Synthetic oligonucleotide
  Target: SCN9A; (+) strand; PAM type: YTN; PAM sequence: TTT
taaattgccagaacaacaaa

SEQ ID NO: 93811 - DNA, 20 bp, Artificial Sequence
  Description of Artificial Sequence: Synthetic oligonucleotide
  Target: SCN9A; (+) strand; PAM type: YTN; PAM sequence: TTT
aaattgccagaacaacaaaa

SEQ ID NO: 93812 - DNA, 20 bp, Artificial Sequence
  Description of Artificial Sequence: Synthetic oligonucleotide
  Target: SCN9A; (+) strand; PAM type: YTN; PAM sequence: TTA
aattgccagaacaacaaaaa

SEQ ID NO: 93813 - DNA, 20 bp, Artificial Sequence
  Description of Artificial Sequence: Synthetic oligonucleotide
  Target: SCN9A; (+) strand; PAM type: YTN; PAM sequence: TTG
ccagaacaacaaaaaatatg

SEQ ID NO: 93814 - DNA, 20 bp, Artificial Sequence
  Description of Artificial Sequence: Synthetic oligonucleotide
  Target: SCN9A; (+) strand; PAM type: YTN; PAM sequence: CTT
taaacatttattatataaat

SEQ ID NO: 93815 - DNA, 20 bp, Artificial Sequence
  Description of Artificial Sequence: Synthetic oligonucleotide
  Target: SCN9A; (+) strand; PAM type: YTN; PAM sequence: TTT
aaacatttattatataaatg

SEQ ID NO: 93816 - DNA, 20 bp, Artificial Sequence
  Description of Artificial Sequence: Synthetic oligonucleotide
  Target: SCN9A; (+) strand; PAM type: YTN; PAM sequence: TTA
aacatttattatataaatgt

SEQ ID NO: 93817 - DNA, 20 bp, Artificial Sequence
  Description of Artificial Sequence: Synthetic oligonucleotide
  Target: SCN9A; (+) strand; PAM type: YTN; PAM sequence: TTT
attatataaatgtaatttat

SEQ ID NO: 93818 - DNA, 20 bp, Artificial Sequence
  Description of Artificial Sequence: Synthetic oligonucleotide
  Target: SCN9A; (+) strand; PAM type: YTN; PAM sequence: TTA
ttatataaatgtaatttatt

SEQ ID NO: 93819 - DNA, 20 bp, Artificial Sequence
  Description of Artificial Sequence: Synthetic oligonucleotide
  Target: SCN9A; (+) strand; PAM type: YTN; PAM sequence: TTA
tataaatgtaatttattatt

SEQ ID NO: 93820 - DNA, 20 bp, Artificial Sequence
  Description of Artificial Sequence: Synthetic oligonucleotide
  Target: SCN9A; (+) strand; PAM type: YTN; PAM sequence: TTT
attattttttaaatatggaa

SEQ ID NO: 93821 - DNA, 20 bp, Artificial Sequence
  Description of Artificial Sequence: Synthetic oligonucleotide
  Target: SCN9A; (+) strand; PAM type: YTN; PAM sequence: TTA
ttattttttaaatatggaaa

SEQ ID NO: 93822 - DNA, 20 bp, Artificial Sequence
  Description of Artificial Sequence: Synthetic oligonucleotide
  Target: SCN9A; (+) strand; PAM type: YTN; PAM sequence: TTA
ttttttaaatatggaaagca

SEQ ID NO: 93823 - DNA, 20 bp, Artificial Sequence
  Description of Artificial Sequence: Synthetic oligonucleotide
  Target: SCN9A; (+) strand; PAM type: YTN; PAM sequence: TTT
tttaaatatggaaagcaaat

SEQ ID NO: 93824 - DNA, 20 bp, Artificial Sequence
  Description of Artificial Sequence: Synthetic oligonucleotide
  Target: SCN9A; (+) strand; PAM type: YTN; PAM sequence: TTT
ttaaatatggaaagcaaatt

SEQ ID NO: 93825 - DNA, 20 bp, Artificial Sequence
  Description of Artificial Sequence: Synthetic oligonucleotide
  Target: SCN9A; (+) strand; PAM type: YTN; PAM sequence: TTT
taaatatggaaagcaaatta

SEQ ID NO: 93826 - DNA, 20 bp, Artificial Sequence
  Description of Artificial Sequence: Synthetic oligonucleotide
  Target: SCN9A; (+) strand; PAM type: YTN; PAM sequence: TTT
aaatatggaaagcaaattag

SEQ ID NO: 93827 - DNA, 20 bp, Artificial Sequence
  Description of Artificial Sequence: Synthetic oligonucleotide
  Target: SCN9A; (+) strand; PAM type: YTN; PAM sequence: TTA
aatatggaaagcaaattagt

SEQ ID NO: 93828 - DNA, 20 bp, Artificial Sequence
  Description of Artificial Sequence: Synthetic oligonucleotide
  Target: SCN9A; (+) strand; PAM type: YTN; PAM sequence: TTA
gtgaaagttgttttatatat

SEQ ID NO: 93829 - DNA, 20 bp, Artificial Sequence
  Description of Artificial Sequence: Synthetic oligonucleotide
  Target: SCN9A; (+) strand; PAM type: YTN; PAM sequence: TTG
ttttatatatttgcttcaaa

SEQ ID NO: 93830 - DNA, 20 bp, Artificial Sequence
  Description of Artificial Sequence: Synthetic oligonucleotide
  Target: SCN9A; (+) strand; PAM type: YTN; PAM sequence: TTT
tatatatttgcttcaaaacc

SEQ ID NO: 93831 - DNA, 20 bp, Artificial Sequence
  Description of Artificial Sequence: Synthetic oligonucleotide
  Target: SCN9A; (+) strand; PAM type: YTN; PAM sequence: TTT
atatatttgcttcaaaacct

SEQ ID NO: 93832 - DNA, 20 bp, Artificial Sequence
  Description of Artificial Sequence: Synthetic oligonucleotide
  Target: SCN9A; (+) strand; PAM type: YTN; PAM sequence: TTA
tatatttgcttcaaaacctc

SEQ ID NO: 93833 - DNA, 20 bp, Artificial Sequence
  Description of Artificial Sequence: Synthetic oligonucleotide
  Target: SCN9A; (+) strand; PAM type: YTN; PAM sequence: TTT
gcttcaaaacctcccacaaa

SEQ ID NO: 93834 - DNA, 20 bp, Artificial Sequence
  Description of Artificial Sequence: Synthetic oligonucleotide
  Target: SCN9A; (+) strand; PAM type: YTN; PAM sequence: TTG
cttcaaaacctcccacaaaa

SEQ ID NO: 93835 - DNA, 20 bp, Artificial Sequence
  Description of Artificial Sequence: Synthetic oligonucleotide
  Target: SCN9A; (+) strand; PAM type: YTN; PAM sequence: CTT
caaaacctcccacaaaaatc

SEQ ID NO: 93836 - DNA, 20 bp, Artificial Sequence
  Description of Artificial Sequence: Synthetic oligonucleotide
  Target: SCN9A; (+) strand; PAM type: YTN; PAM sequence: TTC
aaaacctcccacaaaaatct

SEQ ID NO: 93837 - DNA, 20 bp, Artificial Sequence
  Description of Artificial Sequence: Synthetic oligonucleotide
  Target: SCN9A; (+) strand; PAM type: YTN; PAM sequence: CTC
ccacaaaaatcttctaagta

SEQ ID NO: 93838 - DNA, 20 bp, Artificial Sequence
  Description of Artificial Sequence: Synthetic oligonucleotide
  Target: SCN9A; (+) strand; PAM type: YTN; PAM sequence: CTT
ctaagtaaaactacattcta

SEQ ID NO: 93839 - DNA, 20 bp, Artificial Sequence
  Description of Artificial Sequence: Synthetic oligonucleotide
  Target: SCN9A; (+) strand; PAM type: YTN; PAM sequence: TTC
taagtaaaactacattctac

SEQ ID NO: 93840 - DNA, 20 bp, Artificial Sequence
  Description of Artificial Sequence: Synthetic oligonucleotide
  Target: SCN9A; (+) strand; PAM type: YTN; PAM sequence: CTA
agtaaaactacattctacct

SEQ ID NO: 93841 - DNA, 20 bp, Artificial Sequence
  Description of Artificial Sequence: Synthetic oligonucleotide
  Target: SCN9A; (+) strand; PAM type: YTN; PAM sequence: CTA
cattctacctgtgtagctca

SEQ ID NO: 93842 - DNA, 20 bp, Artificial Sequence
  Description of Artificial Sequence: Synthetic oligonucleotide
  Target: SCN9A; (+) strand; PAM type: YTN; PAM sequence: TTC
tacctgtgtagctcaatttt

SEQ ID NO: 93843 - DNA, 20 bp, Artificial Sequence
  Description of Artificial Sequence: Synthetic oligonucleotide
  Target: SCN9A; (+) strand; PAM type: YTN; PAM sequence: CTA
cctgtgtagctcaatttttg

SEQ ID NO: 93844 - DNA, 20 bp, Artificial Sequence
  Description of Artificial Sequence: Synthetic oligonucleotide
  Target: SCN9A; (+) strand; PAM type: YTN; PAM sequence: CTG
tgtagctcaatttttgcctg

SEQ ID NO: 93845 - DNA, 20 bp, Artificial Sequence
  Description of Artificial Sequence: Synthetic oligonucleotide
  Target: SCN9A; (+) strand; PAM type: YTN; PAM sequence: CTC
aatttttgcctgtgcatgaa

SEQ ID NO: 93846 - DNA, 20 bp, Artificial Sequence
  Description of Artificial Sequence: Synthetic oligonucleotide
  Target: SCN9A; (+) strand; PAM type: YTN; PAM sequence: TTT
ttgcctgtgcatgaataact

SEQ ID NO: 93847 - DNA, 20 bp, Artificial Sequence
  Description of Artificial Sequence: Synthetic oligonucleotide
  Target: SCN9A; (+) strand; PAM type: YTN; PAM sequence: TTT
tgcctgtgcatgaataactt

SEQ ID NO: 93848 - DNA, 20 bp, Artificial Sequence
  Description of Artificial Sequence: Synthetic oligonucleotide
  Target: SCN9A; (+) strand; PAM type: YTN; PAM sequence: TTT
gcctgtgcatgaataacttt

SEQ ID NO: 93849 - DNA, 20 bp, Artificial Sequence
  Description of Artificial Sequence: Synthetic oligonucleotide
  Target: SCN9A; (+) strand; PAM type: YTN; PAM sequence: TTG
cctgtgcatgaataacttta

SEQ ID NO: 93850 - DNA, 20 bp, Artificial Sequence
  Description of Artificial Sequence: Synthetic oligonucleotide
  Target: SCN9A; (+) strand; PAM type: YTN; PAM sequence: CTG
tgcatgaataactttataga

SEQ ID NO: 93851 - DNA, 20 bp, Artificial Sequence
  Description of Artificial Sequence: Synthetic oligonucleotide
  Target: SCN9A; (+) strand; PAM type: YTN; PAM sequence: CTT
tatagaagaaagatctcata

SEQ ID NO: 93852 - DNA, 20 bp, Artificial Sequence
  Description of Artificial Sequence: Synthetic oligonucleotide
  Target: SCN9A; (+) strand; PAM type: YTN; PAM sequence: TTT
atagaagaaagatctcatat

SEQ ID NO: 93853 - DNA, 20 bp, Artificial Sequence
  Description of Artificial Sequence: Synthetic oligonucleotide
  Target: SCN9A; (+) strand; PAM type: YTN; PAM sequence: TTA
tagaagaaagatctcatatt

SEQ ID NO: 93854 - DNA, 20 bp, Artificial Sequence
  Description of Artificial Sequence: Synthetic oligonucleotide
  Target: SCN9A; (+) strand; PAM type: YTN; PAM sequence: CTC
atattcctgaaataaactca

SEQ ID NO: 93855 - DNA, 20 bp, Artificial Sequence
  Description of Artificial Sequence: Synthetic oligonucleotide
  Target: SCN9A; (+) strand; PAM type: YTN; PAM sequence: TTC
ctgaaataaactcacgaaaa

SEQ ID NO: 93856 - DNA, 20 bp, Artificial Sequence
  Description of Artificial Sequence: Synthetic oligonucleotide
  Target: SCN9A; (+) strand; PAM type: YTN; PAM sequence: CTG
aaataaactcacgaaaaaaa

SEQ ID NO: 93857 - DNA, 20 bp, Artificial Sequence
  Description of Artificial Sequence: Synthetic oligonucleotide
  Target: SCN9A; (+) strand; PAM type: YTN; PAM sequence: CTC
acgaaaaaaagcattatggt

SEQ ID NO: 93858 - DNA, 20 bp, Artificial Sequence
  Description of Artificial Sequence: Synthetic oligonucleotide
  Target: SCN9A; (+) strand; PAM type: YTN; PAM sequence: TTA
tggttatttcttttcaaatt

SEQ ID NO: 93859 - DNA, 20 bp, Artificial Sequence
  Description of Artificial Sequence: Synthetic oligonucleotide
  Target: SCN9A; (+) strand; PAM type: YTN; PAM sequence: TTA
tttcttttcaaattactatt

SEQ ID NO: 93860 - DNA, 20 bp, Artificial Sequence
  Description of Artificial Sequence: Synthetic oligonucleotide
  Target: SCN9A; (+) strand; PAM type: YTN; PAM sequence: TTT
cttttcaaattactattaat

SEQ ID NO: 93861 - DNA, 20 bp, Artificial Sequence
  Description of Artificial Sequence: Synthetic oligonucleotide
  Target: SCN9A; (+) strand; PAM type: YTN; PAM sequence: TTC
ttttcaaattactattaata

SEQ ID NO: 93862 - DNA, 20 bp, Artificial Sequence
  Description of Artificial Sequence: Synthetic oligonucleotide
  Target: SCN9A; (+) strand; PAM type: YTN; PAM sequence: CTT
ttcaaattactattaatagg

SEQ ID NO: 93863 - DNA, 20 bp, Artificial Sequence
  Description of Artificial Sequence: Synthetic oligonucleotide
  Target: SCN9A; (+) strand; PAM type: YTN; PAM sequence: TTT
tcaaattactattaataggt

SEQ ID NO: 93864 - DNA, 20 bp, Artificial Sequence
  Description of Artificial Sequence: Synthetic oligonucleotide
  Target: SCN9A; (+) strand; PAM type: YTN; PAM sequence: TTT
caaattactattaataggtg

SEQ ID NO: 93865 - DNA, 20 bp, Artificial Sequence
  Description of Artificial Sequence: Synthetic oligonucleotide
  Target: SCN9A; (+) strand; PAM type: YTN; PAM sequence: TTC
aaattactattaataggtgt

SEQ ID NO: 93866 - DNA, 20 bp, Artificial Sequence
  Description of Artificial Sequence: Synthetic oligonucleotide
  Target: SCN9A; (+) strand; PAM type: YTN; PAM sequence: TTA
ctattaataggtgttttcaa

SEQ ID NO: 93867 - DNA, 20 bp, Artificial Sequence
  Description of Artificial Sequence: Synthetic oligonucleotide
  Target: SCN9A; (+) strand; PAM type: YTN; PAM sequence: CTA
ttaataggtgttttcaaaaa

SEQ ID NO: 93868 - DNA, 20 bp, Artificial Sequence
  Description of Artificial Sequence: Synthetic oligonucleotide
  Target: SCN9A; (+) strand; PAM type: YTN; PAM sequence: TTA
ataggtgttttcaaaaaact

SEQ ID NO: 93869 - DNA, 20 bp, Artificial Sequence
  Description of Artificial Sequence: Synthetic oligonucleotide
  Target: SCN9A; (+) strand; PAM type: YTN; PAM sequence: TTT
tcaaaaaactagatgtctac

SEQ ID NO: 93870 - DNA, 20 bp, Artificial Sequence
  Description of Artificial Sequence: Synthetic oligonucleotide
  Target: SCN9A; (+) strand; PAM type: YTN; PAM sequence: TTT
caaaaaactagatgtctaca

SEQ ID NO: 93871 - DNA, 20 bp, Artificial Sequence
  Description of Artificial Sequence: Synthetic oligonucleotide
  Target: SCN9A; (+) strand; PAM type: YTN; PAM sequence: TTC
aaaaaactagatgtctacag

SEQ ID NO: 93872 - DNA, 20 bp, Artificial Sequence
  Description of Artificial Sequence: Synthetic oligonucleotide
  Target: SCN9A; (+) strand; PAM type: YTN; PAM sequence: CTA
gatgtctacagctaatgcaa

SEQ ID NO: 93873 - DNA, 20 bp, Artificial Sequence
  Description of Artificial Sequence: Synthetic oligonucleotide
  Target: SCN9A; (+) strand; PAM type: YTN; PAM sequence: CTA
cagctaatgcaaaatgaata

SEQ ID NO: 93874 - DNA, 20 bp, Artificial Sequence
  Description of Artificial Sequence: Synthetic oligonucleotide
  Target: SCN9A; (+) strand; PAM type: YTN; PAM sequence: CTA
atgcaaaatgaatatgtgct

SEQ ID NO: 93875 - DNA, 20 bp, Artificial Sequence
  Description of Artificial Sequence: Synthetic oligonucleotide
  Target: SCN9A; (+) strand; PAM type: YTN; PAM sequence: CTT
gataaattagaagcccatgg

SEQ ID NO: 93876 - DNA, 20 bp, Artificial Sequence
  Description of Artificial Sequence: Synthetic oligonucleotide
  Target: SCN9A; (+) strand; PAM type: YTN; PAM sequence: TTG
ataaattagaagcccatggt

SEQ ID NO: 93877 - DNA, 20 bp, Artificial Sequence
  Description of Artificial Sequence: Synthetic oligonucleotide
  Target: SCN9A; (+) strand; PAM type: YTN; PAM sequence: TTA
gaagcccatggtactgtgtt

SEQ ID NO: 93878 - DNA, 20 bp, Artificial Sequence
  Description of Artificial Sequence: Synthetic oligonucleotide
  Target: SCN9A; (+) strand; PAM type: YTN; PAM sequence: CTG
tgttgattgaggcaaaatat

SEQ ID NO: 93879 - DNA, 20 bp, Artificial Sequence
  Description of Artificial Sequence: Synthetic oligonucleotide
  Target: SCN9A; (+) strand; PAM type: YTN; PAM sequence: TTG
attgaggcaaaatatatttc

SEQ ID NO: 93880 - DNA, 20 bp, Artificial Sequence
  Description of Artificial Sequence: Synthetic oligonucleotide
  Target: SCN9A; (+) strand; PAM type: YTN; PAM sequence: TTG
aggcaaaatatatttcacat

SEQ ID NO: 93881 - DNA, 20 bp, Artificial Sequence
  Description of Artificial Sequence: Synthetic oligonucleotide
  Target: SCN9A; (+) strand; PAM type: YTN; PAM sequence: TTT
cacatcatagaattttaagg

SEQ ID NO: 93882 - DNA, 20 bp, Artificial Sequence
  Description of Artificial Sequence: Synthetic oligonucleotide
  Target: SCN9A; (+) strand; PAM type: YTN; PAM sequence: TTC
acatcatagaattttaagga

SEQ ID NO: 93883 - DNA, 20 bp, Artificial Sequence
  Description of Artificial Sequence: Synthetic oligonucleotide
  Target: SCN9A; (+) strand; PAM type: YTN; PAM sequence: TTT
taaggagaaggtgacatctt

SEQ ID NO: 93884 - DNA, 20 bp, Artificial Sequence
  Description of Artificial Sequence: Synthetic oligonucleotide
  Target: SCN9A; (+) strand; PAM type: YTN; PAM sequence: TTT
aaggagaaggtgacatcttc

SEQ ID NO: 93885 - DNA, 20 bp, Artificial Sequence
  Description of Artificial Sequence: Synthetic oligonucleotide
  Target: SCN9A; (+) strand; PAM type: YTN; PAM sequence: TTA
aggagaaggtgacatcttcc

SEQ ID NO: 93886 - DNA, 20 bp, Artificial Sequence
  Description of Artificial Sequence: Synthetic oligonucleotide
  Target: SCN9A; (+) strand; PAM type: YTN; PAM sequence: CTT
cctcattgtatacattgaag

SEQ ID NO: 93887 - DNA, 20 bp, Artificial Sequence
  Description of Artificial Sequence: Synthetic oligonucleotide
  Target: SCN9A; (+) strand; PAM type: YTN; PAM sequence: TTC
ctcattgtatacattgaagt

SEQ ID NO: 93888 - DNA, 20 bp, Artificial Sequence
  Description of Artificial Sequence: Synthetic oligonucleotide
  Target: SCN9A; (+) strand; PAM type: YTN; PAM sequence: CTC
attgtatacattgaagtata

SEQ ID NO: 93889 - DNA, 20 bp, Artificial Sequence
  Description of Artificial Sequence: Synthetic oligonucleotide
  Target: SCN9A; (+) strand; PAM type: YTN; PAM sequence: TTG
tatacattgaagtatatcca

SEQ ID NO: 93890 - DNA, 20 bp, Artificial Sequence
  Description of Artificial Sequence: Synthetic oligonucleotide
  Target: SCN9A; (+) strand; PAM type: YTN; PAM sequence: TTG
aagtatatccaaaaaagatt

SEQ ID NO: 93891 - DNA, 20 bp, Artificial Sequence
  Description of Artificial Sequence: Synthetic oligonucleotide
  Target: SCN9A; (+) strand; PAM type: YTN; PAM sequence: TTA
cttccataatttaggaaagt

SEQ ID NO: 93892 - DNA, 20 bp, Artificial Sequence
  Description of Artificial Sequence: Synthetic oligonucleotide
  Target: SCN9A; (+) strand; PAM type: YTN; PAM sequence: CTT
ccataatttaggaaagtaag

SEQ ID NO: 93893 - DNA, 20 bp, Artificial Sequence
  Description of Artificial Sequence: Synthetic oligonucleotide
  Target: SCN9A; (+) strand; PAM type: YTN; PAM sequence: TTC
cataatttaggaaagtaagt

SEQ ID NO: 93894 - DNA, 20 bp, Artificial Sequence
  Description of Artificial Sequence: Synthetic oligonucleotide
  Target: SCN9A; (+) strand; PAM type: YTN; PAM sequence: TTT
aggaaagtaagttggtggca

SEQ ID NO: 93895 - DNA, 20 bp, Artificial Sequence
  Description of Artificial Sequence: Synthetic oligonucleotide
  Target: SCN9A; (+) strand; PAM type: YTN; PAM sequence: TTA
ggaaagtaagttggtggcaa

SEQ ID NO: 93896 - DNA, 20 bp, Artificial Sequence
  Description of Artificial Sequence: Synthetic oligonucleotide
  Target: SCN9A; (+) strand; PAM type: YTN; PAM sequence: TTG
gtggcaagagagcaagttgg

SEQ ID NO: 93897 - DNA, 20 bp, Artificial Sequence
  Description of Artificial Sequence: Synthetic oligonucleotide
  Target: SCN9A; (+) strand; PAM type: YTN; PAM sequence: TTG
gcaagaatccctatttcaat

SEQ ID NO: 93898 - DNA, 20 bp, Artificial Sequence
  Description of Artificial Sequence: Synthetic oligonucleotide
  Target: SCN9A; (+) strand; PAM type: YTN; PAM sequence: CTA
tttcaatgcttttttattca

SEQ ID NO: 93899 - DNA, 20 bp, Artificial Sequence
  Description of Artificial Sequence: Synthetic oligonucleotide
  Target: SCN9A; (+) strand; PAM type: YTN; PAM sequence: TTT
caatgcttttttattcatac

SEQ ID NO: 93900 - DNA, 20 bp, Artificial Sequence
  Description of Artificial Sequence: Synthetic oligonucleotide
  Target: SCN9A; (+) strand; PAM type: YTN; PAM sequence: TTC
aatgcttttttattcatact

SEQ ID NO: 93901 - DNA, 20 bp, Artificial Sequence
  Description of Artificial Sequence: Synthetic oligonucleotide
  Target: SCN9A; (+) strand; PAM type: YTN; PAM sequence: CTT
ttttattcatactaaacaca

SEQ ID NO: 93902 - DNA, 20 bp, Artificial Sequence
  Description of Artificial Sequence: Synthetic oligonucleotide
  Target: SCN9A; (+) strand; PAM type: YTN; PAM sequence: TTT
tttattcatactaaacacat

SEQ ID NO: 93903 - DNA, 20 bp, Artificial Sequence
  Description of Artificial Sequence: Synthetic oligonucleotide
  Target: SCN9A; (+) strand; PAM type: YTN; PAM sequence: TTT
ttattcatactaaacacata

SEQ ID NO: 93904 - DNA, 20 bp, Artificial Sequence
  Description of Artificial Sequence: Synthetic oligonucleotide
  Target: SCN9A; (+) strand; PAM type: YTN; PAM sequence: TTT
tattcatactaaacacatat

SEQ ID NO: 93905 - DNA, 20 bp, Artificial Sequence
  Description of Artificial Sequence: Synthetic oligonucleotide
  Target: SCN9A; (+) strand; PAM type: YTN; PAM sequence: TTT
attcatactaaacacatatc

SEQ ID NO: 93906 - DNA, 20 bp, Artificial Sequence
  Description of Artificial Sequence: Synthetic oligonucleotide
  Target: SCN9A; (+) strand; PAM type: YTN; PAM sequence: TTA
ttcatactaaacacatatct

SEQ ID NO: 93907 - DNA, 20 bp, Artificial Sequence
  Description of Artificial Sequence: Synthetic oligonucleotide
  Target: SCN9A; (+) strand; PAM type: YTN; PAM sequence: TTC
atactaaacacatatctgtg

SEQ ID NO: 93908 - DNA, 20 bp, Artificial Sequence
  Description of Artificial Sequence: Synthetic oligonucleotide
  Target: SCN9A; (+) strand; PAM type: YTN; PAM sequence: CTA
aacacatatctgtgtaaagt

SEQ ID NO: 93909 - DNA, 20 bp, Artificial Sequence
  Description of Artificial Sequence: Synthetic oligonucleotide
  Target: SCN9A; (+) strand; PAM type: YTN; PAM sequence: CTG
tgtaaagtctgtcatattac

SEQ ID NO: 93910 - DNA, 20 bp, Artificial Sequence
  Description of Artificial Sequence: Synthetic oligonucleotide
  Target: SCN9A; (+) strand; PAM type: YTN; PAM sequence: CTG
tcatattacatgatttgaaa

SEQ ID NO: 93911 - DNA, 20 bp, Artificial Sequence
  Description of Artificial Sequence: Synthetic oligonucleotide
  Target: SCN9A; (+) strand; PAM type: YTN; PAM sequence: TTA
catgatttgaaagcttgcca

SEQ ID NO: 93912 - DNA, 20 bp, Artificial Sequence
  Description of Artificial Sequence: Synthetic oligonucleotide
  Target: SCN9A; (+) strand; PAM type: YTN; PAM sequence: TTT
gaaagcttgccaaacacggg

SEQ ID NO: 93913 - DNA, 20 bp, Artificial Sequence
  Description of Artificial Sequence: Synthetic oligonucleotide
  Target: SCN9A; (+) strand; PAM type: YTN; PAM sequence: TTG
aaagcttgccaaacacggga

SEQ ID NO: 93914 - DNA, 20 bp, Artificial Sequence
  Description of Artificial Sequence: Synthetic oligonucleotide
  Target: SCN9A; (+) strand; PAM type: YTN; PAM sequence: CTT
gccaaacacgggattgtata

SEQ ID NO: 93915 - DNA, 20 bp, Artificial Sequence
  Description of Artificial Sequence: Synthetic oligonucleotide
  Target: SCN9A; (+) strand; PAM type: YTN; PAM sequence: TTG
ccaaacacgggattgtatac

SEQ ID NO: 93916 - DNA, 20 bp, Artificial Sequence
  Description of Artificial Sequence: Synthetic oligonucleotide
  Target: SCN9A; (+) strand; PAM type: YTN; PAM sequence: TTG
tatacaagtgatgcaataaa

SEQ ID NO: 93917 - DNA, 20 bp, Artificial Sequence
  Description of Artificial Sequence: Synthetic oligonucleotide
  Target: SCN9A; (+) strand; PAM type: YTN; PAM sequence: CTG
tgcccaagttattatctgct

SEQ ID NO: 93918 - DNA, 20 bp, Artificial Sequence
  Description of Artificial Sequence: Synthetic oligonucleotide
  Target: SCN9A; (+) strand; PAM type: YTN; PAM sequence: TTA
ttatctgctcaagtatgtac

SEQ ID NO: 93919 - DNA, 20 bp, Artificial Sequence
  Description of Artificial Sequence: Synthetic oligonucleotide
  Target: SCN9A; (+) strand; PAM type: YTN; PAM sequence: TTA
tctgctcaagtatgtaccgt

SEQ ID NO: 93920 - DNA, 20 bp, Artificial Sequence
  Description of Artificial Sequence: Synthetic oligonucleotide
  Target: SCN9A; (+) strand; PAM type: YTN; PAM sequence: CTG
ctcaagtatgtaccgtggtc

SEQ ID NO: 93921 - DNA, 20 bp, Artificial Sequence
  Description of Artificial Sequence: Synthetic oligonucleotide
  Target: SCN9A; (+) strand; PAM type: YTN; PAM sequence: CTC
aagtatgtaccgtggtcaaa

SEQ ID NO: 93922 - DNA, 20 bp, Artificial Sequence
  Description of Artificial Sequence: Synthetic oligonucleotide
  Target: SCN9A; (+) strand; PAM type: YTN; PAM sequence: CTA
actgcatatcaggaaggatt

SEQ ID NO: 93923 - DNA, 20 bp, Artificial Sequence
  Description of Artificial Sequence: Synthetic oligonucleotide
  Target: SCN9A; (+) strand; PAM type: YTN; PAM sequence: CTG
catatcaggaaggatttcat

SEQ ID NO: 93924 - DNA, 20 bp, Artificial Sequence
  Description of Artificial Sequence: Synthetic oligonucleotide
  Target: SCN9A; (+) strand; PAM type: YTN; PAM sequence: TTT
catcaactttgcttacagcg

SEQ ID NO: 93925 - DNA, 20 bp, Artificial Sequence
  Description of Artificial Sequence: Synthetic oligonucleotide
  Target: SCN9A; (+) strand; PAM type: YTN; PAM sequence: TTC
atcaactttgcttacagcga

SEQ ID NO: 93926 - DNA, 20 bp, Artificial Sequence
  Description of Artificial Sequence: Synthetic oligonucleotide
  Target: SCN9A; (+) strand; PAM type: YTN; PAM sequence: CTT
tgcttacagcgaaaggatga

SEQ ID NO: 93927 - DNA, 20 bp, Artificial Sequence
  Description of Artificial Sequence: Synthetic oligonucleotide
  Target: SCN9A; (+) strand; PAM type: YTN; PAM sequence: TTT
gcttacagcgaaaggatgac

SEQ ID NO: 93928 - DNA, 20 bp, Artificial Sequence
  Description of Artificial Sequence: Synthetic oligonucleotide
  Target: SCN9A; (+) strand; PAM type: YTN; PAM sequence: TTG
cttacagcgaaaggatgact

SEQ ID NO: 93929 - DNA, 20 bp, Artificial Sequence
  Description of Artificial Sequence: Synthetic oligonucleotide
  Target: SCN9A; (+) strand; PAM type: YTN; PAM sequence: CTT
acagcgaaaggatgactaaa

SEQ ID NO: 93930 - DNA, 20 bp, Artificial Sequence
  Description of Artificial Sequence: Synthetic oligonucleotide
  Target: SCN9A; (+) strand; PAM type: YTN; PAM sequence: TTA
cagcgaaaggatgactaaac

SEQ ID NO: 93931 - DNA, 20 bp, Artificial Sequence
  Description of Artificial Sequence: Synthetic oligonucleotide
  Target: SCN9A; (+) strand; PAM type: YTN; PAM sequence: CTA
aacaatactgcataagaaag

SEQ ID NO: 93932 - DNA, 20 bp, Artificial Sequence
  Description of Artificial Sequence: Synthetic oligonucleotide
  Target: SCN9A; (+) strand; PAM type: YTN; PAM sequence: CTG
cataagaaagcaggaaaatt

SEQ ID NO: 93933 - DNA, 20 bp, Artificial Sequence
  Description of Artificial Sequence: Synthetic oligonucleotide
  Target: SCN9A; (+) strand; PAM type: YTN; PAM sequence: TTT
gacaaaagagtttaagagac

SEQ ID NO: 93934 - DNA, 20 bp, Artificial Sequence
  Description of Artificial Sequence: Synthetic oligonucleotide
  Target: SCN9A; (+) strand; PAM type: YTN; PAM sequence: TTG
acaaaagagtttaagagact

SEQ ID NO: 93935 - DNA, 20 bp, Artificial Sequence
  Description of Artificial Sequence: Synthetic oligonucleotide
  Target: SCN9A; (+) strand; PAM type: YTN; PAM sequence: TTT
aagagactattatcagtatt

SEQ ID NO: 93936 - DNA, 20 bp, Artificial Sequence
  Description of Artificial Sequence: Synthetic oligonucleotide
  Target: SCN9A; (+) strand; PAM type: YTN; PAM sequence: TTA
agagactattatcagtattt

SEQ ID NO: 93937 - DNA, 20 bp, Artificial Sequence
  Description of Artificial Sequence: Synthetic oligonucleotide
  Target: SCN9A; (+) strand; PAM type: YTN; PAM sequence: CTA
ttatcagtattttgggcagc

SEQ ID NO: 93938 - DNA, 20 bp, Artificial Sequence
  Description of Artificial Sequence: Synthetic oligonucleotide
  Target: SCN9A; (+) strand; PAM type: YTN; PAM sequence: TTA
tcagtattttgggcagcaca

SEQ ID NO: 93939 - DNA, 20 bp, Artificial Sequence
  Description of Artificial Sequence: Synthetic oligonucleotide
  Target: SCN9A; (+) strand; PAM type: YTN; PAM sequence: TTT
tgggcagcacagtcaaatgt

SEQ ID NO: 93940 - DNA, 20 bp, Artificial Sequence
  Description of Artificial Sequence: Synthetic oligonucleotide
  Target: SCN9A; (+) strand; PAM type: YTN; PAM sequence: TTT
gggcagcacagtcaaatgtt

SEQ ID NO: 93941 - DNA, 20 bp, Artificial Sequence
  Description of Artificial Sequence: Synthetic oligonucleotide
  Target: SCN9A; (+) strand; PAM type: YTN; PAM sequence: TTG
ggcagcacagtcaaatgtta

SEQ ID NO: 93942 - DNA, 20 bp, Artificial Sequence
  Description of Artificial Sequence: Synthetic oligonucleotide
  Target: SCN9A; (+) strand; PAM type: YTN; PAM sequence: TTA
ggctatgtaaataatagcaa

SEQ ID NO: 93943 - DNA, 20 bp, Artificial Sequence
  Description of Artificial Sequence: Synthetic oligonucleotide
  Target: SCN9A; (+) strand; PAM type: YTN; PAM sequence: CTA
tgtaaataatagcaaataga

SEQ ID NO: 93944 - DNA, 20 bp, Artificial Sequence
  Description of Artificial Sequence: Synthetic oligonucleotide
  Target: SCN9A; (+) strand; PAM type: YTN; PAM sequence: CTT
ctgtcaataacttttttctc

SEQ ID NO: 93945 - DNA, 20 bp, Artificial Sequence
  Description of Artificial Sequence: Synthetic oligonucleotide
  Target: SCN9A; (+) strand; PAM type: YTN; PAM sequence: TTC
tgtcaataacttttttctca

SEQ ID NO: 93946 - DNA, 20 bp, Artificial Sequence
  Description of Artificial Sequence: Synthetic oligonucleotide
  Target: SCN9A; (+) strand; PAM type: YTN; PAM sequence: CTG
tcaataacttttttctcagt

SEQ ID NO: 93947 - DNA, 20 bp, Artificial Sequence
  Description of Artificial Sequence: Synthetic oligonucleotide
  Target: SCN9A; (+) strand; PAM type: YTN; PAM sequence: CTT
ttttctcagttatctttgtt

SEQ ID NO: 93948 - DNA, 20 bp, Artificial Sequence
  Description of Artificial Sequence: Synthetic oligonucleotide
  Target: SCN9A; (+) strand; PAM type: YTN; PAM sequence: TTT
tttctcagttatctttgttt

SEQ ID NO: 93949 - DNA, 20 bp, Artificial Sequence
  Description of Artificial Sequence: Synthetic oligonucleotide
  Target: SCN9A; (+) strand; PAM type: YTN; PAM sequence: TTT
ttctcagttatctttgtttt

SEQ ID NO: 93950 - DNA, 20 bp, Artificial Sequence
  Description of Artificial Sequence: Synthetic oligonucleotide
  Target: SCN9A; (+) strand; PAM type: YTN; PAM sequence: TTT
tctcagttatctttgttttt

SEQ ID NO: 93951 - DNA, 20 bp, Artificial Sequence
  Description of Artificial Sequence: Synthetic oligonucleotide
  Target: SCN9A; (+) strand; PAM type: YTN; PAM sequence: TTT
ctcagttatctttgtttttt

SEQ ID NO: 93952 - DNA, 20 bp, Artificial Sequence
  Description of Artificial Sequence: Synthetic oligonucleotide
  Target: SCN9A; (+) strand; PAM type: YTN; PAM sequence: TTC
tcagttatctttgttttttt

SEQ ID NO: 93953 - DNA, 20 bp, Artificial Sequence
  Description of Artificial Sequence: Synthetic oligonucleotide
  Target: SCN9A; (+) strand; PAM type: YTN; PAM sequence: CTC
agttatctttgttttttttg

SEQ ID NO: 93954 - DNA, 20 bp, Artificial Sequence
  Description of Artificial Sequence: Synthetic oligonucleotide
  Target: SCN9A; (+) strand; PAM type: YTN; PAM sequence: TTA
tctttgttttttttgaggag

SEQ ID NO: 93955 - DNA, 20 bp, Artificial Sequence
  Description of Artificial Sequence: Synthetic oligonucleotide
  Target: SCN9A; (+) strand; PAM type: YTN; PAM sequence: CTT
tgttttttttgaggagtgta

SEQ ID NO: 93956 - DNA, 20 bp, Artificial Sequence
  Description of Artificial Sequence: Synthetic oligonucleotide
  Target: SCN9A; (+) strand; PAM type: YTN; PAM sequence: TTT
gttttttttgaggagtgtaa

SEQ ID NO: 93957 - DNA, 20 bp, Artificial Sequence
  Description of Artificial Sequence: Synthetic oligonucleotide
  Target: SCN9A; (+) strand; PAM type: YTN; PAM sequence: TTG
ttttttttgaggagtgtaat

SEQ ID NO: 93958 - DNA, 20 bp, Artificial Sequence
  Description of Artificial Sequence: Synthetic oligonucleotide
  Target: SCN9A; (+) strand; PAM type: YTN; PAM sequence: TTT
tttttgaggagtgtaatatg

SEQ ID NO: 93959 - DNA, 20 bp, Artificial Sequence
  Description of Artificial Sequence: Synthetic oligonucleotide
  Target: SCN9A; (+) strand; PAM type: YTN; PAM sequence: TTT
ttttgaggagtgtaatatgt

SEQ ID NO: 93960 - DNA, 20 bp, Artificial Sequence
  Description of Artificial Sequence: Synthetic oligonucleotide
  Target: SCN9A; (+) strand; PAM type: YTN; PAM sequence: TTT
tttgaggagtgtaatatgta

SEQ ID NO: 93961 - DNA, 20 bp, Artificial Sequence
  Description of Artificial Sequence: Synthetic oligonucleotide
  Target: SCN9A; (+) strand; PAM type: YTN; PAM sequence: TTT
ttgaggagtgtaatatgtac

SEQ ID NO: 93962 - DNA, 20 bp, Artificial Sequence
  Description of Artificial Sequence: Synthetic oligonucleotide
  Target: SCN9A; (+) strand; PAM type: YTN; PAM sequence: TTT
tgaggagtgtaatatgtact

SEQ ID NO: 93963 - DNA, 20 bp, Artificial Sequence
  Description of Artificial Sequence: Synthetic oligonucleotide
  Target: SCN9A; (+) strand; PAM type: YTN; PAM sequence: TTT
gaggagtgtaatatgtactt

SEQ ID NO: 93964 - DNA, 20 bp, Artificial Sequence
  Description of Artificial Sequence: Synthetic oligonucleotide
  Target: SCN9A; (+) strand; PAM type: YTN; PAM sequence: TTG
aggagtgtaatatgtactta

SEQ ID NO: 93965 - DNA, 20 bp, Artificial Sequence
  Description of Artificial Sequence: Synthetic oligonucleotide
  Target: SCN9A; (+) strand; PAM type: YTN; PAM sequence: CTT
agaataatttttcaagttct

SEQ ID NO: 93966 - DNA, 20 bp, Artificial Sequence
  Description of Artificial Sequence: Synthetic oligonucleotide
  Target: SCN9A; (+) strand; PAM type: YTN; PAM sequence: TTA
gaataatttttcaagttctg

SEQ ID NO: 93967 - DNA, 20 bp, Artificial Sequence
  Description of Artificial Sequence: Synthetic oligonucleotide
  Target: SCN9A; (+) strand; PAM type: YTN; PAM sequence: TTT
ttcaagttctgtggttattc

SEQ ID NO: 93968 - DNA, 20 bp, Artificial Sequence
  Description of Artificial Sequence: Synthetic oligonucleotide
  Target: SCN9A; (+) strand; PAM type: YTN; PAM sequence: TTT
tcaagttctgtggttattct

SEQ ID NO: 93969 - DNA, 20 bp, Artificial Sequence
  Description of Artificial Sequence: Synthetic oligonucleotide
  Target: SCN9A; (+) strand; PAM type: YTN; PAM sequence: TTT
caagttctgtggttattcta

SEQ ID NO: 93970 - DNA, 20 bp, Artificial Sequence
  Description of Artificial Sequence: Synthetic oligonucleotide
  Target: SCN9A; (+) strand; PAM type: YTN; PAM sequence: TTC
aagttctgtggttattctat

SEQ ID NO: 93971 - DNA, 20 bp, Artificial Sequence
  Description of Artificial Sequence: Synthetic oligonucleotide
  Target: SCN9A; (+) strand; PAM type: YTN; PAM sequence: TTC
tgtggttattctatgaacaa

SEQ ID NO: 93972 - DNA, 20 bp, Artificial Sequence
  Description of Artificial Sequence: Synthetic oligonucleotide
  Target: SCN9A; (+) strand; PAM type: YTN; PAM sequence: CTG
tggttattctatgaacaaaa

SEQ ID NO: 93973 - DNA, 20 bp, Artificial Sequence
  Description of Artificial Sequence: Synthetic oligonucleotide
  Target: SCN9A; (+) strand; PAM type: YTN; PAM sequence: TTA
ttctatgaacaaaaagggat

SEQ ID NO: 93974 - DNA, 20 bp, Artificial Sequence
  Description of Artificial Sequence: Synthetic oligonucleotide
  Target: SCN9A; (+) strand; PAM type: YTN; PAM sequence: TTC
tatgaacaaaaagggatatg

SEQ ID NO: 93975 - DNA, 20 bp, Artificial Sequence
  Description of Artificial Sequence: Synthetic oligonucleotide
  Target: SCN9A; (+) strand; PAM type: YTN; PAM sequence: CTA
tgaacaaaaagggatatgaa

SEQ ID NO: 93976 - DNA, 20 bp, Artificial Sequence
  Description of Artificial Sequence: Synthetic oligonucleotide
  Target: SCN9A; (+) strand; PAM type: YTN; PAM sequence: CTA
tgaaacacaatactctaaag

SEQ ID NO: 93977 - DNA, 20 bp, Artificial Sequence
  Description of Artificial Sequence: Synthetic oligonucleotide
  Target: SCN9A; (+) strand; PAM type: YTN; PAM sequence: CTC
taaaggtaagtcttatcctt

SEQ ID NO: 93978 - DNA, 20 bp, Artificial Sequence
  Description of Artificial Sequence: Synthetic oligonucleotide
  Target: SCN9A; (+) strand; PAM type: YTN; PAM sequence: CTA
aaggtaagtcttatccttgt

SEQ ID NO: 93979 - DNA, 20 bp, Artificial Sequence
  Description of Artificial Sequence: Synthetic oligonucleotide
  Target: SCN9A; (+) strand; PAM type: YTN; PAM sequence: CTT
atccttgttggcatgtgagt

SEQ ID NO: 93980 - DNA, 20 bp, Artificial Sequence
  Description of Artificial Sequence: Synthetic oligonucleotide
  Target: SCN9A; (+) strand; PAM type: YTN; PAM sequence: TTA
tccttgttggcatgtgagtc

SEQ ID NO: 93981 - DNA, 20 bp, Artificial Sequence
  Description of Artificial Sequence: Synthetic oligonucleotide
  Target: SCN9A; (+) strand; PAM type: YTN; PAM sequence: CTT
gttggcatgtgagtcaagat

SEQ ID NO: 93982 - DNA, 20 bp, Artificial Sequence
  Description of Artificial Sequence: Synthetic oligonucleotide
  Target: SCN9A; (+) strand; PAM type: YTN; PAM sequence: TTG
ttggcatgtgagtcaagatg

SEQ ID NO: 93983 - DNA, 20 bp, Artificial Sequence
  Description of Artificial Sequence: Synthetic oligonucleotide
  Target: SCN9A; (+) strand; PAM type: YTN; PAM sequence: TTG
gcatgtgagtcaagatgaat

SEQ ID NO: 93984 - DNA, 20 bp, Artificial Sequence
  Description of Artificial Sequence: Synthetic oligonucleotide
  Target: SCN9A; (+) strand; PAM type: YTN; PAM sequence: TTT
gtagaaatgaatagcctaca

SEQ ID NO: 93985 - DNA, 20 bp, Artificial Sequence
  Description of Artificial Sequence: Synthetic oligonucleotide
  Target: SCN9A; (+) strand; PAM type: YTN; PAM sequence: TTG
tagaaatgaatagcctacat

SEQ ID NO: 93986 - DNA, 20 bp, Artificial Sequence
  Description of Artificial Sequence: Synthetic oligonucleotide
  Target: SCN9A; (+) strand; PAM type: YTN; PAM sequence: CTA
catatatttttaatcccatg

SEQ ID NO: 93987 - DNA, 20 bp, Artificial Sequence
  Description of Artificial Sequence: Synthetic oligonucleotide
  Target: SCN9A; (+) strand; PAM type: YTN; PAM sequence: TTT
ttaatcccatggcattttat

SEQ ID NO: 93988 - DNA, 20 bp, Artificial Sequence
  Description of Artificial Sequence: Synthetic oligonucleotide
  Target: SCN9A; (+) strand; PAM type: YTN; PAM sequence: TTT
taatcccatggcattttata

SEQ ID NO: 93989 - DNA, 20 bp, Artificial Sequence
  Description of Artificial Sequence: Synthetic oligonucleotide
  Target: SCN9A; (+) strand; PAM type: YTN; PAM sequence: TTT
aatcccatggcattttatag

SEQ ID NO: 93990 - DNA, 20 bp, Artificial Sequence
  Description of Artificial Sequence: Synthetic oligonucleotide
  Target: SCN9A; (+) strand; PAM type: YTN; PAM sequence: TTA
atcccatggcattttatagg

SEQ ID NO: 93991 - DNA, 20 bp, Artificial Sequence
  Description of Artificial Sequence: Synthetic oligonucleotide
  Target: SCN9A; (+) strand; PAM type: YTN; PAM sequence: TTT
tataggcacatataaattgg

SEQ ID NO: 93992 - DNA, 20 bp, Artificial Sequence
  Description of Artificial Sequence: Synthetic oligonucleotide
  Target: SCN9A; (+) strand; PAM type: YTN; PAM sequence: TTT
ataggcacatataaattggt

SEQ ID NO: 93993 - DNA, 20 bp, Artificial Sequence
  Description of Artificial Sequence: Synthetic oligonucleotide
  Target: SCN9A; (+) strand; PAM type: YTN; PAM sequence: TTA
taggcacatataaattggtt

SEQ ID NO: 93994 - DNA, 20 bp, Artificial Sequence
  Description of Artificial Sequence: Synthetic oligonucleotide
  Target: SCN9A; (+) strand; PAM type: YTN; PAM sequence: TTG
gttctgatgcaatgtagaat

SEQ ID NO: 93995 - DNA, 20 bp, Artificial Sequence
  Description of Artificial Sequence: Synthetic oligonucleotide
  Target: SCN9A; (+) strand; PAM type: YTN; PAM sequence: TTC
tgatgcaatgtagaataaat

SEQ ID NO: 93996 - DNA, 20 bp, Artificial Sequence
  Description of Artificial Sequence: Synthetic oligonucleotide
  Target: SCN9A; (+) strand; PAM type: YTN; PAM sequence: CTG
atgcaatgtagaataaattt

SEQ ID NO: 93997 - DNA, 20 bp, Artificial Sequence
  Description of Artificial Sequence: Synthetic oligonucleotide
  Target: SCN9A; (+) strand; PAM type: YTN; PAM sequence: TTT
aagcacctcaaaatatagaa

SEQ ID NO: 93998 - DNA, 20 bp, Artificial Sequence
  Description of Artificial Sequence: Synthetic oligonucleotide
  Target: SCN9A; (+) strand; PAM type: YTN; PAM sequence: TTA
agcacctcaaaatatagaat

SEQ ID NO: 93999 - DNA, 20 bp, Artificial Sequence
  Description of Artificial Sequence: Synthetic oligonucleotide
  Target: SCN9A; (+) strand; PAM type: YTN; PAM sequence: CTC
aaaatatagaataacctctg

SEQ ID NO: 94000 - DNA, 20 bp, Artificial Sequence
  Description of Artificial Sequence: Synthetic oligonucleotide
  Target: SCN9A; (+) strand; PAM type: YTN; PAM sequence: CTC
tgtacattgataaaaagtca

SEQ ID NO: 94001 - DNA, 20 bp, Artificial Sequence
  Description of Artificial Sequence: Synthetic oligonucleotide
  Target: SCN9A; (+) strand; PAM type: YTN; PAM sequence: CTG
tacattgataaaaagtcaag

SEQ ID NO: 94002 - DNA, 20 bp, Artificial Sequence
  Description of Artificial Sequence: Synthetic oligonucleotide
  Target: SCN9A; (+) strand; PAM type: YTN; PAM sequence: TTG
ataaaaagtcaagctcccta

SEQ ID NO: 94003 - DNA, 20 bp, Artificial Sequence
  Description of Artificial Sequence: Synthetic oligonucleotide
  Target: SCN9A; (+) strand; PAM type: YTN; PAM sequence: CTC
cctaataatgcattttaact

SEQ ID NO: 94004 - DNA, 20 bp, Artificial Sequence
  Description of Artificial Sequence: Synthetic oligonucleotide
  Target: SCN9A; (+) strand; PAM type: YTN; PAM sequence: CTA
ataatgcattttaactaaac

SEQ ID NO: 94005 - DNA, 20 bp, Artificial Sequence
  Description of Artificial Sequence: Synthetic oligonucleotide
  Target: SCN9A; (+) strand; PAM type: YTN; PAM sequence: TTT
taactaaacattcataacta

SEQ ID NO: 94006 - DNA, 20 bp, Artificial Sequence
  Description of Artificial Sequence: Synthetic oligonucleotide
  Target: SCN9A; (+) strand; PAM type: YTN; PAM sequence: TTT
aactaaacattcataactaa

SEQ ID NO: 94007 - DNA, 20 bp, Artificial Sequence
  Description of Artificial Sequence: Synthetic oligonucleotide
  Target: SCN9A; (+) strand; PAM type: YTN; PAM sequence: TTA
actaaacattcataactaat

SEQ ID NO: 94008 - DNA, 20 bp, Artificial Sequence
  Description of Artificial Sequence: Synthetic oligonucleotide
  Target: SCN9A; (+) strand; PAM type: YTN; PAM sequence: CTA
aacattcataactaatgtcc

SEQ ID NO: 94009 - DNA, 20 bp, Artificial Sequence
  Description of Artificial Sequence: Synthetic oligonucleotide
  Target: SCN9A; (+) strand; PAM type: YTN; PAM sequence: TTC
ataactaatgtccattactt

SEQ ID NO: 94010 - DNA, 20 bp, Artificial Sequence
  Description of Artificial Sequence: Synthetic oligonucleotide
  Target: SCN9A; (+) strand; PAM type: YTN; PAM sequence: CTA
atgtccattacttctatcaa

SEQ ID NO: 94011 - DNA, 20 bp, Artificial Sequence
  Description of Artificial Sequence: Synthetic oligonucleotide
  Target: SCN9A; (+) strand; PAM type: YTN; PAM sequence: TTA
cttctatcaagcatttcatt

SEQ ID NO: 94012 - DNA, 20 bp, Artificial Sequence
  Description of Artificial Sequence: Synthetic oligonucleotide
  Target: SCN9A; (+) strand; PAM type: YTN; PAM sequence: CTT
ctatcaagcatttcattgca

SEQ ID NO: 94013 - DNA, 20 bp, Artificial Sequence
  Description of Artificial Sequence: Synthetic oligonucleotide
  Target: SCN9A; (+) strand; PAM type: YTN; PAM sequence: TTC
tatcaagcatttcattgcaa

SEQ ID NO: 94014 - DNA, 20 bp, Artificial Sequence
  Description of Artificial Sequence: Synthetic oligonucleotide
  Target: SCN9A; (+) strand; PAM type: YTN; PAM sequence: CTA
tcaagcatttcattgcaaag

SEQ ID NO: 94015 - DNA, 20 bp, Artificial Sequence
  Description of Artificial Sequence: Synthetic oligonucleotide
  Target: SCN9A; (+) strand; PAM type: YTN; PAM sequence: TTT
cattgcaaagccaaggcaaa

SEQ ID NO: 94016 - DNA, 20 bp, Artificial Sequence
  Description of Artificial Sequence: Synthetic oligonucleotide
  Target: SCN9A; (+) strand; PAM type: YTN; PAM sequence: TTC
attgcaaagccaaggcaaat

SEQ ID NO: 94017 - DNA, 20 bp, Artificial Sequence
  Description of Artificial Sequence: Synthetic oligonucleotide
  Target: SCN9A; (+) strand; PAM type: YTN; PAM sequence: TTG
caaagccaaggcaaatactt

SEQ ID NO: 94018 - DNA, 20 bp, Artificial Sequence
  Description of Artificial Sequence: Synthetic oligonucleotide
  Target: SCN9A; (+) strand; PAM type: YTN; PAM sequence: CTT
ttgttgatttccaaataata

SEQ ID NO: 94019 - DNA, 20 bp, Artificial Sequence
  Description of Artificial Sequence: Synthetic oligonucleotide
  Target: SCN9A; (+) strand; PAM type: YTN; PAM sequence: TTT
tgttgatttccaaataatag

SEQ ID NO: 94020 - DNA, 20 bp, Artificial Sequence
  Description of Artificial Sequence: Synthetic oligonucleotide
  Target: SCN9A; (+) strand; PAM type: YTN; PAM sequence: TTT
gttgatttccaaataataga

SEQ ID NO: 94021 - DNA, 20 bp, Artificial Sequence
  Description of Artificial Sequence: Synthetic oligonucleotide
  Target: SCN9A; (+) strand; PAM type: YTN; PAM sequence: TTG
ttgatttccaaataatagat

SEQ ID NO: 94022 - DNA, 20 bp, Artificial Sequence
  Description of Artificial Sequence: Synthetic oligonucleotide
  Target: SCN9A; (+) strand; PAM type: YTN; PAM sequence: TTG
atttccaaataatagataaa

SEQ ID NO: 94023 - DNA, 20 bp, Artificial Sequence
  Description of Artificial Sequence: Synthetic oligonucleotide
  Target: SCN9A; (+) strand; PAM type: YTN; PAM sequence: TTT
ccaaataatagataaataat

SEQ ID NO: 94024 - DNA, 20 bp, Artificial Sequence
  Description of Artificial Sequence: Synthetic oligonucleotide
  Target: SCN9A; (+) strand; PAM type: YTN; PAM sequence: TTC
caaataatagataaataata

SEQ ID NO: 94025 - DNA, 20 bp, Artificial Sequence
  Description of Artificial Sequence: Synthetic oligonucleotide
  Target: SCN9A; (+) strand; PAM type: YTN; PAM sequence: TTT
ttctgtatgcgtgtgttgtt

SEQ ID NO: 94026 - DNA, 20 bp, Artificial Sequence
  Description of Artificial Sequence: Synthetic oligonucleotide
  Target: SCN9A; (+) strand; PAM type: YTN; PAM sequence: TTT
tctgtatgcgtgtgttgttt

SEQ ID NO: 94027 - DNA, 20 bp, Artificial Sequence
  Description of Artificial Sequence: Synthetic oligonucleotide
  Target: SCN9A; (+) strand; PAM type: YTN; PAM sequence: TTT
ctgtatgcgtgtgttgttta

SEQ ID NO: 94028 - DNA, 20 bp, Artificial Sequence
  Description of Artificial Sequence: Synthetic oligonucleotide
  Target: SCN9A; (+) strand; PAM type: YTN; PAM sequence: TTC
tgtatgcgtgtgttgtttat

SEQ ID NO: 94029 - DNA, 20 bp, Artificial Sequence
  Description of Artificial Sequence: Synthetic oligonucleotide
  Target: SCN9A; (+) strand; PAM type: YTN; PAM sequence: CTG
tatgcgtgtgttgtttattt

SEQ ID NO: 94030 - DNA, 20 bp, Artificial Sequence
  Description of Artificial Sequence: Synthetic oligonucleotide
  Target: SCN9A; (+) strand; PAM type: YTN; PAM sequence: TTG
tttatttacatgggaaacaa

SEQ ID NO: 94031 - DNA, 20 bp, Artificial Sequence
  Description of Artificial Sequence: Synthetic oligonucleotide
  Target: SCN9A; (+) strand; PAM type: YTN; PAM sequence: TTT
atttacatgggaaacaagac

SEQ ID NO: 94032 - DNA, 20 bp, Artificial Sequence
  Description of Artificial Sequence: Synthetic oligonucleotide
  Target: SCN9A; (+) strand; PAM type: YTN; PAM sequence: TTA
tttacatgggaaacaagact

SEQ ID NO: 94033 - DNA, 20 bp, Artificial Sequence
  Description of Artificial Sequence: Synthetic oligonucleotide
  Target: SCN9A; (+) strand; PAM type: YTN; PAM sequence: TTT
acatgggaaacaagactaat

SEQ ID NO: 94034 - DNA, 20 bp, Artificial Sequence
  Description of Artificial Sequence: Synthetic oligonucleotide
  Target: SCN9A; (+) strand; PAM type: YTN; PAM sequence: TTA
catgggaaacaagactaatt

SEQ ID NO: 94035 - DNA, 20 bp, Artificial Sequence
  Description of Artificial Sequence: Synthetic oligonucleotide
  Target: SCN9A; (+) strand; PAM type: YTN; PAM sequence: CTA
attacaatcctgtgaaaaga

SEQ ID NO: 94036 - DNA, 20 bp, Artificial Sequence
  Description of Artificial Sequence: Synthetic oligonucleotide
  Target: SCN9A; (+) strand; PAM type: YTN; PAM sequence: TTA
caatcctgtgaaaagatgac

SEQ ID NO: 94037 - DNA, 20 bp, Artificial Sequence
  Description of Artificial Sequence: Synthetic oligonucleotide
  Target: SCN9A; (+) strand; PAM type: YTN; PAM sequence: CTG
tgaaaagatgacaaggcaga

SEQ ID NO: 94038 - DNA, 20 bp, Artificial Sequence
  Description of Artificial Sequence: Synthetic oligonucleotide
  Target: SCN9A; (+) strand; PAM type: YTN; PAM sequence: TTT
tctacatggtcttctgattt

SEQ ID NO: 94039 - DNA, 20 bp, Artificial Sequence
  Description of Artificial Sequence: Synthetic oligonucleotide
  Target: SCN9A; (+) strand; PAM type: YTN; PAM sequence: TTT
ctacatggtcttctgattta

SEQ ID NO: 94040 - DNA, 20 bp, Artificial Sequence
  Description of Artificial Sequence: Synthetic oligonucleotide
  Target: SCN9A; (+) strand; PAM type: YTN; PAM sequence: TTC
tacatggtcttctgatttat

SEQ ID NO: 94041 - DNA, 20 bp, Artificial Sequence
  Description of Artificial Sequence: Synthetic oligonucleotide
  Target: SCN9A; (+) strand; PAM type: YTN; PAM sequence: CTA
catggtcttctgatttatta

SEQ ID NO: 94042 - DNA, 20 bp, Artificial Sequence
  Description of Artificial Sequence: Synthetic oligonucleotide
  Target: SCN9A; (+) strand; PAM type: YTN; PAM sequence: CTT
ctgatttattaaaaaccaaa

SEQ ID NO: 94043 - DNA, 20 bp, Artificial Sequence
  Description of Artificial Sequence: Synthetic oligonucleotide
  Target: SCN9A; (+) strand; PAM type: YTN; PAM sequence: TTC
tgatttattaaaaaccaaaa

SEQ ID NO: 94044 - DNA, 20 bp, Artificial Sequence
  Description of Artificial Sequence: Synthetic oligonucleotide
  Target: SCN9A; (+) strand; PAM type: YTN; PAM sequence: CTG
atttattaaaaaccaaaaaa

SEQ ID NO: 94045 - DNA, 20 bp, Artificial Sequence
  Description of Artificial Sequence: Synthetic oligonucleotide
  Target: SCN9A; (+) strand; PAM type: YTN; PAM sequence: TTT
attaaaaaccaaaaaactga

SEQ ID NO: 94046 - DNA, 20 bp, Artificial Sequence
  Description of Artificial Sequence: Synthetic oligonucleotide
  Target: SCN9A; (+) strand; PAM type: YTN; PAM sequence: TTA
ttaaaaaccaaaaaactgaa

SEQ ID NO: 94047 - DNA, 20 bp, Artificial Sequence
  Description of Artificial Sequence: Synthetic oligonucleotide
  Target: SCN9A; (+) strand; PAM type: YTN; PAM sequence: TTA
aaaaccaaaaaactgaatca

SEQ ID NO: 94048 - DNA, 20 bp, Artificial Sequence
  Description of Artificial Sequence: Synthetic oligonucleotide
  Target: SCN9A; (+) strand; PAM type: YTN; PAM sequence: CTG
aatcacttttgtatgctata

SEQ ID NO: 94049 - DNA, 20 bp, Artificial Sequence
  Description of Artificial Sequence: Synthetic oligonucleotide
  Target: SCN9A; (+) strand; PAM type: YTN; PAM sequence: CTT
ttgtatgctataatcaataa

SEQ ID NO: 94050 - DNA, 20 bp, Artificial Sequence
  Description of Artificial Sequence: Synthetic oligonucleotide
  Target: SCN9A; (+) strand; PAM type: YTN; PAM sequence: TTT
tgtatgctataatcaataat

SEQ ID NO: 94051 - DNA, 20 bp, Artificial Sequence
  Description of Artificial Sequence: Synthetic oligonucleotide
  Target: SCN9A; (+) strand; PAM type: YTN; PAM sequence: TTT
gtatgctataatcaataatt

SEQ ID NO: 94052 - DNA, 20 bp, Artificial Sequence
  Description of Artificial Sequence: Synthetic oligonucleotide
  Target: SCN9A; (+) strand; PAM type: YTN; PAM sequence: TTG
tatgctataatcaataattc

SEQ ID NO: 94053 - DNA, 20 bp, Artificial Sequence
  Description of Artificial Sequence: Synthetic oligonucleotide
  Target: SCN9A; (+) strand; PAM type: YTN; PAM sequence: CTA
taatcaataattcctacaga

SEQ ID NO: 94054 - DNA, 20 bp, Artificial Sequence
  Description of Artificial Sequence: Synthetic oligonucleotide
  Target: SCN9A; (+) strand; PAM type: YTN; PAM sequence: TTC
ctacagagttctcttacgat

SEQ ID NO: 94055 - DNA, 20 bp, Artificial Sequence
  Description of Artificial Sequence: Synthetic oligonucleotide
  Target: SCN9A; (+) strand; PAM type: YTN; PAM sequence: CTA
cagagttctcttacgattct

SEQ ID NO: 94056 - DNA, 20 bp, Artificial Sequence
  Description of Artificial Sequence: Synthetic oligonucleotide
  Target: SCN9A; (+) strand; PAM type: YTN; PAM sequence: TTC
tcttacgattcttaaagaat

SEQ ID NO: 94057 - DNA, 20 bp, Artificial Sequence
  Description of Artificial Sequence: Synthetic oligonucleotide
  Target: SCN9A; (+) strand; PAM type: YTN; PAM sequence: CTC
ttacgattcttaaagaatca

SEQ ID NO: 94058 - DNA, 20 bp, Artificial Sequence
  Description of Artificial Sequence: Synthetic oligonucleotide
  Target: SCN9A; (+) strand; PAM type: YTN; PAM sequence: CTT
acgattcttaaagaatcatc

SEQ ID NO: 94059 - DNA, 20 bp, Artificial Sequence
  Description of Artificial Sequence: Synthetic oligonucleotide
  Target: SCN9A; (+) strand; PAM type: YTN; PAM sequence: TTA
cgattcttaaagaatcatca

SEQ ID NO: 94060 - DNA, 20 bp, Artificial Sequence
  Description of Artificial Sequence: Synthetic oligonucleotide
  Target: SCN9A; (+) strand; PAM type: YTN; PAM sequence: TTC
ttaaagaatcatcagtgcaa

SEQ ID NO: 94061 - DNA, 20 bp, Artificial Sequence
  Description of Artificial Sequence: Synthetic oligonucleotide
  Target: SCN9A; (+) strand; PAM type: YTN; PAM sequence: CTT
aaagaatcatcagtgcaaaa

SEQ ID NO: 94062 - DNA, 20 bp, Artificial Sequence
  Description of Artificial Sequence: Synthetic oligonucleotide
  Target: SCN9A; (+) strand; PAM type: YTN; PAM sequence: TTA
aagaatcatcagtgcaaaaa

SEQ ID NO: 94063 - DNA, 20 bp, Artificial Sequence
  Description of Artificial Sequence: Synthetic oligonucleotide
  Target: SCN9A; (+) strand; PAM type: YTN; PAM sequence: CTG
ctaatgctgcccacctttct

SEQ ID NO: 94064 - DNA, 20 bp, Artificial Sequence
  Description of Artificial Sequence: Synthetic oligonucleotide
  Target: SCN9A; (+) strand; PAM type: YTN; PAM sequence: CTA
atgctgcccacctttcttag

SEQ ID NO: 94065 - DNA, 20 bp, Artificial Sequence
  Description of Artificial Sequence: Synthetic oligonucleotide
  Target: SCN9A; (+) strand; PAM type: YTN; PAM sequence: CTG
cccacctttcttaggaaatc

SEQ ID NO: 94066 - DNA, 20 bp, Artificial Sequence
  Description of Artificial Sequence: Synthetic oligonucleotide
  Target: SCN9A; (+) strand; PAM type: YTN; PAM sequence: CTT
tcttaggaaatcagagttag

SEQ ID NO: 94067 - DNA, 20 bp, Artificial Sequence
  Description of Artificial Sequence: Synthetic oligonucleotide
  Target: SCN9A; (+) strand; PAM type: YTN; PAM sequence: TTT
cttaggaaatcagagttagt

SEQ ID NO: 94068 - DNA, 20 bp, Artificial Sequence
  Description of Artificial Sequence: Synthetic oligonucleotide
  Target: SCN9A; (+) strand; PAM type: YTN; PAM sequence: TTC
ttaggaaatcagagttagtg

SEQ ID NO: 94069 - DNA, 20 bp, Artificial Sequence
  Description of Artificial Sequence: Synthetic oligonucleotide
  Target: SCN9A; (+) strand; PAM type: YTN; PAM sequence: CTT
aggaaatcagagttagtgac

SEQ ID NO: 94070 - DNA, 20 bp, Artificial Sequence
  Description of Artificial Sequence: Synthetic oligonucleotide
  Target: SCN9A; (+) strand; PAM type: YTN; PAM sequence: TTA
ggaaatcagagttagtgact

SEQ ID NO: 94071 - DNA, 20 bp, Artificial Sequence
  Description of Artificial Sequence: Synthetic oligonucleotide
  Target: SCN9A; (+) strand; PAM type: YTN; PAM sequence: TTA
gtgactgcactgccttcgag

SEQ ID NO: 94072 - DNA, 20 bp, Artificial Sequence
  Description of Artificial Sequence: Synthetic oligonucleotide
  Target: SCN9A; (+) strand; PAM type: YTN; PAM sequence: CTG
cactgccttcgagaatattt

SEQ ID NO: 94073 - DNA, 20 bp, Artificial Sequence
  Description of Artificial Sequence: Synthetic oligonucleotide
  Target: SCN9A; (+) strand; PAM type: YTN; PAM sequence: CTG
ccttcgagaatattttgata

SEQ ID NO: 94074 - DNA, 20 bp, Artificial Sequence
  Description of Artificial Sequence: Synthetic oligonucleotide
  Target: SCN9A; (+) strand; PAM type: YTN; PAM sequence: CTT
cgagaatattttgataaaaa

SEQ ID NO: 94075 - DNA, 20 bp, Artificial Sequence
  Description of Artificial Sequence: Synthetic oligonucleotide
  Target: SCN9A; (+) strand; PAM type: YTN; PAM sequence: TTC
gagaatattttgataaaaag

SEQ ID NO: 94076 - DNA, 20 bp, Artificial Sequence
  Description of Artificial Sequence: Synthetic oligonucleotide
  Target: SCN9A; (+) strand; PAM type: YTN; PAM sequence: TTT
tgataaaaaggattttggca

SEQ ID NO: 94077 - DNA, 20 bp, Artificial Sequence
  Description of Artificial Sequence: Synthetic oligonucleotide
  Target: SCN9A; (+) strand; PAM type: YTN; PAM sequence: TTT
gataaaaaggattttggcat

SEQ ID NO: 94078 - DNA, 20 bp, Artificial Sequence
  Description of Artificial Sequence: Synthetic oligonucleotide
  Target: SCN9A; (+) strand; PAM type: YTN; PAM sequence: TTG
ataaaaaggattttggcata

SEQ ID NO: 94079 - DNA, 20 bp, Artificial Sequence
  Description of Artificial Sequence: Synthetic oligonucleotide
  Target: SCN9A; (+) strand; PAM type: YTN; PAM sequence: TTT
tggcatagacttcctcaaaa

SEQ ID NO: 94080 - DNA, 20 bp, Artificial Sequence
  Description of Artificial Sequence: Synthetic oligonucleotide
  Target: SCN9A; (+) strand; PAM type: YTN; PAM sequence: TTT
ggcatagacttcctcaaaag

SEQ ID NO: 94081 - DNA, 20 bp, Artificial Sequence
  Description of Artificial Sequence: Synthetic oligonucleotide
  Target: SCN9A; (+) strand; PAM type: YTN; PAM sequence: TTG
gcatagacttcctcaaaaga

SEQ ID NO: 94082 - DNA, 20 bp, Artificial Sequence
  Description of Artificial Sequence: Synthetic oligonucleotide
  Target: SCN9A; (+) strand; PAM type: YTN; PAM sequence: CTT
cctcaaaagagttttattaa

SEQ ID NO: 94083 - DNA, 20 bp, Artificial Sequence
  Description of Artificial Sequence: Synthetic oligonucleotide
  Target: SCN9A; (+) strand; PAM type: YTN; PAM sequence: TTC
ctcaaaagagttttattaac

SEQ ID NO: 94084 - DNA, 20 bp, Artificial Sequence
  Description of Artificial Sequence: Synthetic oligonucleotide
  Target: SCN9A; (+) strand; PAM type: YTN; PAM sequence: CTC
aaaagagttttattaacaca

SEQ ID NO: 94085 - DNA, 20 bp, Artificial Sequence
  Description of Artificial Sequence: Synthetic oligonucleotide
  Target: SCN9A; (+) strand; PAM type: YTN; PAM sequence: TTT
tattaacacaaataaatcac

SEQ ID NO: 94086 - DNA, 20 bp, Artificial Sequence
  Description of Artificial Sequence: Synthetic oligonucleotide
  Target: SCN9A; (+) strand; PAM type: YTN; PAM sequence: TTT
attaacacaaataaatcact

SEQ ID NO: 94087 - DNA, 20 bp, Artificial Sequence
  Description of Artificial Sequence: Synthetic oligonucleotide
  Target: SCN9A; (+) strand; PAM type: YTN; PAM sequence: TTA
ttaacacaaataaatcactt

SEQ ID NO: 94088 - DNA, 20 bp, Artificial Sequence
  Description of Artificial Sequence: Synthetic oligonucleotide
  Target: SCN9A; (+) strand; PAM type: YTN; PAM sequence: TTA
acacaaataaatcactttca

SEQ ID NO: 94089 - DNA, 20 bp, Artificial Sequence
  Description of Artificial Sequence: Synthetic oligonucleotide
  Target: SCN9A; (+) strand; PAM type: YTN; PAM sequence: CTT
tcacaggctgtaaacaatat

SEQ ID NO: 94090 - DNA, 20 bp, Artificial Sequence
  Description of Artificial Sequence: Synthetic oligonucleotide
  Target: SCN9A; (+) strand; PAM type: YTN; PAM sequence: TTT
cacaggctgtaaacaatata

SEQ ID NO: 94091 - DNA, 20 bp, Artificial Sequence
  Description of Artificial Sequence: Synthetic oligonucleotide
  Target: SCN9A; (+) strand; PAM type: YTN; PAM sequence: TTC
acaggctgtaaacaatatat

SEQ ID NO: 94092 - DNA, 20 bp, Artificial Sequence
  Description of Artificial Sequence: Synthetic oligonucleotide
  Target: SCN9A; (+) strand; PAM type: YTN; PAM sequence: CTG
taaacaatatatcaaaaatg

SEQ ID NO: 94093 - DNA, 20 bp, Artificial Sequence
  Description of Artificial Sequence: Synthetic oligonucleotide
  Target: SCN9A; (+) strand; PAM type: YTN; PAM sequence: CTC
tattttttgctttccttgct

SEQ ID NO: 94094 - DNA, 20 bp, Artificial Sequence
  Description of Artificial Sequence: Synthetic oligonucleotide
  Target: SCN9A; (+) strand; PAM type: YTN; PAM sequence: CTA
ttttttgctttccttgctgt

SEQ ID NO: 94095 - DNA, 20 bp, Artificial Sequence
  Description of Artificial Sequence: Synthetic oligonucleotide
  Target: SCN9A; (+) strand; PAM type: YTN; PAM sequence: TTT
tttgctttccttgctgtctt

SEQ ID NO: 94096 - DNA, 20 bp, Artificial Sequence
  Description of Artificial Sequence: Synthetic oligonucleotide
  Target: SCN9A; (+) strand; PAM type: YTN; PAM sequence: TTT
ttgctttccttgctgtcttt

SEQ ID NO: 94097 - DNA, 20 bp, Artificial Sequence
  Description of Artificial Sequence: Synthetic oligonucleotide
  Target: SCN9A; (+) strand; PAM type: YTN; PAM sequence: TTT
tgctttccttgctgtctttc

SEQ ID NO: 94098 - DNA, 20 bp, Artificial Sequence
  Description of Artificial Sequence: Synthetic oligonucleotide
  Target: SCN9A; (+) strand; PAM type: YTN; PAM sequence: TTT
gctttccttgctgtctttcc

SEQ ID NO: 94099 - DNA, 20 bp, Artificial Sequence
  Description of Artificial Sequence: Synthetic oligonucleotide
  Target: SCN9A; (+) strand; PAM type: YTN; PAM sequence: TTG
ctttccttgctgtctttccc

SEQ ID NO: 94100 - DNA, 20 bp, Artificial Sequence
  Description of Artificial Sequence: Synthetic oligonucleotide
  Target: SCN9A; (+) strand; PAM type: YTN; PAM sequence: CTT
tccttgctgtctttcccttt

SEQ ID NO: 94101 - DNA, 20 bp, Artificial Sequence
  Description of Artificial Sequence: Synthetic oligonucleotide
  Target: SCN9A; (+) strand; PAM type: YTN; PAM sequence: TTT
ccttgctgtctttccctttg

SEQ ID NO: 94102 - DNA, 20 bp, Artificial Sequence
  Description of Artificial Sequence: Synthetic oligonucleotide
  Target: SCN9A; (+) strand; PAM type: YTN; PAM sequence: TTC
cttgctgtctttccctttgt

SEQ ID NO: 94103 - DNA, 20 bp, Artificial Sequence
  Description of Artificial Sequence: Synthetic oligonucleotide
  Target: SCN9A; (+) strand; PAM type: YTN; PAM sequence: CTT
gctgtctttccctttgtctt

SEQ ID NO: 94104 - DNA, 20 bp, Artificial Sequence
  Description of Artificial Sequence: Synthetic oligonucleotide
  Target: SCN9A; (+) strand; PAM type: YTN; PAM sequence: TTG
ctgtctttccctttgtcttc

SEQ ID NO: 94105 - DNA, 20 bp, Artificial Sequence
  Description of Artificial Sequence: Synthetic oligonucleotide
  Target: SCN9A; (+) strand; PAM type: YTN; PAM sequence: CTG
tctttccctttgtcttcctt

SEQ ID NO: 94106 - DNA, 20 bp, Artificial Sequence
  Description of Artificial Sequence: Synthetic oligonucleotide
  Target: SCN9A; (+) strand; PAM type: YTN; PAM sequence: CTT
tccctttgtcttccttttct

SEQ ID NO: 94107 - DNA, 20 bp, Artificial Sequence
  Description of Artificial Sequence: Synthetic oligonucleotide
  Target: SCN9A; (+) strand; PAM type: YTN; PAM sequence: TTT
ccctttgtcttccttttctg

SEQ ID NO: 94108 - DNA, 20 bp, Artificial Sequence
  Description of Artificial Sequence: Synthetic oligonucleotide
  Target: SCN9A; (+) strand; PAM type: YTN; PAM sequence: TTC
cctttgtcttccttttctgt

SEQ ID NO: 94109 - DNA, 20 bp, Artificial Sequence
  Description of Artificial Sequence: Synthetic oligonucleotide
  Target: SCN9A; (+) strand; PAM type: YTN; PAM sequence: CTT
tgtcttccttttctgttctg

SEQ ID NO: 94110 - DNA, 20 bp, Artificial Sequence
  Description of Artificial Sequence: Synthetic oligonucleotide
  Target: SCN9A; (+) strand; PAM type: YTN; PAM sequence: TTT
gtcttccttttctgttctgt

SEQ ID NO: 94111 - DNA, 20 bp, Artificial Sequence
  Description of Artificial Sequence: Synthetic oligonucleotide
  Target: SCN9A; (+) strand; PAM type: YTN; PAM sequence: TTG
tcttccttttctgttctgtc

SEQ ID NO: 94112 - DNA, 20 bp, Artificial Sequence
  Description of Artificial Sequence: Synthetic oligonucleotide
  Target: SCN9A; (+) strand; PAM type: YTN; PAM sequence: CTT
ccttttctgttctgtcttgt

SEQ ID NO: 94113 - DNA, 20 bp, Artificial Sequence
  Description of Artificial Sequence: Synthetic oligonucleotide
  Target: SCN9A; (+) strand; PAM type: YTN; PAM sequence: TTC
cttttctgttctgtcttgtt

SEQ ID NO: 94114 - DNA, 20 bp, Artificial Sequence
  Description of Artificial Sequence: Synthetic oligonucleotide
  Target: SCN9A; (+) strand; PAM type: YTN; PAM sequence: CTT
ttctgttctgtcttgttcat

SEQ ID NO: 94115 - DNA, 20 bp, Artificial Sequence
  Description of Artificial Sequence: Synthetic oligonucleotide
  Target: SCN9A; (+) strand; PAM type: YTN; PAM sequence: TTT
tctgttctgtcttgttcata

SEQ ID NO: 94116 - DNA, 20 bp, Artificial Sequence
  Description of Artificial Sequence: Synthetic oligonucleotide
  Target: SCN9A; (+) strand; PAM type: YTN; PAM sequence: TTT
ctgttctgtcttgttcatat

SEQ ID NO: 94117 - DNA, 20 bp, Artificial Sequence
  Description of Artificial Sequence: Synthetic oligonucleotide
  Target: SCN9A; (+) strand; PAM type: YTN; PAM sequence: TTC
tgttctgtcttgttcatatt

SEQ ID NO: 94118 - DNA, 20 bp, Artificial Sequence
  Description of Artificial Sequence: Synthetic oligonucleotide
  Target: SCN9A; (+) strand; PAM type: YTN; PAM sequence: CTG
ttctgtcttgttcatatttc

SEQ ID NO: 94119 - DNA, 20 bp, Artificial Sequence
  Description of Artificial Sequence: Synthetic oligonucleotide
  Target: SCN9A; (+) strand; PAM type: YTN; PAM sequence: TTC
tgtcttgttcatatttctct

SEQ ID NO: 94120 - DNA, 20 bp, Artificial Sequence
  Description of Artificial Sequence: Synthetic oligonucleotide
  Target: SCN9A; (+) strand; PAM type: YTN; PAM sequence: CTG
tcttgttcatatttctcttt

SEQ ID NO: 94121 - DNA, 20 bp, Artificial Sequence
  Description of Artificial Sequence: Synthetic oligonucleotide
  Target: SCN9A; (+) strand; PAM type: YTN; PAM sequence: CTT
gttcatatttctctttgtct

SEQ ID NO: 94122 - DNA, 20 bp, Artificial Sequence
  Description of Artificial Sequence: Synthetic oligonucleotide
  Target: SCN9A; (+) strand; PAM type: YTN; PAM sequence: TTG
ttcatatttctctttgtctg

SEQ ID NO: 94123 - DNA, 20 bp, Artificial Sequence
  Description of Artificial Sequence: Synthetic oligonucleotide
  Target: SCN9A; (+) strand; PAM type: YTN; PAM sequence: TTC
atatttctctttgtctggct

SEQ ID NO: 94124 - DNA, 20 bp, Artificial Sequence
  Description of Artificial Sequence: Synthetic oligonucleotide
  Target: SCN9A; (+) strand; PAM type: YTN; PAM sequence: TTT
ctctttgtctggctttgtta

SEQ ID NO: 94125 - DNA, 20 bp, Artificial Sequence
  Description of Artificial Sequence: Synthetic oligonucleotide
  Target: SCN9A; (+) strand; PAM type: YTN; PAM sequence: TTC
tctttgtctggctttgttac

SEQ ID NO: 94126 - DNA, 20 bp, Artificial Sequence
  Description of Artificial Sequence: Synthetic oligonucleotide
  Target: SCN9A; (+) strand; PAM type: YTN; PAM sequence: CTC
tttgtctggctttgttacac

SEQ ID NO: 94127 - DNA, 20 bp, Artificial Sequence
  Description of Artificial Sequence: Synthetic oligonucleotide
  Target: SCN9A; (+) strand; PAM type: YTN; PAM sequence: CTT
tgtctggctttgttacacta

SEQ ID NO: 94128 - DNA, 20 bp, Artificial Sequence
  Description of Artificial Sequence: Synthetic oligonucleotide
  Target: SCN9A; (+) strand; PAM type: YTN; PAM sequence: TTT
gtctggctttgttacactat

SEQ ID NO: 94129 - DNA, 20 bp, Artificial Sequence
  Description of Artificial Sequence: Synthetic oligonucleotide
  Target: SCN9A; (+) strand; PAM type: YTN; PAM sequence: TTG
tctggctttgttacactatc

SEQ ID NO: 94130 - DNA, 20 bp, Artificial Sequence
  Description of Artificial Sequence: Synthetic oligonucleotide
  Target: SCN9A; (+) strand; PAM type: YTN; PAM sequence: CTG
gctttgttacactatcatat

SEQ ID NO: 94131 - DNA, 20 bp, Artificial Sequence
  Description of Artificial Sequence: Synthetic oligonucleotide
  Target: SCN9A; (+) strand; PAM type: YTN; PAM sequence: CTT
tgttacactatcatatgaag

SEQ ID NO: 94132 - DNA, 20 bp, Artificial Sequence
  Description of Artificial Sequence: Synthetic oligonucleotide
  Target: SCN9A; (+) strand; PAM type: YTN; PAM sequence: TTT
gttacactatcatatgaagg

SEQ ID NO: 94133 - DNA, 20 bp, Artificial Sequence
  Description of Artificial Sequence: Synthetic oligonucleotide
  Target: SCN9A; (+) strand; PAM type: YTN; PAM sequence: TTG
ttacactatcatatgaaggt

SEQ ID NO: 94134 - DNA, 20 bp, Artificial Sequence
  Description of Artificial Sequence: Synthetic oligonucleotide
  Target: SCN9A; (+) strand; PAM type: YTN; PAM sequence: TTA
cactatcatatgaaggtgga

SEQ ID NO: 94135 - DNA, 20 bp, Artificial Sequence
  Description of Artificial Sequence: Synthetic oligonucleotide
  Target: SCN9A; (+) strand; PAM type: YTN; PAM sequence: CTA
tcatatgaaggtggagaggt

SEQ ID NO: 94136 - DNA, 20 bp, Artificial Sequence
  Description of Artificial Sequence: Synthetic oligonucleotide
  Target: SCN9A; (+) strand; PAM type: YTN; PAM sequence: CTG
ttttttctggacttgagttc

SEQ ID NO: 94137 - DNA, 20 bp, Artificial Sequence
  Description of Artificial Sequence: Synthetic oligonucleotide
  Target: SCN9A; (+) strand; PAM type: YTN; PAM sequence: TTT
tttctggacttgagttctca

SEQ ID NO: 94138 - DNA, 20 bp, Artificial Sequence
  Description of Artificial Sequence: Synthetic oligonucleotide
  Target: SCN9A; (+) strand; PAM type: YTN; PAM sequence: TTT
ttctggacttgagttctcat

SEQ ID NO: 94139 - DNA, 20 bp, Artificial Sequence
  Description of Artificial Sequence: Synthetic oligonucleotide
  Target: SCN9A; (+) strand; PAM type: YTN; PAM sequence: TTT
tctggacttgagttctcatt

SEQ ID NO: 94140 - DNA, 20 bp, Artificial Sequence
  Description of Artificial Sequence: Synthetic oligonucleotide
  Target: SCN9A; (+) strand; PAM type: YTN; PAM sequence: TTT
ctggacttgagttctcatta

SEQ ID NO: 94141 - DNA, 20 bp, Artificial Sequence
  Description of Artificial Sequence: Synthetic oligonucleotide
  Target: SCN9A; (+) strand; PAM type: YTN; PAM sequence: TTC
tggacttgagttctcattaa

SEQ ID NO: 94142 - DNA, 20 bp, Artificial Sequence
  Description of Artificial Sequence: Synthetic oligonucleotide
  Target: SCN9A; (+) strand; PAM type: YTN; PAM sequence: CTG
gacttgagttctcattaaca

SEQ ID NO: 94143 - DNA, 20 bp, Artificial Sequence
  Description of Artificial Sequence: Synthetic oligonucleotide
  Target: SCN9A; (+) strand; PAM type: YTN; PAM sequence: CTT
gagttctcattaacattatc

SEQ ID NO: 94144 - DNA, 20 bp, Artificial Sequence
  Description of Artificial Sequence: Synthetic oligonucleotide
  Target: SCN9A; (+) strand; PAM type: YTN; PAM sequence: TTG
agttctcattaacattatca

SEQ ID NO: 94145 - DNA, 20 bp, Artificial Sequence
  Description of Artificial Sequence: Synthetic oligonucleotide
  Target: SCN9A; (+) strand; PAM type: YTN; PAM sequence: TTC
tcattaacattatcaaaagc

SEQ ID NO: 94146 - DNA, 20 bp, Artificial Sequence
  Description of Artificial Sequence: Synthetic oligonucleotide
  Target: SCN9A; (+) strand; PAM type: YTN; PAM sequence: CTC
attaacattatcaaaagcca

SEQ ID NO: 94147 - DNA, 20 bp, Artificial Sequence
  Description of Artificial Sequence: Synthetic oligonucleotide
  Target: SCN9A; (+) strand; PAM type: YTN; PAM sequence: TTA
acattatcaaaagccatatc

SEQ ID NO: 94148 - DNA, 20 bp, Artificial Sequence
  Description of Artificial Sequence: Synthetic oligonucleotide
  Target: SCN9A; (+) strand; PAM type: YTN; PAM sequence: TTA
tcaaaagccatatctttttt

SEQ ID NO: 94149 - DNA, 20 bp, Artificial Sequence
  Description of Artificial Sequence: Synthetic oligonucleotide
  Target: SCN9A; (+) strand; PAM type: YTN; PAM sequence: CTT
ttttattgagtaaatcatca

SEQ ID NO: 94150 - DNA, 20 bp, Artificial Sequence
  Description of Artificial Sequence: Synthetic oligonucleotide
  Target: SCN9A; (+) strand; PAM type: YTN; PAM sequence: TTT
tttattgagtaaatcatcat

SEQ ID NO: 94151 - DNA, 20 bp, Artificial Sequence
  Description of Artificial Sequence: Synthetic oligonucleotide
  Target: SCN9A; (+) strand; PAM type: YTN; PAM sequence: TTT
ttattgagtaaatcatcatc

SEQ ID NO: 94152 - DNA, 20 bp, Artificial Sequence
  Description of Artificial Sequence: Synthetic oligonucleotide
  Target: SCN9A; (+) strand; PAM type: YTN; PAM sequence: TTT
tattgagtaaatcatcatct

SEQ ID NO: 94153 - DNA, 20 bp, Artificial Sequence
  Description of Artificial Sequence: Synthetic oligonucleotide
  Target: SCN9A; (+) strand; PAM type: YTN; PAM sequence: TTT
attgagtaaatcatcatctc

SEQ ID NO: 94154 - DNA, 20 bp, Artificial Sequence
  Description of Artificial Sequence: Synthetic oligonucleotide
  Target: SCN9A; (+) strand; PAM type: YTN; PAM sequence: TTA
ttgagtaaatcatcatctct

SEQ ID NO: 94155 - DNA, 20 bp, Artificial Sequence
  Description of Artificial Sequence: Synthetic oligonucleotide
  Target: SCN9A; (+) strand; PAM type: YTN; PAM sequence: TTG
agtaaatcatcatctctgtc

SEQ ID NO: 94156 - DNA, 20 bp, Artificial Sequence
  Description of Artificial Sequence: Synthetic oligonucleotide
  Target: SCN9A; (+) strand; PAM type: YTN; PAM sequence: CTC
tgtctccatcttttatgtat

SEQ ID NO: 94157 - DNA, 20 bp, Artificial Sequence
  Description of Artificial Sequence: Synthetic oligonucleotide
  Target: SCN9A; (+) strand; PAM type: YTN; PAM sequence: CTG
tctccatcttttatgtatat

SEQ ID NO: 94158 - DNA, 20 bp, Artificial Sequence
  Description of Artificial Sequence: Synthetic oligonucleotide
  Target: SCN9A; (+) strand; PAM type: YTN; PAM sequence: CTC
catcttttatgtatatactt

SEQ ID NO: 94159 - DNA, 20 bp, Artificial Sequence
  Description of Artificial Sequence: Synthetic oligonucleotide
  Target: SCN9A; (+) strand; PAM type: YTN; PAM sequence: CTT
ttatgtatatacttgatata

SEQ ID NO: 94160 - DNA, 20 bp, Artificial Sequence
  Description of Artificial Sequence: Synthetic oligonucleotide
  Target: SCN9A; (+) strand; PAM type: YTN; PAM sequence: TTT
tatgtatatacttgatatat

SEQ ID NO: 94161 - DNA, 20 bp, Artificial Sequence
  Description of Artificial Sequence: Synthetic oligonucleotide
  Target: SCN9A; (+) strand; PAM type: YTN; PAM sequence: TTT
atgtatatacttgatatatt

SEQ ID NO: 94162 - DNA, 20 bp, Artificial Sequence
  Description of Artificial Sequence: Synthetic oligonucleotide
  Target: SCN9A; (+) strand; PAM type: YTN; PAM sequence: TTA
tgtatatacttgatatattt

SEQ ID NO: 94163 - DNA, 20 bp, Artificial Sequence
  Description of Artificial Sequence: Synthetic oligonucleotide
  Target: SCN9A; (+) strand; PAM type: YTN; PAM sequence: CTT
gatatatttttgacattttg

SEQ ID NO: 94164 - DNA, 20 bp, Artificial Sequence
  Description of Artificial Sequence: Synthetic oligonucleotide
  Target: SCN9A; (+) strand; PAM type: YTN; PAM sequence: TTG
atatatttttgacattttgc

SEQ ID NO: 94165 - DNA, 20 bp, Artificial Sequence
  Description of Artificial Sequence: Synthetic oligonucleotide
  Target: SCN9A; (+) strand; PAM type: YTN; PAM sequence: TTT
ttgacattttgccttaagcg

SEQ ID NO: 94166 - DNA, 20 bp, Artificial Sequence
  Description of Artificial Sequence: Synthetic oligonucleotide
  Target: SCN9A; (+) strand; PAM type: YTN; PAM sequence: TTT
tgacattttgccttaagcgg

SEQ ID NO: 94167 - DNA, 20 bp, Artificial Sequence
  Description of Artificial Sequence: Synthetic oligonucleotide
  Target: SCN9A; (+) strand; PAM type: YTN; PAM sequence: TTT
gacattttgccttaagcggt

SEQ ID NO: 94168 - DNA, 20 bp, Artificial Sequence
  Description of Artificial Sequence: Synthetic oligonucleotide
  Target: SCN9A; (+) strand; PAM type: YTN; PAM sequence: TTG
acattttgccttaagcggta

SEQ ID NO: 94169 - DNA, 20 bp, Artificial Sequence
  Description of Artificial Sequence: Synthetic oligonucleotide
  Target: SCN9A; (+) strand; PAM type: YTN; PAM sequence: TTT
tgccttaagcggtaacgtct

SEQ ID NO: 94170 - DNA, 20 bp, Artificial Sequence
  Description of Artificial Sequence: Synthetic oligonucleotide
  Target: SCN9A; (+) strand; PAM type: YTN; PAM sequence: TTT
gccttaagcggtaacgtcta

SEQ ID NO: 94171 - DNA, 20 bp, Artificial Sequence
  Description of Artificial Sequence: Synthetic oligonucleotide
  Target: SCN9A; (+) strand; PAM type: YTN; PAM sequence: TTG
ccttaagcggtaacgtctat

SEQ ID NO: 94172 - DNA, 20 bp, Artificial Sequence
  Description of Artificial Sequence: Synthetic oligonucleotide
  Target: SCN9A; (+) strand; PAM type: YTN; PAM sequence: CTT
aagcggtaacgtctataagc

SEQ ID NO: 94173 - DNA, 20 bp, Artificial Sequence
  Description of Artificial Sequence: Synthetic oligonucleotide
  Target: SCN9A; (+) strand; PAM type: YTN; PAM sequence: TTA
agcggtaacgtctataagca

SEQ ID NO: 94174 - DNA, 20 bp, Artificial Sequence
  Description of Artificial Sequence: Synthetic oligonucleotide
  Target: SCN9A; (+) strand; PAM type: YTN; PAM sequence: CTA
taagcacgctgaatgacagt

SEQ ID NO: 94175 - DNA, 20 bp, Artificial Sequence
  Description of Artificial Sequence: Synthetic oligonucleotide
  Target: SCN9A; (+) strand; PAM type: YTN; PAM sequence: CTG
aatgacagtagcagacacat

SEQ ID NO: 94176 - DNA, 20 bp, Artificial Sequence
  Description of Artificial Sequence: Synthetic oligonucleotide
  Target: SCN9A; (+) strand; PAM type: YTN; PAM sequence: CTC
ttgtttccgttttagtgtgg

SEQ ID NO: 94177 - DNA, 20 bp, Artificial Sequence
  Description of Artificial Sequence: Synthetic oligonucleotide
  Target: SCN9A; (+) strand; PAM type: YTN; PAM sequence: CTT
gtttccgttttagtgtggtt

SEQ ID NO: 94178 - DNA, 20 bp, Artificial Sequence
  Description of Artificial Sequence: Synthetic oligonucleotide
  Target: SCN9A; (+) strand; PAM type: YTN; PAM sequence: TTG
tttccgttttagtgtggttg

SEQ ID NO: 94179 - DNA, 20 bp, Artificial Sequence
  Description of Artificial Sequence: Synthetic oligonucleotide
  Target: SCN9A; (+) strand; PAM type: YTN; PAM sequence: TTT
ccgttttagtgtggttgtga

SEQ ID NO: 94180 - DNA, 20 bp, Artificial Sequence
  Description of Artificial Sequence: Synthetic oligonucleotide
  Target: SCN9A; (+) strand; PAM type: YTN; PAM sequence: TTC
cgttttagtgtggttgtgat

SEQ ID NO: 94181 - DNA, 20 bp, Artificial Sequence
  Description of Artificial Sequence: Synthetic oligonucleotide
  Target: SCN9A; (+) strand; PAM type: YTN; PAM sequence: TTT
tagtgtggttgtgatgggtt

SEQ ID NO: 94182 - DNA, 20 bp, Artificial Sequence
  Description of Artificial Sequence: Synthetic oligonucleotide
  Target: SCN9A; (+) strand; PAM type: YTN; PAM sequence: TTT
agtgtggttgtgatgggttc

SEQ ID NO: 94183 - DNA, 20 bp, Artificial Sequence
  Description of Artificial Sequence: Synthetic oligonucleotide
  Target: SCN9A; (+) strand; PAM type: YTN; PAM sequence: TTA
gtgtggttgtgatgggttca

SEQ ID NO: 94184 - DNA, 20 bp, Artificial Sequence
  Description of Artificial Sequence: Synthetic oligonucleotide
  Target: SCN9A; (+) strand; PAM type: YTN; PAM sequence: TTG
tgatgggttcataggacact

SEQ ID NO: 94185 - DNA, 20 bp, Artificial Sequence
  Description of Artificial Sequence: Synthetic oligonucleotide
  Target: SCN9A; (+) strand; PAM type: YTN; PAM sequence: TTC
ataggacactttggaaggat

SEQ ID NO: 94186 - DNA, 20 bp, Artificial Sequence
  Description of Artificial Sequence: Synthetic oligonucleotide
  Target: SCN9A; (+) strand; PAM type: YTN; PAM sequence: CTT
tggaaggatttgcagacatg

SEQ ID NO: 94187 - DNA, 20 bp, Artificial Sequence
  Description of Artificial Sequence: Synthetic oligonucleotide
  Target: SCN9A; (+) strand; PAM type: YTN; PAM sequence: TTT
ggaaggatttgcagacatga

SEQ ID NO: 94188 - DNA, 20 bp, Artificial Sequence
  Description of Artificial Sequence: Synthetic oligonucleotide
  Target: SCN9A; (+) strand; PAM type: YTN; PAM sequence: TTG
gaaggatttgcagacatgaa

SEQ ID NO: 94189 - DNA, 20 bp, Artificial Sequence
  Description of Artificial Sequence: Synthetic oligonucleotide
  Target: SCN9A; (+) strand; PAM type: YTN; PAM sequence: TTT
gcagacatgaacctttcttc

SEQ ID NO: 94190 - DNA, 20 bp, Artificial Sequence
  Description of Artificial Sequence: Synthetic oligonucleotide
  Target: SCN9A; (+) strand; PAM type: YTN; PAM sequence: TTG
cagacatgaacctttcttcc

SEQ ID NO: 94191 - DNA, 20 bp, Artificial Sequence
  Description of Artificial Sequence: Synthetic oligonucleotide
  Target: SCN9A; (+) strand; PAM type: YTN; PAM sequence: CTT
tcttccatctgtgaacgaag

SEQ ID NO: 94192 - DNA, 20 bp, Artificial Sequence
  Description of Artificial Sequence: Synthetic oligonucleotide
  Target: SCN9A; (+) strand; PAM type: YTN; PAM sequence: TTT
cttccatctgtgaacgaaga

SEQ ID NO: 94193 - DNA, 20 bp, Artificial Sequence
  Description of Artificial Sequence: Synthetic oligonucleotide
  Target: SCN9A; (+) strand; PAM type: YTN; PAM sequence: TTC
ttccatctgtgaacgaagag

SEQ ID NO: 94194 - DNA, 20 bp, Artificial Sequence
  Description of Artificial Sequence: Synthetic oligonucleotide
  Target: SCN9A; (+) strand; PAM type: YTN; PAM sequence: CTT
ccatctgtgaacgaagagaa

SEQ ID NO: 94195 - DNA, 20 bp, Artificial Sequence
  Description of Artificial Sequence: Synthetic oligonucleotide
  Target: SCN9A; (+) strand; PAM type: YTN; PAM sequence: TTC
catctgtgaacgaagagaat

SEQ ID NO: 94196 - DNA, 20 bp, Artificial Sequence
  Description of Artificial Sequence: Synthetic oligonucleotide
  Target: SCN9A; (+) strand; PAM type: YTN; PAM sequence: CTG
tgaacgaagagaatccatct

SEQ ID NO: 94197 - DNA, 20 bp, Artificial Sequence
  Description of Artificial Sequence: Synthetic oligonucleotide
  Target: SCN9A; (+) strand; PAM type: YTN; PAM sequence: CTC
cccactctcacccaaaacac

SEQ ID NO: 94198 - DNA, 20 bp, Artificial Sequence
  Description of Artificial Sequence: Synthetic oligonucleotide
  Target: SCN9A; (+) strand; PAM type: YTN; PAM sequence: CTC
tcacccaaaacacgctttgt

SEQ ID NO: 94199 - DNA, 20 bp, Artificial Sequence
  Description of Artificial Sequence: Synthetic oligonucleotide
  Target: SCN9A; (+) strand; PAM type: YTN; PAM sequence: CTC
acccaaaacacgctttgtaa

SEQ ID NO: 94200 - DNA, 20 bp, Artificial Sequence
  Description of Artificial Sequence: Synthetic oligonucleotide
  Target: SCN9A; (+) strand; PAM type: YTN; PAM sequence: CTT
tgtaaaagcaaataagatgt

SEQ ID NO: 94201 - DNA, 20 bp, Artificial Sequence
  Description of Artificial Sequence: Synthetic oligonucleotide
  Target: SCN9A; (+) strand; PAM type: YTN; PAM sequence: TTT
gtaaaagcaaataagatgtc

SEQ ID NO: 94202 - DNA, 20 bp, Artificial Sequence
  Description of Artificial Sequence: Synthetic oligonucleotide
  Target: SCN9A; (+) strand; PAM type: YTN; PAM sequence: TTG
taaaagcaaataagatgtca

SEQ ID NO: 94203 - DNA, 20 bp, Artificial Sequence
  Description of Artificial Sequence: Synthetic oligonucleotide
  Target: SCN9A; (+) strand; PAM type: YTN; PAM sequence: CTA
accatgggcagatccatggc

SEQ ID NO: 94204 - DNA, 20 bp, Artificial Sequence
  Description of Artificial Sequence: Synthetic oligonucleotide
  Target: SCN9A; (+) strand; PAM type: YTN; PAM sequence: CTG
gactttgttgggttttgcta

SEQ ID NO: 94205 - DNA, 20 bp, Artificial Sequence
  Description of Artificial Sequence: Synthetic oligonucleotide
  Target: SCN9A; (+) strand; PAM type: YTN; PAM sequence: CTT
tgttgggttttgctatgaga

SEQ ID NO: 94206 - DNA, 20 bp, Artificial Sequence
  Description of Artificial Sequence: Synthetic oligonucleotide
  Target: SCN9A; (+) strand; PAM type: YTN; PAM sequence: TTT
gttgggttttgctatgagaa

SEQ ID NO: 94207 - DNA, 20 bp, Artificial Sequence
  Description of Artificial Sequence: Synthetic oligonucleotide
  Target: SCN9A; (+) strand; PAM type: YTN; PAM sequence: TTG
ttgggttttgctatgagaag

SEQ ID NO: 94208 - DNA, 20 bp, Artificial Sequence
  Description of Artificial Sequence: Synthetic oligonucleotide
  Target: SCN9A; (+) strand; PAM type: YTN; PAM sequence: TTG
ggttttgctatgagaagagg

SEQ ID NO: 94209 - DNA, 20 bp, Artificial Sequence
  Description of Artificial Sequence: Synthetic oligonucleotide
  Target: SCN9A; (+) strand; PAM type: YTN; PAM sequence: TTT
tgctatgagaagaggaggat

SEQ ID NO: 94210 - DNA, 20 bp, Artificial Sequence
  Description of Artificial Sequence: Synthetic oligonucleotide
  Target: SCN9A; (+) strand; PAM type: YTN; PAM sequence: TTT
gctatgagaagaggaggatc

SEQ ID NO: 94211 - DNA, 20 bp, Artificial Sequence
  Description of Artificial Sequence: Synthetic oligonucleotide
  Target: SCN9A; (+) strand; PAM type: YTN; PAM sequence: TTG
ctatgagaagaggaggatcc

SEQ ID NO: 94212 - DNA, 20 bp, Artificial Sequence
  Description of Artificial Sequence: Synthetic oligonucleotide
  Target: SCN9A; (+) strand; PAM type: YTN; PAM sequence: CTA
tgagaagaggaggatccagg

SEQ ID NO: 94213 - DNA, 20 bp, Artificial Sequence
  Description of Artificial Sequence: Synthetic oligonucleotide
  Target: SCN9A; (+) strand; PAM type: YTN; PAM sequence: CTG
caaaatcagagagtttagag

SEQ ID NO: 94214 - DNA, 20 bp, Artificial Sequence
  Description of Artificial Sequence: Synthetic oligonucleotide
  Target: SCN9A; (+) strand; PAM type: YTN; PAM sequence: TTT
agagaactctataaactggg

SEQ ID NO: 94215 - DNA, 20 bp, Artificial Sequence
  Description of Artificial Sequence: Synthetic oligonucleotide
  Target: SCN9A; (+) strand; PAM type: YTN; PAM sequence: TTA
gagaactctataaactgggt

SEQ ID NO: 94216 - DNA, 20 bp, Artificial Sequence
  Description of Artificial Sequence: Synthetic oligonucleotide
  Target: SCN9A; (+) strand; PAM type: YTN; PAM sequence: CTC
tataaactgggtcgcatcgg

SEQ ID NO: 94217 - DNA, 20 bp, Artificial Sequence
  Description of Artificial Sequence: Synthetic oligonucleotide
  Target: SCN9A; (+) strand; PAM type: YTN; PAM sequence: CTA
taaactgggtcgcatcggga

SEQ ID NO: 94218 - DNA, 20 bp, Artificial Sequence
  Description of Artificial Sequence: Synthetic oligonucleotide
  Target: SCN9A; (+) strand; PAM type: YTN; PAM sequence: CTG
ggtcgcatcgggatcaaact

SEQ ID NO: 94219 - DNA, 20 bp, Artificial Sequence
  Description of Artificial Sequence: Synthetic oligonucleotide
  Target: SCN9A; (+) strand; PAM type: YTN; PAM sequence: CTT
ctcccaaacctcatagaaca

SEQ ID NO: 94220 - DNA, 20 bp, Artificial Sequence
  Description of Artificial Sequence: Synthetic oligonucleotide
  Target: SCN9A; (+) strand; PAM type: YTN; PAM sequence: TTC
tcccaaacctcatagaacat

SEQ ID NO: 94221 - DNA, 20 bp, Artificial Sequence
  Description of Artificial Sequence: Synthetic oligonucleotide
  Target: SCN9A; (+) strand; PAM type: YTN; PAM sequence: CTC
ccaaacctcatagaacatct

SEQ ID NO: 94222 - DNA, 20 bp, Artificial Sequence
  Description of Artificial Sequence: Synthetic oligonucleotide
  Target: SCN9A; (+) strand; PAM type: YTN; PAM sequence: CTC
atagaacatctcaaagtcat

SEQ ID NO: 94223 - DNA, 20 bp, Artificial Sequence
  Description of Artificial Sequence: Synthetic oligonucleotide
  Target: SCN9A; (+) strand; PAM type: YTN; PAM sequence: CTC
aaagtcatcctcactcagag

SEQ ID NO: 94224 - DNA, 20 bp, Artificial Sequence
  Description of Artificial Sequence: Synthetic oligonucleotide
  Target: SCN9A; (+) strand; PAM type: YTN; PAM sequence: CTC
actcagaggttcagtacttt

SEQ ID NO: 94225 - DNA, 20 bp, Artificial Sequence
  Description of Artificial Sequence: Synthetic oligonucleotide
  Target: SCN9A; (+) strand; PAM type: YTN; PAM sequence: CTC
agaggttcagtactttcttc

SEQ ID NO: 94226 - DNA, 20 bp, Artificial Sequence
  Description of Artificial Sequence: Synthetic oligonucleotide
  Target: SCN9A; (+) strand; PAM type: YTN; PAM sequence: TTC
agtactttcttcagtggcaa

SEQ ID NO: 94227 - DNA, 20 bp, Artificial Sequence
  Description of Artificial Sequence: Synthetic oligonucleotide
  Target: SCN9A; (+) strand; PAM type: YTN; PAM sequence: CTT
tcttcagtggcaacactaaa

SEQ ID NO: 94228 - DNA, 20 bp, Artificial Sequence
  Description of Artificial Sequence: Synthetic oligonucleotide
  Target: SCN9A; (+) strand; PAM type: YTN; PAM sequence: TTT
cttcagtggcaacactaaaa

SEQ ID NO: 94229 - DNA, 20 bp, Artificial Sequence
  Description of Artificial Sequence: Synthetic oligonucleotide
  Target: SCN9A; (+) strand; PAM type: YTN; PAM sequence: TTC
ttcagtggcaacactaaaat

SEQ ID NO: 94230 - DNA, 20 bp, Artificial Sequence
  Description of Artificial Sequence: Synthetic oligonucleotide
  Target: SCN9A; (+) strand; PAM type: YTN; PAM sequence: CTT
cagtggcaacactaaaattc

SEQ ID NO: 94231 - DNA, 20 bp, Artificial Sequence
  Description of Artificial Sequence: Synthetic oligonucleotide
  Target: SCN9A; (+) strand; PAM type: YTN; PAM sequence: TTC
agtggcaacactaaaattct

SEQ ID NO: 94232 - DNA, 20 bp, Artificial Sequence
  Description of Artificial Sequence: Synthetic oligonucleotide
  Target: SCN9A; (+) strand; PAM type: YTN; PAM sequence: CTA
aaattctccagtatgactgc

SEQ ID NO: 94233 - DNA, 20 bp, Artificial Sequence
  Description of Artificial Sequence: Synthetic oligonucleotide
  Target: SCN9A; (+) strand; PAM type: YTN; PAM sequence: TTC
tccagtatgactgcaatgta

SEQ ID NO: 94234 - DNA, 20 bp, Artificial Sequence
  Description of Artificial Sequence: Synthetic oligonucleotide
  Target: SCN9A; (+) strand; PAM type: YTN; PAM sequence: CTC
cagtatgactgcaatgtaca

SEQ ID NO: 94235 - DNA, 20 bp, Artificial Sequence
  Description of Artificial Sequence: Synthetic oligonucleotide
  Target: SCN9A; (+) strand; PAM type: YTN; PAM sequence: CTG
caatgtacatgttcaccaca

SEQ ID NO: 94236 - DNA, 20 bp, Artificial Sequence
  Description of Artificial Sequence: Synthetic oligonucleotide
  Target: SCN9A; (+) strand; PAM type: YTN; PAM sequence: TTC
accacaaccaggaaggatat

SEQ ID NO: 94237 - DNA, 20 bp, Artificial Sequence
  Description of Artificial Sequence: Synthetic oligonucleotide
  Target: SCN9A; (+) strand; PAM type: YTN; PAM sequence: CTA
acaaagtagaatattccaac

SEQ ID NO: 94238 - DNA, 20 bp, Artificial Sequence
  Description of Artificial Sequence: Synthetic oligonucleotide
  Target: SCN9A; (+) strand; PAM type: YTN; PAM sequence: TTC
caacagatgggttaccacag

SEQ ID NO: 94239 - DNA, 20 bp, Artificial Sequence
  Description of Artificial Sequence: Synthetic oligonucleotide
  Target: SCN9A; (+) strand; PAM type: YTN; PAM sequence: TTA
ccacagtctccttcaactga

SEQ ID NO: 94240 - DNA, 20 bp, Artificial Sequence
  Description of Artificial Sequence: Synthetic oligonucleotide
  Target: SCN9A; (+) strand; PAM type: YTN; PAM sequence: CTC
cttcaactgaacttccagga

SEQ ID NO: 94241 - DNA, 20 bp, Artificial Sequence
  Description of Artificial Sequence: Synthetic oligonucleotide
  Target: SCN9A; (+) strand; PAM type: YTN; PAM sequence: CTT
caactgaacttccaggatga

SEQ ID NO: 94242 - DNA, 20 bp, Artificial Sequence
  Description of Artificial Sequence: Synthetic oligonucleotide
  Target: SCN9A; (+) strand; PAM type: YTN; PAM sequence: TTC
aactgaacttccaggatgaa

SEQ ID NO: 94243 - DNA, 20 bp, Artificial Sequence
  Description of Artificial Sequence: Synthetic oligonucleotide
  Target: SCN9A; (+) strand; PAM type: YTN; PAM sequence: CTG
aacttccaggatgaactttt

SEQ ID NO: 94244 - DNA, 20 bp, Artificial Sequence
  Description of Artificial Sequence: Synthetic oligonucleotide
  Target: SCN9A; (+) strand; PAM type: YTN; PAM sequence: CTT
ccaggatgaactttttttgg

SEQ ID NO: 94245 - DNA, 20 bp, Artificial Sequence
  Description of Artificial Sequence: Synthetic oligonucleotide
  Target: SCN9A; (+) strand; PAM type: YTN; PAM sequence: TTC
caggatgaactttttttggg

SEQ ID NO: 94246 - DNA, 20 bp, Artificial Sequence
  Description of Artificial Sequence: Synthetic oligonucleotide
  Target: SCN9A; (+) strand; PAM type: YTN; PAM sequence: CTT
tttttgggtcacagtcgggt

SEQ ID NO: 94247 - DNA, 20 bp, Artificial Sequence
  Description of Artificial Sequence: Synthetic oligonucleotide
  Target: SCN9A; (+) strand; PAM type: YTN; PAM sequence: TTT
ttttgggtcacagtcgggtg

SEQ ID NO: 94248 - DNA, 20 bp, Artificial Sequence
  Description of Artificial Sequence: Synthetic oligonucleotide
  Target: SCN9A; (+) strand; PAM type: YTN; PAM sequence: TTT
tttgggtcacagtcgggtgg

SEQ ID NO: 94249 - DNA, 20 bp, Artificial Sequence
  Description of Artificial Sequence: Synthetic oligonucleotide
  Target: SCN9A; (+) strand; PAM type: YTN; PAM sequence: TTT
ttgggtcacagtcgggtggc

SEQ ID NO: 94250 - DNA, 20 bp, Artificial Sequence
  Description of Artificial Sequence: Synthetic oligonucleotide
  Target: SCN9A; (+) strand; PAM type: YTN; PAM sequence: TTT
tgggtcacagtcgggtggct

SEQ ID NO: 94251 - DNA, 20 bp, Artificial Sequence
  Description of Artificial Sequence: Synthetic oligonucleotide
  Target: SCN9A; (+) strand; PAM type: YTN; PAM sequence: TTT
gggtcacagtcgggtggctt

SEQ ID NO: 94252 - DNA, 20 bp, Artificial Sequence
  Description of Artificial Sequence: Synthetic oligonucleotide
  Target: SCN9A; (+) strand; PAM type: YTN; PAM sequence: TTG
ggtcacagtcgggtggctta

SEQ ID NO: 94253 - DNA, 20 bp, Artificial Sequence
  Description of Artificial Sequence: Synthetic oligonucleotide
  Target: SCN9A; (+) strand; PAM type: YTN; PAM sequence: CTT
actgttaagaataggtgcta

SEQ ID NO: 94254 - DNA, 20 bp, Artificial Sequence
  Description of Artificial Sequence: Synthetic oligonucleotide
  Target: SCN9A; (+) strand; PAM type: YTN; PAM sequence: TTA
ctgttaagaataggtgctag

SEQ ID NO: 94255 - DNA, 20 bp, Artificial Sequence
  Description of Artificial Sequence: Synthetic oligonucleotide
  Target: SCN9A; (+) strand; PAM type: YTN; PAM sequence: CTG
ttaagaataggtgctagcaa

SEQ ID NO: 94256 - DNA, 20 bp, Artificial Sequence
  Description of Artificial Sequence: Synthetic oligonucleotide
  Target: SCN9A; (+) strand; PAM type: YTN; PAM sequence: TTA
agaataggtgctagcaatcc

SEQ ID NO: 94257 - DNA, 20 bp, Artificial Sequence
  Description of Artificial Sequence: Synthetic oligonucleotide
  Target: SCN9A; (+) strand; PAM type: YTN; PAM sequence: CTA
gcaatccatcccagccagca

SEQ ID NO: 94258 - DNA, 20 bp, Artificial Sequence
  Description of Artificial Sequence: Synthetic oligonucleotide
  Target: SCN9A; (+) strand; PAM type: YTN; PAM sequence: TTG
taatttggaacaggcaaatc

SEQ ID NO: 94259 - DNA, 20 bp, Artificial Sequence
  Description of Artificial Sequence: Synthetic oligonucleotide
  Target: SCN9A; (+) strand; PAM type: YTN; PAM sequence: TTT
ggaacaggcaaatcatactg

SEQ ID NO: 94260 - DNA, 20 bp, Artificial Sequence
  Description of Artificial Sequence: Synthetic oligonucleotide
  Target: SCN9A; (+) strand; PAM type: YTN; PAM sequence: TTG
gaacaggcaaatcatactgt

SEQ ID NO: 94261 - DNA, 20 bp, Artificial Sequence
  Description of Artificial Sequence: Synthetic oligonucleotide
  Target: SCN9A; (+) strand; PAM type: YTN; PAM sequence: CTG
ttgccaaaggtctcaaaatt

SEQ ID NO: 94262 - DNA, 20 bp, Artificial Sequence
  Description of Artificial Sequence: Synthetic oligonucleotide
  Target: SCN9A; (+) strand; PAM type: YTN; PAM sequence: TTG
ccaaaggtctcaaaattgaa

SEQ ID NO: 94263 - DNA, 20 bp, Artificial Sequence
  Description of Artificial Sequence: Synthetic oligonucleotide
  Target: SCN9A; (+) strand; PAM type: YTN; PAM sequence: CTC
aaaattgaacatgtcattaa

SEQ ID NO: 94264 - DNA, 20 bp, Artificial Sequence
  Description of Artificial Sequence: Synthetic oligonucleotide
  Target: SCN9A; (+) strand; PAM type: YTN; PAM sequence: TTG
aacatgtcattaattccatc

SEQ ID NO: 94265 - DNA, 20 bp, Artificial Sequence
  Description of Artificial Sequence: Synthetic oligonucleotide
  Target: SCN9A; (+) strand; PAM type: YTN; PAM sequence: TTA
attccatcttcctttttaac

SEQ ID NO: 94266 - DNA, 20 bp, Artificial Sequence
  Description of Artificial Sequence: Synthetic oligonucleotide
  Target: SCN9A; (+) strand; PAM type: YTN; PAM sequence: TTC
catcttcctttttaacatag

SEQ ID NO: 94267 - DNA, 20 bp, Artificial Sequence
  Description of Artificial Sequence: Synthetic oligonucleotide
  Target: SCN9A; (+) strand; PAM type: YTN; PAM sequence: CTT
cctttttaacataggcaaag

SEQ ID NO: 94268 - DNA, 20 bp, Artificial Sequence
  Description of Artificial Sequence: Synthetic oligonucleotide
  Target: SCN9A; (+) strand; PAM type: YTN; PAM sequence: TTC
ctttttaacataggcaaagt

SEQ ID NO: 94269 - DNA, 20 bp, Artificial Sequence
  Description of Artificial Sequence: Synthetic oligonucleotide
  Target: SCN9A; (+) strand; PAM type: YTN; PAM sequence: CTT
tttaacataggcaaagttgg

SEQ ID NO: 94270 - DNA, 20 bp, Artificial Sequence
  Description of Artificial Sequence: Synthetic oligonucleotide
  Target: SCN9A; (+) strand; PAM type: YTN; PAM sequence: TTT
ttaacataggcaaagttgga

SEQ ID NO: 94271 - DNA, 20 bp, Artificial Sequence
  Description of Artificial Sequence: Synthetic oligonucleotide
  Target: SCN9A; (+) strand; PAM type: YTN; PAM sequence: TTT
taacataggcaaagttggac

SEQ ID NO: 94272 - DNA, 20 bp, Artificial Sequence
  Description of Artificial Sequence: Synthetic oligonucleotide
  Target: SCN9A; (+) strand; PAM type: YTN; PAM sequence: TTT
aacataggcaaagttggaca

SEQ ID NO: 94273 - DNA, 20 bp, Artificial Sequence
  Description of Artificial Sequence: Synthetic oligonucleotide
  Target: SCN9A; (+) strand; PAM type: YTN; PAM sequence: TTA
acataggcaaagttggacat

SEQ ID NO: 94274 - DNA, 20 bp, Artificial Sequence
  Description of Artificial Sequence: Synthetic oligonucleotide
  Target: SCN9A; (+) strand; PAM type: YTN; PAM sequence: TTG
gacattccaaagatggcgta

SEQ ID NO: 94275 - DNA, 20 bp, Artificial Sequence
  Description of Artificial Sequence: Synthetic oligonucleotide
  Target: SCN9A; (+) strand; PAM type: YTN; PAM sequence: TTC
caaagatggcgtagatgaac

SEQ ID NO: 94276 - DNA, 20 bp, Artificial Sequence
  Description of Artificial Sequence: Synthetic oligonucleotide
  Target: SCN9A; (+) strand; PAM type: YTN; PAM sequence: TTA
aacaacgcaggaagggacat

SEQ ID NO: 94277 - DNA, 20 bp, Artificial Sequence
  Description of Artificial Sequence: Synthetic oligonucleotide
  Target: SCN9A; (+) strand; PAM type: YTN; PAM sequence: CTT
tgctcctttgactagacgta

SEQ ID NO: 94278 - DNA, 20 bp, Artificial Sequence
  Description of Artificial Sequence: Synthetic oligonucleotide
  Target: SCN9A; (+) strand; PAM type: YTN; PAM sequence: TTT
gctcctttgactagacgtag

SEQ ID NO: 94279 - DNA, 20 bp, Artificial Sequence
  Description of Artificial Sequence: Synthetic oligonucleotide
  Target: SCN9A; (+) strand; PAM type: YTN; PAM sequence: TTG
ctcctttgactagacgtagg

SEQ ID NO: 94280 - DNA, 20 bp, Artificial Sequence
  Description of Artificial Sequence: Synthetic oligonucleotide
  Target: SCN9A; (+) strand; PAM type: YTN; PAM sequence: CTC
ctttgactagacgtaggatt

SEQ ID NO: 94281 - DNA, 20 bp, Artificial Sequence
  Description of Artificial Sequence: Synthetic oligonucleotide
  Target: SCN9A; (+) strand; PAM type: YTN; PAM sequence: CTT
tgactagacgtaggattcgg

SEQ ID NO: 94282 - DNA, 20 bp, Artificial Sequence
  Description of Artificial Sequence: Synthetic oligonucleotide
  Target: SCN9A; (+) strand; PAM type: YTN; PAM sequence: TTT
gactagacgtaggattcggc

SEQ ID NO: 94283 - DNA, 20 bp, Artificial Sequence
  Description of Artificial Sequence: Synthetic oligonucleotide
  Target: SCN9A; (+) strand; PAM type: YTN; PAM sequence: TTG
actagacgtaggattcggcc

SEQ ID NO: 94284 - DNA, 20 bp, Artificial Sequence
  Description of Artificial Sequence: Synthetic oligonucleotide
  Target: SCN9A; (+) strand; PAM type: YTN; PAM sequence: CTA
gacgtaggattcggccaatc

SEQ ID NO: 94285 - DNA, 20 bp, Artificial Sequence
  Description of Artificial Sequence: Synthetic oligonucleotide
  Target: SCN9A; (+) strand; PAM type: YTN; PAM sequence: TTC
ggccaatcctggcaagacgg

SEQ ID NO: 94286 - DNA, 20 bp, Artificial Sequence
  Description of Artificial Sequence: Synthetic oligonucleotide
  Target: SCN9A; (+) strand; PAM type: YTN; PAM sequence: CTG
gcaagacggatcactcggaa

SEQ ID NO: 94287 - DNA, 20 bp, Artificial Sequence
  Description of Artificial Sequence: Synthetic oligonucleotide
  Target: SCN9A; (+) strand; PAM type: YTN; PAM sequence: CTC
ggaacagggtaggggacaca

SEQ ID NO: 94288 - DNA, 20 bp, Artificial Sequence
  Description of Artificial Sequence: Synthetic oligonucleotide
  Target: SCN9A; (+) strand; PAM type: YTN; PAM sequence: TTT
caatcaaatcagctagaaac

SEQ ID NO: 94289 - DNA, 20 bp, Artificial Sequence
  Description of Artificial Sequence: Synthetic oligonucleotide
  Target: SCN9A; (+) strand; PAM type: YTN; PAM sequence: TTC
aatcaaatcagctagaaaca

SEQ ID NO: 94290 - DNA, 20 bp, Artificial Sequence
  Description of Artificial Sequence: Synthetic oligonucleotide
  Target: SCN9A; (+) strand; PAM type: YTN; PAM sequence: CTA
gaaacatacctgtatgtgga

SEQ ID NO: 94291 - DNA, 20 bp, Artificial Sequence
  Description of Artificial Sequence: Synthetic oligonucleotide
  Target: SCN9A; (+) strand; PAM type: YTN; PAM sequence: CTG
tatgtggaggaaaataatag

SEQ ID NO: 94292 - DNA, 20 bp, Artificial Sequence
  Description of Artificial Sequence: Synthetic oligonucleotide
  Target: SCN9A; (+) strand; PAM type: YTN; PAM sequence: TTT
aaagatgtatgctacctgaa

SEQ ID NO: 94293 - DNA, 20 bp, Artificial Sequence
  Description of Artificial Sequence: Synthetic oligonucleotide
  Target: SCN9A; (+) strand; PAM type: YTN; PAM sequence: TTA
aagatgtatgctacctgaaa

SEQ ID NO: 94294 - DNA, 20 bp, Artificial Sequence
  Description of Artificial Sequence: Synthetic oligonucleotide
  Target: SCN9A; (+) strand; PAM type: YTN; PAM sequence: CTA
cctgaaatgatgactctaaa

SEQ ID NO: 94295 - DNA, 20 bp, Artificial Sequence
  Description of Artificial Sequence: Synthetic oligonucleotide
  Target: SCN9A; (+) strand; PAM type: YTN; PAM sequence: CTG
aaatgatgactctaaacagt

SEQ ID NO: 94296 - DNA, 20 bp, Artificial Sequence
  Description of Artificial Sequence: Synthetic oligonucleotide
  Target: SCN9A; (+) strand; PAM type: YTN; PAM sequence: CTC
taaacagttttatctgtcaa

SEQ ID NO: 94297 - DNA, 20 bp, Artificial Sequence
  Description of Artificial Sequence: Synthetic oligonucleotide
  Target: SCN9A; (+) strand; PAM type: YTN; PAM sequence: CTA
aacagttttatctgtcaact

SEQ ID NO: 94298 - DNA, 20 bp, Artificial Sequence
  Description of Artificial Sequence: Synthetic oligonucleotide
  Target: SCN9A; (+) strand; PAM type: YTN; PAM sequence: TTT
tatctgtcaactcatttctt

SEQ ID NO: 94299 - DNA, 20 bp, Artificial Sequence
  Description of Artificial Sequence: Synthetic oligonucleotide
  Target: SCN9A; (+) strand; PAM type: YTN; PAM sequence: TTT
atctgtcaactcatttctta

SEQ ID NO: 94300 - DNA, 20 bp, Artificial Sequence
  Description of Artificial Sequence: Synthetic oligonucleotide
  Target: SCN9A; (+) strand; PAM type: YTN; PAM sequence: TTA
tctgtcaactcatttcttat

SEQ ID NO: 94301 - DNA, 20 bp, Artificial Sequence
  Description of Artificial Sequence: Synthetic oligonucleotide
  Target: SCN9A; (+) strand; PAM type: YTN; PAM sequence: CTG
tcaactcatttcttatgaat

SEQ ID NO: 94302 - DNA, 20 bp, Artificial Sequence
  Description of Artificial Sequence: Synthetic oligonucleotide
  Target: SCN9A; (+) strand; PAM type: YTN; PAM sequence: CTC
atttcttatgaattcaagac

SEQ ID NO: 94303 - DNA, 20 bp, Artificial Sequence
  Description of Artificial Sequence: Synthetic oligonucleotide
  Target: SCN9A; (+) strand; PAM type: YTN; PAM sequence: TTT
cttatgaattcaagacagtt

SEQ ID NO: 94304 - DNA, 20 bp, Artificial Sequence
  Description of Artificial Sequence: Synthetic oligonucleotide
  Target: SCN9A; (+) strand; PAM type: YTN; PAM sequence: TTC
ttatgaattcaagacagttt

SEQ ID NO: 94305 - DNA, 20 bp, Artificial Sequence
  Description of Artificial Sequence: Synthetic oligonucleotide
  Target: SCN9A; (+) strand; PAM type: YTN; PAM sequence: CTT
atgaattcaagacagttttt

SEQ ID NO: 94306 - DNA, 20 bp, Artificial Sequence
  Description of Artificial Sequence: Synthetic oligonucleotide
  Target: SCN9A; (+) strand; PAM type: YTN; PAM sequence: TTA
tgaattcaagacagtttttt

SEQ ID NO: 94307 - DNA, 20 bp, Artificial Sequence
  Description of Artificial Sequence: Synthetic oligonucleotide
  Target: SCN9A; (+) strand; PAM type: YTN; PAM sequence: TTC
aagacagttttttttttttt

SEQ ID NO: 94308 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttttttttt

SEQ ID NO: 94309 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttttttttt

SEQ ID NO: 94310 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttttttttt

SEQ ID NO: 94311 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttttttttt

SEQ ID NO: 94312 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttttttttt

SEQ ID NO: 94313 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttttttttt

SEQ ID NO: 94314 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttttttttt

SEQ ID NO: 94315 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttttttttt

SEQ ID NO: 94316 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttttttttt

SEQ ID NO: 94317 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttttttttt

SEQ ID NO: 94318 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttttttttt

SEQ ID NO: 94319 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttttttttt

SEQ ID NO: 94320 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttttttttt

SEQ ID NO: 94321 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttttttttt

SEQ ID NO: 94322 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttttttttt

SEQ ID NO: 94323 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttttttttt

SEQ ID NO: 94324 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttttttttt

SEQ ID NO: 94325 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttttttttt

SEQ ID NO: 94326 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttttttttg

SEQ ID NO: 94327 - DNA, 20 bp, Artificial Sequence
  Description of Artificial Sequence: Synthetic oligonucleotide
  Target: SCN9A; (+) strand; PAM type: YTN; PAM sequence: TTT
ttttttttttttttttttga

SEQ ID NO: 94328 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttttttgag

SEQ ID NO: 94329 - DNA, 20 bp, Artificial Sequence
  Description of Artificial Sequence: Synthetic oligonucleotide
  Target: SCN9A; (+) strand; PAM type: YTN; PAM sequence: TTT
ttttttttttttttttgaga

SEQ ID NO: 94330 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttttgagac

SEQ ID NO: 94331 - DNA, 20 bp, Artificial Sequence
  Description of Artificial Sequence: Synthetic oligonucleotide
  Target: SCN9A; (+) strand; PAM type: YTN; PAM sequence: TTT
ttttttttttttttgagacg

SEQ ID NO: 94332 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttgagacgg

SEQ ID NO: 94333 - DNA, 20 bp, Artificial Sequence
  Description of Artificial Sequence: Synthetic oligonucleotide
  Target: SCN9A; (+) strand; PAM type: YTN; PAM sequence: TTT
ttttttttttttgagacgga

SEQ ID NO: 94334 - DNA, 20 bp, Artificial Sequence
  Description of Artificial Sequence: Synthetic oligonucleotide
  Target: SCN9A; (+) strand; PAM type: YTN; PAM sequence: TTT
tttttttttttgagacggag

SEQ ID NO: 94335 - DNA, 20 bp, Artificial Sequence
  Description of Artificial Sequence: Synthetic oligonucleotide
  Target: SCN9A; (+) strand; PAM type: YTN; PAM sequence: TTT
ttttttttttgagacggagt

SEQ ID NO: 94336 - DNA, 20 bp, Artificial Sequence
  Description of Artificial Sequence: Synthetic oligonucleotide
  Target: SCN9A; (+) strand; PAM type: YTN; PAM sequence: TTT
tttttttttgagacggagtc

SEQ ID NO: 94337 - DNA, 20 bp, Artificial Sequence
  Description of Artificial Sequence: Synthetic oligonucleotide
  Target: SCN9A; (+) strand; PAM type: YTN; PAM sequence: TTT
ttttttttgagacggagtct

SEQ ID NO: 94338 - DNA, 20 bp, Artificial Sequence
  Description of Artificial Sequence: Synthetic oligonucleotide
  Target: SCN9A; (+) strand; PAM type: YTN; PAM sequence: TTT
tttttttgagacggagtctc

SEQ ID NO: 94339 - DNA, 20 bp, Artificial Sequence
  Description of Artificial Sequence: Synthetic oligonucleotide
  Target: SCN9A; (+) strand; PAM type: YTN; PAM sequence: TTT
ttttttgagacggagtctcg

SEQ ID NO: 94340 - DNA, 20 bp, Artificial Sequence
  Description of Artificial Sequence: Synthetic oligonucleotide
  Target: SCN9A; (+) strand; PAM type: YTN; PAM sequence: TTT
tttttgagacggagtctcgc

SEQ ID NO: 94341 - DNA, 20 bp, Artificial Sequence
  Description of Artificial Sequence: Synthetic oligonucleotide
  Target: SCN9A; (+) strand; PAM type: YTN; PAM sequence: TTT
ttttgagacggagtctcgct

SEQ ID NO: 94342 - DNA, 20 bp, Artificial Sequence
  Description of Artificial Sequence: Synthetic oligonucleotide
  Target: SCN9A; (+) strand; PAM type: YTN; PAM sequence: TTT
tttgagacggagtctcgctc

SEQ ID NO: 94343 - DNA, 20 bp, Artificial Sequence
  Description of Artificial Sequence: Synthetic oligonucleotide
  Target: SCN9A; (+) strand; PAM type: YTN; PAM sequence: TTT
ttgagacggagtctcgctct

SEQ ID NO: 94344 - DNA, 20 bp, Artificial Sequence
  Description of Artificial Sequence: Synthetic oligonucleotide
  Target: SCN9A; (+) strand; PAM type: YTN; PAM sequence: TTT
tgagacggagtctcgctctg

SEQ ID NO: 94345 - DNA, 20 bp, Artificial Sequence
  Description of Artificial Sequence: Synthetic oligonucleotide
  Target: SCN9A; (+) strand; PAM type: YTN; PAM sequence: TTT
gagacggagtctcgctctgt

SEQ ID NO: 94346 - DNA, 20 bp, Artificial Sequence
  Description of Artificial Sequence: Synthetic oligonucleotide
  Target: SCN9A; (+) strand; PAM type: YTN; PAM sequence: TTG
agacggagtctcgctctgtc

SEQ ID NO: 94347 - DNA, 20 bp, Artificial Sequence
  Description of Artificial Sequence: Synthetic oligonucleotide
  Target: SCN9A; (+) strand; PAM type: YTN; PAM sequence: CTC
gctctgtcgcccaggctgga

SEQ ID NO: 94348 - DNA, 20 bp, Artificial Sequence
  Description of Artificial Sequence: Synthetic oligonucleotide
  Target: SCN9A; (+) strand; PAM type: YTN; PAM sequence: CTC
tgtcgcccaggctggagtgc

SEQ ID NO: 94349 - DNA, 20 bp, Artificial Sequence
  Description of Artificial Sequence: Synthetic oligonucleotide
  Target: SCN9A; (+) strand; PAM type: YTN; PAM sequence: CTG
tcgcccaggctggagtgcag

SEQ ID NO: 94350 - DNA, 20 bp, Artificial Sequence
  Description of Artificial Sequence: Synthetic oligonucleotide
  Target: SCN9A; (+) strand; PAM type: YTN; PAM sequence: CTG
gagtgcagtggcgcgatctc

SEQ ID NO: 94351 - DNA, 20 bp, Artificial Sequence
  Description of Artificial Sequence: Synthetic oligonucleotide
  Target: SCN9A; (+) strand; PAM type: YTN; PAM sequence: CTC
ggctcactgcaagctccgcc

SEQ ID NO: 94352 - DNA, 20 bp, Artificial Sequence
  Description of Artificial Sequence: Synthetic oligonucleotide
  Target: SCN9A; (+) strand; PAM type: YTN; PAM sequence: CTC
actgcaagctccgcctcccg

SEQ ID NO: 94353 - DNA, 20 bp, Artificial Sequence
  Description of Artificial Sequence: Synthetic oligonucleotide
  Target: SCN9A; (+) strand; PAM type: YTN; PAM sequence: CTG
caagctccgcctcccgggtt

SEQ ID NO: 94354 - DNA, 20 bp, Artificial Sequence
  Description of Artificial Sequence: Synthetic oligonucleotide
  Target: SCN9A; (+) strand; PAM type: YTN; PAM sequence: CTC
cgcctcccgggttcacgcca

SEQ ID NO: 94355 - DNA, 20 bp, Artificial Sequence
  Description of Artificial Sequence: Synthetic oligonucleotide
  Target: SCN9A; (+) strand; PAM type: YTN; PAM sequence: CTC
ccgggttcacgccattctcc

SEQ ID NO: 94356 - DNA, 20 bp, Artificial Sequence
  Description of Artificial Sequence: Synthetic oligonucleotide
  Target: SCN9A; (+) strand; PAM type: YTN; PAM sequence: TTC
acgccattctcctgcctcag

SEQ ID NO: 94357 - DNA, 20 bp, Artificial Sequence
  Description of Artificial Sequence: Synthetic oligonucleotide
  Target: SCN9A; (+) strand; PAM type: YTN; PAM sequence: TTC
tcctgcctcagcctcccgag

SEQ ID NO: 94358 - DNA, 20 bp, Artificial Sequence
  Description of Artificial Sequence: Synthetic oligonucleotide
  Target: SCN9A; (+) strand; PAM type: YTN; PAM sequence: CTC
ctgcctcagcctcccgagta

SEQ ID NO: 94359 - DNA, 20 bp, Artificial Sequence
  Description of Artificial Sequence: Synthetic oligonucleotide
  Target: SCN9A; (+) strand; PAM type: YTN; PAM sequence: CTG
cctcagcctcccgagtagct

SEQ ID NO: 94360 - DNA, 20 bp, Artificial Sequence
  Description of Artificial Sequence: Synthetic oligonucleotide
  Target: SCN9A; (+) strand; PAM type: YTN; PAM sequence: CTC
agcctcccgagtagctggga

SEQ ID NO: 94361 - DNA, 20 bp, Artificial Sequence
  Description of Artificial Sequence: Synthetic oligonucleotide
  Target: SCN9A; (+) strand; PAM type: YTN; PAM sequence: CTC
ccgagtagctgggactacag

SEQ ID NO: 94362 - DNA, 20 bp, Artificial Sequence
  Description of Artificial Sequence: Synthetic oligonucleotide
  Target: SCN9A; (+) strand; PAM type: YTN; PAM sequence: CTG
ggactacaggcgcccgctac

SEQ ID NO: 94363 - DNA, 20 bp, Artificial Sequence
  Description of Artificial Sequence: Synthetic oligonucleotide
  Target: SCN9A; (+) strand; PAM type: YTN; PAM sequence: CTA
caggcgcccgctaccacgcc

SEQ ID NO: 94364 - DNA, 20 bp, Artificial Sequence
  Description of Artificial Sequence: Synthetic oligonucleotide
  Target: SCN9A; (+) strand; PAM type: YTN; PAM sequence: CTA
ccacgcccggctaatttttt

SEQ ID NO: 94365 - DNA, 20 bp, Artificial Sequence
  Description of Artificial Sequence: Synthetic oligonucleotide
  Target: SCN9A; (+) strand; PAM type: YTN; PAM sequence: CTA
attttttgtatttttagtag

SEQ ID NO: 94366 - DNA, 20 bp, Artificial Sequence
  Description of Artificial Sequence: Synthetic oligonucleotide
  Target: SCN9A; (+) strand; PAM type: YTN; PAM sequence: TTT
tttgtatttttagtagagac

SEQ ID NO: 94367 - DNA, 20 bp, Artificial Sequence
  Description of Artificial Sequence: Synthetic oligonucleotide
  Target: SCN9A; (+) strand; PAM type: YTN; PAM sequence: TTT
ttgtatttttagtagagacg

SEQ ID NO: 94368 - DNA, 20 bp, Artificial Sequence
  Description of Artificial Sequence: Synthetic oligonucleotide
  Target: SCN9A; (+) strand; PAM type: YTN; PAM sequence: TTT
tgtatttttagtagagacgg

SEQ ID NO: 94369 - DNA, 20 bp, Artificial Sequence
  Description of Artificial Sequence: Synthetic oligonucleotide
  Target: SCN9A; (+) strand; PAM type: YTN; PAM sequence: TTT
gtatttttagtagagacggg

SEQ ID NO: 94370 - DNA, 20 bp, Artificial Sequence
  Description of Artificial Sequence: Synthetic oligonucleotide
  Target: SCN9A; (+) strand; PAM type: YTN; PAM sequence: TTG
tatttttagtagagacgggg

SEQ ID NO: 94371 - DNA, 20 bp, Artificial Sequence
  Description of Artificial Sequence: Synthetic oligonucleotide
  Target: SCN9A; (+) strand; PAM type: YTN; PAM sequence: TTT
ttagtagagacggggtttca

SEQ ID NO: 94372 - DNA, 20 bp, Artificial Sequence
  Description of Artificial Sequence: Synthetic oligonucleotide
  Target: SCN9A; (+) strand; PAM type: YTN; PAM sequence: TTT
tagtagagacggggtttcac

SEQ ID NO: 94373 - DNA, 20 bp, Artificial Sequence
  Description of Artificial Sequence: Synthetic oligonucleotide
  Target: SCN9A; (+) strand; PAM type: YTN; PAM sequence: TTT
agtagagacggggtttcacc

SEQ ID NO: 94374 - DNA, 20 bp, Artificial Sequence
  Description of Artificial Sequence: Synthetic oligonucleotide
  Target: SCN9A; (+) strand; PAM type: YTN; PAM sequence: TTA
gtagagacggggtttcacct

SEQ ID NO: 94375 - DNA, 20 bp, Artificial Sequence
  Description of Artificial Sequence: Synthetic oligonucleotide
  Target: SCN9A; (+) strand; PAM type: YTN; PAM sequence: TTT
caccttgttagccaggatgg

SEQ ID NO: 94376 - DNA, 20 bp, Artificial Sequence
  Description of Artificial Sequence: Synthetic oligonucleotide
  Target: SCN9A; (+) strand; PAM type: YTN; PAM sequence: TTC
accttgttagccaggatggt

SEQ ID NO: 94377 - DNA, 20 bp, Artificial Sequence
  Description of Artificial Sequence: Synthetic oligonucleotide
  Target: SCN9A; (+) strand; PAM type: YTN; PAM sequence: CTT
gttagccaggatggtctcga

SEQ ID NO: 94378 - DNA, 20 bp, Artificial Sequence
  Description of Artificial Sequence: Synthetic oligonucleotide
  Target: SCN9A; (+) strand; PAM type: YTN; PAM sequence: TTG
ttagccaggatggtctcgat

SEQ ID NO: 94379 - DNA, 20 bp, Artificial Sequence
  Description of Artificial Sequence: Synthetic oligonucleotide
  Target: SCN9A; (+) strand; PAM type: YTN; PAM sequence: TTA
gccaggatggtctcgatctc

SEQ ID NO: 94380 - DNA, 20 bp, Artificial Sequence
  Description of Artificial Sequence: Synthetic oligonucleotide
  Target: SCN9A; (+) strand; PAM type: YTN; PAM sequence: CTC
gatctcctgacctcgtgatc

SEQ ID NO: 94381 - DNA, 20 bp, Artificial Sequence
  Description of Artificial Sequence: Synthetic oligonucleotide
  Target: SCN9A; (+) strand; PAM type: YTN; PAM sequence: CTC
ctgacctcgtgatccgcccg

SEQ ID NO: 94382 - DNA, 20 bp, Artificial Sequence
  Description of Artificial Sequence: Synthetic oligonucleotide
  Target: SCN9A; (+) strand; PAM type: YTN; PAM sequence: CTG
acctcgtgatccgcccgcct

SEQ ID NO: 94383 - DNA, 20 bp, Artificial Sequence
  Description of Artificial Sequence: Synthetic oligonucleotide
  Target: SCN9A; (+) strand; PAM type: YTN; PAM sequence: CTC
gtgatccgcccgcctcggcc

SEQ ID NO: 94384 - DNA, 20 bp, Artificial Sequence
  Description of Artificial Sequence: Synthetic oligonucleotide
  Target: SCN9A; (+) strand; PAM type: YTN; PAM sequence: CTC
ggcctcccaaagtgctggga

SEQ ID NO: 94385 - DNA, 20 bp, Artificial Sequence
  Description of Artificial Sequence: Synthetic oligonucleotide
  Target: SCN9A; (+) strand; PAM type: YTN; PAM sequence: CTC
ccaaagtgctgggattacag

SEQ ID NO: 94386 - DNA, 20 bp, Artificial Sequence
  Description of Artificial Sequence: Synthetic oligonucleotide
  Target: SCN9A; (+) strand; PAM type: YTN; PAM sequence: CTG
ggattacaggcgtgagccac

SEQ ID NO: 94387 - DNA, 20 bp, Artificial Sequence
  Description of Artificial Sequence: Synthetic oligonucleotide
  Target: SCN9A; (+) strand; PAM type: YTN; PAM sequence: TTA
caggcgtgagccaccgtgcc

SEQ ID NO: 94388 - DNA, 20 bp, Artificial Sequence
  Description of Artificial Sequence: Synthetic oligonucleotide
  Target: SCN9A; (+) strand; PAM type: YTN; PAM sequence: TTA
ttttatactgaatgcaatta

SEQ ID NO: 94389 - DNA, 20 bp, Artificial Sequence
  Description of Artificial Sequence: Synthetic oligonucleotide
  Target: SCN9A; (+) strand; PAM type: YTN; PAM sequence: TTT
tatactgaatgcaattactt

SEQ ID NO: 94390 - DNA, 20 bp, Artificial Sequence
  Description of Artificial Sequence: Synthetic oligonucleotide
  Target: SCN9A; (+) strand; PAM type: YTN; PAM sequence: TTT
atactgaatgcaattactta

SEQ ID NO: 94391 - DNA, 20 bp, Artificial Sequence
  Description of Artificial Sequence: Synthetic oligonucleotide
  Target: SCN9A; (+) strand; PAM type: YTN; PAM sequence: TTA
tactgaatgcaattacttaa

SEQ ID NO: 94392 - DNA, 20 bp, Artificial Sequence
  Description of Artificial Sequence: Synthetic oligonucleotide
  Target: SCN9A; (+) strand; PAM type: YTN; PAM sequence: CTG
aatgcaattacttaaaaaag

SEQ ID NO: 94393 - DNA, 20 bp, Artificial Sequence
  Description of Artificial Sequence: Synthetic oligonucleotide
  Target: SCN9A; (+) strand; PAM type: YTN; PAM sequence: TTA
cttaaaaaaggattaagaaa

SEQ ID NO: 94394 - DNA, 20 bp, Artificial Sequence
  Description of Artificial Sequence: Synthetic oligonucleotide
  Target: SCN9A; (+) strand; PAM type: YTN; PAM sequence: CTT
aaaaaaggattaagaaattc

SEQ ID NO: 94395 - DNA, 20 bp, Artificial Sequence
  Description of Artificial Sequence: Synthetic oligonucleotide
  Target: SCN9A; (+) strand; PAM type: YTN; PAM sequence: TTA
aaaaaggattaagaaattcc

SEQ ID NO: 94396 - DNA, 20 bp, Artificial Sequence
  Description of Artificial Sequence: Synthetic oligonucleotide
  Target: SCN9A; (+) strand; PAM type: YTN; PAM sequence: TTA
agaaattccaaagagaaatg

SEQ ID NO: 94397 - DNA, 20 bp, Artificial Sequence
  Description of Artificial Sequence: Synthetic oligonucleotide
  Target: SCN9A; (+) strand; PAM type: YTN; PAM sequence: TTC
caaagagaaatgactaacat

SEQ ID NO: 94398 - DNA, 20 bp, Artificial Sequence
  Description of Artificial Sequence: Synthetic oligonucleotide
  Target: SCN9A; (+) strand; PAM type: YTN; PAM sequence: CTA
acattaccattgtgacattt

SEQ ID NO: 94399 - DNA, 20 bp, Artificial Sequence
  Description of Artificial Sequence: Synthetic oligonucleotide
  Target: SCN9A; (+) strand; PAM type: YTN; PAM sequence: TTA
ccattgtgacattttctcct

SEQ ID NO: 94400 - DNA, 20 bp, Artificial Sequence
  Description of Artificial Sequence: Synthetic oligonucleotide
  Target: SCN9A; (+) strand; PAM type: YTN; PAM sequence: TTG
tgacattttctcctttttac

SEQ ID NO: 94401 - DNA, 20 bp, Artificial Sequence
  Description of Artificial Sequence: Synthetic oligonucleotide
  Target: SCN9A; (+) strand; PAM type: YTN; PAM sequence: TTT
tctcctttttactaagttca

SEQ ID NO: 94402 - DNA, 20 bp, Artificial Sequence
  Description of Artificial Sequence: Synthetic oligonucleotide
  Target: SCN9A; (+) strand; PAM type: YTN; PAM sequence: TTT
ctcctttttactaagttcat

SEQ ID NO: 94403 - DNA, 20 bp, Artificial Sequence
  Description of Artificial Sequence: Synthetic oligonucleotide
  Target: SCN9A; (+) strand; PAM type: YTN; PAM sequence: TTC
tcctttttactaagttcatg

SEQ ID NO: 94404 - DNA, 20 bp, Artificial Sequence
  Description of Artificial Sequence: Synthetic oligonucleotide
  Target: SCN9A; (+) strand; PAM type: YTN; PAM sequence: CTC
ctttttactaagttcatggg

SEQ ID NO: 94405 - DNA, 20 bp, Artificial Sequence
  Description of Artificial Sequence: Synthetic oligonucleotide
  Target: SCN9A; (+) strand; PAM type: YTN; PAM sequence: CTT
tttactaagttcatgggcca

SEQ ID NO: 94406 - DNA, 20 bp, Artificial Sequence
  Description of Artificial Sequence: Synthetic oligonucleotide
  Target: SCN9A; (+) strand; PAM type: YTN; PAM sequence: TTT
ttactaagttcatgggccat

SEQ ID NO: 94407 - DNA, 20 bp, Artificial Sequence
  Description of Artificial Sequence: Synthetic oligonucleotide
  Target: SCN9A; (+) strand; PAM type: YTN; PAM sequence: TTT
tactaagttcatgggccatt

SEQ ID NO: 94408 - DNA, 20 bp, Artificial Sequence
  Description of Artificial Sequence: Synthetic oligonucleotide
  Target: SCN9A; (+) strand; PAM type: YTN; PAM sequence: TTT
actaagttcatgggccattt

SEQ ID NO: 94409 - DNA, 20 bp, Artificial Sequence
  Description of Artificial Sequence: Synthetic oligonucleotide
  Target: SCN9A; (+) strand; PAM type: YTN; PAM sequence: TTA
ctaagttcatgggccatttt

SEQ ID NO: 94410 - DNA, 20 bp, Artificial Sequence
  Description of Artificial Sequence: Synthetic oligonucleotide
  Target: SCN9A; (+) strand; PAM type: YTN; PAM sequence: CTA
agttcatgggccattttttc

SEQ ID NO: 94411 - DNA, 20 bp, Artificial Sequence
  Description of Artificial Sequence: Synthetic oligonucleotide
  Target: SCN9A; (+) strand; PAM type: YTN; PAM sequence: TTC
atgggccattttttccctcc

SEQ ID NO: 94412 - DNA, 20 bp, Artificial Sequence
  Description of Artificial Sequence: Synthetic oligonucleotide
  Target: SCN9A; (+) strand; PAM type: YTN; PAM sequence: TTT
tttccctccataatagtgtt

SEQ ID NO: 94413 - DNA, 20 bp, Artificial Sequence
  Description of Artificial Sequence: Synthetic oligonucleotide
  Target: SCN9A; (+) strand; PAM type: YTN; PAM sequence: TTT
ttccctccataatagtgttt

SEQ ID NO: 94414 - DNA, 20 bp, Artificial Sequence
  Description of Artificial Sequence: Synthetic oligonucleotide
  Target: SCN9A; (+) strand; PAM type: YTN; PAM sequence: TTT
tccctccataatagtgtttt

SEQ ID NO: 94415 - DNA, 20 bp, Artificial Sequence
  Description of Artificial Sequence: Synthetic oligonucleotide
  Target: SCN9A; (+) strand; PAM type: YTN; PAM sequence: TTT
ccctccataatagtgtttta

SEQ ID NO: 94416 - DNA, 20 bp, Artificial Sequence
  Description of Artificial Sequence: Synthetic oligonucleotide
  Target: SCN9A; (+) strand; PAM type: YTN; PAM sequence: TTC
cctccataatagtgttttac

SEQ ID NO: 94417 - DNA, 20 bp, Artificial Sequence
  Description of Artificial Sequence: Synthetic oligonucleotide
  Target: SCN9A; (+) strand; PAM type: YTN; PAM sequence: CTC
cataatagtgttttacattt

SEQ ID NO: 94418 - DNA, 20 bp, Artificial Sequence
  Description of Artificial Sequence: Synthetic oligonucleotide
  Target: SCN9A; (+) strand; PAM type: YTN; PAM sequence: TTT
tacattttaagaatgatacc

SEQ ID NO: 94419 - DNA, 20 bp, Artificial Sequence
  Description of Artificial Sequence: Synthetic oligonucleotide
  Target: SCN9A; (+) strand; PAM type: YTN; PAM sequence: TTT
acattttaagaatgatacct

SEQ ID NO: 94420 - DNA, 20 bp, Artificial Sequence
  Description of Artificial Sequence: Synthetic oligonucleotide
  Target: SCN9A; (+) strand; PAM type: YTN; PAM sequence: TTA
cattttaagaatgataccta

SEQ ID NO: 94421 - DNA, 20 bp, Artificial Sequence
  Description of Artificial Sequence: Synthetic oligonucleotide
  Target: SCN9A; (+) strand; PAM type: YTN; PAM sequence: TTT
taagaatgatacctactcac

SEQ ID NO: 94422 - DNA, 20 bp, Artificial Sequence
  Description of Artificial Sequence: Synthetic oligonucleotide
  Target: SCN9A; (+) strand; PAM type: YTN; PAM sequence: TTT
aagaatgatacctactcaca

SEQ ID NO: 94423 - DNA, 20 bp, Artificial Sequence
  Description of Artificial Sequence: Synthetic oligonucleotide
  Target: SCN9A; (+) strand; PAM type: YTN; PAM sequence: TTA
agaatgatacctactcacat

SEQ ID NO: 94424 - DNA, 20 bp, Artificial Sequence
  Description of Artificial Sequence: Synthetic oligonucleotide
  Target: SCN9A; (+) strand; PAM type: YTN; PAM sequence: CTA
ctcacatagaaaattcaagc

SEQ ID NO: 94425 - DNA, 20 bp, Artificial Sequence
  Description of Artificial Sequence: Synthetic oligonucleotide
  Target: SCN9A; (+) strand; PAM type: YTN; PAM sequence: CTC
acatagaaaattcaagcaat

SEQ ID NO: 94426 - DNA, 20 bp, Artificial Sequence
  Description of Artificial Sequence: Synthetic oligonucleotide
  Target: SCN9A; (+) strand; PAM type: YTN; PAM sequence: TTC
aagcaataccgttaaatgct

SEQ ID NO: 94427 - DNA, 20 bp, Artificial Sequence
  Description of Artificial Sequence: Synthetic oligonucleotide
  Target: SCN9A; (+) strand; PAM type: YTN; PAM sequence: TTA
aatgctaaaaagaaaatata

SEQ ID NO: 94428 - DNA, 20 bp, Artificial Sequence
  Description of Artificial Sequence: Synthetic oligonucleotide
  Target: SCN9A; (+) strand; PAM type: YTN; PAM sequence: CTA
aaaagaaaatataaatcacc

SEQ ID NO: 94429 - DNA, 20 bp, Artificial Sequence
  Description of Artificial Sequence: Synthetic oligonucleotide
  Target: SCN9A; (+) strand; PAM type: YTN; PAM sequence: CTG
aaatgtcaacaataactatt

SEQ ID NO: 94430 - DNA, 20 bp, Artificial Sequence
  Description of Artificial Sequence: Synthetic oligonucleotide
  Target: SCN9A; (+) strand; PAM type: YTN; PAM sequence: CTA
ttatcaatatttttttgagt

SEQ ID NO: 94431 - DNA, 20 bp, Artificial Sequence
  Description of Artificial Sequence: Synthetic oligonucleotide
  Target: SCN9A; (+) strand; PAM type: YTN; PAM sequence: TTA
tcaatatttttttgagtatc

SEQ ID NO: 94432 - DNA, 20 bp, Artificial Sequence
  Description of Artificial Sequence: Synthetic oligonucleotide
  Target: SCN9A; (+) strand; PAM type: YTN; PAM sequence: TTT
ttttgagtatcacttcagac

SEQ ID NO: 94433 - DNA, 20 bp, Artificial Sequence
  Description of Artificial Sequence: Synthetic oligonucleotide
  Target: SCN9A; (+) strand; PAM type: YTN; PAM sequence: TTT
tttgagtatcacttcagaca

SEQ ID NO: 94434 - DNA, 20 bp, Artificial Sequence
  Description of Artificial Sequence: Synthetic oligonucleotide
  Target: SCN9A; (+) strand; PAM type: YTN; PAM sequence: TTT
ttgagtatcacttcagacat

SEQ ID NO: 94435 - DNA, 20 bp, Artificial Sequence
  Description of Artificial Sequence: Synthetic oligonucleotide
  Target: SCN9A; (+) strand; PAM type: YTN; PAM sequence: TTT
tgagtatcacttcagacatt

SEQ ID NO: 94436 - DNA, 20 bp, Artificial Sequence
  Description of Artificial Sequence: Synthetic oligonucleotide
  Target: SCN9A; (+) strand; PAM type: YTN; PAM sequence: TTT
gagtatcacttcagacattt

SEQ ID NO: 94437 - DNA, 20 bp, Artificial Sequence
  Description of Artificial Sequence: Synthetic oligonucleotide
  Target: SCN9A; (+) strand; PAM type: YTN; PAM sequence: TTG
agtatcacttcagacatttt

SEQ ID NO: 94438 - DNA, 20 bp, Artificial Sequence
  Description of Artificial Sequence: Synthetic oligonucleotide
  Target: SCN9A; (+) strand; PAM type: YTN; PAM sequence: CTT
cagacatttttctgtgcaag

SEQ ID NO: 94439 - DNA, 20 bp, Artificial Sequence
  Description of Artificial Sequence: Synthetic oligonucleotide
  Target: SCN9A; (+) strand; PAM type: YTN; PAM sequence: TTC
agacatttttctgtgcaagc

SEQ ID NO: 94440 - DNA, 20 bp, Artificial Sequence
  Description of Artificial Sequence: Synthetic oligonucleotide
  Target: SCN9A; (+) strand; PAM type: YTN; PAM sequence: TTT
ttctgtgcaagcacatgtac

SEQ ID NO: 94441 - DNA, 20 bp, Artificial Sequence
  Description of Artificial Sequence: Synthetic oligonucleotide
  Target: SCN9A; (+) strand; PAM type: YTN; PAM sequence: TTT
tctgtgcaagcacatgtaca

SEQ ID NO: 94442 - DNA, 20 bp, Artificial Sequence
  Description of Artificial Sequence: Synthetic oligonucleotide
  Target: SCN9A; (+) strand; PAM type: YTN; PAM sequence: TTT
ctgtgcaagcacatgtacac

SEQ ID NO: 94443 - DNA, 20 bp, Artificial Sequence
  Description of Artificial Sequence: Synthetic oligonucleotide
  Target: SCN9A; (+) strand; PAM type: YTN; PAM sequence: TTC
tgtgcaagcacatgtacaca

SEQ ID NO: 94444 - DNA, 20 bp, Artificial Sequence
  Description of Artificial Sequence: Synthetic oligonucleotide
  Target: SCN9A; (+) strand; PAM type: YTN; PAM sequence: CTG
tgcaagcacatgtacacaca

SEQ ID NO: 94445 - DNA, 20 bp, Artificial Sequence
  Description of Artificial Sequence: Synthetic oligonucleotide
  Target: SCN9A; (+) strand; PAM type: YTN; PAM sequence: TTC
atgttatataagcttttttt

SEQ ID NO: 94446 - DNA, 20 bp, Artificial Sequence
  Description of Artificial Sequence: Synthetic oligonucleotide
  Target: SCN9A; (+) strand; PAM type: YTN; PAM sequence: TTA
tataagctttttttgtaacc

SEQ ID NO: 94447 - DNA, 20 bp, Artificial Sequence
  Description of Artificial Sequence: Synthetic oligonucleotide
  Target: SCN9A; (+) strand; PAM type: YTN; PAM sequence: CTT
tttttgtaacctatttattt

SEQ ID NO: 94448 - DNA, 20 bp, Artificial Sequence
  Description of Artificial Sequence: Synthetic oligonucleotide
  Target: SCN9A; (+) strand; PAM type: YTN; PAM sequence: TTT
ttttgtaacctatttattta

SEQ ID NO: 94449 - DNA, 20 bp, Artificial Sequence
  Description of Artificial Sequence: Synthetic oligonucleotide
  Target: SCN9A; (+) strand; PAM type: YTN; PAM sequence: TTT
tttgtaacctatttatttat

SEQ ID NO: 94450 - DNA, 20 bp, Artificial Sequence
  Description of Artificial Sequence: Synthetic oligonucleotide
  Target: SCN9A; (+) strand; PAM type: YTN; PAM sequence: TTT
ttgtaacctatttatttatt

SEQ ID NO: 94451 - DNA, 20 bp, Artificial Sequence
  Description of Artificial Sequence: Synthetic oligonucleotide
  Target: SCN9A; (+) strand; PAM type: YTN; PAM sequence: TTT
tgtaacctatttatttattt

SEQ ID NO: 94452 - DNA, 20 bp, Artificial Sequence
  Description of Artificial Sequence: Synthetic oligonucleotide
  Target: SCN9A; (+) strand; PAM type: YTN; PAM sequence: TTT
gtaacctatttatttatttt

SEQ ID NO: 94453 - DNA, 20 bp, Artificial Sequence
  Description of Artificial Sequence: Synthetic oligonucleotide
  Target: SCN9A; (+) strand; PAM type: YTN; PAM sequence: TTG
taacctatttatttattttt

SEQ ID NO: 94454 - DNA, 20 bp, Artificial Sequence
  Description of Artificial Sequence: Synthetic oligonucleotide
  Target: SCN9A; (+) strand; PAM type: YTN; PAM sequence: CTA
tttatttatttttcaagaca

SEQ ID NO: 94455 - DNA, 20 bp, Artificial Sequence
  Description of Artificial Sequence: Synthetic oligonucleotide
  Target: SCN9A; (+) strand; PAM type: YTN; PAM sequence: TTT
atttatttttcaagacagag

SEQ ID NO: 94456 - DNA, 20 bp, Artificial Sequence
  Description of Artificial Sequence: Synthetic oligonucleotide
  Target: SCN9A; (+) strand; PAM type: YTN; PAM sequence: TTA
tttatttttcaagacagagt

SEQ ID NO: 94457 - DNA, 20 bp, Artificial Sequence
  Description of Artificial Sequence: Synthetic oligonucleotide
  Target: SCN9A; (+) strand; PAM type: YTN; PAM sequence: TTT
atttttcaagacagagtctt

SEQ ID NO: 94458 - DNA, 20 bp, Artificial Sequence
  Description of Artificial Sequence: Synthetic oligonucleotide
  Target: SCN9A; (+) strand; PAM type: YTN; PAM sequence: TTA
tttttcaagacagagtcttg

SEQ ID NO: 94459 - DNA, 20 bp, Artificial Sequence
  Description of Artificial Sequence: Synthetic oligonucleotide
  Target: SCN9A; (+) strand; PAM type: YTN; PAM sequence: TTT
ttcaagacagagtcttgctc

SEQ ID NO: 94460 - DNA, 20 bp, Artificial Sequence
  Description of Artificial Sequence: Synthetic oligonucleotide
  Target: SCN9A; (+) strand; PAM type: YTN; PAM sequence: TTT
tcaagacagagtcttgctct

SEQ ID NO: 94461 - DNA, 20 bp, Artificial Sequence
  Description of Artificial Sequence: Synthetic oligonucleotide
  Target: SCN9A; (+) strand; PAM type: YTN; PAM sequence: TTT
caagacagagtcttgctctg

SEQ ID NO: 94462 - DNA, 20 bp, Artificial Sequence
  Description of Artificial Sequence: Synthetic oligonucleotide
  Target: SCN9A; (+) strand; PAM type: YTN; PAM sequence: TTC
aagacagagtcttgctctgt

SEQ ID NO: 94463 - DNA, 20 bp, Artificial Sequence
  Description of Artificial Sequence: Synthetic oligonucleotide
  Target: SCN9A; (+) strand; PAM type: YTN; PAM sequence: CTT
gctctgtcgccaaagctgga

SEQ ID NO: 94464 - DNA, 20 bp, Artificial Sequence
  Description of Artificial Sequence: Synthetic oligonucleotide
  Target: SCN9A; (+) strand; PAM type: YTN; PAM sequence: TTG
ctctgtcgccaaagctggag

SEQ ID NO: 94465 - DNA, 20 bp, Artificial Sequence
  Description of Artificial Sequence: Synthetic oligonucleotide
  Target: SCN9A; (+) strand; PAM type: YTN; PAM sequence: CTC
tgtcgccaaagctggagtgc

SEQ ID NO: 94466 - DNA, 20 bp, Artificial Sequence
  Description of Artificial Sequence: Synthetic oligonucleotide
  Target: SCN9A; (+) strand; PAM type: YTN; PAM sequence: CTG
tcgccaaagctggagtgcgg

SEQ ID NO: 94467 - DNA, 20 bp, Artificial Sequence
  Description of Artificial Sequence: Synthetic oligonucleotide
  Target: SCN9A; (+) strand; PAM type: YTN; PAM sequence: CTG
gagtgcggtggtgtgatctt

SEQ ID NO: 94468 - DNA, 20 bp, Artificial Sequence
  Description of Artificial Sequence: Synthetic oligonucleotide
  Target: SCN9A; (+) strand; PAM type: YTN; PAM sequence: CTT
ggcctactgcaatctctgca

SEQ ID NO: 94469 - DNA, 20 bp, Artificial Sequence
  Description of Artificial Sequence: Synthetic oligonucleotide
  Target: SCN9A; (+) strand; PAM type: YTN; PAM sequence: TTG
gcctactgcaatctctgcat

SEQ ID NO: 94470 - DNA, 20 bp, Artificial Sequence
  Description of Artificial Sequence: Synthetic oligonucleotide
  Target: SCN9A; (+) strand; PAM type: YTN; PAM sequence: CTA
ctgcaatctctgcatcccgg

SEQ ID NO: 94471 - DNA, 20 bp, Artificial Sequence
  Description of Artificial Sequence: Synthetic oligonucleotide
  Target: SCN9A; (+) strand; PAM type: YTN; PAM sequence: CTG
caatctctgcatcccgggat

SEQ ID NO: 94472 - DNA, 20 bp, Artificial Sequence
  Description of Artificial Sequence: Synthetic oligonucleotide
  Target: SCN9A; (+) strand; PAM type: YTN; PAM sequence: CTC
tgcatcccgggatcaaatga

SEQ ID NO: 94473 - DNA, 20 bp, Artificial Sequence
  Description of Artificial Sequence: Synthetic oligonucleotide
  Target: SCN9A; (+) strand; PAM type: YTN; PAM sequence: CTG
catcccgggatcaaatgatt

SEQ ID NO: 94474 - DNA, 20 bp, Artificial Sequence
  Description of Artificial Sequence: Synthetic oligonucleotide
  Target: SCN9A; (+) strand; PAM type: YTN; PAM sequence: TTC
tccagcctcagcctccagag

SEQ ID NO: 94475 - DNA, 20 bp, Artificial Sequence
  Description of Artificial Sequence: Synthetic oligonucleotide
  Target: SCN9A; (+) strand; PAM type: YTN; PAM sequence: CTC
cagcctcagcctccagagta

SEQ ID NO: 94476 - DNA, 20 bp, Artificial Sequence
  Description of Artificial Sequence: Synthetic oligonucleotide
  Target: SCN9A; (+) strand; PAM type: YTN; PAM sequence: CTC
agcctccagagtagctggga

SEQ ID NO: 94477 - DNA, 20 bp, Artificial Sequence
  Description of Artificial Sequence: Synthetic oligonucleotide
  Target: SCN9A; (+) strand; PAM type: YTN; PAM sequence: CTC
cagagtagctgggactacag

SEQ ID NO: 94478 - DNA, 20 bp, Artificial Sequence
  Description of Artificial Sequence: Synthetic oligonucleotide
  Target: SCN9A; (+) strand; PAM type: YTN; PAM sequence: CTG
ggactacaggcatgcgccac

SEQ ID NO: 94479 - DNA, 20 bp, Artificial Sequence
  Description of Artificial Sequence: Synthetic oligonucleotide
  Target: SCN9A; (+) strand; PAM type: YTN; PAM sequence: CTA
caggcatgcgccaccacacc

SEQ ID NO: 94480 - DNA, 20 bp, Artificial Sequence
  Description of Artificial Sequence: Synthetic oligonucleotide
  Target: SCN9A; (+) strand; PAM type: YTN; PAM sequence: CTG
gttaatttttgtgtttttgg

SEQ ID NO: 94481 - DNA, 20 bp, Artificial Sequence
  Description of Artificial Sequence: Synthetic oligonucleotide
  Target: SCN9A; (+) strand; PAM type: YTN; PAM sequence: TTA
atttttgtgtttttggtagg

SEQ ID NO: 94482 - DNA, 20 bp, Artificial Sequence
  Description of Artificial Sequence: Synthetic oligonucleotide
  Target: SCN9A; (+) strand; PAM type: YTN; PAM sequence: TTT
ttgtgtttttggtagggacg

SEQ ID NO: 94483 - DNA, 20 bp, Artificial Sequence
  Description of Artificial Sequence: Synthetic oligonucleotide
  Target: SCN9A; (+) strand; PAM type: YTN; PAM sequence: TTT
tgtgtttttggtagggacgg

SEQ ID NO: 94484 - DNA, 20 bp, Artificial Sequence
  Description of Artificial Sequence: Synthetic oligonucleotide
  Target: SCN9A; (+) strand; PAM type: YTN; PAM sequence: TTT
gtgtttttggtagggacggt

SEQ ID NO: 94485 - DNA, 20 bp, Artificial Sequence
  Description of Artificial Sequence: Synthetic oligonucleotide
  Target: SCN9A; (+) strand; PAM type: YTN; PAM sequence: TTG
tgtttttggtagggacggtt

SEQ ID NO: 94486 - DNA, 20 bp, Artificial Sequence
  Description of Artificial Sequence: Synthetic oligonucleotide
  Target: SCN9A; (+) strand; PAM type: YTN; PAM sequence: TTT
ttggtagggacggttttcac

SEQ ID NO: 94487 - DNA, 20 bp, Artificial Sequence
  Description of Artificial Sequence: Synthetic oligonucleotide
  Target: SCN9A; (+) strand; PAM type: YTN; PAM sequence: TTT
tggtagggacggttttcacc

SEQ ID NO: 94488 - DNA, 20 bp, Artificial Sequence
  Description of Artificial Sequence: Synthetic oligonucleotide
  Target: SCN9A; (+) strand; PAM type: YTN; PAM sequence: TTT
ggtagggacggttttcacct

SEQ ID NO: 94489 - DNA, 20 bp, Artificial Sequence
  Description of Artificial Sequence: Synthetic oligonucleotide
  Target: SCN9A; (+) strand; PAM type: YTN; PAM sequence: TTG
gtagggacggttttcacctt

SEQ ID NO: 94490 - DNA, 20 bp, Artificial Sequence
  Description of Artificial Sequence: Synthetic oligonucleotide
  Target: SCN9A; (+) strand; PAM type: YTN; PAM sequence: TTT
tcaccttgttggccaggctg

SEQ ID NO: 94491 - DNA, 20 bp, Artificial Sequence
  Description of Artificial Sequence: Synthetic oligonucleotide
  Target: SCN9A; (+) strand; PAM type: YTN; PAM sequence: TTT
caccttgttggccaggctgg

SEQ ID NO: 94492 - DNA, 20 bp, Artificial Sequence
  Description of Artificial Sequence: Synthetic oligonucleotide
  Target: SCN9A; (+) strand; PAM type: YTN; PAM sequence: TTC
accttgttggccaggctggt

SEQ ID NO: 94493 - DNA, 20 bp, Artificial Sequence
  Description of Artificial Sequence: Synthetic oligonucleotide
  Target: SCN9A; (+) strand; PAM type: YTN; PAM sequence: CTT
gttggccaggctggtctcaa

SEQ ID NO: 94494 - DNA, 20 bp, Artificial Sequence
  Description of Artificial Sequence: Synthetic oligonucleotide
  Target: SCN9A; (+) strand; PAM type: YTN; PAM sequence: TTG
ttggccaggctggtctcaaa

SEQ ID NO: 94495 - DNA, 20 bp, Artificial Sequence
  Description of Artificial Sequence: Synthetic oligonucleotide
  Target: SCN9A; (+) strand; PAM type: YTN; PAM sequence: TTG
gccaggctggtctcaaactt

SEQ ID NO: 94496 - DNA, 20 bp, Artificial Sequence
  Description of Artificial Sequence: Synthetic oligonucleotide
  Target: SCN9A; (+) strand; PAM type: YTN; PAM sequence: CTG
gtctcaaacttctgacttca

SEQ ID NO: 94497 - DNA, 20 bp, Artificial Sequence
  Description of Artificial Sequence: Synthetic oligonucleotide
  Target: SCN9A; (+) strand; PAM type: YTN; PAM sequence: CTC
aaacttctgacttcaagtga

SEQ ID NO: 94498 - DNA, 20 bp, Artificial Sequence
  Description of Artificial Sequence: Synthetic oligonucleotide
  Target: SCN9A; (+) strand; PAM type: YTN; PAM sequence: CTT
ctgacttcaagtgatttcgc

SEQ ID NO: 94499 - DNA, 20 bp, Artificial Sequence
  Description of Artificial Sequence: Synthetic oligonucleotide
  Target: SCN9A; (+) strand; PAM type: YTN; PAM sequence: TTC
tgacttcaagtgatttcgcc

SEQ ID NO: 94500 - DNA, 20 bp, Artificial Sequence
  Description of Artificial Sequence: Synthetic oligonucleotide
  Target: SCN9A; (+) strand; PAM type: YTN; PAM sequence: CTG
acttcaagtgatttcgccca

SEQ ID NO: 94501 - DNA, 20 bp, Artificial Sequence
  Description of Artificial Sequence: Synthetic oligonucleotide
  Target: SCN9A; (+) strand; PAM type: YTN; PAM sequence: CTT
caagtgatttcgcccacctc

SEQ ID NO: 94502 - DNA, 20 bp, Artificial Sequence
  Description of Artificial Sequence: Synthetic oligonucleotide
  Target: SCN9A; (+) strand; PAM type: YTN; PAM sequence: TTC
aagtgatttcgcccacctcg

SEQ ID NO: 94503 - DNA, 20 bp, Artificial Sequence
  Description of Artificial Sequence: Synthetic oligonucleotide
  Target: SCN9A; (+) strand; PAM type: YTN; PAM sequence: TTT
cgcccacctcggcctcccaa

SEQ ID NO: 94504 - DNA, 20 bp, Artificial Sequence
  Description of Artificial Sequence: Synthetic oligonucleotide
  Target: SCN9A; (+) strand; PAM type: YTN; PAM sequence: TTC
gcccacctcggcctcccaat

SEQ ID NO: 94505 - DNA, 20 bp, Artificial Sequence
  Description of Artificial Sequence: Synthetic oligonucleotide
  Target: SCN9A; (+) strand; PAM type: YTN; PAM sequence: CTC
ggcctcccaatgtgctggga

SEQ ID NO: 94506 - DNA, 20 bp, Artificial Sequence
  Description of Artificial Sequence: Synthetic oligonucleotide
  Target: SCN9A; (+) strand; PAM type: YTN; PAM sequence: CTC
ccaatgtgctgggattatag

SEQ ID NO: 94507 - DNA, 20 bp, Artificial Sequence
  Description of Artificial Sequence: Synthetic oligonucleotide
  Target: SCN9A; (+) strand; PAM type: YTN; PAM sequence: CTG
ggattataggcgtgagccac

SEQ ID NO: 94508 - DNA, 20 bp, Artificial Sequence
  Description of Artificial Sequence: Synthetic oligonucleotide
  Target: SCN9A; (+) strand; PAM type: YTN; PAM sequence: TTA
taggcgtgagccacagtgcc

SEQ ID NO: 94509 - DNA, 20 bp, Artificial Sequence
  Description of Artificial Sequence: Synthetic oligonucleotide
  Target: SCN9A; (+) strand; PAM type: YTN; PAM sequence: CTG
taacctattttatttacttt

SEQ ID NO: 94510 - DNA, 20 bp, Artificial Sequence
  Description of Artificial Sequence: Synthetic oligonucleotide
  Target: SCN9A; (+) strand; PAM type: YTN; PAM sequence: CTA
ttttatttactttatatgtc

SEQ ID NO: 94511 - DNA, 20 bp, Artificial Sequence
  Description of Artificial Sequence: Synthetic oligonucleotide
  Target: SCN9A; (+) strand; PAM type: YTN; PAM sequence: TTT
tatttactttatatgtcatg

SEQ ID NO: 94512 - DNA, 20 bp, Artificial Sequence
  Description of Artificial Sequence: Synthetic oligonucleotide
  Target: SCN9A; (+) strand; PAM type: YTN; PAM sequence: TTT
atttactttatatgtcatgg

SEQ ID NO: 94513 - DNA, 20 bp, Artificial Sequence
  Description of Artificial Sequence: Synthetic oligonucleotide
  Target: SCN9A; (+) strand; PAM type: YTN; PAM sequence: TTA
tttactttatatgtcatgga

SEQ ID NO: 94514 - DNA, 20 bp, Artificial Sequence
  Description of Artificial Sequence: Synthetic oligonucleotide
  Target: SCN9A; (+) strand; PAM type: YTN; PAM sequence: TTT
actttatatgtcatggagat

SEQ ID NO: 94515 - DNA, 20 bp, Artificial Sequence
  Description of Artificial Sequence: Synthetic oligonucleotide
  Target: SCN9A; (+) strand; PAM type: YTN; PAM sequence: TTA
ctttatatgtcatggagata

SEQ ID NO: 94516 - DNA, 20 bp, Artificial Sequence
  Description of Artificial Sequence: Synthetic oligonucleotide
  Target: SCN9A; (+) strand; PAM type: YTN; PAM sequence: CTT
tatatgtcatggagatagtt

SEQ ID NO: 94517 - DNA, 20 bp, Artificial Sequence
  Description of Artificial Sequence: Synthetic oligonucleotide
  Target: SCN9A; (+) strand; PAM type: YTN; PAM sequence: TTT
atatgtcatggagatagttt

SEQ ID NO: 94518 - DNA, 20 bp, Artificial Sequence
  Description of Artificial Sequence: Synthetic oligonucleotide
  Target: SCN9A; (+) strand; PAM type: YTN; PAM sequence: TTA
tatgtcatggagatagtttc

SEQ ID NO: 94519 - DNA, 20 bp, Artificial Sequence
  Description of Artificial Sequence: Synthetic oligonucleotide
  Target: SCN9A; (+) strand; PAM type: YTN; PAM sequence: TTT
cataaaaatgacaacgaaat

SEQ ID NO: 94520 - DNA, 20 bp, Artificial Sequence
  Description of Artificial Sequence: Synthetic oligonucleotide
  Target: SCN9A; (+) strand; PAM type: YTN; PAM sequence: TTC
ataaaaatgacaacgaaata

SEQ ID NO: 94521 - DNA, 20 bp, Artificial Sequence
  Description of Artificial Sequence: Synthetic oligonucleotide
  Target: SCN9A; (+) strand; PAM type: YTN; PAM sequence: TTT
attatagtggtataatgttc

SEQ ID NO: 94522 - DNA, 20 bp, Artificial Sequence
  Description of Artificial Sequence: Synthetic oligonucleotide
  Target: SCN9A; (+) strand; PAM type: YTN; PAM sequence: TTA
ttatagtggtataatgttct

SEQ ID NO: 94523 - DNA, 20 bp, Artificial Sequence
  Description of Artificial Sequence: Synthetic oligonucleotide
  Target: SCN9A; (+) strand; PAM type: YTN; PAM sequence: TTA
tagtggtataatgttctctc

SEQ ID NO: 94524 - DNA, 20 bp, Artificial Sequence
  Description of Artificial Sequence: Synthetic oligonucleotide
  Target: SCN9A; (+) strand; PAM type: YTN; PAM sequence: TTC
tctcaaaataaccacaaatt

SEQ ID NO: 94525 - DNA, 20 bp, Artificial Sequence
  Description of Artificial Sequence: Synthetic oligonucleotide
  Target: SCN9A; (+) strand; PAM type: YTN; PAM sequence: CTC
tcaaaataaccacaaattga

SEQ ID NO: 94526 - DNA, 20 bp, Artificial Sequence
  Description of Artificial Sequence: Synthetic oligonucleotide
  Target: SCN9A; (+) strand; PAM type: YTN; PAM sequence: CTC
aaaataaccacaaattgaag

SEQ ID NO: 94527 - DNA, 20 bp, Artificial Sequence
  Description of Artificial Sequence: Synthetic oligonucleotide
  Target: SCN9A; (+) strand; PAM type: YTN; PAM sequence: TTG
aagactagcatttatactgt

SEQ ID NO: 94528 - DNA, 20 bp, Artificial Sequence
  Description of Artificial Sequence: Synthetic oligonucleotide
  Target: SCN9A; (+) strand; PAM type: YTN; PAM sequence: CTA
gcatttatactgtttccatt

SEQ ID NO: 94529 - DNA, 20 bp, Artificial Sequence
  Description of Artificial Sequence: Synthetic oligonucleotide
  Target: SCN9A; (+) strand; PAM type: YTN; PAM sequence: TTT
atactgtttccatttttgtt

SEQ ID NO: 94530 - DNA, 20 bp, Artificial Sequence
  Description of Artificial Sequence: Synthetic oligonucleotide
  Target: SCN9A; (+) strand; PAM type: YTN; PAM sequence: TTA
tactgtttccatttttgtta

SEQ ID NO: 94531 - DNA, 20 bp, Artificial Sequence
  Description of Artificial Sequence: Synthetic oligonucleotide
  Target: SCN9A; (+) strand; PAM type: YTN; PAM sequence: CTG
tttccatttttgttactgaa

SEQ ID NO: 94532 - DNA, 20 bp, Artificial Sequence
  Description of Artificial Sequence: Synthetic oligonucleotide
  Target: SCN9A; (+) strand; PAM type: YTN; PAM sequence: TTT
ccatttttgttactgaaatg

SEQ ID NO: 94533 - DNA, 20 bp, Artificial Sequence
  Description of Artificial Sequence: Synthetic oligonucleotide
  Target: SCN9A; (+) strand; PAM type: YTN; PAM sequence: TTC
catttttgttactgaaatga

SEQ ID NO: 94534 - DNA, 20 bp, Artificial Sequence
  Description of Artificial Sequence: Synthetic oligonucleotide
  Target: SCN9A; (+) strand; PAM type: YTN; PAM sequence: TTT
ttgttactgaaatgaatatc

SEQ ID NO: 94535 - DNA, 20 bp, Artificial Sequence
  Description of Artificial Sequence: Synthetic oligonucleotide
  Target: SCN9A; (+) strand; PAM type: YTN; PAM sequence: TTT
tgttactgaaatgaatatct

SEQ ID NO: 94536 - DNA, 20 bp, Artificial Sequence
  Description of Artificial Sequence: Synthetic oligonucleotide
  Target: SCN9A; (+) strand; PAM type: YTN; PAM sequence: TTT
gttactgaaatgaatatcta

SEQ ID NO: 94537 - DNA, 20 bp, Artificial Sequence
  Description of Artificial Sequence: Synthetic oligonucleotide
  Target: SCN9A; (+) strand; PAM type: YTN; PAM sequence: TTG
ttactgaaatgaatatctaa

SEQ ID NO: 94538 - DNA, 20 bp, Artificial Sequence
  Description of Artificial Sequence: Synthetic oligonucleotide
  Target: SCN9A; (+) strand; PAM type: YTN; PAM sequence: TTA
ctgaaatgaatatctaaata

SEQ ID NO: 94539 - DNA, 20 bp, Artificial Sequence
  Description of Artificial Sequence: Synthetic oligonucleotide
  Target: SCN9A; (+) strand; PAM type: YTN; PAM sequence: CTG
aaatgaatatctaaatagct

SEQ ID NO: 94540 - DNA, 20 bp, Artificial Sequence
  Description of Artificial Sequence: Synthetic oligonucleotide
  Target: SCN9A; (+) strand; PAM type: YTN; PAM sequence: CTA
aatagctatgttctcctaat

SEQ ID NO: 94541 - DNA, 20 bp, Artificial Sequence
  Description of Artificial Sequence: Synthetic oligonucleotide
  Target: SCN9A; (+) strand; PAM type: YTN; PAM sequence: CTA
tgttctcctaattgcatgag

SEQ ID NO: 94542 - DNA, 20 bp, Artificial Sequence
  Description of Artificial Sequence: Synthetic oligonucleotide
  Target: SCN9A; (+) strand; PAM type: YTN; PAM sequence: TTC
tcctaattgcatgagtactt

SEQ ID NO: 94543 - DNA, 20 bp, Artificial Sequence
  Description of Artificial Sequence: Synthetic oligonucleotide
  Target: SCN9A; (+) strand; PAM type: YTN; PAM sequence: CTC
ctaattgcatgagtactttt

SEQ ID NO: 94544 - DNA, 20 bp, Artificial Sequence
  Description of Artificial Sequence: Synthetic oligonucleotide
  Target: SCN9A; (+) strand; PAM type: YTN; PAM sequence: CTA
attgcatgagtactttttaa

SEQ ID NO: 94545 - DNA, 20 bp, Artificial Sequence
  Description of Artificial Sequence: Synthetic oligonucleotide
  Target: SCN9A; (+) strand; PAM type: YTN; PAM sequence: TTG
catgagtactttttaataat

SEQ ID NO: 94546 - DNA, 20 bp, Artificial Sequence
  Description of Artificial Sequence: Synthetic oligonucleotide
  Target: SCN9A; (+) strand; PAM type: YTN; PAM sequence: CTT
tttaataatatgttaataga

SEQ ID NO: 94547 - DNA, 20 bp, Artificial Sequence
  Description of Artificial Sequence: Synthetic oligonucleotide
  Target: SCN9A; (+) strand; PAM type: YTN; PAM sequence: TTT
ttaataatatgttaatagaa

SEQ ID NO: 94548 - DNA, 20 bp, Artificial Sequence
  Description of Artificial Sequence: Synthetic oligonucleotide
  Target: SCN9A; (+) strand; PAM type: YTN; PAM sequence: TTT
taataatatgttaatagaac

SEQ ID NO: 94549 - DNA, 20 bp, Artificial Sequence
  Description of Artificial Sequence: Synthetic oligonucleotide
  Target: SCN9A; (+) strand; PAM type: YTN; PAM sequence: TTT
aataatatgttaatagaact

SEQ ID NO: 94550 - DNA, 20 bp, Artificial Sequence
  Description of Artificial Sequence: Synthetic oligonucleotide
  Target: SCN9A; (+) strand; PAM type: YTN; PAM sequence: TTA
ataatatgttaatagaactt

SEQ ID NO: 94551 - DNA, 20 bp, Artificial Sequence
  Description of Artificial Sequence: Synthetic oligonucleotide
  Target: SCN9A; (+) strand; PAM type: YTN; PAM sequence: TTA
atagaacttgggtcaacagt

SEQ ID NO: 94552 - DNA, 20 bp, Artificial Sequence
  Description of Artificial Sequence: Synthetic oligonucleotide
  Target: SCN9A; (+) strand; PAM type: YTN; PAM sequence: CTT
gggtcaacagtatatatatg

SEQ ID NO: 94553 - DNA, 20 bp, Artificial Sequence
  Description of Artificial Sequence: Synthetic oligonucleotide
  Target: SCN9A; (+) strand; PAM type: YTN; PAM sequence: TTG
ggtcaacagtatatatatgt

SEQ ID NO: 94554 - DNA, 20 bp, Artificial Sequence
  Description of Artificial Sequence: Synthetic oligonucleotide
  Target: SCN9A; (+) strand; PAM type: YTN; PAM sequence: TTT
atatatatacacacactata

SEQ ID NO: 94555 - DNA, 20 bp, Artificial Sequence
  Description of Artificial Sequence: Synthetic oligonucleotide
  Target: SCN9A; (+) strand; PAM type: YTN; PAM sequence: TTA
tatatatacacacactatat

SEQ ID NO: 94556 - DNA, 20 bp, Artificial Sequence
  Description of Artificial Sequence: Synthetic oligonucleotide
  Target: SCN9A; (+) strand; PAM type: YTN; PAM sequence: CTA
tatatacacacatactatat

SEQ ID NO: 94557 - DNA, 20 bp, Artificial Sequence
  Description of Artificial Sequence: Synthetic oligonucleotide
  Target: SCN9A; (+) strand; PAM type: YTN; PAM sequence: CTA
tatatatacacatactatat

SEQ ID NO: 94558 - DNA, 20 bp, Artificial Sequence
  Description of Artificial Sequence: Synthetic oligonucleotide
  Target: SCN9A; (+) strand; PAM type: YTN; PAM sequence: CTA
tatatactatatacagtata

SEQ ID NO: 94559 - DNA, 20 bp, Artificial Sequence
  Description of Artificial Sequence: Synthetic oligonucleotide
  Target: SCN9A; (+) strand; PAM type: YTN; PAM sequence: CTA
tatacagtatatagtataca

SEQ ID NO: 94560 - DNA, 20 bp, Artificial Sequence
  Description of Artificial Sequence: Synthetic oligonucleotide
  Target: SCN9A; (+) strand; PAM type: YTN; PAM sequence: CTA
tacatatacatatactatac

SEQ ID NO: 94561 - DNA, 20 bp, Artificial Sequence
  Description of Artificial Sequence: Synthetic oligonucleotide
  Target: SCN9A; (+) strand; PAM type: YTN; PAM sequence: CTA
tacatatacatatacatata

SEQ ID NO: 94562 - DNA, 20 bp, Artificial Sequence
  Description of Artificial Sequence: Synthetic oligonucleotide
  Target: SCN9A; (+) strand; PAM type: YTN; PAM sequence: CTA
agtatacgtatatacagtac

SEQ ID NO: 94563 - DNA, 20 bp, Artificial Sequence
  Description of Artificial Sequence: Synthetic oligonucleotide
  Target: SCN9A; (+) strand; PAM type: YTN; PAM sequence: CTA
tatagtatgtatatatagca

SEQ ID NO: 94564 - DNA, 20 bp, Artificial Sequence
  Description of Artificial Sequence: Synthetic oligonucleotide
  Target: SCN9A; (+) strand; PAM type: YTN; PAM sequence: CTC
tatatagcatatagtatgca

SEQ ID NO: 94565 - DNA, 20 bp, Artificial Sequence
  Description of Artificial Sequence: Synthetic oligonucleotide
  Target: SCN9A; (+) strand; PAM type: YTN; PAM sequence: CTA
tatagcatatagtatgcata

SEQ ID NO: 94566 - DNA, 20 bp, Artificial Sequence
  Description of Artificial Sequence: Synthetic oligonucleotide
  Target: SCN9A; (+) strand; PAM type: YTN; PAM sequence: CTA
tatagcatatagtatgcata

SEQ ID NO: 94567 - DNA, 20 bp, Artificial Sequence
  Description of Artificial Sequence: Synthetic oligonucleotide
  Target: SCN9A; (+) strand; PAM type: YTN; PAM sequence: CTA
tatatagtatagagtatgcg

SEQ ID NO: 94568 - DNA, 20 bp, Artificial Sequence
  Description of Artificial Sequence: Synthetic oligonucleotide
  Target: SCN9A; (+) strand; PAM type: YTN; PAM sequence: CTA
tatatatagtatagagtatg

SEQ ID NO: 94569 - DNA, 20 bp, Artificial Sequence
  Description of Artificial Sequence: Synthetic oligonucleotide
  Target: SCN9A; (+) strand; PAM type: YTN; PAM sequence: CTA
tatatatagtatagagtatg

SEQ ID NO: 94570 - DNA, 20 bp, Artificial Sequence
  Description of Artificial Sequence: Synthetic oligonucleotide
  Target: SCN9A; (+) strand; PAM type: YTN; PAM sequence: CTA
tatatatagtatagagtatg

SEQ ID NO: 94571 - DNA, 20 bp, Artificial Sequence
  Description of Artificial Sequence: Synthetic oligonucleotide
  Target: SCN9A; (+) strand; PAM type: YTN; PAM sequence: CTA
tatatatagtatagagtatg

SEQ ID NO: 94572 - DNA, 20 bp, Artificial Sequence
  Description of Artificial Sequence: Synthetic oligonucleotide
  Target: SCN9A; (+) strand; PAM type: YTN; PAM sequence: CTA
tatatatagtatagagtatg

SEQ ID NO: 94573 - DNA, 20 bp, Artificial Sequence
  Description of Artificial Sequence: Synthetic oligonucleotide
  Target: SCN9A; (+) strand; PAM type: YTN; PAM sequence: CTA
tatatatagtatagagtatg

SEQ ID NO: 94574 - DNA, 20 bp, Artificial Sequence
  Description of Artificial Sequence: Synthetic oligonucleotide
  Target: SCN9A; (+) strand; PAM type: YTN; PAM sequence: CTA
tatatatagtatagagtatg

SEQ ID NO: 94575 - DNA, 20 bp, Artificial Sequence
  Description of Artificial Sequence: Synthetic oligonucleotide
  Target: SCN9A; (+) strand; PAM type: YTN; PAM sequence: CTC
tatactatatacatagtatg

SEQ ID NO: 94576 - DNA, 20 bp, Artificial Sequence
  Description of Artificial Sequence: Synthetic oligonucleotide
  Target: SCN9A; (+) strand; PAM type: YTN; PAM sequence: CTA
tactatatacatagtatgtg

SEQ ID NO: 94577 - DNA, 20 bp, Artificial Sequence
  Description of Artificial Sequence: Synthetic oligonucleotide
  Target: SCN9A; (+) strand; PAM type: YTN; PAM sequence: CTA
tatacatagtatgtgtgtgt

SEQ ID NO: 94578 - DNA, 20 bp, Artificial Sequence
  Description of Artificial Sequence: Synthetic oligonucleotide
  Target: SCN9A; (+) strand; PAM type: YTN; PAM sequence: CTG
aacctatctccagaaagcct

SEQ ID NO: 94579 - DNA, 20 bp, Artificial Sequence
  Description of Artificial Sequence: Synthetic oligonucleotide
  Target: SCN9A; (+) strand; PAM type: YTN; PAM sequence: CTA
tctccagaaagcctgtacta

SEQ ID NO: 94580 - DNA, 20 bp, Artificial Sequence
  Description of Artificial Sequence: Synthetic oligonucleotide
  Target: SCN9A; (+) strand; PAM type: YTN; PAM sequence: CTC
cagaaagcctgtactaatta

SEQ ID NO: 94581 - DNA, 20 bp, Artificial Sequence
  Description of Artificial Sequence: Synthetic oligonucleotide
  Target: SCN9A; (+) strand; PAM type: YTN; PAM sequence: CTG
tactaattaacatttctaat

SEQ ID NO: 94582 - DNA, 20 bp, Artificial Sequence
  Description of Artificial Sequence: Synthetic oligonucleotide
  Target: SCN9A; (+) strand; PAM type: YTN; PAM sequence: CTA
attaacatttctaatggcag

SEQ ID NO: 94583 - DNA, 20 bp, Artificial Sequence
  Description of Artificial Sequence: Synthetic oligonucleotide
  Target: SCN9A; (+) strand; PAM type: YTN; PAM sequence: TTA
acatttctaatggcagtata

SEQ ID NO: 94584 - DNA, 20 bp, Artificial Sequence
  Description of Artificial Sequence: Synthetic oligonucleotide
  Target: SCN9A; (+) strand; PAM type: YTN; PAM sequence: TTT
ctaatggcagtatatgatag

SEQ ID NO: 94585 - DNA, 20 bp, Artificial Sequence
  Description of Artificial Sequence: Synthetic oligonucleotide
  Target: SCN9A; (+) strand; PAM type: YTN; PAM sequence: TTC
taatggcagtatatgatagt

SEQ ID NO: 94586 - DNA, 20 bp, Artificial Sequence
  Description of Artificial Sequence: Synthetic oligonucleotide
  Target: SCN9A; (+) strand; PAM type: YTN; PAM sequence: CTA
atggcagtatatgatagtgc

SEQ ID NO: 94587 - DNA, 20 bp, Artificial Sequence
  Description of Artificial Sequence: Synthetic oligonucleotide
  Target: SCN9A; (+) strand; PAM type: YTN; PAM sequence: CTC
atactttacacattcaacag

SEQ ID NO: 94588 - DNA, 20 bp, Artificial Sequence
  Description of Artificial Sequence: Synthetic oligonucleotide
  Target: SCN9A; (+) strand; PAM type: YTN; PAM sequence: CTT
tacacattcaacagtattga

SEQ ID NO: 94589 - DNA, 20 bp, Artificial Sequence
  Description of Artificial Sequence: Synthetic oligonucleotide
  Target: SCN9A; (+) strand; PAM type: YTN; PAM sequence: TTT
acacattcaacagtattgag

SEQ ID NO: 94590 - DNA, 20 bp, Artificial Sequence
  Description of Artificial Sequence: Synthetic oligonucleotide
  Target: SCN9A; (+) strand; PAM type: YTN; PAM sequence: TTA
cacattcaacagtattgagt

SEQ ID NO: 94591 - DNA, 20 bp, Artificial Sequence
  Description of Artificial Sequence: Synthetic oligonucleotide
  Target: SCN9A; (+) strand; PAM type: YTN; PAM sequence: TTC
aacagtattgagtgctacca

SEQ ID NO: 94592 - DNA, 20 bp, Artificial Sequence
  Description of Artificial Sequence: Synthetic oligonucleotide
  Target: SCN9A; (+) strand; PAM type: YTN; PAM sequence: TTG
agtgctaccattcttcttta

SEQ ID NO: 94593 - DNA, 20 bp, Artificial Sequence
  Description of Artificial Sequence: Synthetic oligonucleotide
  Target: SCN9A; (+) strand; PAM type: YTN; PAM sequence: CTA
ccattcttctttatagtttt

SEQ ID NO: 94594 - DNA, 20 bp, Artificial Sequence
  Description of Artificial Sequence: Synthetic oligonucleotide
  Target: SCN9A; (+) strand; PAM type: YTN; PAM sequence: TTC
ttctttatagttttttacca

SEQ ID NO: 94595 - DNA, 20 bp, Artificial Sequence
  Description of Artificial Sequence: Synthetic oligonucleotide
  Target: SCN9A; (+) strand; PAM type: YTN; PAM sequence: CTT
ctttatagttttttaccaaa

SEQ ID NO: 94596 - DNA, 20 bp, Artificial Sequence
  Description of Artificial Sequence: Synthetic oligonucleotide
  Target: SCN9A; (+) strand; PAM type: YTN; PAM sequence: TTC
tttatagttttttaccaaaa

SEQ ID NO: 94597 - DNA, 20 bp, Artificial Sequence
  Description of Artificial Sequence: Synthetic oligonucleotide
  Target: SCN9A; (+) strand; PAM type: YTN; PAM sequence: CTT
tatagttttttaccaaaaaa

SEQ ID NO: 94598 - DNA, 20 bp, Artificial Sequence
  Description of Artificial Sequence: Synthetic oligonucleotide
  Target: SCN9A; (+) strand; PAM type: YTN; PAM sequence: TTT
atagttttttaccaaaaaat

SEQ ID NO: 94599 - DNA, 20 bp, Artificial Sequence
  Description of Artificial Sequence: Synthetic oligonucleotide
  Target: SCN9A; (+) strand; PAM type: YTN; PAM sequence: TTA
tagttttttaccaaaaaatt

SEQ ID NO: 94600 - DNA, 20 bp, Artificial Sequence
  Description of Artificial Sequence: Synthetic oligonucleotide
  Target: SCN9A; (+) strand; PAM type: YTN; PAM sequence: TTT
tttaccaaaaaattttcatg

SEQ ID NO: 94601 - DNA, 20 bp, Artificial Sequence
  Description of Artificial Sequence: Synthetic oligonucleotide
  Target: SCN9A; (+) strand; PAM type: YTN; PAM sequence: TTT
ttaccaaaaaattttcatga

SEQ ID NO: 94602 - DNA, 20 bp, Artificial Sequence
  Description of Artificial Sequence: Synthetic oligonucleotide
  Target: SCN9A; (+) strand; PAM type: YTN; PAM sequence: TTT
taccaaaaaattttcatgac

SEQ ID NO: 94603 - DNA, 20 bp, Artificial Sequence
  Description of Artificial Sequence: Synthetic oligonucleotide
  Target: SCN9A; (+) strand; PAM type: YTN; PAM sequence: TTT
accaaaaaattttcatgaca

SEQ ID NO: 94604 - DNA, 20 bp, Artificial Sequence
  Description of Artificial Sequence: Synthetic oligonucleotide
  Target: SCN9A; (+) strand; PAM type: YTN; PAM sequence: TTA
ccaaaaaattttcatgacat

SEQ ID NO: 94605 - DNA, 20 bp, Artificial Sequence
  Description of Artificial Sequence: Synthetic oligonucleotide
  Target: SCN9A; (+) strand; PAM type: YTN; PAM sequence: TTT
tcatgacatttgaaaacatc

SEQ ID NO: 94606 - DNA, 20 bp, Artificial Sequence
  Description of Artificial Sequence: Synthetic oligonucleotide
  Target: SCN9A; (+) strand; PAM type: YTN; PAM sequence: TTT
catgacatttgaaaacatct

SEQ ID NO: 94607 - DNA, 20 bp, Artificial Sequence
  Description of Artificial Sequence: Synthetic oligonucleotide
  Target: SCN9A; (+) strand; PAM type: YTN; PAM sequence: TTC
atgacatttgaaaacatcta

SEQ ID NO: 94608 - DNA, 20 bp, Artificial Sequence
  Description of Artificial Sequence: Synthetic oligonucleotide
  Target: SCN9A; (+) strand; PAM type: YTN; PAM sequence: TTT
gaaaacatctactattgtaa

SEQ ID NO: 94609 - DNA, 20 bp, Artificial Sequence
  Description of Artificial Sequence: Synthetic oligonucleotide
  Target: SCN9A; (+) strand; PAM type: YTN; PAM sequence: TTG
aaaacatctactattgtaat

SEQ ID NO: 94610 - DNA, 20 bp, Artificial Sequence
  Description of Artificial Sequence: Synthetic oligonucleotide
  Target: SCN9A; (+) strand; PAM type: YTN; PAM sequence: CTA
ctattgtaatttatttgcat

SEQ ID NO: 94611 - DNA, 20 bp, Artificial Sequence
  Description of Artificial Sequence: Synthetic oligonucleotide
  Target: SCN9A; (+) strand; PAM type: YTN; PAM sequence: CTA
ttgtaatttatttgcatttt

SEQ ID NO: 94612 - DNA, 20 bp, Artificial Sequence
  Description of Artificial Sequence: Synthetic oligonucleotide
  Target: SCN9A; (+) strand; PAM type: YTN; PAM sequence: TTG
taatttatttgcattttttg

SEQ ID NO: 94613 - DNA, 20 bp, Artificial Sequence
  Description of Artificial Sequence: Synthetic oligonucleotide
  Target: SCN9A; (+) strand; PAM type: YTN; PAM sequence: TTT
atttgcattttttgtgaaaa

SEQ ID NO: 94614 - DNA, 20 bp, Artificial Sequence
  Description of Artificial Sequence: Synthetic oligonucleotide
  Target: SCN9A; (+) strand; PAM type: YTN; PAM sequence: TTA
tttgcattttttgtgaaaat

SEQ ID NO: 94615 - DNA, 20 bp, Artificial Sequence
  Description of Artificial Sequence: Synthetic oligonucleotide
  Target: SCN9A; (+) strand; PAM type: YTN; PAM sequence: TTT
gcattttttgtgaaaataat

SEQ ID NO: 94616 - DNA, 20 bp, Artificial Sequence
  Description of Artificial Sequence: Synthetic oligonucleotide
  Target: SCN9A; (+) strand; PAM type: YTN; PAM sequence: TTG
cattttttgtgaaaataatc

SEQ ID NO: 94617 - DNA, 20 bp, Artificial Sequence
  Description of Artificial Sequence: Synthetic oligonucleotide
  Target: SCN9A; (+) strand; PAM type: YTN; PAM sequence: TTT
tttgtgaaaataatccacaa

SEQ ID NO: 94618 - DNA, 20 bp, Artificial Sequence
  Description of Artificial Sequence: Synthetic oligonucleotide
  Target: SCN9A; (+) strand; PAM type: YTN; PAM sequence: TTT
ttgtgaaaataatccacaat

SEQ ID NO: 94619 - DNA, 20 bp, Artificial Sequence
  Description of Artificial Sequence: Synthetic oligonucleotide
  Target: SCN9A; (+) strand; PAM type: YTN; PAM sequence: TTT
tgtgaaaataatccacaatt

SEQ ID NO: 94620 - DNA, 20 bp, Artificial Sequence
  Description of Artificial Sequence: Synthetic oligonucleotide
  Target: SCN9A; (+) strand; PAM type: YTN; PAM sequence: TTT
gtgaaaataatccacaattt

SEQ ID NO: 94621 - DNA, 20 bp, Artificial Sequence
  Description of Artificial Sequence: Synthetic oligonucleotide
  Target: SCN9A; (+) strand; PAM type: YTN; PAM sequence: TTG
tgaaaataatccacaatttt

SEQ ID NO: 94622 - DNA, 20 bp, Artificial Sequence
  Description of Artificial Sequence: Synthetic oligonucleotide
  Target: SCN9A; (+) strand; PAM type: YTN; PAM sequence: TTT
tccttgtgttttgttatttt

SEQ ID NO: 94623 - DNA, 20 bp, Artificial Sequence
  Description of Artificial Sequence: Synthetic oligonucleotide
  Target: SCN9A; (+) strand; PAM type: YTN; PAM sequence: TTT
ccttgtgttttgttattttg

SEQ ID NO: 94624 - DNA, 20 bp, Artificial Sequence
  Description of Artificial Sequence: Synthetic oligonucleotide
  Target: SCN9A; (+) strand; PAM type: YTN; PAM sequence: TTC
cttgtgttttgttattttgt

SEQ ID NO: 94625 - DNA, 20 bp, Artificial Sequence
  Description of Artificial Sequence: Synthetic oligonucleotide
  Target: SCN9A; (+) strand; PAM type: YTN; PAM sequence: CTT
gtgttttgttattttgtatc

SEQ ID NO: 94626 - DNA, 20 bp, Artificial Sequence
  Description of Artificial Sequence: Synthetic oligonucleotide
  Target: SCN9A; (+) strand; PAM type: YTN; PAM sequence: TTG
tgttttgttattttgtatcc

SEQ ID NO: 94627 - DNA, 20 bp, Artificial Sequence
  Description of Artificial Sequence: Synthetic oligonucleotide
  Target: SCN9A; (+) strand; PAM type: YTN; PAM sequence: TTT
tgttattttgtatccttatt

SEQ ID NO: 94628 - DNA, 20 bp, Artificial Sequence
  Description of Artificial Sequence: Synthetic oligonucleotide
  Target: SCN9A; (+) strand; PAM type: YTN; PAM sequence: TTT
gttattttgtatccttattg

SEQ ID NO: 94629 - DNA, 20 bp, Artificial Sequence
  Description of Artificial Sequence: Synthetic oligonucleotide
  Target: SCN9A; (+) strand; PAM type: YTN; PAM sequence: TTG
ttattttgtatccttattgg

SEQ ID NO: 94630 - DNA, 20 bp, Artificial Sequence
  Description of Artificial Sequence: Synthetic oligonucleotide
  Target: SCN9A; (+) strand; PAM type: YTN; PAM sequence: TTA
ttttgtatccttattggttg

SEQ ID NO: 94631 - DNA, 20 bp, Artificial Sequence
  Description of Artificial Sequence: Synthetic oligonucleotide
  Target: SCN9A; (+) strand; PAM type: YTN; PAM sequence: TTT
tgtatccttattggttgttt

SEQ ID NO: 94632 - DNA, 20 bp, Artificial Sequence
  Description of Artificial Sequence: Synthetic oligonucleotide
  Target: SCN9A; (+) strand; PAM type: YTN; PAM sequence: TTT
gtatccttattggttgtttt

SEQ ID NO: 94633 - DNA, 20 bp, Artificial Sequence
  Description of Artificial Sequence: Synthetic oligonucleotide
  Target: SCN9A; (+) strand; PAM type: YTN; PAM sequence: TTG
tatccttattggttgttttt

SEQ ID NO: 94634 - DNA, 20 bp, Artificial Sequence
  Description of Artificial Sequence: Synthetic oligonucleotide
  Target: SCN9A; (+) strand; PAM type: YTN; PAM sequence: CTT
attggttgtttttaacttct

SEQ ID NO: 94635 - DNA, 20 bp, Artificial Sequence
  Description of Artificial Sequence: Synthetic oligonucleotide
  Target: SCN9A; (+) strand; PAM type: YTN; PAM sequence: TTA
ttggttgtttttaacttctg

SEQ ID NO: 94636 - DNA, 20 bp, Artificial Sequence
  Description of Artificial Sequence: Synthetic oligonucleotide
  Target: SCN9A; (+) strand; PAM type: YTN; PAM sequence: TTG
gttgtttttaacttctgttt

SEQ ID NO: 94637 - DNA, 20 bp, Artificial Sequence
  Description of Artificial Sequence: Synthetic oligonucleotide
  Target: SCN9A; (+) strand; PAM type: YTN; PAM sequence: TTG
tttttaacttctgtttttgg

SEQ ID NO: 94638 - DNA, 20 bp, Artificial Sequence
  Description of Artificial Sequence: Synthetic oligonucleotide
  Target: SCN9A; (+) strand; PAM type: YTN; PAM sequence: TTT
ttaacttctgtttttggctt

SEQ ID NO: 94639 - DNA, 20 bp, Artificial Sequence
  Description of Artificial Sequence: Synthetic oligonucleotide
  Target: SCN9A; (+) strand; PAM type: YTN; PAM sequence: TTT
taacttctgtttttggctta

SEQ ID NO: 94640 - DNA, 20 bp, Artificial Sequence
  Description of Artificial Sequence: Synthetic oligonucleotide
  Target: SCN9A; (+) strand; PAM type: YTN; PAM sequence: TTT
aacttctgtttttggcttag

SEQ ID NO: 94641 - DNA, 20 bp, Artificial Sequence
  Description of Artificial Sequence: Synthetic oligonucleotide
  Target: SCN9A; (+) strand; PAM type: YTN; PAM sequence: TTA
acttctgtttttggcttagt

SEQ ID NO: 94642 - DNA, 20 bp, Artificial Sequence
  Description of Artificial Sequence: Synthetic oligonucleotide
  Target: SCN9A; (+) strand; PAM type: YTN; PAM sequence: CTT
ctgtttttggcttagtttgg

SEQ ID NO: 94643 - DNA, 20 bp, Artificial Sequence
  Description of Artificial Sequence: Synthetic oligonucleotide
  Target: SCN9A; (+) strand; PAM type: YTN; PAM sequence: TTC
tgtttttggcttagtttggt

SEQ ID NO: 94644 - DNA, 20 bp, Artificial Sequence
  Description of Artificial Sequence: Synthetic oligonucleotide
  Target: SCN9A; (+) strand; PAM type: YTN; PAM sequence: CTG
tttttggcttagtttggtat

SEQ ID NO: 94645 - DNA, 20 bp, Artificial Sequence
  Description of Artificial Sequence: Synthetic oligonucleotide
  Target: SCN9A; (+) strand; PAM type: YTN; PAM sequence: TTT
ttggcttagtttggtatttg

SEQ ID NO: 94646 - DNA, 20 bp, Artificial Sequence
  Description of Artificial Sequence: Synthetic oligonucleotide
  Target: SCN9A; (+) strand; PAM type: YTN; PAM sequence: TTT
tggcttagtttggtatttgc

SEQ ID NO: 94647 - DNA, 20 bp, Artificial Sequence
  Description of Artificial Sequence: Synthetic oligonucleotide
  Target: SCN9A; (+) strand; PAM type: YTN; PAM sequence: TTT
ggcttagtttggtatttgcc

SEQ ID NO: 94648 - DNA, 20 bp, Artificial Sequence
  Description of Artificial Sequence: Synthetic oligonucleotide
  Target: SCN9A; (+) strand; PAM type: YTN; PAM sequence: TTG
gcttagtttggtatttgccc

SEQ ID NO: 94649 - DNA, 20 bp, Artificial Sequence
  Description of Artificial Sequence: Synthetic oligonucleotide
  Target: SCN9A; (+) strand; PAM type: YTN; PAM sequence: CTT
agtttggtatttgcccatgt

SEQ ID NO: 94650 - DNA, 20 bp, Artificial Sequence
  Description of Artificial Sequence: Synthetic oligonucleotide
  Target: SCN9A; (+) strand; PAM type: YTN; PAM sequence: TTA
gtttggtatttgcccatgtg

SEQ ID NO: 94651 - DNA, 20 bp, Artificial Sequence
  Description of Artificial Sequence: Synthetic oligonucleotide
  Target: SCN9A; (+) strand; PAM type: YTN; PAM sequence: TTT
ggtatttgcccatgtgtcta

SEQ ID NO: 94652 - DNA, 20 bp, Artificial Sequence
  Description of Artificial Sequence: Synthetic oligonucleotide
  Target: SCN9A; (+) strand; PAM type: YTN; PAM sequence: TTG
gtatttgcccatgtgtctat

SEQ ID NO: 94653 - DNA, 20 bp, Artificial Sequence
  Description of Artificial Sequence: Synthetic oligonucleotide
  Target: SCN9A; (+) strand; PAM type: YTN; PAM sequence: TTT
gcccatgtgtctattgggat

SEQ ID NO: 94654 - DNA, 20 bp, Artificial Sequence
  Description of Artificial Sequence: Synthetic oligonucleotide
  Target: SCN9A; (+) strand; PAM type: YTN; PAM sequence: TTG
cccatgtgtctattgggatt

SEQ ID NO: 94655 - DNA, 20 bp, Artificial Sequence
  Description of Artificial Sequence: Synthetic oligonucleotide
  Target: SCN9A; (+) strand; PAM type: YTN; PAM sequence: CTA
ttgggatttttactatattc

SEQ ID NO: 94656 - DNA, 20 bp, Artificial Sequence
  Description of Artificial Sequence: Synthetic oligonucleotide
  Target: SCN9A; (+) strand; PAM type: YTN; PAM sequence: TTG
ggatttttactatattctta

SEQ ID NO: 94657 - DNA, 20 bp, Artificial Sequence
  Description of Artificial Sequence: Synthetic oligonucleotide
  Target: SCN9A; (+) strand; PAM type: YTN; PAM sequence: TTT
ttactatattcttattaatt

SEQ ID NO: 94658 - DNA, 20 bp, Artificial Sequence
  Description of Artificial Sequence: Synthetic oligonucleotide
  Target: SCN9A; (+) strand; PAM type: YTN; PAM sequence: TTT
tactatattcttattaattt

SEQ ID NO: 94659 - DNA, 20 bp, Artificial Sequence
  Description of Artificial Sequence: Synthetic oligonucleotide
  Target: SCN9A; (+) strand; PAM type: YTN; PAM sequence: TTT
actatattcttattaattta

SEQ ID NO: 94660 - DNA, 20 bp, Artificial Sequence
  Description of Artificial Sequence: Synthetic oligonucleotide
  Target: SCN9A; (+) strand; PAM type: YTN; PAM sequence: TTA
ctatattcttattaatttat

SEQ ID NO: 94661 - DNA, 20 bp, Artificial Sequence
  Description of Artificial Sequence: Synthetic oligonucleotide
  Target: SCN9A; (+) strand; PAM type: YTN; PAM sequence: CTA
tattcttattaatttataag

SEQ ID NO: 94662 - DNA, 20 bp, Artificial Sequence
  Description of Artificial Sequence: Synthetic oligonucleotide
  Target: SCN9A; (+) strand; PAM type: YTN; PAM sequence: TTC
ttattaatttataagaacaa

SEQ ID NO: 94663 - DNA, 20 bp, Artificial Sequence
  Description of Artificial Sequence: Synthetic oligonucleotide
  Target: SCN9A; (+) strand; PAM type: YTN; PAM sequence: CTT
attaatttataagaacaatt

SEQ ID NO: 94664 - DNA, 20 bp, Artificial Sequence
  Description of Artificial Sequence: Synthetic oligonucleotide
  Target: SCN9A; (+) strand; PAM type: YTN; PAM sequence: TTA
ttaatttataagaacaattt

SEQ ID NO: 94665 - DNA, 20 bp, Artificial Sequence
  Description of Artificial Sequence: Synthetic oligonucleotide
  Target: SCN9A; (+) strand; PAM type: YTN; PAM sequence: TTA
atttataagaacaattttct

SEQ ID NO: 94666 - DNA, 20 bp, Artificial Sequence
  Description of Artificial Sequence: Synthetic oligonucleotide
  Target: SCN9A; (+) strand; PAM type: YTN; PAM sequence: TTT
ataagaacaattttctattt

SEQ ID NO: 94667 - DNA, 20 bp, Artificial Sequence
  Description of Artificial Sequence: Synthetic oligonucleotide
  Target: SCN9A; (+) strand; PAM type: YTN; PAM sequence: TTA
taagaacaattttctattta

SEQ ID NO: 94668 - DNA, 20 bp, Artificial Sequence
  Description of Artificial Sequence: Synthetic oligonucleotide
  Target: SCN9A; (+) strand; PAM type: YTN; PAM sequence: TTT
tctatttaaagtattgatcc

SEQ ID NO: 94669 - DNA, 20 bp, Artificial Sequence
  Description of Artificial Sequence: Synthetic oligonucleotide
  Target: SCN9A; (+) strand; PAM type: YTN; PAM sequence: TTT
ctatttaaagtattgatcct

SEQ ID NO: 94670 - DNA, 20 bp, Artificial Sequence
  Description of Artificial Sequence: Synthetic oligonucleotide
  Target: SCN9A; (+) strand; PAM type: YTN; PAM sequence: TTC
tatttaaagtattgatcctt

SEQ ID NO: 94671 - DNA, 20 bp, Artificial Sequence
  Description of Artificial Sequence: Synthetic oligonucleotide
  Target: SCN9A; (+) strand; PAM type: YTN; PAM sequence: CTA
tttaaagtattgatcctttc

SEQ ID NO: 94672 - DNA, 20 bp, Artificial Sequence
  Description of Artificial Sequence: Synthetic oligonucleotide
  Target: SCN9A; (+) strand; PAM type: YTN; PAM sequence: TTT
aaagtattgatcctttctcg

SEQ ID NO: 94673 - DNA, 20 bp, Artificial Sequence
  Description of Artificial Sequence: Synthetic oligonucleotide
  Target: SCN9A; (+) strand; PAM type: YTN; PAM sequence: TTA
aagtattgatcctttctcgg

SEQ ID NO: 94674 - DNA, 20 bp, Artificial Sequence
  Description of Artificial Sequence: Synthetic oligonucleotide
  Target: SCN9A; (+) strand; PAM type: YTN; PAM sequence: TTG
atcctttctcggccttaact

SEQ ID NO: 94675 - DNA, 20 bp, Artificial Sequence
  Description of Artificial Sequence: Synthetic oligonucleotide
  Target: SCN9A; (+) strand; PAM type: YTN; PAM sequence: CTT
tctcggccttaactgttatg

SEQ ID NO: 94676 - DNA, 20 bp, Artificial Sequence
  Description of Artificial Sequence: Synthetic oligonucleotide
  Target: SCN9A; (+) strand; PAM type: YTN; PAM sequence: TTT
ctcggccttaactgttatgt

SEQ ID NO: 94677 - DNA, 20 bp, Artificial Sequence
  Description of Artificial Sequence: Synthetic oligonucleotide
  Target: SCN9A; (+) strand; PAM type: YTN; PAM sequence: TTC
tcggccttaactgttatgta

SEQ ID NO: 94678 - DNA, 20 bp, Artificial Sequence
  Description of Artificial Sequence: Synthetic oligonucleotide
  Target: SCN9A; (+) strand; PAM type: YTN; PAM sequence: CTC
ggccttaactgttatgtaaa

SEQ ID NO: 94679 - DNA, 20 bp, Artificial Sequence
  Description of Artificial Sequence: Synthetic oligonucleotide
  Target: SCN9A; (+) strand; PAM type: YTN; PAM sequence: CTT
aactgttatgtaaacatttc

SEQ ID NO: 94680 - DNA, 20 bp, Artificial Sequence
  Description of Artificial Sequence: Synthetic oligonucleotide
  Target: SCN9A; (+) strand; PAM type: YTN; PAM sequence: TTA
actgttatgtaaacatttca

SEQ ID NO: 94681 - DNA, 20 bp, Artificial Sequence
  Description of Artificial Sequence: Synthetic oligonucleotide
  Target: SCN9A; (+) strand; PAM type: YTN; PAM sequence: CTG
ttatgtaaacatttcaccta

SEQ ID NO: 94682 - DNA, 20 bp, Artificial Sequence
  Description of Artificial Sequence: Synthetic oligonucleotide
  Target: SCN9A; (+) strand; PAM type: YTN; PAM sequence: TTA
tgtaaacatttcacctattt

SEQ ID NO: 94683 - DNA, 20 bp, Artificial Sequence
  Description of Artificial Sequence: Synthetic oligonucleotide
  Target: SCN9A; (+) strand; PAM type: YTN; PAM sequence: TTT
cacctattttttgtctttca

SEQ ID NO: 94684 - DNA, 20 bp, Artificial Sequence
  Description of Artificial Sequence: Synthetic oligonucleotide
  Target: SCN9A; (+) strand; PAM type: YTN; PAM sequence: TTC
acctattttttgtctttcaa

SEQ ID NO: 94685 - DNA, 20 bp, Artificial Sequence
  Description of Artificial Sequence: Synthetic oligonucleotide
  Target: SCN9A; (+) strand; PAM type: YTN; PAM sequence: CTA
ttttttgtctttcaaccttt

SEQ ID NO: 94686 - DNA, 20 bp, Artificial Sequence
  Description of Artificial Sequence: Synthetic oligonucleotide
  Target: SCN9A; (+) strand; PAM type: YTN; PAM sequence: TTT
tttgtctttcaaccttttat

SEQ ID NO: 94687 - DNA, 20 bp, Artificial Sequence
  Description of Artificial Sequence: Synthetic oligonucleotide
  Target: SCN9A; (+) strand; PAM type: YTN; PAM sequence: TTT
ttgtctttcaaccttttatt

SEQ ID NO: 94688 - DNA, 20 bp, Artificial Sequence
  Description of Artificial Sequence: Synthetic oligonucleotide
  Target: SCN9A; (+) strand; PAM type: YTN; PAM sequence: TTT
tgtctttcaaccttttattt

SEQ ID NO: 94689 - DNA, 20 bp, Artificial Sequence
  Description of Artificial Sequence: Synthetic oligonucleotide
  Target: SCN9A; (+) strand; PAM type: YTN; PAM sequence: TTT
gtctttcaaccttttattta

SEQ ID NO: 94690 - DNA, 20 bp, Artificial Sequence
  Description of Artificial Sequence: Synthetic oligonucleotide
  Target: SCN9A; (+) strand; PAM type: YTN; PAM sequence: TTG
tctttcaaccttttatttat

SEQ ID NO: 94691 - DNA, 20 bp, Artificial Sequence
  Description of Artificial Sequence: Synthetic oligonucleotide
  Target: SCN9A; (+) strand; PAM type: YTN; PAM sequence: CTT
tcaaccttttatttatgatg

SEQ ID NO: 94692 - DNA, 20 bp, Artificial Sequence
  Description of Artificial Sequence: Synthetic oligonucleotide
  Target: SCN9A; (+) strand; PAM type: YTN; PAM sequence: TTT
caaccttttatttatgatga

SEQ ID NO: 94693 - DNA, 20 bp, Artificial Sequence
  Description of Artificial Sequence: Synthetic oligonucleotide
  Target: SCN9A; (+) strand; PAM type: YTN; PAM sequence: TTC
aaccttttatttatgatgat

SEQ ID NO: 94694 - DNA, 20 bp, Artificial Sequence
  Description of Artificial Sequence: Synthetic oligonucleotide
  Target: SCN9A; (+) strand; PAM type: YTN; PAM sequence: CTT
ttatttatgatgattttttc

SEQ ID NO: 94695 - DNA, 20 bp, Artificial Sequence
  Description of Artificial Sequence: Synthetic oligonucleotide
  Target: SCN9A; (+) strand; PAM type: YTN; PAM sequence: TTT
tatttatgatgattttttcc

SEQ ID NO: 94696 - DNA, 20 bp, Artificial Sequence
  Description of Artificial Sequence: Synthetic oligonucleotide
  Target: SCN9A; (+) strand; PAM type: YTN; PAM sequence: TTT
atttatgatgattttttccc

SEQ ID NO: 94697 - DNA, 20 bp, Artificial Sequence
  Description of Artificial Sequence: Synthetic oligonucleotide
  Target: SCN9A; (+) strand; PAM type: YTN; PAM sequence: TTA
tttatgatgattttttcccc

SEQ ID NO: 94698 - DNA, 20 bp, Artificial Sequence
  Description of Artificial Sequence: Synthetic oligonucleotide
  Target: SCN9A; (+) strand; PAM type: YTN; PAM sequence: TTT
atgatgattttttccccaaa

SEQ ID NO: 94699 - DNA, 20 bp, Artificial Sequence
  Description of Artificial Sequence: Synthetic oligonucleotide
  Target: SCN9A; (+) strand; PAM type: YTN; PAM sequence: TTA
tgatgattttttccccaaag

SEQ ID NO: 94700 - DNA, 20 bp, Artificial Sequence
  Description of Artificial Sequence: Synthetic oligonucleotide
  Target: SCN9A; (+) strand; PAM type: YTN; PAM sequence: TTT
tttccccaaagaatattttg

SEQ ID NO: 94701 - DNA, 20 bp, Artificial Sequence
  Description of Artificial Sequence: Synthetic oligonucleotide
  Target: SCN9A; (+) strand; PAM type: YTN; PAM sequence: TTT
ttccccaaagaatattttgt

SEQ ID NO: 94702 - DNA, 20 bp, Artificial Sequence
  Description of Artificial Sequence: Synthetic oligonucleotide
  Target: SCN9A; (+) strand; PAM type: YTN; PAM sequence: TTT
tccccaaagaatattttgtt

SEQ ID NO: 94703 - DNA, 20 bp, Artificial Sequence
  Description of Artificial Sequence: Synthetic oligonucleotide
  Target: SCN9A; (+) strand; PAM type: YTN; PAM sequence: TTT
ccccaaagaatattttgttt

SEQ ID NO: 94704 - DNA, 20 bp, Artificial Sequence
  Description of Artificial Sequence: Synthetic oligonucleotide
  Target: SCN9A; (+) strand; PAM type: YTN; PAM sequence: TTC
cccaaagaatattttgtttt

SEQ ID NO: 94705 - DNA, 20 bp, Artificial Sequence
  Description of Artificial Sequence: Synthetic oligonucleotide
  Target: SCN9A; (+) strand; PAM type: YTN; PAM sequence: TTT
tgtttttttgtgcagtcatt

SEQ ID NO: 94706 - DNA, 20 bp, Artificial Sequence
  Description of Artificial Sequence: Synthetic oligonucleotide
  Target: SCN9A; (+) strand; PAM type: YTN; PAM sequence: TTT
gtttttttgtgcagtcattt

SEQ ID NO: 94707 - DNA, 20 bp, Artificial Sequence
  Description of Artificial Sequence: Synthetic oligonucleotide
  Target: SCN9A; (+) strand; PAM type: YTN; PAM sequence: TTG
tttttttgtgcagtcatttc

SEQ ID NO: 94708 - DNA, 20 bp, Artificial Sequence
  Description of Artificial Sequence: Synthetic oligonucleotide
  Target: SCN9A; (+) strand; PAM type: YTN; PAM sequence: TTT
ttttgtgcagtcatttcttc

SEQ ID NO: 94709 - DNA, 20 bp, Artificial Sequence
  Description of Artificial Sequence: Synthetic oligonucleotide
  Target: SCN9A; (+) strand; PAM type: YTN; PAM sequence: TTT
tttgtgcagtcatttcttct

SEQ ID NO: 94710 - DNA, 20 bp, Artificial Sequence
  Description of Artificial Sequence: Synthetic oligonucleotide
  Target: SCN9A; (+) strand; PAM type: YTN; PAM sequence: TTT
ttgtgcagtcatttcttctt

SEQ ID NO: 94711 - DNA, 20 bp, Artificial Sequence
  Description of Artificial Sequence: Synthetic oligonucleotide
  Target: SCN9A; (+) strand; PAM type: YTN; PAM sequence: TTT
tgtgcagtcatttcttcttc

SEQ ID NO: 94712 - DNA, 20 bp, Artificial Sequence
  Description of Artificial Sequence: Synthetic oligonucleotide
  Target: SCN9A; (+) strand; PAM type: YTN; PAM sequence: TTT
gtgcagtcatttcttcttca

SEQ ID NO: 94713 - DNA, 20 bp, Artificial Sequence
  Description of Artificial Sequence: Synthetic oligonucleotide
  Target: SCN9A; (+) strand; PAM type: YTN; PAM sequence: TTG
tgcagtcatttcttcttcat

SEQ ID NO: 94714 - DNA, 20 bp, Artificial Sequence
  Description of Artificial Sequence: Synthetic oligonucleotide
  Target: SCN9A; (+) strand; PAM type: YTN; PAM sequence: TTT
cttcttcatttttttttttg

SEQ ID NO: 94715 - DNA, 20 bp, Artificial Sequence
  Description of Artificial Sequence: Synthetic oligonucleotide
  Target: SCN9A; (+) strand; PAM type: YTN; PAM sequence: TTC
ttcttcatttttttttttgg

SEQ ID NO: 94716 - DNA, 20 bp, Artificial Sequence
  Description of Artificial Sequence: Synthetic oligonucleotide
  Target: SCN9A; (+) strand; PAM type: YTN; PAM sequence: CTT
cttcatttttttttttggct

SEQ ID NO: 94717 - DNA, 20 bp, Artificial Sequence
  Description of Artificial Sequence: Synthetic oligonucleotide
  Target: SCN9A; (+) strand; PAM type: YTN; PAM sequence: TTC
ttcatttttttttttggctt

SEQ ID NO: 94718 - DNA, 20 bp, Artificial Sequence
  Description of Artificial Sequence: Synthetic oligonucleotide
  Target: SCN9A; (+) strand; PAM type: YTN; PAM sequence: CTT
catttttttttttggcttta

SEQ ID NO: 94719 - DNA, 20 bp, Artificial Sequence
  Description of Artificial Sequence: Synthetic oligonucleotide
  Target: SCN9A; (+) strand; PAM type: YTN; PAM sequence: TTC
atttttttttttggctttac

SEQ ID NO: 94720 - DNA, 20 bp, Artificial Sequence
  Description of Artificial Sequence: Synthetic oligonucleotide
  Target: SCN9A; (+) strand; PAM type: YTN; PAM sequence: TTT
ttttttttggctttacaaat

SEQ ID NO: 94721 - DNA, 20 bp, Artificial Sequence
  Description of Artificial Sequence: Synthetic oligonucleotide
  Target: SCN9A; (+) strand; PAM type: YTN; PAM sequence: TTT
tttttttggctttacaaatt

SEQ ID NO: 94722 - DNA, 20 bp, Artificial Sequence
  Description of Artificial Sequence: Synthetic oligonucleotide
  Target: SCN9A; (+) strand; PAM type: YTN; PAM sequence: TTT
ttttttggctttacaaattt

SEQ ID NO: 94723 - DNA, 20 bp, Artificial Sequence
  Description of Artificial Sequence: Synthetic oligonucleotide
  Target: SCN9A; (+) strand; PAM type: YTN; PAM sequence: TTT
tttttggctttacaaatttg

SEQ ID NO: 94724 - DNA, 20 bp, Artificial Sequence
  Description of Artificial Sequence: Synthetic oligonucleotide
  Target: SCN9A; (+) strand; PAM type: YTN; PAM sequence: TTT
ttttggctttacaaatttgt

SEQ ID NO: 94725 - DNA, 20 bp, Artificial Sequence
  Description of Artificial Sequence: Synthetic oligonucleotide
  Target: SCN9A; (+) strand; PAM type: YTN; PAM sequence: TTT
tttggctttacaaatttgtg

SEQ ID NO: 94726 - DNA, 20 bp, Artificial Sequence
  Description of Artificial Sequence: Synthetic oligonucleotide
  Target: SCN9A; (+) strand; PAM type: YTN; PAM sequence: TTT
ttggctttacaaatttgtgt

SEQ ID NO: 94727 - DNA, 20 bp, Artificial Sequence
  Description of Artificial Sequence: Synthetic oligonucleotide
  Target: SCN9A; (+) strand; PAM type: YTN; PAM sequence: TTT
tggctttacaaatttgtgtt

SEQ ID NO: 94728 - DNA, 20 bp, Artificial Sequence
  Description of Artificial Sequence: Synthetic oligonucleotide
  Target: SCN9A; (+) strand; PAM type: YTN; PAM sequence: TTT
ggctttacaaatttgtgttt

SEQ ID NO: 94729 - DNA, 20 bp, Artificial Sequence
  Description of Artificial Sequence: Synthetic oligonucleotide
  Target: SCN9A; (+) strand; PAM type: YTN; PAM sequence: TTG
gctttacaaatttgtgtttt

SEQ ID NO: 94730 - DNA, 20 bp, Artificial Sequence
  Description of Artificial Sequence: Synthetic oligonucleotide
  Target: SCN9A; (+) strand; PAM type: YTN; PAM sequence: CTT
tacaaatttgtgttttgcat

SEQ ID NO: 94731 - DNA, 20 bp, Artificial Sequence
  Description of Artificial Sequence: Synthetic oligonucleotide
  Target: SCN9A; (+) strand; PAM type: YTN; PAM sequence: TTT
acaaatttgtgttttgcata

SEQ ID NO: 94732 - DNA, 20 bp, Artificial Sequence
  Description of Artificial Sequence: Synthetic oligonucleotide
  Target: SCN9A; (+) strand; PAM type: YTN; PAM sequence: TTA
caaatttgtgttttgcatag

SEQ ID NO: 94733 - DNA, 20 bp, Artificial Sequence
  Description of Artificial Sequence: Synthetic oligonucleotide
  Target: SCN9A; (+) strand; PAM type: YTN; PAM sequence: TTT
gtgttttgcatagaaaggac

SEQ ID NO: 94734 - DNA, 20 bp, Artificial Sequence
  Description of Artificial Sequence: Synthetic oligonucleotide
  Target: SCN9A; (+) strand; PAM type: YTN; PAM sequence: TTG
tgttttgcatagaaaggact

SEQ ID NO: 94735 - DNA, 20 bp, Artificial Sequence
  Description of Artificial Sequence: Synthetic oligonucleotide
  Target: SCN9A; (+) strand; PAM type: YTN; PAM sequence: TTT
tgcatagaaaggactataag

SEQ ID NO: 94736 - DNA, 20 bp, Artificial Sequence
  Description of Artificial Sequence: Synthetic oligonucleotide
  Target: SCN9A; (+) strand; PAM type: YTN; PAM sequence: TTT
gcatagaaaggactataaga

SEQ ID NO: 94737 - DNA, 20 bp, Artificial Sequence
  Description of Artificial Sequence: Synthetic oligonucleotide
  Target: SCN9A; (+) strand; PAM type: YTN; PAM sequence: TTG
catagaaaggactataagag

SEQ ID NO: 94738 - DNA, 20 bp, Artificial Sequence
  Description of Artificial Sequence: Synthetic oligonucleotide
  Target: SCN9A; (+) strand; PAM type: YTN; PAM sequence: CTA
taagagtatatggttatatg

SEQ ID NO: 94739 - DNA, 20 bp, Artificial Sequence
  Description of Artificial Sequence: Synthetic oligonucleotide
  Target: SCN9A; (+) strand; PAM type: YTN; PAM sequence: TTA
tatgtctatttccacatatt

SEQ ID NO: 94740 - DNA, 20 bp, Artificial Sequence
  Description of Artificial Sequence: Synthetic oligonucleotide
  Target: SCN9A; (+) strand; PAM type: YTN; PAM sequence: CTA
tttccacatatttcctacta

SEQ ID NO: 94741 - DNA, 20 bp, Artificial Sequence
  Description of Artificial Sequence: Synthetic oligonucleotide
  Target: SCN9A; (+) strand; PAM type: YTN; PAM sequence: TTT
ccacatatttcctactagaa

SEQ ID NO: 94742 - DNA, 20 bp, Artificial Sequence
  Description of Artificial Sequence: Synthetic oligonucleotide
  Target: SCN9A; (+) strand; PAM type: YTN; PAM sequence: TTC
cacatatttcctactagaat

SEQ ID NO: 94743 - DNA, 20 bp, Artificial Sequence
  Description of Artificial Sequence: Synthetic oligonucleotide
  Target: SCN9A; (+) strand; PAM type: YTN; PAM sequence: TTT
cctactagaatctttttttt

SEQ ID NO: 94744 - DNA, 20 bp, Artificial Sequence
  Description of Artificial Sequence: Synthetic oligonucleotide
  Target: SCN9A; (+) strand; PAM type: YTN; PAM sequence: TTC
ctactagaatcttttttttt

SEQ ID NO: 94745 - DNA, 20 bp, Artificial Sequence
  Description of Artificial Sequence: Synthetic oligonucleotide
  Target: SCN9A; (+) strand; PAM type: YTN; PAM sequence: CTA
ctagaatctttttttttaac

SEQ ID NO: 94746 - DNA, 20 bp, Artificial Sequence
  Description of Artificial Sequence: Synthetic oligonucleotide
  Target: SCN9A; (+) strand; PAM type: YTN; PAM sequence: CTA
gaatctttttttttaacttt

SEQ ID NO: 94747 - DNA, 20 bp, Artificial Sequence
  Description of Artificial Sequence: Synthetic oligonucleotide
  Target: SCN9A; (+) strand; PAM type: YTN; PAM sequence: CTT
tttttttaactttagatttt

SEQ ID NO: 94748 - DNA, 20 bp, Artificial Sequence
  Description of Artificial Sequence: Synthetic oligonucleotide
  Target: SCN9A; (+) strand; PAM type: YTN; PAM sequence: TTT
ttttttaactttagattttg

SEQ ID NO: 94749 - DNA, 20 bp, Artificial Sequence
  Description of Artificial Sequence: Synthetic oligonucleotide
  Target: SCN9A; (+) strand; PAM type: YTN; PAM sequence: TTT
tttttaactttagattttga

SEQ ID NO: 94750 - DNA, 20 bp, Artificial Sequence
  Description of Artificial Sequence: Synthetic oligonucleotide
  Target: SCN9A; (+) strand; PAM type: YTN; PAM sequence: TTT
ttttaactttagattttgat

SEQ ID NO: 94751 - DNA, 20 bp, Artificial Sequence
  Description of Artificial Sequence: Synthetic oligonucleotide
  Target: SCN9A; (+) strand; PAM type: YTN; PAM sequence: TTT
tttaactttagattttgatt

SEQ ID NO: 94752 - DNA, 20 bp, Artificial Sequence
  Description of Artificial Sequence: Synthetic oligonucleotide
  Target: SCN9A; (+) strand; PAM type: YTN; PAM sequence: TTT
ttaactttagattttgattc

SEQ ID NO: 94753 - DNA, 20 bp, Artificial Sequence
  Description of Artificial Sequence: Synthetic oligonucleotide
  Target: SCN9A; (+) strand; PAM type: YTN; PAM sequence: TTT
taactttagattttgattca

SEQ ID NO: 94754 - DNA, 20 bp, Artificial Sequence
  Description of Artificial Sequence: Synthetic oligonucleotide
  Target: SCN9A; (+) strand; PAM type: YTN; PAM sequence: TTT
aactttagattttgattcat

SEQ ID NO: 94755 - DNA, 20 bp, Artificial Sequence
  Description of Artificial Sequence: Synthetic oligonucleotide
  Target: SCN9A; (+) strand; PAM type: YTN; PAM sequence: TTA
actttagattttgattcatg

SEQ ID NO: 94756 - DNA, 20 bp, Artificial Sequence
  Description of Artificial Sequence: Synthetic oligonucleotide
  Target: SCN9A; (+) strand; PAM type: YTN; PAM sequence: CTT
tagattttgattcatgtgat

SEQ ID NO: 94757 - DNA, 20 bp, Artificial Sequence
  Description of Artificial Sequence: Synthetic oligonucleotide
  Target: SCN9A; (+) strand; PAM type: YTN; PAM sequence: TTT
agattttgattcatgtgatc

SEQ ID NO: 94758 - DNA, 20 bp, Artificial Sequence
  Description of Artificial Sequence: Synthetic oligonucleotide
  Target: SCN9A; (+) strand; PAM type: YTN; PAM sequence: TTA
gattttgattcatgtgatct

SEQ ID NO: 94759 - DNA, 20 bp, Artificial Sequence
  Description of Artificial Sequence: Synthetic oligonucleotide
  Target: SCN9A; (+) strand; PAM type: YTN; PAM sequence: TTT
tgattcatgtgatcttttca

SEQ ID NO: 94760 - DNA, 20 bp, Artificial Sequence
  Description of Artificial Sequence: Synthetic oligonucleotide
  Target: SCN9A; (+) strand; PAM type: YTN; PAM sequence: TTT
gattcatgtgatcttttcac

SEQ ID NO: 94761 - DNA, 20 bp, Artificial Sequence
  Description of Artificial Sequence: Synthetic oligonucleotide
  Target: SCN9A; (+) strand; PAM type: YTN; PAM sequence: TTG
attcatgtgatcttttcaca

SEQ ID NO: 94762 - DNA, 20 bp, Artificial Sequence
  Description of Artificial Sequence: Synthetic oligonucleotide
  Target: SCN9A; (+) strand; PAM type: YTN; PAM sequence: TTC
atgtgatcttttcacacagt

SEQ ID NO: 94763 - DNA, 20 bp, Artificial Sequence
  Description of Artificial Sequence: Synthetic oligonucleotide
  Target: SCN9A; (+) strand; PAM type: YTN; PAM sequence: CTT
ttcacacagtaaattggtaa

SEQ ID NO: 94764 - DNA, 20 bp, Artificial Sequence
  Description of Artificial Sequence: Synthetic oligonucleotide
  Target: SCN9A; (+) strand; PAM type: YTN; PAM sequence: TTT
tcacacagtaaattggtaat

SEQ ID NO: 94765 - DNA, 20 bp, Artificial Sequence
  Description of Artificial Sequence: Synthetic oligonucleotide
  Target: SCN9A; (+) strand; PAM type: YTN; PAM sequence: TTT
cacacagtaaattggtaatt

SEQ ID NO: 94766 - DNA, 20 bp, Artificial Sequence
  Description of Artificial Sequence: Synthetic oligonucleotide
  Target: SCN9A; (+) strand; PAM type: YTN; PAM sequence: TTC
acacagtaaattggtaatta

SEQ ID NO: 94767 - DNA, 20 bp, Artificial Sequence
  Description of Artificial Sequence: Synthetic oligonucleotide
  Target: SCN9A; (+) strand; PAM type: YTN; PAM sequence: TTG
gtaattatacattaaagttt

SEQ ID NO: 94768 - DNA, 20 bp, Artificial Sequence
  Description of Artificial Sequence: Synthetic oligonucleotide
  Target: SCN9A; (+) strand; PAM type: YTN; PAM sequence: TTA
tacattaaagtttaatttgg

SEQ ID NO: 94769 - DNA, 20 bp, Artificial Sequence
  Description of Artificial Sequence: Synthetic oligonucleotide
  Target: SCN9A; (+) strand; PAM type: YTN; PAM sequence: TTA
aagtttaatttggactctct

SEQ ID NO: 94770 - DNA, 20 bp, Artificial Sequence
  Description of Artificial Sequence: Synthetic oligonucleotide
  Target: SCN9A; (+) strand; PAM type: YTN; PAM sequence: TTT
aatttggactctcttcaaac

SEQ ID NO: 94771 - DNA, 20 bp, Artificial Sequence
  Description of Artificial Sequence: Synthetic oligonucleotide
  Target: SCN9A; (+) strand; PAM type: YTN; PAM sequence: TTA
atttggactctcttcaaacc

SEQ ID NO: 94772 - DNA, 20 bp, Artificial Sequence
  Description of Artificial Sequence: Synthetic oligonucleotide
  Target: SCN9A; (+) strand; PAM type: YTN; PAM sequence: TTT
ggactctcttcaaacccact

SEQ ID NO: 94773 - DNA, 20 bp, Artificial Sequence
  Description of Artificial Sequence: Synthetic oligonucleotide
  Target: SCN9A; (+) strand; PAM type: YTN; PAM sequence: TTG
gactctcttcaaacccactg

SEQ ID NO: 94774 - DNA, 20 bp, Artificial Sequence
  Description of Artificial Sequence: Synthetic oligonucleotide
  Target: SCN9A; (+) strand; PAM type: YTN; PAM sequence: CTC
tcttcaaacccactgagctt

SEQ ID NO: 94775 - DNA, 20 bp, Artificial Sequence
  Description of Artificial Sequence: Synthetic oligonucleotide
  Target: SCN9A; (+) strand; PAM type: YTN; PAM sequence: CTC
ttcaaacccactgagctttt

SEQ ID NO: 94776 - DNA, 20 bp, Artificial Sequence
  Description of Artificial Sequence: Synthetic oligonucleotide
  Target: SCN9A; (+) strand; PAM type: YTN; PAM sequence: CTT
caaacccactgagcttttat

SEQ ID NO: 94777 - DNA, 20 bp, Artificial Sequence
  Description of Artificial Sequence: Synthetic oligonucleotide
  Target: SCN9A; (+) strand; PAM type: YTN; PAM sequence: TTC
aaacccactgagcttttata

SEQ ID NO: 94778 - DNA, 20 bp, Artificial Sequence
  Description of Artificial Sequence: Synthetic oligonucleotide
  Target: SCN9A; (+) strand; PAM type: YTN; PAM sequence: CTG
agcttttatatttgaacagt

SEQ ID NO: 94779 - DNA, 20 bp, Artificial Sequence
  Description of Artificial Sequence: Synthetic oligonucleotide
  Target: SCN9A; (+) strand; PAM type: YTN; PAM sequence: CTT
ttatatttgaacagttttat

SEQ ID NO: 94780 - DNA, 20 bp, Artificial Sequence
  Description of Artificial Sequence: Synthetic oligonucleotide
  Target: SCN9A; (+) strand; PAM type: YTN; PAM sequence: TTT
tatatttgaacagttttatt

SEQ ID NO: 94781 - DNA, 20 bp, Artificial Sequence
  Description of Artificial Sequence: Synthetic oligonucleotide
  Target: SCN9A; (+) strand; PAM type: YTN; PAM sequence: TTT
atatttgaacagttttattt

SEQ ID NO: 94782 - DNA, 20 bp, Artificial Sequence
  Description of Artificial Sequence: Synthetic oligonucleotide
  Target: SCN9A; (+) strand; PAM type: YTN; PAM sequence: TTA
tatttgaacagttttattta

SEQ ID NO: 94783 - DNA, 20 bp, Artificial Sequence
  Description of Artificial Sequence: Synthetic oligonucleotide
  Target: SCN9A; (+) strand; PAM type: YTN; PAM sequence: TTT
gaacagttttatttaacatc

SEQ ID NO: 94784 - DNA, 20 bp, Artificial Sequence
  Description of Artificial Sequence: Synthetic oligonucleotide
  Target: SCN9A; (+) strand; PAM type: YTN; PAM sequence: TTG
aacagttttatttaacatct

SEQ ID NO: 94785 - DNA, 20 bp, Artificial Sequence
  Description of Artificial Sequence: Synthetic oligonucleotide
  Target: SCN9A; (+) strand; PAM type: YTN; PAM sequence: TTT
tatttaacatctatatgtct

SEQ ID NO: 94786 - DNA, 20 bp, Artificial Sequence
  Description of Artificial Sequence: Synthetic oligonucleotide
  Target: SCN9A; (+) strand; PAM type: YTN; PAM sequence: TTT
atttaacatctatatgtctt

SEQ ID NO: 94787 - DNA, 20 bp, Artificial Sequence
  Description of Artificial Sequence: Synthetic oligonucleotide
  Target: SCN9A; (+) strand; PAM type: YTN; PAM sequence: TTA
tttaacatctatatgtctta

SEQ ID NO: 94788 - DNA, 20 bp, Artificial Sequence
  Description of Artificial Sequence: Synthetic oligonucleotide
  Target: SCN9A; (+) strand; PAM type: YTN; PAM sequence: TTT
aacatctatatgtcttaata

SEQ ID NO: 94789 - DNA, 20 bp, Artificial Sequence
  Description of Artificial Sequence: Synthetic oligonucleotide
  Target: SCN9A; (+) strand; PAM type: YTN; PAM sequence: TTA
acatctatatgtcttaatat

SEQ ID NO: 94790 - DNA, 20 bp, Artificial Sequence
  Description of Artificial Sequence: Synthetic oligonucleotide
  Target: SCN9A; (+) strand; PAM type: YTN; PAM sequence: CTA
tatgtcttaatattttgcag

SEQ ID NO: 94791 - DNA, 20 bp, Artificial Sequence
  Description of Artificial Sequence: Synthetic oligonucleotide
  Target: SCN9A; (+) strand; PAM type: YTN; PAM sequence: CTT
aatattttgcagaataagcc

SEQ ID NO: 94792 - DNA, 20 bp, Artificial Sequence
  Description of Artificial Sequence: Synthetic oligonucleotide
  Target: SCN9A; (+) strand; PAM type: YTN; PAM sequence: TTA
atattttgcagaataagcca

SEQ ID NO: 94793 - DNA, 20 bp, Artificial Sequence
  Description of Artificial Sequence: Synthetic oligonucleotide
  Target: SCN9A; (+) strand; PAM type: YTN; PAM sequence: TTT
tgcagaataagccacctctt

SEQ ID NO: 94794 - DNA, 20 bp, Artificial Sequence
  Description of Artificial Sequence: Synthetic oligonucleotide
  Target: SCN9A; (+) strand; PAM type: YTN; PAM sequence: TTT
gcagaataagccacctcttg

SEQ ID NO: 94795 - DNA, 20 bp, Artificial Sequence
  Description of Artificial Sequence: Synthetic oligonucleotide
  Target: SCN9A; (+) strand; PAM type: YTN; PAM sequence: TTG
cagaataagccacctcttgt

SEQ ID NO: 94796 - DNA, 20 bp, Artificial Sequence
  Description of Artificial Sequence: Synthetic oligonucleotide
  Target: SCN9A; (+) strand; PAM type: YTN; PAM sequence: CTC
ttgtcaccctaattttcttc

SEQ ID NO: 94797 - DNA, 20 bp, Artificial Sequence
  Description of Artificial Sequence: Synthetic oligonucleotide
  Target: SCN9A; (+) strand; PAM type: YTN; PAM sequence: CTT
gtcaccctaattttcttcca

SEQ ID NO: 94798 - DNA, 20 bp, Artificial Sequence
  Description of Artificial Sequence: Synthetic oligonucleotide
  Target: SCN9A; (+) strand; PAM type: YTN; PAM sequence: TTG
tcaccctaattttcttccag

SEQ ID NO: 94799 - DNA, 20 bp, Artificial Sequence
  Description of Artificial Sequence: Synthetic oligonucleotide
  Target: SCN9A; (+) strand; PAM type: YTN; PAM sequence: CTA
attttcttccagatgaattt

SEQ ID NO: 94800 - DNA, 20 bp, Artificial Sequence
  Description of Artificial Sequence: Synthetic oligonucleotide
  Target: SCN9A; (+) strand; PAM type: YTN; PAM sequence: TTT
tcttccagatgaatttagaa

SEQ ID NO: 94801 - DNA, 20 bp, Artificial Sequence
  Description of Artificial Sequence: Synthetic oligonucleotide
  Target: SCN9A; (+) strand; PAM type: YTN; PAM sequence: TTT
cttccagatgaatttagaat

SEQ ID NO: 94802 - DNA, 20 bp, Artificial Sequence
  Description of Artificial Sequence: Synthetic oligonucleotide
  Target: SCN9A; (+) strand; PAM type: YTN; PAM sequence: TTC
ttccagatgaatttagaatc

SEQ ID NO: 94803 - DNA, 20 bp, Artificial Sequence
  Description of Artificial Sequence: Synthetic oligonucleotide
  Target: SCN9A; (+) strand; PAM type: YTN; PAM sequence: CTT
ccagatgaatttagaatcat

SEQ ID NO: 94804 - DNA, 20 bp, Artificial Sequence
  Description of Artificial Sequence: Synthetic oligonucleotide
  Target: SCN9A; (+) strand; PAM type: YTN; PAM sequence: TTC
cagatgaatttagaatcatt

SEQ ID NO: 94805 - DNA, 20 bp, Artificial Sequence
  Description of Artificial Sequence: Synthetic oligonucleotide
  Target: SCN9A; (+) strand; PAM type: YTN; PAM sequence: TTT
agaatcatttagacttatat

SEQ ID NO: 94806 - DNA, 20 bp, Artificial Sequence
  Description of Artificial Sequence: Synthetic oligonucleotide
  Target: SCN9A; (+) strand; PAM type: YTN; PAM sequence: TTA
gaatcatttagacttatatt

SEQ ID NO: 94807 - DNA, 20 bp, Artificial Sequence
  Description of Artificial Sequence: Synthetic oligonucleotide
  Target: SCN9A; (+) strand; PAM type: YTN; PAM sequence: TTT
agacttatattgtttttgtc

SEQ ID NO: 94808 - DNA, 20 bp, Artificial Sequence
  Description of Artificial Sequence: Synthetic oligonucleotide
  Target: SCN9A; (+) strand; PAM type: YTN; PAM sequence: TTA
gacttatattgtttttgtct

SEQ ID NO: 94809 - DNA, 20 bp, Artificial Sequence
  Description of Artificial Sequence: Synthetic oligonucleotide
  Target: SCN9A; (+) strand; PAM type: YTN; PAM sequence: CTT
atattgtttttgtctattta

SEQ ID NO: 94810 - DNA, 20 bp, Artificial Sequence
  Description of Artificial Sequence: Synthetic oligonucleotide
  Target: SCN9A; (+) strand; PAM type: YTN; PAM sequence: TTA
tattgtttttgtctatttat

SEQ ID NO: 94811 - DNA, 20 bp, Artificial Sequence
  Description of Artificial Sequence: Synthetic oligonucleotide
  Target: SCN9A; (+) strand; PAM type: YTN; PAM sequence: TTG
tttttgtctatttattaccc

SEQ ID NO: 94812 - DNA, 20 bp, Artificial Sequence
  Description of Artificial Sequence: Synthetic oligonucleotide
  Target: SCN9A; (+) strand; PAM type: YTN; PAM sequence: TTT
ttgtctatttattacccaca

SEQ ID NO: 94813 - DNA, 20 bp, Artificial Sequence
  Description of Artificial Sequence: Synthetic oligonucleotide
  Target: SCN9A; (+) strand; PAM type: YTN; PAM sequence: TTT
tgtctatttattacccacac

SEQ ID NO: 94814 - DNA, 20 bp, Artificial Sequence
  Description of Artificial Sequence: Synthetic oligonucleotide
  Target: SCN9A; (+) strand; PAM type: YTN; PAM sequence: TTT
gtctatttattacccacact

SEQ ID NO: 94815 - DNA, 20 bp, Artificial Sequence
  Description of Artificial Sequence: Synthetic oligonucleotide
  Target: SCN9A; (+) strand; PAM type: YTN; PAM sequence: TTG
tctatttattacccacacta

SEQ ID NO: 94816 - DNA, 20 bp, Artificial Sequence
  Description of Artificial Sequence: Synthetic oligonucleotide
  Target: SCN9A; (+) strand; PAM type: YTN; PAM sequence: CTA
tttattacccacactacata

SEQ ID NO: 94817 - DNA, 20 bp, Artificial Sequence
  Description of Artificial Sequence: Synthetic oligonucleotide
  Target: SCN9A; (+) strand; PAM type: YTN; PAM sequence: TTT
attacccacactacataaaa

SEQ ID NO: 94818 - DNA, 20 bp, Artificial Sequence
  Description of Artificial Sequence: Synthetic oligonucleotide
  Target: SCN9A; (+) strand; PAM type: YTN; PAM sequence: TTA
ttacccacactacataaaaa

SEQ ID NO: 94819 - DNA, 20 bp, Artificial Sequence
  Description of Artificial Sequence: Synthetic oligonucleotide
  Target: SCN9A; (+) strand; PAM type: YTN; PAM sequence: TTA
cccacactacataaaaagac

SEQ ID NO: 94820 - DNA, 20 bp, Artificial Sequence
  Description of Artificial Sequence: Synthetic oligonucleotide
  Target: SCN9A; (+) strand; PAM type: YTN; PAM sequence: CTA
cataaaaagactcattgata

SEQ ID NO: 94821 - DNA, 20 bp, Artificial Sequence
  Description of Artificial Sequence: Synthetic oligonucleotide
  Target: SCN9A; (+) strand; PAM type: YTN; PAM sequence: CTC
attgatattttccttgaatt

SEQ ID NO: 94822 - DNA, 20 bp, Artificial Sequence
  Description of Artificial Sequence: Synthetic oligonucleotide
  Target: SCN9A; (+) strand; PAM type: YTN; PAM sequence: TTG
atattttccttgaatttata

SEQ ID NO: 94823 - DNA, 20 bp, Artificial Sequence
  Description of Artificial Sequence: Synthetic oligonucleotide
  Target: SCN9A; (+) strand; PAM type: YTN; PAM sequence: TTT
tccttgaatttatagattaa

SEQ ID NO: 94824 - DNA, 20 bp, Artificial Sequence
  Description of Artificial Sequence: Synthetic oligonucleotide
  Target: SCN9A; (+) strand; PAM type: YTN; PAM sequence: TTT
ccttgaatttatagattaat

SEQ ID NO: 94825 - DNA, 20 bp, Artificial Sequence
  Description of Artificial Sequence: Synthetic oligonucleotide
  Target: SCN9A; (+) strand; PAM type: YTN; PAM sequence: TTC
cttgaatttatagattaata

SEQ ID NO: 94826 - DNA, 20 bp, Artificial Sequence
  Description of Artificial Sequence: Synthetic oligonucleotide
  Target: SCN9A; (+) strand; PAM type: YTN; PAM sequence: CTT
gaatttatagattaataaat

SEQ ID NO: 94827 - DNA, 20 bp, Artificial Sequence
  Description of Artificial Sequence: Synthetic oligonucleotide
  Target: SCN9A; (+) strand; PAM type: YTN; PAM sequence: TTG
aatttatagattaataaatt

SEQ ID NO: 94828 - DNA, 20 bp, Artificial Sequence
  Description of Artificial Sequence: Synthetic oligonucleotide
  Target: SCN9A; (+) strand; PAM type: YTN; PAM sequence: TTT
atagattaataaatttgaaa

SEQ ID NO: 94829 - DNA, 20 bp, Artificial Sequence
  Description of Artificial Sequence: Synthetic oligonucleotide
  Target: SCN9A; (+) strand; PAM type: YTN; PAM sequence: TTA
tagattaataaatttgaaag

SEQ ID NO: 94830 - DNA, 20 bp, Artificial Sequence
  Description of Artificial Sequence: Synthetic oligonucleotide
  Target: SCN9A; (+) strand; PAM type: YTN; PAM sequence: TTA
ataaatttgaaagtcttaat

SEQ ID NO: 94831 - DNA, 20 bp, Artificial Sequence
  Description of Artificial Sequence: Synthetic oligonucleotide
  Target: SCN9A; (+) strand; PAM type: YTN; PAM sequence: TTT
gaaagtcttaattacaatga

SEQ ID NO: 94832 - DNA, 20 bp, Artificial Sequence
  Description of Artificial Sequence: Synthetic oligonucleotide
  Target: SCN9A; (+) strand; PAM type: YTN; PAM sequence: TTG
aaagtcttaattacaatgag

SEQ ID NO: 94833 - DNA, 20 bp, Artificial Sequence
  Description of Artificial Sequence: Synthetic oligonucleotide
  Target: SCN9A; (+) strand; PAM type: YTN; PAM sequence: CTT
aattacaatgagagaagctt

SEQ ID NO: 94834 - DNA, 20 bp, Artificial Sequence
  Description of Artificial Sequence: Synthetic oligonucleotide
  Target: SCN9A; (+) strand; PAM type: YTN; PAM sequence: TTA
attacaatgagagaagctta

SEQ ID NO: 94835 - DNA, 20 bp, Artificial Sequence
  Description of Artificial Sequence: Synthetic oligonucleotide
  Target: SCN9A; (+) strand; PAM type: YTN; PAM sequence: TTA
caatgagagaagcttatcta

SEQ ID NO: 94836 - DNA, 20 bp, Artificial Sequence
  Description of Artificial Sequence: Synthetic oligonucleotide
  Target: SCN9A; (+) strand; PAM type: YTN; PAM sequence: CTT
atctaagtacatgacaatcc

SEQ ID NO: 94837 - DNA, 20 bp, Artificial Sequence
  Description of Artificial Sequence: Synthetic oligonucleotide
  Target: SCN9A; (+) strand; PAM type: YTN; PAM sequence: TTA
tctaagtacatgacaatcct

SEQ ID NO: 94838 - DNA, 20 bp, Artificial Sequence
  Description of Artificial Sequence: Synthetic oligonucleotide
  Target: SCN9A; (+) strand; PAM type: YTN; PAM sequence: CTA
agtacatgacaatcctttca

SEQ ID NO: 94839 - DNA, 20 bp, Artificial Sequence
  Description of Artificial Sequence: Synthetic oligonucleotide
  Target: SCN9A; (+) strand; PAM type: YTN; PAM sequence: CTT
tcaattattttagctttctt

SEQ ID NO: 94840 - DNA, 20 bp, Artificial Sequence
  Description of Artificial Sequence: Synthetic oligonucleotide
  Target: SCN9A; (+) strand; PAM type: YTN; PAM sequence: TTT
caattattttagctttcttt

SEQ ID NO: 94841 - DNA, 20 bp, Artificial Sequence
  Description of Artificial Sequence: Synthetic oligonucleotide
  Target: SCN9A; (+) strand; PAM type: YTN; PAM sequence: TTC
aattattttagctttctttt

SEQ ID NO: 94842 - DNA, 20 bp, Artificial Sequence
  Description of Artificial Sequence: Synthetic oligonucleotide
  Target: SCN9A; (+) strand; PAM type: YTN; PAM sequence: TTA
ttttagctttcttttatatc

SEQ ID NO: 94843 - DNA, 20 bp, Artificial Sequence
  Description of Artificial Sequence: Synthetic oligonucleotide
  Target: SCN9A; (+) strand; PAM type: YTN; PAM sequence: TTT
tagctttcttttatatccta

SEQ ID NO: 94844 - DNA, 20 bp, Artificial Sequence
  Description of Artificial Sequence: Synthetic oligonucleotide
  Target: SCN9A; (+) strand; PAM type: YTN; PAM sequence: TTT
agctttcttttatatcctaa

SEQ ID NO: 94845 - DNA, 20 bp, Artificial Sequence
  Description of Artificial Sequence: Synthetic oligonucleotide
  Target: SCN9A; (+) strand; PAM type: YTN; PAM sequence: TTA
gctttcttttatatcctaaa

SEQ ID NO: 94846 - DNA, 20 bp, Artificial Sequence
  Description of Artificial Sequence: Synthetic oligonucleotide
  Target: SCN9A; (+) strand; PAM type: YTN; PAM sequence: CTT
tcttttatatcctaaagttt

SEQ ID NO: 94847 - DNA, 20 bp, Artificial Sequence
  Description of Artificial Sequence: Synthetic oligonucleotide
  Target: SCN9A; (+) strand; PAM type: YTN; PAM sequence: TTT
cttttatatcctaaagtttt

SEQ ID NO: 94848 - DNA, 20 bp, Artificial Sequence
  Description of Artificial Sequence: Synthetic oligonucleotide
  Target: SCN9A; (+) strand; PAM type: YTN; PAM sequence: TTC
ttttatatcctaaagttttc

SEQ ID NO: 94849 - DNA, 20 bp, Artificial Sequence
  Description of Artificial Sequence: Synthetic oligonucleotide
  Target: SCN9A; (+) strand; PAM type: YTN; PAM sequence: CTT
ttatatcctaaagttttctt

SEQ ID NO: 94850 - DNA, 20 bp, Artificial Sequence
  Description of Artificial Sequence: Synthetic oligonucleotide
  Target: SCN9A; (+) strand; PAM type: YTN; PAM sequence: TTT
tatatcctaaagttttcttc

SEQ ID NO: 94851 - DNA, 20 bp, Artificial Sequence
  Description of Artificial Sequence: Synthetic oligonucleotide
  Target: SCN9A; (+) strand; PAM type: YTN; PAM sequence: TTT
atatcctaaagttttcttca

SEQ ID NO: 94852 - DNA, 20 bp, Artificial Sequence
  Description of Artificial Sequence: Synthetic oligonucleotide
  Target: SCN9A; (+) strand; PAM type: YTN; PAM sequence: TTA
tatcctaaagttttcttcag

SEQ ID NO: 94853 - DNA, 20 bp, Artificial Sequence
  Description of Artificial Sequence: Synthetic oligonucleotide
  Target: SCN9A; (+) strand; PAM type: YTN; PAM sequence: CTA
aagttttcttcagaagtctc

SEQ ID NO: 94854 - DNA, 20 bp, Artificial Sequence
  Description of Artificial Sequence: Synthetic oligonucleotide
  Target: SCN9A; (+) strand; PAM type: YTN; PAM sequence: TTT
tcttcagaagtctcatatga

SEQ ID NO: 94855 - DNA, 20 bp, Artificial Sequence
  Description of Artificial Sequence: Synthetic oligonucleotide
  Target: SCN9A; (+) strand; PAM type: YTN; PAM sequence: TTT
cttcagaagtctcatatgat

SEQ ID NO: 94856 - DNA, 20 bp, Artificial Sequence
  Description of Artificial Sequence: Synthetic oligonucleotide
  Target: SCN9A; (+) strand; PAM type: YTN; PAM sequence: TTC
ttcagaagtctcatatgata

SEQ ID NO: 94857 - DNA, 20 bp, Artificial Sequence
  Description of Artificial Sequence: Synthetic oligonucleotide
  Target: SCN9A; (+) strand; PAM type: YTN; PAM sequence: CTT
cagaagtctcatatgataaa

SEQ ID NO: 94858 - DNA, 20 bp, Artificial Sequence
  Description of Artificial Sequence: Synthetic oligonucleotide
  Target: SCN9A; (+) strand; PAM type: YTN; PAM sequence: TTC
agaagtctcatatgataaag

SEQ ID NO: 94859 - DNA, 20 bp, Artificial Sequence
  Description of Artificial Sequence: Synthetic oligonucleotide
  Target: SCN9A; (+) strand; PAM type: YTN; PAM sequence: CTC
atatgataaagttattatta

SEQ ID NO: 94860 - DNA, 20 bp, Artificial Sequence
  Description of Artificial Sequence: Synthetic oligonucleotide
  Target: SCN9A; (+) strand; PAM type: YTN; PAM sequence: TTA
ttattagataatttacttta

SEQ ID NO: 94861 - DNA, 20 bp, Artificial Sequence
  Description of Artificial Sequence: Synthetic oligonucleotide
  Target: SCN9A; (+) strand; PAM type: YTN; PAM sequence: TTA
ttagataatttactttattt

SEQ ID NO: 94862 - DNA, 20 bp, Artificial Sequence
  Description of Artificial Sequence: Synthetic oligonucleotide
  Target: SCN9A; (+) strand; PAM type: YTN; PAM sequence: TTA
gataatttactttattttta

SEQ ID NO: 94863 - DNA, 20 bp, Artificial Sequence
  Description of Artificial Sequence: Synthetic oligonucleotide
  Target: SCN9A; (+) strand; PAM type: YTN; PAM sequence: TTT
actttatttttattgcaatt

SEQ ID NO: 94864 - DNA, 20 bp, Artificial Sequence
  Description of Artificial Sequence: Synthetic oligonucleotide
  Target: SCN9A; (+) strand; PAM type: YTN; PAM sequence: TTA
ctttatttttattgcaattg

SEQ ID NO: 94865 - DNA, 20 bp, Artificial Sequence
  Description of Artificial Sequence: Synthetic oligonucleotide
  Target: SCN9A; (+) strand; PAM type: YTN; PAM sequence: CTT
tatttttattgcaattgtga

SEQ ID NO: 94866 - DNA, 20 bp, Artificial Sequence
  Description of Artificial Sequence: Synthetic oligonucleotide
  Target: SCN9A; (+) strand; PAM type: YTN; PAM sequence: TTT
atttttattgcaattgtgaa

SEQ ID NO: 94867 - DNA, 20 bp, Artificial Sequence
  Description of Artificial Sequence: Synthetic oligonucleotide
  Target: SCN9A; (+) strand; PAM type: YTN; PAM sequence: TTA
tttttattgcaattgtgaat

SEQ ID NO: 94868 - DNA, 20 bp, Artificial Sequence
  Description of Artificial Sequence: Synthetic oligonucleotide
  Target: SCN9A; (+) strand; PAM type: YTN; PAM sequence: TTT
ttattgcaattgtgaatcag

SEQ ID NO: 94869 - DNA, 20 bp, Artificial Sequence
  Description of Artificial Sequence: Synthetic oligonucleotide
  Target: SCN9A; (+) strand; PAM type: YTN; PAM sequence: TTT
tattgcaattgtgaatcaga

SEQ ID NO: 94870 - DNA, 20 bp, Artificial Sequence
  Description of Artificial Sequence: Synthetic oligonucleotide
  Target: SCN9A; (+) strand; PAM type: YTN; PAM sequence: TTT
attgcaattgtgaatcagat

SEQ ID NO: 94871 - DNA, 20 bp, Artificial Sequence
  Description of Artificial Sequence: Synthetic oligonucleotide
  Target: SCN9A; (+) strand; PAM type: YTN; PAM sequence: TTA
ttgcaattgtgaatcagatt

SEQ ID NO: 94872 - DNA, 20 bp, Artificial Sequence
  Description of Artificial Sequence: Synthetic oligonucleotide
  Target: SCN9A; (+) strand; PAM type: YTN; PAM sequence: TTG
caattgtgaatcagattttc

SEQ ID NO: 94873 - DNA, 20 bp, Artificial Sequence
  Description of Artificial Sequence: Synthetic oligonucleotide
  Target: SCN9A; (+) strand; PAM type: YTN; PAM sequence: TTG
tgaatcagattttctaattt

SEQ ID NO: 94874 - DNA, 20 bp, Artificial Sequence
  Description of Artificial Sequence: Synthetic oligonucleotide
  Target: SCN9A; (+) strand; PAM type: YTN; PAM sequence: TTT
tctaatttttttcatgtata

SEQ ID NO: 94875 - DNA, 20 bp, Artificial Sequence
  Description of Artificial Sequence: Synthetic oligonucleotide
  Target: SCN9A; (+) strand; PAM type: YTN; PAM sequence: TTT
ctaatttttttcatgtataa

SEQ ID NO: 94876 - DNA, 20 bp, Artificial Sequence
  Description of Artificial Sequence: Synthetic oligonucleotide
  Target: SCN9A; (+) strand; PAM type: YTN; PAM sequence: TTC
taatttttttcatgtataag

SEQ ID NO: 94877 - DNA, 20 bp, Artificial Sequence
  Description of Artificial Sequence: Synthetic oligonucleotide
  Target: SCN9A; (+) strand; PAM type: YTN; PAM sequence: CTA
atttttttcatgtataagat

SEQ ID NO: 94878 - DNA, 20 bp, Artificial Sequence
  Description of Artificial Sequence: Synthetic oligonucleotide
  Target: SCN9A; (+) strand; PAM type: YTN; PAM sequence: TTT
ttttcatgtataagataatt

SEQ ID NO: 94879 - DNA, 20 bp, Artificial Sequence
  Description of Artificial Sequence: Synthetic oligonucleotide
  Target: SCN9A; (+) strand; PAM type: YTN; PAM sequence: TTT
tttcatgtataagataatta

SEQ ID NO: 94880 - DNA, 20 bp, Artificial Sequence
  Description of Artificial Sequence: Synthetic oligonucleotide
  Target: SCN9A; (+) strand; PAM type: YTN; PAM sequence: TTT
ttcatgtataagataattat

SEQ ID NO: 94881 - DNA, 20 bp, Artificial Sequence
  Description of Artificial Sequence: Synthetic oligonucleotide
  Target: SCN9A; (+) strand; PAM type: YTN; PAM sequence: TTT
tcatgtataagataattatt

SEQ ID NO: 94882 - DNA, 20 bp, Artificial Sequence
  Description of Artificial Sequence: Synthetic oligonucleotide
  Target: SCN9A; (+) strand; PAM type: YTN; PAM sequence: TTT
catgtataagataattatta

SEQ ID NO: 94883 - DNA, 20 bp, Artificial Sequence
  Description of Artificial Sequence: Synthetic oligonucleotide
  Target: SCN9A; (+) strand; PAM type: YTN; PAM sequence: TTC
atgtataagataattattag

SEQ ID NO: 94884 - DNA, 20 bp, Artificial Sequence
  Description of Artificial Sequence: Synthetic oligonucleotide
  Target: SCN9A; (+) strand; PAM type: YTN; PAM sequence: TTA
ttagtgttggcacatgtaat

SEQ ID NO: 94885 - DNA, 20 bp, Artificial Sequence
  Description of Artificial Sequence: Synthetic oligonucleotide
  Target: SCN9A; (+) strand; PAM type: YTN; PAM sequence: TTA
gtgttggcacatgtaattta

SEQ ID NO: 94886 - DNA, 20 bp, Artificial Sequence
  Description of Artificial Sequence: Synthetic oligonucleotide
  Target: SCN9A; (+) strand; PAM type: YTN; PAM sequence: TTG
gcacatgtaatttaaaattt

SEQ ID NO: 94887 - DNA, 20 bp, Artificial Sequence
  Description of Artificial Sequence: Synthetic oligonucleotide
  Target: SCN9A; (+) strand; PAM type: YTN; PAM sequence: TTT
aaaatttgtaccttttgaac

SEQ ID NO: 94888 - DNA, 20 bp, Artificial Sequence
  Description of Artificial Sequence: Synthetic oligonucleotide
  Target: SCN9A; (+) strand; PAM type: YTN; PAM sequence: TTA
aaatttgtaccttttgaact

SEQ ID NO: 94889 - DNA, 20 bp, Artificial Sequence
  Description of Artificial Sequence: Synthetic oligonucleotide
  Target: SCN9A; (+) strand; PAM type: YTN; PAM sequence: TTT
gtaccttttgaactctaatt

SEQ ID NO: 94890 - DNA, 20 bp, Artificial Sequence
  Description of Artificial Sequence: Synthetic oligonucleotide
  Target: SCN9A; (+) strand; PAM type: YTN; PAM sequence: TTG
taccttttgaactctaattg

SEQ ID NO: 94891 - DNA, 20 bp, Artificial Sequence
  Description of Artificial Sequence: Synthetic oligonucleotide
  Target: SCN9A; (+) strand; PAM type: YTN; PAM sequence: CTT
ttgaactctaattgaattta

SEQ ID NO: 94892 - DNA, 20 bp, Artificial Sequence
  Description of Artificial Sequence: Synthetic oligonucleotide
  Target: SCN9A; (+) strand; PAM type: YTN; PAM sequence: TTT
tgaactctaattgaatttat

SEQ ID NO: 94893 - DNA, 20 bp, Artificial Sequence
  Description of Artificial Sequence: Synthetic oligonucleotide
  Target: SCN9A; (+) strand; PAM type: YTN; PAM sequence: TTT
gaactctaattgaatttatt

SEQ ID NO: 94894 - DNA, 20 bp, Artificial Sequence
  Description of Artificial Sequence: Synthetic oligonucleotide
  Target: SCN9A; (+) strand; PAM type: YTN; PAM sequence: TTG
aactctaattgaatttattt

SEQ ID NO: 94895 - DNA, 20 bp, Artificial Sequence
  Description of Artificial Sequence: Synthetic oligonucleotide
  Target: SCN9A; (+) strand; PAM type: YTN; PAM sequence: CTC
taattgaatttatttttagt

SEQ ID NO: 94896 - DNA, 20 bp, Artificial Sequence
  Description of Artificial Sequence: Synthetic oligonucleotide
  Target: SCN9A; (+) strand; PAM type: YTN; PAM sequence: CTA
attgaatttatttttagttg

SEQ ID NO: 94897 - DNA, 20 bp, Artificial Sequence
  Description of Artificial Sequence: Synthetic oligonucleotide
  Target: SCN9A; (+) strand; PAM type: YTN; PAM sequence: TTG
aatttatttttagttgattc

SEQ ID NO: 94898 - DNA, 20 bp, Artificial Sequence
  Description of Artificial Sequence: Synthetic oligonucleotide
  Target: SCN9A; (+) strand; PAM type: YTN; PAM sequence: TTT
atttttagttgattctcttt

SEQ ID NO: 94899 - DNA, 20 bp, Artificial Sequence
  Description of Artificial Sequence: Synthetic oligonucleotide
  Target: SCN9A; (+) strand; PAM type: YTN; PAM sequence: TTA
tttttagttgattctctttc

SEQ ID NO: 94900 - DNA, 20 bp, Artificial Sequence
  Description of Artificial Sequence: Synthetic oligonucleotide
  Target: SCN9A; (+) strand; PAM type: YTN; PAM sequence: TTT
ttagttgattctctttcaat

SEQ ID NO: 94901 - DNA, 20 bp, Artificial Sequence
  Description of Artificial Sequence: Synthetic oligonucleotide
  Target: SCN9A; (+) strand; PAM type: YTN; PAM sequence: TTT
tagttgattctctttcaata

SEQ ID NO: 94902 - DNA, 20 bp, Artificial Sequence
  Description of Artificial Sequence: Synthetic oligonucleotide
  Target: SCN9A; (+) strand; PAM type: YTN; PAM sequence: TTT
agttgattctctttcaatat

SEQ ID NO: 94903 - DNA, 20 bp, Artificial Sequence
  Description of Artificial Sequence: Synthetic oligonucleotide
  Target: SCN9A; (+) strand; PAM type: YTN; PAM sequence: TTA
gttgattctctttcaatata

SEQ ID NO: 94904 - DNA, 20 bp, Artificial Sequence
  Description of Artificial Sequence: Synthetic oligonucleotide
  Target: SCN9A; (+) strand; PAM type: YTN; PAM sequence: TTG
attctctttcaatatatgaa

SEQ ID NO: 94905 - DNA, 20 bp, Artificial Sequence
  Description of Artificial Sequence: Synthetic oligonucleotide
  Target: SCN9A; (+) strand; PAM type: YTN; PAM sequence: TTC
tctttcaatatatgaacaag

SEQ ID NO: 94906 - DNA, 20 bp, Artificial Sequence
  Description of Artificial Sequence: Synthetic oligonucleotide
  Target: SCN9A; (+) strand; PAM type: YTN; PAM sequence: CTC
tttcaatatatgaacaagtt

SEQ ID NO: 94907 - DNA, 20 bp, Artificial Sequence
  Description of Artificial Sequence: Synthetic oligonucleotide
  Target: SCN9A; (+) strand; PAM type: YTN; PAM sequence: CTT
tcaatatatgaacaagttct

SEQ ID NO: 94908 - DNA, 20 bp, Artificial Sequence
  Description of Artificial Sequence: Synthetic oligonucleotide
  Target: SCN9A; (+) strand; PAM type: YTN; PAM sequence: TTT
caatatatgaacaagttctt

SEQ ID NO: 94909 - DNA, 20 bp, Artificial Sequence
  Description of Artificial Sequence: Synthetic oligonucleotide
  Target: SCN9A; (+) strand; PAM type: YTN; PAM sequence: TTC
aatatatgaacaagttcttt

SEQ ID NO: 94910 - DNA, 20 bp, Artificial Sequence
  Description of Artificial Sequence: Synthetic oligonucleotide
  Target: SCN9A; (+) strand; PAM type: YTN; PAM sequence: TTC
tttcattatatgaagaaggt

SEQ ID NO: 94911 - DNA, 20 bp, Artificial Sequence
  Description of Artificial Sequence: Synthetic oligonucleotide
  Target: SCN9A; (+) strand; PAM type: YTN; PAM sequence: CTT
tcattatatgaagaaggtca

SEQ ID NO: 94912 - DNA, 20 bp, Artificial Sequence
  Description of Artificial Sequence: Synthetic oligonucleotide
  Target: SCN9A; (+) strand; PAM type: YTN; PAM sequence: TTT
cattatatgaagaaggtcat

SEQ ID NO: 94913 - DNA, 20 bp, Artificial Sequence
  Description of Artificial Sequence: Synthetic oligonucleotide
  Target: SCN9A; (+) strand; PAM type: YTN; PAM sequence: TTC
attatatgaagaaggtcatt

SEQ ID NO: 94914 - DNA, 20 bp, Artificial Sequence
  Description of Artificial Sequence: Synthetic oligonucleotide
  Target: SCN9A; (+) strand; PAM type: YTN; PAM sequence: TTA
tatgaagaaggtcattatat

SEQ ID NO: 94915 - DNA, 20 bp, Artificial Sequence
  Description of Artificial Sequence: Synthetic oligonucleotide
  Target: SCN9A; (+) strand; PAM type: YTN; PAM sequence: TTA
tattaaggatcatttactcc

SEQ ID NO: 94916 - DNA, 20 bp, Artificial Sequence
  Description of Artificial Sequence: Synthetic oligonucleotide
  Target: SCN9A; (+) strand; PAM type: YTN; PAM sequence: TTA
aggatcatttactccattgt

SEQ ID NO: 94917 - DNA, 20 bp, Artificial Sequence
  Description of Artificial Sequence: Synthetic oligonucleotide
  Target: SCN9A; (+) strand; PAM type: YTN; PAM sequence: TTT
actccattgtttttatatat

SEQ ID NO: 94918 - DNA, 20 bp, Artificial Sequence
  Description of Artificial Sequence: Synthetic oligonucleotide
  Target: SCN9A; (+) strand; PAM type: YTN; PAM sequence: TTA
ctccattgtttttatatatg

SEQ ID NO: 94919 - DNA, 20 bp, Artificial Sequence
  Description of Artificial Sequence: Synthetic oligonucleotide
  Target: SCN9A; (+) strand; PAM type: YTN; PAM sequence: CTC
cattgtttttatatatgtac

SEQ ID NO: 94920 - DNA, 20 bp, Artificial Sequence
  Description of Artificial Sequence: Synthetic oligonucleotide
  Target: SCN9A; (+) strand; PAM type: YTN; PAM sequence: TTG
tttttatatatgtacctctc

SEQ ID NO: 94921 - DNA, 20 bp, Artificial Sequence
  Description of Artificial Sequence: Synthetic oligonucleotide
  Target: SCN9A; (+) strand; PAM type: YTN; PAM sequence: TTT
ttatatatgtacctctctgt

SEQ ID NO: 94922 - DNA, 20 bp, Artificial Sequence
  Description of Artificial Sequence: Synthetic oligonucleotide
  Target: SCN9A; (+) strand; PAM type: YTN; PAM sequence: TTT
tatatatgtacctctctgtt

SEQ ID NO: 94923 - DNA, 20 bp, Artificial Sequence
  Description of Artificial Sequence: Synthetic oligonucleotide
  Target: SCN9A; (+) strand; PAM type: YTN; PAM sequence: TTT
atatatgtacctctctgttt

SEQ ID NO: 94924 - DNA, 20 bp, Artificial Sequence
  Description of Artificial Sequence: Synthetic oligonucleotide
  Target: SCN9A; (+) strand; PAM type: YTN; PAM sequence: TTA
tatatgtacctctctgtttt

SEQ ID NO: 94925 - DNA, 20 bp, Artificial Sequence
  Description of Artificial Sequence: Synthetic oligonucleotide
  Target: SCN9A; (+) strand; PAM type: YTN; PAM sequence: CTC
tctgttttcttatctaattg

SEQ ID NO: 94926 - DNA, 20 bp, Artificial Sequence
  Description of Artificial Sequence: Synthetic oligonucleotide
  Target: SCN9A; (+) strand; PAM type: YTN; PAM sequence: CTC
tgttttcttatctaattgca

SEQ ID NO: 94927 - DNA, 20 bp, Artificial Sequence
  Description of Artificial Sequence: Synthetic oligonucleotide
  Target: SCN9A; (+) strand; PAM type: YTN; PAM sequence: CTG
ttttcttatctaattgcatt

SEQ ID NO: 94928 - DNA, 20 bp, Artificial Sequence
  Description of Artificial Sequence: Synthetic oligonucleotide
  Target: SCN9A; (+) strand; PAM type: YTN; PAM sequence: TTT
tcttatctaattgcattggc

SEQ ID NO: 94929 - DNA, 20 bp, Artificial Sequence
  Description of Artificial Sequence: Synthetic oligonucleotide
  Target: SCN9A; (+) strand; PAM type: YTN; PAM sequence: TTT
cttatctaattgcattggcc

SEQ ID NO: 94930 - DNA, 20 bp, Artificial Sequence
  Description of Artificial Sequence: Synthetic oligonucleotide
  Target: SCN9A; (+) strand; PAM type: YTN; PAM sequence: TTC
ttatctaattgcattggcca

SEQ ID NO: 94931 - DNA, 20 bp, Artificial Sequence
  Description of Artificial Sequence: Synthetic oligonucleotide
  Target: SCN9A; (+) strand; PAM type: YTN; PAM sequence: CTT
atctaattgcattggccaac

SEQ ID NO: 94932 - DNA, 20 bp, Artificial Sequence
  Description of Artificial Sequence: Synthetic oligonucleotide
  Target: SCN9A; (+) strand; PAM type: YTN; PAM sequence: TTA
tctaattgcattggccaaca

SEQ ID NO: 94933 - DNA, 20 bp, Artificial Sequence
  Description of Artificial Sequence: Synthetic oligonucleotide
  Target: SCN9A; (+) strand; PAM type: YTN; PAM sequence: CTA
attgcattggccaacaacac

SEQ ID NO: 94934 - DNA, 20 bp, Artificial Sequence
  Description of Artificial Sequence: Synthetic oligonucleotide
  Target: SCN9A; (+) strand; PAM type: YTN; PAM sequence: TTG
cattggccaacaacactaaa

SEQ ID NO: 94935 - DNA, 20 bp, Artificial Sequence
  Description of Artificial Sequence: Synthetic oligonucleotide
  Target: SCN9A; (+) strand; PAM type: YTN; PAM sequence: TTG
gccaacaacactaaaaacag

SEQ ID NO: 94936 - DNA, 20 bp, Artificial Sequence
  Description of Artificial Sequence: Synthetic oligonucleotide
  Target: SCN9A; (+) strand; PAM type: YTN; PAM sequence: CTA
aaaacagggatgatacaggc

SEQ ID NO: 94937 - DNA, 20 bp, Artificial Sequence
  Description of Artificial Sequence: Synthetic oligonucleotide
  Target: SCN9A; (+) strand; PAM type: YTN; PAM sequence: CTC
ttttttttttcctgacttaa

SEQ ID NO: 94938 - DNA, 20 bp, Artificial Sequence
  Description of Artificial Sequence: Synthetic oligonucleotide
  Target: SCN9A; (+) strand; PAM type: YTN; PAM sequence: CTT
ttttttttcctgacttaata

SEQ ID NO: 94939 - DNA, 20 bp, Artificial Sequence
  Description of Artificial Sequence: Synthetic oligonucleotide
  Target: SCN9A; (+) strand; PAM type: YTN; PAM sequence: TTT
tttttttcctgacttaatag

SEQ ID NO: 94940 - DNA, 20 bp, Artificial Sequence
  Description of Artificial Sequence: Synthetic oligonucleotide
  Target: SCN9A; (+) strand; PAM type: YTN; PAM sequence: TTT
ttttttcctgacttaatagg

SEQ ID NO: 94941 - DNA, 20 bp, Artificial Sequence
  Description of Artificial Sequence: Synthetic oligonucleotide
  Target: SCN9A; (+) strand; PAM type: YTN; PAM sequence: TTT
tttttcctgacttaatagga

SEQ ID NO: 94942 - DNA, 20 bp, Artificial Sequence
  Description of Artificial Sequence: Synthetic oligonucleotide
  Target: SCN9A; (+) strand; PAM type: YTN; PAM sequence: TTT
ttttcctgacttaataggaa

SEQ ID NO: 94943 - DNA, 20 bp, Artificial Sequence
  Description of Artificial Sequence: Synthetic oligonucleotide
  Target: SCN9A; (+) strand; PAM type: YTN; PAM sequence: TTT
tttcctgacttaataggaat

SEQ ID NO: 94944 - DNA, 20 bp, Artificial Sequence
  Description of Artificial Sequence: Synthetic oligonucleotide
  Target: SCN9A; (+) strand; PAM type: YTN; PAM sequence: TTT
ttcctgacttaataggaatg

SEQ ID NO: 94945 - DNA, 20 bp, Artificial Sequence
  Description of Artificial Sequence: Synthetic oligonucleotide
  Target: SCN9A; (+) strand; PAM type: YTN; PAM sequence: TTT
tcctgacttaataggaatgc

SEQ ID NO: 94946 - DNA, 20 bp, Artificial Sequence
  Description of Artificial Sequence: Synthetic oligonucleotide
  Target: SCN9A; (+) strand; PAM type: YTN; PAM sequence: TTT
cctgacttaataggaatgct

SEQ ID NO: 94947 - DNA, 20 bp, Artificial Sequence
  Description of Artificial Sequence: Synthetic oligonucleotide
  Target: SCN9A; (+) strand; PAM type: YTN; PAM sequence: TTC
ctgacttaataggaatgctt

SEQ ID NO: 94948 - DNA, 20 bp, Artificial Sequence
  Description of Artificial Sequence: Synthetic oligonucleotide
  Target: SCN9A; (+) strand; PAM type: YTN; PAM sequence: CTG
acttaataggaatgctttca

SEQ ID NO: 94949 - DNA, 20 bp, Artificial Sequence
  Description of Artificial Sequence: Synthetic oligonucleotide
  Target: SCN9A; (+) strand; PAM type: YTN; PAM sequence: CTT
aataggaatgctttcagaat

SEQ ID NO: 94950 - DNA, 20 bp, Artificial Sequence
  Description of Artificial Sequence: Synthetic oligonucleotide
  Target: SCN9A; (+) strand; PAM type: YTN; PAM sequence: TTA
ataggaatgctttcagaatc

SEQ ID NO: 94951 - DNA, 20 bp, Artificial Sequence
  Description of Artificial Sequence: Synthetic oligonucleotide
  Target: SCN9A; (+) strand; PAM type: YTN; PAM sequence: CTT
tcagaatcatttttgttagt

SEQ ID NO: 94952 - DNA, 20 bp, Artificial Sequence
  Description of Artificial Sequence: Synthetic oligonucleotide
  Target: SCN9A; (+) strand; PAM type: YTN; PAM sequence: TTT
cagaatcatttttgttagtg

SEQ ID NO: 94953 - DNA, 20 bp, Artificial Sequence
  Description of Artificial Sequence: Synthetic oligonucleotide
  Target: SCN9A; (+) strand; PAM type: YTN; PAM sequence: TTC
agaatcatttttgttagtgt

SEQ ID NO: 94954 - DNA, 20 bp, Artificial Sequence
  Description of Artificial Sequence: Synthetic oligonucleotide
  Target: SCN9A; (+) strand; PAM type: YTN; PAM sequence: TTT
ttgttagtgtgaaattctca

SEQ ID NO: 94955 - DNA, 20 bp, Artificial Sequence
  Description of Artificial Sequence: Synthetic oligonucleotide
  Target: SCN9A; (+) strand; PAM type: YTN; PAM sequence: TTT
tgttagtgtgaaattctcac

SEQ ID NO: 94956 - DNA, 20 bp, Artificial Sequence
  Description of Artificial Sequence: Synthetic oligonucleotide
  Target: SCN9A; (+) strand; PAM type: YTN; PAM sequence: TTT
gttagtgtgaaattctcacc

SEQ ID NO: 94957 - DNA, 20 bp, Artificial Sequence
  Description of Artificial Sequence: Synthetic oligonucleotide
  Target: SCN9A; (+) strand; PAM type: YTN; PAM sequence: TTG
ttagtgtgaaattctcacct

SEQ ID NO: 94958 - DNA, 20 bp, Artificial Sequence
  Description of Artificial Sequence: Synthetic oligonucleotide
  Target: SCN9A; (+) strand; PAM type: YTN; PAM sequence: TTA
gtgtgaaattctcacctaaa

SEQ ID NO: 94959 - DNA, 20 bp, Artificial Sequence
  Description of Artificial Sequence: Synthetic oligonucleotide
  Target: SCN9A; (+) strand; PAM type: YTN; PAM sequence: TTC
tcacctaaattttaatacat

SEQ ID NO: 94960 - DNA, 20 bp, Artificial Sequence
  Description of Artificial Sequence: Synthetic oligonucleotide
  Target: SCN9A; (+) strand; PAM type: YTN; PAM sequence: CTC
acctaaattttaatacattt

SEQ ID NO: 94961 - DNA, 20 bp, Artificial Sequence
  Description of Artificial Sequence: Synthetic oligonucleotide
  Target: SCN9A; (+) strand; PAM type: YTN; PAM sequence: CTA
aattttaatacattttctta

SEQ ID NO: 94962 - DNA, 20 bp, Artificial Sequence
  Description of Artificial Sequence: Synthetic oligonucleotide
  Target: SCN9A; (+) strand; PAM type: YTN; PAM sequence: TTT
taatacattttcttatatca

SEQ ID NO: 94963 - DNA, 20 bp, Artificial Sequence
  Description of Artificial Sequence: Synthetic oligonucleotide
  Target: SCN9A; (+) strand; PAM type: YTN; PAM sequence: TTT
aatacattttcttatatcaa

SEQ ID NO: 94964 - DNA, 20 bp, Artificial Sequence
  Description of Artificial Sequence: Synthetic oligonucleotide
  Target: SCN9A; (+) strand; PAM type: YTN; PAM sequence: TTA
atacattttcttatatcaat

SEQ ID NO: 94965 - DNA, 20 bp, Artificial Sequence
  Description of Artificial Sequence: Synthetic oligonucleotide
  Target: SCN9A; (+) strand; PAM type: YTN; PAM sequence: TTT
tcttatatcaattttggtat

SEQ ID NO: 94966 - DNA, 20 bp, Artificial Sequence
  Description of Artificial Sequence: Synthetic oligonucleotide
  Target: SCN9A; (+) strand; PAM type: YTN; PAM sequence: TTT
cttatatcaattttggtatg

SEQ ID NO: 94967 - DNA, 20 bp, Artificial Sequence
  Description of Artificial Sequence: Synthetic oligonucleotide
  Target: SCN9A; (+) strand; PAM type: YTN; PAM sequence: TTC
ttatatcaattttggtatga

SEQ ID NO: 94968 - DNA, 20 bp, Artificial Sequence
  Description of Artificial Sequence: Synthetic oligonucleotide
  Target: SCN9A; (+) strand; PAM type: YTN; PAM sequence: CTT
atatcaattttggtatgact

SEQ ID NO: 94969 - DNA, 20 bp, Artificial Sequence
  Description of Artificial Sequence: Synthetic oligonucleotide
  Target: SCN9A; (+) strand; PAM type: YTN; PAM sequence: TTA
tatcaattttggtatgactt

SEQ ID NO: 94970 - DNA, 20 bp, Artificial Sequence
  Description of Artificial Sequence: Synthetic oligonucleotide
  Target: SCN9A; (+) strand; PAM type: YTN; PAM sequence: TTT
tggtatgacttctggtgata

SEQ ID NO: 94971 - DNA, 20 bp, Artificial Sequence
  Description of Artificial Sequence: Synthetic oligonucleotide
  Target: SCN9A; (+) strand; PAM type: YTN; PAM sequence: TTT
ggtatgacttctggtgataa

SEQ ID NO: 94972 - DNA, 20 bp, Artificial Sequence
  Description of Artificial Sequence: Synthetic oligonucleotide
  Target: SCN9A; (+) strand; PAM type: YTN; PAM sequence: TTG
gtatgacttctggtgataat

SEQ ID NO: 94973 - DNA, 20 bp, Artificial Sequence
  Description of Artificial Sequence: Synthetic oligonucleotide
  Target: SCN9A; (+) strand; PAM type: YTN; PAM sequence: CTT
ctggtgataatatgcttttc

SEQ ID NO: 94974 - DNA, 20 bp, Artificial Sequence
  Description of Artificial Sequence: Synthetic oligonucleotide
  Target: SCN9A; (+) strand; PAM type: YTN; PAM sequence: TTC
tggtgataatatgcttttcc

SEQ ID NO: 94975 - DNA, 20 bp, Artificial Sequence
  Description of Artificial Sequence: Synthetic oligonucleotide
  Target: SCN9A; (+) strand; PAM type: YTN; PAM sequence: CTG
gtgataatatgcttttccaa

SEQ ID NO: 94976 - DNA, 20 bp, Artificial Sequence
  Description of Artificial Sequence: Synthetic oligonucleotide
  Target: SCN9A; (+) strand; PAM type: YTN; PAM sequence: CTT
ttccaaaattattgatttta

SEQ ID NO: 94977 - DNA, 20 bp, Artificial Sequence
  Description of Artificial Sequence: Synthetic oligonucleotide
  Target: SCN9A; (+) strand; PAM type: YTN; PAM sequence: TTT
tccaaaattattgattttaa

SEQ ID NO: 94978 - DNA, 20 bp, Artificial Sequence
  Description of Artificial Sequence: Synthetic oligonucleotide
  Target: SCN9A; (+) strand; PAM type: YTN; PAM sequence: TTT
ccaaaattattgattttaaa

SEQ ID NO: 94979 - DNA, 20 bp, Artificial Sequence
  Description of Artificial Sequence: Synthetic oligonucleotide
  Target: SCN9A; (+) strand; PAM type: YTN; PAM sequence: TTC
caaaattattgattttaaat

SEQ ID NO: 94980 - DNA, 20 bp, Artificial Sequence
  Description of Artificial Sequence: Synthetic oligonucleotide
  Target: SCN9A; (+) strand; PAM type: YTN; PAM sequence: TTA
ttgattttaaatgcttactc

SEQ ID NO: 94981 - DNA, 20 bp, Artificial Sequence
  Description of Artificial Sequence: Synthetic oligonucleotide
  Target: SCN9A; (+) strand; PAM type: YTN; PAM sequence: TTG
attttaaatgcttactctgt

SEQ ID NO: 94982 - DNA, 20 bp, Artificial Sequence
  Description of Artificial Sequence: Synthetic oligonucleotide
  Target: SCN9A; (+) strand; PAM type: YTN; PAM sequence: TTT
taaatgcttactctgttatg

SEQ ID NO: 94983 - DNA, 20 bp, Artificial Sequence
  Description of Artificial Sequence: Synthetic oligonucleotide
  Target: SCN9A; (+) strand; PAM type: YTN; PAM sequence: TTT
aaatgcttactctgttatgt

SEQ ID NO: 94984 - DNA, 20 bp, Artificial Sequence
  Description of Artificial Sequence: Synthetic oligonucleotide
  Target: SCN9A; (+) strand; PAM type: YTN; PAM sequence: TTA
aatgcttactctgttatgtg

SEQ ID NO: 94985 - DNA, 20 bp, Artificial Sequence
  Description of Artificial Sequence: Synthetic oligonucleotide
  Target: SCN9A; (+) strand; PAM type: YTN; PAM sequence: CTT
actctgttatgtggcactca

SEQ ID NO: 94986 - DNA, 20 bp, Artificial Sequence
  Description of Artificial Sequence: Synthetic oligonucleotide
  Target: SCN9A; (+) strand; PAM type: YTN; PAM sequence: TTA
ctctgttatgtggcactcaa

SEQ ID NO: 94987 - DNA, 20 bp, Artificial Sequence
  Description of Artificial Sequence: Synthetic oligonucleotide
  Target: SCN9A; (+) strand; PAM type: YTN; PAM sequence: CTC
tgttatgtggcactcaattt

SEQ ID NO: 94988 - DNA, 20 bp, Artificial Sequence
  Description of Artificial Sequence: Synthetic oligonucleotide
  Target: SCN9A; (+) strand; PAM type: YTN; PAM sequence: CTG
ttatgtggcactcaatttta

SEQ ID NO: 94989 - DNA, 20 bp, Artificial Sequence
  Description of Artificial Sequence: Synthetic oligonucleotide
  Target: SCN9A; (+) strand; PAM type: YTN; PAM sequence: TTA
tgtggcactcaattttatga

SEQ ID NO: 94990 - DNA, 20 bp, Artificial Sequence
  Description of Artificial Sequence: Synthetic oligonucleotide
  Target: SCN9A; (+) strand; PAM type: YTN; PAM sequence: CTC
aattttatgattctaagtca

SEQ ID NO: 94991 - DNA, 20 bp, Artificial Sequence
  Description of Artificial Sequence: Synthetic oligonucleotide
  Target: SCN9A; (+) strand; PAM type: YTN; PAM sequence: TTT
tatgattctaagtcatgcaa

SEQ ID NO: 94992 - DNA, 20 bp, Artificial Sequence
  Description of Artificial Sequence: Synthetic oligonucleotide
  Target: SCN9A; (+) strand; PAM type: YTN; PAM sequence: TTT
atgattctaagtcatgcaac

SEQ ID NO: 94993 - DNA, 20 bp, Artificial Sequence
  Description of Artificial Sequence: Synthetic oligonucleotide
  Target: SCN9A; (+) strand; PAM type: YTN; PAM sequence: TTA
tgattctaagtcatgcaacc

SEQ ID NO: 94994 - DNA, 20 bp, Artificial Sequence
  Description of Artificial Sequence: Synthetic oligonucleotide
  Target: SCN9A; (+) strand; PAM type: YTN; PAM sequence: TTC
taagtcatgcaaccttgaac

SEQ ID NO: 94995 - DNA, 20 bp, Artificial Sequence
  Description of Artificial Sequence: Synthetic oligonucleotide
  Target: SCN9A; (+) strand; PAM type: YTN; PAM sequence: CTA
agtcatgcaaccttgaacct

SEQ ID NO: 94996 - DNA, 20 bp, Artificial Sequence
  Description of Artificial Sequence: Synthetic oligonucleotide
  Target: SCN9A; (+) strand; PAM type: YTN; PAM sequence: CTT
gaaccttttcagattgataa

SEQ ID NO: 94997 - DNA, 20 bp, Artificial Sequence
  Description of Artificial Sequence: Synthetic oligonucleotide
  Target: SCN9A; (+) strand; PAM type: YTN; PAM sequence: TTG
aaccttttcagattgataac

SEQ ID NO: 94998 - DNA, 20 bp, Artificial Sequence
  Description of Artificial Sequence: Synthetic oligonucleotide
  Target: SCN9A; (+) strand; PAM type: YTN; PAM sequence: CTT
ttcagattgataacctgttg

SEQ ID NO: 94999 - DNA, 20 bp, Artificial Sequence
  Description of Artificial Sequence: Synthetic oligonucleotide
  Target: SCN9A; (+) strand; PAM type: YTN; PAM sequence: TTT
tcagattgataacctgttga

SEQ ID NO: 95000 - DNA, 20 bp, Artificial Sequence
  Description of Artificial Sequence: Synthetic oligonucleotide
  Target: SCN9A; (+) strand; PAM type: YTN; PAM sequence: TTT
cagattgataacctgttgat

SEQ ID NO: 95001 - DNA, 20 bp, Artificial Sequence
  Description of Artificial Sequence: Synthetic oligonucleotide
  Target: SCN9A; (+) strand; PAM type: YTN; PAM sequence: TTC
agattgataacctgttgatt

SEQ ID NO: 95002 - DNA, 20 bp, Artificial Sequence
  Description of Artificial Sequence: Synthetic oligonucleotide
  Target: SCN9A; (+) strand; PAM type: YTN; PAM sequence: TTG
ataacctgttgattaaactt

SEQ ID NO: 95003 - DNA, 20 bp, Artificial Sequence
  Description of Artificial Sequence: Synthetic oligonucleotide
  Target: SCN9A; (+) strand; PAM type: YTN; PAM sequence: CTG
ttgattaaacttgtagtaat

SEQ ID NO: 95004 - DNA, 20 bp, Artificial Sequence
  Description of Artificial Sequence: Synthetic oligonucleotide
  Target: SCN9A; (+) strand; PAM type: YTN; PAM sequence: TTG
attaaacttgtagtaatctc

SEQ ID NO: 95005 - DNA, 20 bp, Artificial Sequence
  Description of Artificial Sequence: Synthetic oligonucleotide
  Target: SCN9A; (+) strand; PAM type: YTN; PAM sequence: TTA
aacttgtagtaatctctata

SEQ ID NO: 95006 - DNA, 20 bp, Artificial Sequence
  Description of Artificial Sequence: Synthetic oligonucleotide
  Target: SCN9A; (+) strand; PAM type: YTN; PAM sequence: CTT
gtagtaatctctataatctc

SEQ ID NO: 95007 - DNA, 20 bp, Artificial Sequence
  Description of Artificial Sequence: Synthetic oligonucleotide
  Target: SCN9A; (+) strand; PAM type: YTN; PAM sequence: TTG
tagtaatctctataatctct

SEQ ID NO: 95008 - DNA, 20 bp, Artificial Sequence
  Description of Artificial Sequence: Synthetic oligonucleotide
  Target: SCN9A; (+) strand; PAM type: YTN; PAM sequence: CTC
tataatctctctctcttaaa

SEQ ID NO: 95009 - DNA, 20 bp, Artificial Sequence
  Description of Artificial Sequence: Synthetic oligonucleotide
  Target: SCN9A; (+) strand; PAM type: YTN; PAM sequence: CTA
taatctctctctcttaaaag

SEQ ID NO: 95010 - DNA, 20 bp, Artificial Sequence
  Description of Artificial Sequence: Synthetic oligonucleotide
  Target: SCN9A; (+) strand; PAM type: YTN; PAM sequence: CTC
tctctcttaaaagtttataa

SEQ ID NO: 95011 - DNA, 20 bp, Artificial Sequence
  Description of Artificial Sequence: Synthetic oligonucleotide
  Target: SCN9A; (+) strand; PAM type: YTN; PAM sequence: CTC
tctcttaaaagtttataatt

SEQ ID NO: 95012 - DNA, 20 bp, Artificial Sequence
  Description of Artificial Sequence: Synthetic oligonucleotide
  Target: SCN9A; (+) strand; PAM type: YTN; PAM sequence: CTC
tcttaaaagtttataattct

SEQ ID NO: 95013 - DNA, 20 bp, Artificial Sequence
  Description of Artificial Sequence: Synthetic oligonucleotide
  Target: SCN9A; (+) strand; PAM type: YTN; PAM sequence: CTC
ttaaaagtttataattctaa

SEQ ID NO: 95014 - DNA, 20 bp, Artificial Sequence
  Description of Artificial Sequence: Synthetic oligonucleotide
  Target: SCN9A; (+) strand; PAM type: YTN; PAM sequence: CTT
aaaagtttataattctaaaa

SEQ ID NO: 95015 - DNA, 20 bp, Artificial Sequence
  Description of Artificial Sequence: Synthetic oligonucleotide
  Target: SCN9A; (+) strand; PAM type: YTN; PAM sequence: TTA
aaagtttataattctaaaaa

SEQ ID NO: 95016 - DNA, 20 bp, Artificial Sequence
  Description of Artificial Sequence: Synthetic oligonucleotide
  Target: SCN9A; (+) strand; PAM type: YTN; PAM sequence: TTT
ataattctaaaaagaaatac

SEQ ID NO: 95017 - DNA, 20 bp, Artificial Sequence
  Description of Artificial Sequence: Synthetic oligonucleotide
  Target: SCN9A; (+) strand; PAM type: YTN; PAM sequence: TTA
taattctaaaaagaaataca

SEQ ID NO: 95018 - DNA, 20 bp, Artificial Sequence
  Description of Artificial Sequence: Synthetic oligonucleotide
  Target: SCN9A; (+) strand; PAM type: YTN; PAM sequence: TTC
taaaaagaaatacaatccta

SEQ ID NO: 95019 - DNA, 20 bp, Artificial Sequence
  Description of Artificial Sequence: Synthetic oligonucleotide
  Target: SCN9A; (+) strand; PAM type: YTN; PAM sequence: CTA
aaaagaaatacaatcctaaa

SEQ ID NO: 95020 - DNA, 20 bp, Artificial Sequence
  Description of Artificial Sequence: Synthetic oligonucleotide
  Target: SCN9A; (+) strand; PAM type: YTN; PAM sequence: CTA
aaatactttgcaagatatgt

SEQ ID NO: 95021 - DNA, 20 bp, Artificial Sequence
  Description of Artificial Sequence: Synthetic oligonucleotide
  Target: SCN9A; (+) strand; PAM type: YTN; PAM sequence: CTT
tgcaagatatgtgaaaataa

SEQ ID NO: 95022 - DNA, 20 bp, Artificial Sequence
  Description of Artificial Sequence: Synthetic oligonucleotide
  Target: SCN9A; (+) strand; PAM type: YTN; PAM sequence: TTT
gcaagatatgtgaaaataac

SEQ ID NO: 95023 - DNA, 20 bp, Artificial Sequence
  Description of Artificial Sequence: Synthetic oligonucleotide
  Target: SCN9A; (+) strand; PAM type: YTN; PAM sequence: TTG
caagatatgtgaaaataaca

SEQ ID NO: 95024 - DNA, 20 bp, Artificial Sequence
  Description of Artificial Sequence: Synthetic oligonucleotide
  Target: SCN9A; (+) strand; PAM type: YTN; PAM sequence: CTG
ttattcacagacatgaacac

SEQ ID NO: 95025 - DNA, 20 bp, Artificial Sequence
  Description of Artificial Sequence: Synthetic oligonucleotide
  Target: SCN9A; (+) strand; PAM type: YTN; PAM sequence: TTA
ttcacagacatgaacaccat

SEQ ID NO: 95026 - DNA, 20 bp, Artificial Sequence
  Description of Artificial Sequence: Synthetic oligonucleotide
  Target: SCN9A; (+) strand; PAM type: YTN; PAM sequence: TTC
acagacatgaacaccatggc

SEQ ID NO: 95027 - DNA, 20 bp, Artificial Sequence
  Description of Artificial Sequence: Synthetic oligonucleotide
  Target: SCN9A; (+) strand; PAM type: YTN; PAM sequence: CTG
gttgaggaatgattggcatt

SEQ ID NO: 95028 - DNA, 20 bp, Artificial Sequence
  Description of Artificial Sequence: Synthetic oligonucleotide
  Target: SCN9A; (+) strand; PAM type: YTN; PAM sequence: TTG
aggaatgattggcattttat

SEQ ID NO: 95029 - DNA, 20 bp, Artificial Sequence
  Description of Artificial Sequence: Synthetic oligonucleotide
  Target: SCN9A; (+) strand; PAM type: YTN; PAM sequence: TTG
gcattttatacacttgtgaa

SEQ ID NO: 95030 - DNA, 20 bp, Artificial Sequence
  Description of Artificial Sequence: Synthetic oligonucleotide
  Target: SCN9A; (+) strand; PAM type: YTN; PAM sequence: TTT
tatacacttgtgaagtatta

SEQ ID NO: 95031 - DNA, 20 bp, Artificial Sequence
  Description of Artificial Sequence: Synthetic oligonucleotide
  Target: SCN9A; (+) strand; PAM type: YTN; PAM sequence: TTT
atacacttgtgaagtattaa

SEQ ID NO: 95032 - DNA, 20 bp, Artificial Sequence
  Description of Artificial Sequence: Synthetic oligonucleotide
  Target: SCN9A; (+) strand; PAM type: YTN; PAM sequence: TTA
tacacttgtgaagtattaag

SEQ ID NO: 95033 - DNA, 20 bp, Artificial Sequence
  Description of Artificial Sequence: Synthetic oligonucleotide
  Target: SCN9A; (+) strand; PAM type: YTN; PAM sequence: CTT
gtgaagtattaagctgtaaa

SEQ ID NO: 95034 - DNA, 20 bp, Artificial Sequence
  Description of Artificial Sequence: Synthetic oligonucleotide
  Target: SCN9A; (+) strand; PAM type: YTN; PAM sequence: TTG
tgaagtattaagctgtaaaa

SEQ ID NO: 95035 - DNA, 20 bp, Artificial Sequence
  Description of Artificial Sequence: Synthetic oligonucleotide
  Target: SCN9A; (+) strand; PAM type: YTN; PAM sequence: TTA
agctgtaaaaaataaaactg

SEQ ID NO: 95036 - DNA, 20 bp, Artificial Sequence
  Description of Artificial Sequence: Synthetic oligonucleotide
  Target: SCN9A; (+) strand; PAM type: YTN; PAM sequence: CTG
taaaaaataaaactggcatt

SEQ ID NO: 95037 - DNA, 20 bp, Artificial Sequence
  Description of Artificial Sequence: Synthetic oligonucleotide
  Target: SCN9A; (+) strand; PAM type: YTN; PAM sequence: CTG
gcatttctagagatcttaac

SEQ ID NO: 95038 - DNA, 20 bp, Artificial Sequence
  Description of Artificial Sequence: Synthetic oligonucleotide
  Target: SCN9A; (+) strand; PAM type: YTN; PAM sequence: TTT
ctagagatcttaacttcact

SEQ ID NO: 95039 - DNA, 20 bp, Artificial Sequence
  Description of Artificial Sequence: Synthetic oligonucleotide
  Target: SCN9A; (+) strand; PAM type: YTN; PAM sequence: TTC
tagagatcttaacttcactt

SEQ ID NO: 95040 - DNA, 20 bp, Artificial Sequence
  Description of Artificial Sequence: Synthetic oligonucleotide
  Target: SCN9A; (+) strand; PAM type: YTN; PAM sequence: CTA
gagatcttaacttcacttta

SEQ ID NO: 95041 - DNA, 20 bp, Artificial Sequence
  Description of Artificial Sequence: Synthetic oligonucleotide
  Target: SCN9A; (+) strand; PAM type: YTN; PAM sequence: CTT
aacttcactttaaattctgg

SEQ ID NO: 95042 - DNA, 20 bp, Artificial Sequence
  Description of Artificial Sequence: Synthetic oligonucleotide
  Target: SCN9A; (+) strand; PAM type: YTN; PAM sequence: TTA
acttcactttaaattctgga

SEQ ID NO: 95043 - DNA, 20 bp, Artificial Sequence
  Description of Artificial Sequence: Synthetic oligonucleotide
  Target: SCN9A; (+) strand; PAM type: YTN; PAM sequence: CTT
cactttaaattctggaagaa

SEQ ID NO: 95044 - DNA, 20 bp, Artificial Sequence
  Description of Artificial Sequence: Synthetic oligonucleotide
  Target: SCN9A; (+) strand; PAM type: YTN; PAM sequence: TTC
actttaaattctggaagaat

SEQ ID NO: 95045 - DNA, 20 bp, Artificial Sequence
  Description of Artificial Sequence: Synthetic oligonucleotide
  Target: SCN9A; (+) strand; PAM type: YTN; PAM sequence: CTT
taaattctggaagaattttc

SEQ ID NO: 95046 - DNA, 20 bp, Artificial Sequence
  Description of Artificial Sequence: Synthetic oligonucleotide
  Target: SCN9A; (+) strand; PAM type: YTN; PAM sequence: TTT
aaattctggaagaattttca

SEQ ID NO: 95047 - DNA, 20 bp, Artificial Sequence
  Description of Artificial Sequence: Synthetic oligonucleotide
  Target: SCN9A; (+) strand; PAM type: YTN; PAM sequence: TTA
aattctggaagaattttcac

SEQ ID NO: 95048 - DNA, 20 bp, Artificial Sequence
  Description of Artificial Sequence: Synthetic oligonucleotide
  Target: SCN9A; (+) strand; PAM type: YTN; PAM sequence: TTC
tggaagaattttcacaaatt

SEQ ID NO: 95049 - DNA, 20 bp, Artificial Sequence
  Description of Artificial Sequence: Synthetic oligonucleotide
  Target: SCN9A; (+) strand; PAM type: YTN; PAM sequence: CTG
gaagaattttcacaaattca

SEQ ID NO: 95050 - DNA, 20 bp, Artificial Sequence
  Description of Artificial Sequence: Synthetic oligonucleotide
  Target: SCN9A; (+) strand; PAM type: YTN; PAM sequence: TTT
tcacaaattcacagatattc

SEQ ID NO: 95051 - DNA, 20 bp, Artificial Sequence
  Description of Artificial Sequence: Synthetic oligonucleotide
  Target: SCN9A; (+) strand; PAM type: YTN; PAM sequence: TTT
cacaaattcacagatattct

SEQ ID NO: 95052 - DNA, 20 bp, Artificial Sequence
  Description of Artificial Sequence: Synthetic oligonucleotide
  Target: SCN9A; (+) strand; PAM type: YTN; PAM sequence: TTC
acaaattcacagatattctg

SEQ ID NO: 95053 - DNA, 20 bp, Artificial Sequence
  Description of Artificial Sequence: Synthetic oligonucleotide
  Target: SCN9A; (+) strand; PAM type: YTN; PAM sequence: TTC
acagatattctggctattaa

SEQ ID NO: 95054 - DNA, 20 bp, Artificial Sequence
  Description of Artificial Sequence: Synthetic oligonucleotide
  Target: SCN9A; (+) strand; PAM type: YTN; PAM sequence: TTC
tggctattaatattatcatt

SEQ ID NO: 95055 - DNA, 20 bp, Artificial Sequence
  Description of Artificial Sequence: Synthetic oligonucleotide
  Target: SCN9A; (+) strand; PAM type: YTN; PAM sequence: CTG
gctattaatattatcattaa

SEQ ID NO: 95056 - DNA, 20 bp, Artificial Sequence
  Description of Artificial Sequence: Synthetic oligonucleotide
  Target: SCN9A; (+) strand; PAM type: YTN; PAM sequence: CTA
ttaatattatcattaatcaa

SEQ ID NO: 95057 - DNA, 20 bp, Artificial Sequence
  Description of Artificial Sequence: Synthetic oligonucleotide
  Target: SCN9A; (+) strand; PAM type: YTN; PAM sequence: TTA
atattatcattaatcaaatg

SEQ ID NO: 95058 - DNA, 20 bp, Artificial Sequence
  Description of Artificial Sequence: Synthetic oligonucleotide
  Target: SCN9A; (+) strand; PAM type: YTN; PAM sequence: TTA
tcattaatcaaatgacaagt

SEQ ID NO: 95059 - DNA, 20 bp, Artificial Sequence
  Description of Artificial Sequence: Synthetic oligonucleotide
  Target: SCN9A; (+) strand; PAM type: YTN; PAM sequence: TTA
atcaaatgacaagtctcaca

SEQ ID NO: 95060 - DNA, 20 bp, Artificial Sequence
  Description of Artificial Sequence: Synthetic oligonucleotide
  Target: SCN9A; (+) strand; PAM type: YTN; PAM sequence: CTC
acatgtgctaaaaccagaag

SEQ ID NO: 95061 - DNA, 20 bp, Artificial Sequence
  Description of Artificial Sequence: Synthetic oligonucleotide
  Target: SCN9A; (+) strand; PAM type: YTN; PAM sequence: CTA
aaaccagaagttatttcaga

SEQ ID NO: 95062 - DNA, 20 bp, Artificial Sequence
  Description of Artificial Sequence: Synthetic oligonucleotide
  Target: SCN9A; (+) strand; PAM type: YTN; PAM sequence: TTA
tttcagattcaacattggtt

SEQ ID NO: 95063 - DNA, 20 bp, Artificial Sequence
  Description of Artificial Sequence: Synthetic oligonucleotide
  Target: SCN9A; (+) strand; PAM type: YTN; PAM sequence: TTT
cagattcaacattggttttc

SEQ ID NO: 95064 - DNA, 20 bp, Artificial Sequence
  Description of Artificial Sequence: Synthetic oligonucleotide
  Target: SCN9A; (+) strand; PAM type: YTN; PAM sequence: TTC
agattcaacattggttttcc

SEQ ID NO: 95065 - DNA, 20 bp, Artificial Sequence
  Description of Artificial Sequence: Synthetic oligonucleotide
  Target: SCN9A; (+) strand; PAM type: YTN; PAM sequence: TTC
aacattggttttccaagaca

SEQ ID NO: 95066 - DNA, 20 bp, Artificial Sequence
  Description of Artificial Sequence: Synthetic oligonucleotide
  Target: SCN9A; (+) strand; PAM type: YTN; PAM sequence: TTG
gttttccaagacacagctat

SEQ ID NO: 95067 - DNA, 20 bp, Artificial Sequence
  Description of Artificial Sequence: Synthetic oligonucleotide
  Target: SCN9A; (+) strand; PAM type: YTN; PAM sequence: TTT
tccaagacacagctatatat

SEQ ID NO: 95068 - DNA, 20 bp, Artificial Sequence
  Description of Artificial Sequence: Synthetic oligonucleotide
  Target: SCN9A; (+) strand; PAM type: YTN; PAM sequence: TTT
ccaagacacagctatatata

SEQ ID NO: 95069 - DNA, 20 bp, Artificial Sequence
  Description of Artificial Sequence: Synthetic oligonucleotide
  Target: SCN9A; (+) strand; PAM type: YTN; PAM sequence: TTC
caagacacagctatatataa

SEQ ID NO: 95070 - DNA, 20 bp, Artificial Sequence
  Description of Artificial Sequence: Synthetic oligonucleotide
  Target: SCN9A; (+) strand; PAM type: YTN; PAM sequence: CTA
tatataaacatggtaactag

SEQ ID NO: 95071 - DNA, 20 bp, Artificial Sequence
  Description of Artificial Sequence: Synthetic oligonucleotide
  Target: SCN9A; (+) strand; PAM type: YTN; PAM sequence: CTA
gttttgcaaaggtaatattg

SEQ ID NO: 95072 - DNA, 20 bp, Artificial Sequence
  Description of Artificial Sequence: Synthetic oligonucleotide
  Target: SCN9A; (+) strand; PAM type: YTN; PAM sequence: TTT
tgcaaaggtaatattggaaa

SEQ ID NO: 95073 - DNA, 20 bp, Artificial Sequence
  Description of Artificial Sequence: Synthetic oligonucleotide
  Target: SCN9A; (+) strand; PAM type: YTN; PAM sequence: TTT
gcaaaggtaatattggaaac

SEQ ID NO: 95074 - DNA, 20 bp, Artificial Sequence
  Description of Artificial Sequence: Synthetic oligonucleotide
  Target: SCN9A; (+) strand; PAM type: YTN; PAM sequence: TTG
caaaggtaatattggaaact

SEQ ID NO: 95075 - DNA, 20 bp, Artificial Sequence
  Description of Artificial Sequence: Synthetic oligonucleotide
  Target: SCN9A; (+) strand; PAM type: YTN; PAM sequence: TTG
gaaactaaatatcaacaagt

SEQ ID NO: 95076 - DNA, 20 bp, Artificial Sequence
  Description of Artificial Sequence: Synthetic oligonucleotide
  Target: SCN9A; (+) strand; PAM type: YTN; PAM sequence: CTA
aatatcaacaagtataattt

SEQ ID NO: 95077 - DNA, 20 bp, Artificial Sequence
  Description of Artificial Sequence: Synthetic oligonucleotide
  Target: SCN9A; (+) strand; PAM type: YTN; PAM sequence: TTT
ccttctaatagatagaaata

SEQ ID NO: 95078 - DNA, 20 bp, Artificial Sequence
  Description of Artificial Sequence: Synthetic oligonucleotide
  Target: SCN9A; (+) strand; PAM type: YTN; PAM sequence: TTC
cttctaatagatagaaatat

SEQ ID NO: 95079 - DNA, 20 bp, Artificial Sequence
  Description of Artificial Sequence: Synthetic oligonucleotide
  Target: SCN9A; (+) strand; PAM type: YTN; PAM sequence: CTT
ctaatagatagaaatatttg

SEQ ID NO: 95080 - DNA, 20 bp, Artificial Sequence
  Description of Artificial Sequence: Synthetic oligonucleotide
  Target: SCN9A; (+) strand; PAM type: YTN; PAM sequence: TTC
taatagatagaaatatttgg

SEQ ID NO: 95081 - DNA, 20 bp, Artificial Sequence
  Description of Artificial Sequence: Synthetic oligonucleotide
  Target: SCN9A; (+) strand; PAM type: YTN; PAM sequence: CTA
atagatagaaatatttggct

SEQ ID NO: 95082 - DNA, 20 bp, Artificial Sequence
  Description of Artificial Sequence: Synthetic oligonucleotide
  Target: SCN9A; (+) strand; PAM type: YTN; PAM sequence: TTT
ggctttggggcctgtagtgt

SEQ ID NO: 95083 - DNA, 20 bp, Artificial Sequence
  Description of Artificial Sequence: Synthetic oligonucleotide
  Target: SCN9A; (+) strand; PAM type: YTN; PAM sequence: TTG
gctttggggcctgtagtgta

SEQ ID NO: 95084 - DNA, 20 bp, Artificial Sequence
  Description of Artificial Sequence: Synthetic oligonucleotide
  Target: SCN9A; (+) strand; PAM type: YTN; PAM sequence: CTT
tggggcctgtagtgtaaacc

SEQ ID NO: 95085 - DNA, 20 bp, Artificial Sequence
  Description of Artificial Sequence: Synthetic oligonucleotide
  Target: SCN9A; (+) strand; PAM type: YTN; PAM sequence: TTT
ggggcctgtagtgtaaaccc

SEQ ID NO: 95086 - DNA, 20 bp, Artificial Sequence
  Description of Artificial Sequence: Synthetic oligonucleotide
  Target: SCN9A; (+) strand; PAM type: YTN; PAM sequence: TTG
gggcctgtagtgtaaaccca

SEQ ID NO: 95087 - DNA, 20 bp, Artificial Sequence
  Description of Artificial Sequence: Synthetic oligonucleotide
  Target: SCN9A; (+) strand; PAM type: YTN; PAM sequence: CTG
tagtgtaaacccagaaacac

SEQ ID NO: 95088 - DNA, 20 bp, Artificial Sequence
  Description of Artificial Sequence: Synthetic oligonucleotide
  Target: SCN9A; (+) strand; PAM type: YTN; PAM sequence: CTG
tagtatgagagacagatatt

SEQ ID NO: 95089 - DNA, 20 bp, Artificial Sequence
  Description of Artificial Sequence: Synthetic oligonucleotide
  Target: SCN9A; (+) strand; PAM type: YTN; PAM sequence: TTT
gttttgctttttaggatttt

SEQ ID NO: 95090 - DNA, 20 bp, Artificial Sequence
  Description of Artificial Sequence: Synthetic oligonucleotide
  Target: SCN9A; (+) strand; PAM type: YTN; PAM sequence: TTG
ttttgctttttaggattttt

SEQ ID NO: 95091 - DNA, 20 bp, Artificial Sequence
  Description of Artificial Sequence: Synthetic oligonucleotide
  Target: SCN9A; (+) strand; PAM type: YTN; PAM sequence: TTT
tgctttttaggattttttca

SEQ ID NO: 95092 - DNA, 20 bp, Artificial Sequence
  Description of Artificial Sequence: Synthetic oligonucleotide
  Target: SCN9A; (+) strand; PAM type: YTN; PAM sequence: TTT
gctttttaggattttttcat

SEQ ID NO: 95093 - DNA, 20 bp, Artificial Sequence
  Description of Artificial Sequence: Synthetic oligonucleotide
  Target: SCN9A; (+) strand; PAM type: YTN; PAM sequence: TTG
ctttttaggattttttcatt

SEQ ID NO: 95094 - DNA, 20 bp, Artificial Sequence
  Description of Artificial Sequence: Synthetic oligonucleotide
  Target: SCN9A; (+) strand; PAM type: YTN; PAM sequence: CTT
tttaggattttttcattctt

SEQ ID NO: 95095 - DNA, 20 bp, Artificial Sequence
  Description of Artificial Sequence: Synthetic oligonucleotide
  Target: SCN9A; (+) strand; PAM type: YTN; PAM sequence: TTT
ttaggattttttcattcttt

SEQ ID NO: 95096 - DNA, 20 bp, Artificial Sequence
  Description of Artificial Sequence: Synthetic oligonucleotide
  Target: SCN9A; (+) strand; PAM type: YTN; PAM sequence: TTT
taggattttttcattctttc

SEQ ID NO: 95097 - DNA, 20 bp, Artificial Sequence
  Description of Artificial Sequence: Synthetic oligonucleotide
  Target: SCN9A; (+) strand; PAM type: YTN; PAM sequence: TTT
aggattttttcattctttca

SEQ ID NO: 95098 - DNA, 20 bp, Artificial Sequence
  Description of Artificial Sequence: Synthetic oligonucleotide
  Target: SCN9A; (+) strand; PAM type: YTN; PAM sequence: TTA
ggattttttcattctttcat

SEQ ID NO: 95099 - DNA, 20 bp, Artificial Sequence
  Description of Artificial Sequence: Synthetic oligonucleotide
  Target: SCN9A; (+) strand; PAM type: YTN; PAM sequence: TTT
tttcattctttcattgtact

SEQ ID NO: 95100 - DNA, 20 bp, Artificial Sequence
  Description of Artificial Sequence: Synthetic oligonucleotide
  Target: SCN9A; (+) strand; PAM type: YTN; PAM sequence: TTT
ttcattctttcattgtactg

SEQ ID NO: 95101 - DNA, 20 bp, Artificial Sequence
  Description of Artificial Sequence: Synthetic oligonucleotide
  Target: SCN9A; (+) strand; PAM type: YTN; PAM sequence: TTT
tcattctttcattgtactga

SEQ ID NO: 95102 - DNA, 20 bp, Artificial Sequence
  Description of Artificial Sequence: Synthetic oligonucleotide
  Target: SCN9A; (+) strand; PAM type: YTN; PAM sequence: TTT
cattctttcattgtactgac

SEQ ID NO: 95103 - DNA, 20 bp, Artificial Sequence
  Description of Artificial Sequence: Synthetic oligonucleotide
  Target: SCN9A; (+) strand; PAM type: YTN; PAM sequence: TTC
attctttcattgtactgact

SEQ ID NO: 95104 - DNA, 20 bp, Artificial Sequence
  Description of Artificial Sequence: Synthetic oligonucleotide
  Target: SCN9A; (+) strand; PAM type: YTN; PAM sequence: TTC
tttcattgtactgacttact

SEQ ID NO: 95105 - DNA, 20 bp, Artificial Sequence
  Description of Artificial Sequence: Synthetic oligonucleotide
  Target: SCN9A; (+) strand; PAM type: YTN; PAM sequence: CTT
tcattgtactgacttactca

SEQ ID NO: 95106 - DNA, 20 bp, Artificial Sequence
  Description of Artificial Sequence: Synthetic oligonucleotide
  Target: SCN9A; (+) strand; PAM type: YTN; PAM sequence: TTT
cattgtactgacttactcaa

SEQ ID NO: 95107 - DNA, 20 bp, Artificial Sequence
  Description of Artificial Sequence: Synthetic oligonucleotide
  Target: SCN9A; (+) strand; PAM type: YTN; PAM sequence: TTC
attgtactgacttactcaag

SEQ ID NO: 95108 - DNA, 20 bp, Artificial Sequence
  Description of Artificial Sequence: Synthetic oligonucleotide
  Target: SCN9A; (+) strand; PAM type: YTN; PAM sequence: TTG
tactgacttactcaagagta

SEQ ID NO: 95109 - DNA, 20 bp, Artificial Sequence
  Description of Artificial Sequence: Synthetic oligonucleotide
  Target: SCN9A; (+) strand; PAM type: YTN; PAM sequence: CTG
acttactcaagagtaaattt

SEQ ID NO: 95110 - DNA, 20 bp, Artificial Sequence
  Description of Artificial Sequence: Synthetic oligonucleotide
  Target: SCN9A; (+) strand; PAM type: YTN; PAM sequence: CTT
actcaagagtaaatttgtgt

SEQ ID NO: 95111 - DNA, 20 bp, Artificial Sequence
  Description of Artificial Sequence: Synthetic oligonucleotide
  Target: SCN9A; (+) strand; PAM type: YTN; PAM sequence: TTA
ctcaagagtaaatttgtgtt

SEQ ID NO: 95112 - DNA, 20 bp, Artificial Sequence
  Description of Artificial Sequence: Synthetic oligonucleotide
  Target: SCN9A; (+) strand; PAM type: YTN; PAM sequence: CTC
aagagtaaatttgtgttcaa

SEQ ID NO: 95113 - DNA, 20 bp, Artificial Sequence
  Description of Artificial Sequence: Synthetic oligonucleotide
  Target: SCN9A; (+) strand; PAM type: YTN; PAM sequence: TTT
gtgttcaagaattcagcata

SEQ ID NO: 95114 - DNA, 20 bp, Artificial Sequence
  Description of Artificial Sequence: Synthetic oligonucleotide
  Target: SCN9A; (+) strand; PAM type: YTN; PAM sequence: TTG
tgttcaagaattcagcatat

SEQ ID NO: 95115 - DNA, 20 bp, Artificial Sequence
  Description of Artificial Sequence: Synthetic oligonucleotide
  Target: SCN9A; (+) strand; PAM type: YTN; PAM sequence: TTC
aagaattcagcatatacttc

SEQ ID NO: 95116 - DNA, 20 bp, Artificial Sequence
  Description of Artificial Sequence: Synthetic oligonucleotide
  Target: SCN9A; (+) strand; PAM type: YTN; PAM sequence: TTC
agcatatacttccttgagca

SEQ ID NO: 95117 - DNA, 20 bp, Artificial Sequence
  Description of Artificial Sequence: Synthetic oligonucleotide
  Target: SCN9A; (+) strand; PAM type: YTN; PAM sequence: CTT
ccttgagcataagtgaagtt

SEQ ID NO: 95118 - DNA, 20 bp, Artificial Sequence
  Description of Artificial Sequence: Synthetic oligonucleotide
  Target: SCN9A; (+) strand; PAM type: YTN; PAM sequence: TTC
cttgagcataagtgaagttt

SEQ ID NO: 95119 - DNA, 20 bp, Artificial Sequence
  Description of Artificial Sequence: Synthetic oligonucleotide
  Target: SCN9A; (+) strand; PAM type: YTN; PAM sequence: CTT
gagcataagtgaagtttagc

SEQ ID NO: 95120 - DNA, 20 bp, Artificial Sequence
  Description of Artificial Sequence: Synthetic oligonucleotide
  Target: SCN9A; (+) strand; PAM type: YTN; PAM sequence: TTG
agcataagtgaagtttagct

SEQ ID NO: 95121 - DNA, 20 bp, Artificial Sequence
  Description of Artificial Sequence: Synthetic oligonucleotide
  Target: SCN9A; (+) strand; PAM type: YTN; PAM sequence: TTT
agctttactcaaaaaataaa

SEQ ID NO: 95122 - DNA, 20 bp, Artificial Sequence
  Description of Artificial Sequence: Synthetic oligonucleotide
  Target: SCN9A; (+) strand; PAM type: YTN; PAM sequence: TTA
gctttactcaaaaaataaaa

SEQ ID NO: 95123 - DNA, 20 bp, Artificial Sequence
  Description of Artificial Sequence: Synthetic oligonucleotide
  Target: SCN9A; (+) strand; PAM type: YTN; PAM sequence: CTT
tactcaaaaaataaaatctg

SEQ ID NO: 95124 - DNA, 20 bp, Artificial Sequence
  Description of Artificial Sequence: Synthetic oligonucleotide
  Target: SCN9A; (+) strand; PAM type: YTN; PAM sequence: TTT
actcaaaaaataaaatctga

SEQ ID NO: 95125 - DNA, 20 bp, Artificial Sequence
  Description of Artificial Sequence: Synthetic oligonucleotide
  Target: SCN9A; (+) strand; PAM type: YTN; PAM sequence: TTA
ctcaaaaaataaaatctgaa

SEQ ID NO: 95126 - DNA, 20 bp, Artificial Sequence
  Description of Artificial Sequence: Synthetic oligonucleotide
  Target: SCN9A; (+) strand; PAM type: YTN; PAM sequence: CTC
aaaaaataaaatctgaaaaa

SEQ ID NO: 95127 - DNA, 20 bp, Artificial Sequence
  Description of Artificial Sequence: Synthetic oligonucleotide
  Target: SCN9A; (+) strand; PAM type: YTN; PAM sequence: CTG
aaaaataaatattcttacct

SEQ ID NO: 95128 - DNA, 20 bp, Artificial Sequence
  Description of Artificial Sequence: Synthetic oligonucleotide
  Target: SCN9A; (+) strand; PAM type: YTN; PAM sequence: TTC
ttacctacaatggagataat

SEQ ID NO: 95129 - DNA, 20 bp, Artificial Sequence
  Description of Artificial Sequence: Synthetic oligonucleotide
  Target: SCN9A; (+) strand; PAM type: YTN; PAM sequence: CTT
acctacaatggagataatca

SEQ ID NO: 95130 - DNA, 20 bp, Artificial Sequence
  Description of Artificial Sequence: Synthetic oligonucleotide
  Target: SCN9A; (+) strand; PAM type: YTN; PAM sequence: TTA
cctacaatggagataatcac

SEQ ID NO: 95131 - DNA, 20 bp, Artificial Sequence
  Description of Artificial Sequence: Synthetic oligonucleotide
  Target: SCN9A; (+) strand; PAM type: YTN; PAM sequence: CTA
caatggagataatcacaacc

SEQ ID NO: 95132 - DNA, 20 bp, Artificial Sequence
  Description of Artificial Sequence: Synthetic oligonucleotide
  Target: SCN9A; (+) strand; PAM type: YTN; PAM sequence: TTC
catcctacagtgaagtagta

SEQ ID NO: 95133 - DNA, 20 bp, Artificial Sequence
  Description of Artificial Sequence: Synthetic oligonucleotide
  Target: SCN9A; (+) strand; PAM type: YTN; PAM sequence: CTA
cagtgaagtagtagtgtctg

SEQ ID NO: 95134 - DNA, 20 bp, Artificial Sequence
  Description of Artificial Sequence: Synthetic oligonucleotide
  Target: SCN9A; (+) strand; PAM type: YTN; PAM sequence: CTG
agggagatcagttttagcac

SEQ ID NO: 95135 - DNA, 20 bp, Artificial Sequence
  Description of Artificial Sequence: Synthetic oligonucleotide
  Target: SCN9A; (+) strand; PAM type: YTN; PAM sequence: TTT
tagcacacattctccagtga

SEQ ID NO: 95136 - DNA, 20 bp, Artificial Sequence
  Description of Artificial Sequence: Synthetic oligonucleotide
  Target: SCN9A; (+) strand; PAM type: YTN; PAM sequence: TTT
agcacacattctccagtgaa

SEQ ID NO: 95137 - DNA, 20 bp, Artificial Sequence
  Description of Artificial Sequence: Synthetic oligonucleotide
  Target: SCN9A; (+) strand; PAM type: YTN; PAM sequence: TTA
gcacacattctccagtgaaa

SEQ ID NO: 95138 - DNA, 20 bp, Artificial Sequence
  Description of Artificial Sequence: Synthetic oligonucleotide
  Target: SCN9A; (+) strand; PAM type: YTN; PAM sequence: TTC
tccagtgaaaaggattataa

SEQ ID NO: 95139 - DNA, 20 bp, Artificial Sequence
  Description of Artificial Sequence: Synthetic oligonucleotide
  Target: SCN9A; (+) strand; PAM type: YTN; PAM sequence: CTC
cagtgaaaaggattataaaa

SEQ ID NO: 95140 - DNA, 20 bp, Artificial Sequence
  Description of Artificial Sequence: Synthetic oligonucleotide
  Target: SCN9A; (+) strand; PAM type: YTN; PAM sequence: TTA
taaaaaccacatttatccaa

SEQ ID NO: 95141 - DNA, 20 bp, Artificial Sequence
  Description of Artificial Sequence: Synthetic oligonucleotide
  Target: SCN9A; (+) strand; PAM type: YTN; PAM sequence: TTT
atccaatataaaacttcagt

SEQ ID NO: 95142 - DNA, 20 bp, Artificial Sequence
  Description of Artificial Sequence: Synthetic oligonucleotide
  Target: SCN9A; (+) strand; PAM type: YTN; PAM sequence: TTA
tccaatataaaacttcagtc

SEQ ID NO: 95143 - DNA, 20 bp, Artificial Sequence
  Description of Artificial Sequence: Synthetic oligonucleotide
  Target: SCN9A; (+) strand; PAM type: YTN; PAM sequence: CTT
cagtcatatgttgactttga

SEQ ID NO: 95144 - DNA, 20 bp, Artificial Sequence
  Description of Artificial Sequence: Synthetic oligonucleotide
  Target: SCN9A; (+) strand; PAM type: YTN; PAM sequence: TTC
agtcatatgttgactttgac

SEQ ID NO: 95145 - DNA, 20 bp, Artificial Sequence
  Description of Artificial Sequence: Synthetic oligonucleotide
  Target: SCN9A; (+) strand; PAM type: YTN; PAM sequence: TTG
actttgaccctccttttcta

SEQ ID NO: 95146 - DNA, 20 bp, Artificial Sequence
  Description of Artificial Sequence: Synthetic oligonucleotide
  Target: SCN9A; (+) strand; PAM type: YTN; PAM sequence: CTT
tgaccctccttttctaccat

SEQ ID NO: 95147 - DNA, 20 bp, Artificial Sequence
  Description of Artificial Sequence: Synthetic oligonucleotide
  Target: SCN9A; (+) strand; PAM type: YTN; PAM sequence: TTT
gaccctccttttctaccatc

SEQ ID NO: 95148 - DNA, 20 bp, Artificial Sequence
  Description of Artificial Sequence: Synthetic oligonucleotide
  Target: SCN9A; (+) strand; PAM type: YTN; PAM sequence: TTG
accctccttttctaccatca

SEQ ID NO: 95149 - DNA, 20 bp, Artificial Sequence
  Description of Artificial Sequence: Synthetic oligonucleotide
  Target: SCN9A; (+) strand; PAM type: YTN; PAM sequence: CTC
cttttctaccatcatggtta

SEQ ID NO: 95150 - DNA, 20 bp, Artificial Sequence
  Description of Artificial Sequence: Synthetic oligonucleotide
  Target: SCN9A; (+) strand; PAM type: YTN; PAM sequence: CTT
ttctaccatcatggttacca

SEQ ID NO: 95151 - DNA, 20 bp, Artificial Sequence
  Description of Artificial Sequence: Synthetic oligonucleotide
  Target: SCN9A; (+) strand; PAM type: YTN; PAM sequence: TTT
tctaccatcatggttaccat

SEQ ID NO: 95152 - DNA, 20 bp, Artificial Sequence
  Description of Artificial Sequence: Synthetic oligonucleotide
  Target: SCN9A; (+) strand; PAM type: YTN; PAM sequence: TTT
ctaccatcatggttaccatg

SEQ ID NO: 95153 - DNA, 20 bp, Artificial Sequence
  Description of Artificial Sequence: Synthetic oligonucleotide
  Target: SCN9A; (+) strand; PAM type: YTN; PAM sequence: TTC
taccatcatggttaccatgt

SEQ ID NO: 95154 - DNA, 20 bp, Artificial Sequence
  Description of Artificial Sequence: Synthetic oligonucleotide
  Target: SCN9A; (+) strand; PAM type: YTN; PAM sequence: CTA
ccatcatggttaccatgttg

SEQ ID NO: 95155 - DNA, 20 bp, Artificial Sequence
  Description of Artificial Sequence: Synthetic oligonucleotide
  Target: SCN9A; (+) strand; PAM type: YTN; PAM sequence: TTA
ccatgttgagacagataaga

SEQ ID NO: 95156 - DNA, 20 bp, Artificial Sequence
  Description of Artificial Sequence: Synthetic oligonucleotide
  Target: SCN9A; (+) strand; PAM type: YTN; PAM sequence: TTG
agacagataagaaccatgat

SEQ ID NO: 95157 - DNA, 20 bp, Artificial Sequence
  Description of Artificial Sequence: Synthetic oligonucleotide
  Target: SCN9A; (+) strand; PAM type: YTN; PAM sequence: CTA
atatcaaaggcttgatttgt

SEQ ID NO: 95158 - DNA, 20 bp, Artificial Sequence
  Description of Artificial Sequence: Synthetic oligonucleotide
  Target: SCN9A; (+) strand; PAM type: YTN; PAM sequence: CTT
gatttgtcactaggtcaaat

SEQ ID NO: 95159 - DNA, 20 bp, Artificial Sequence
  Description of Artificial Sequence: Synthetic oligonucleotide
  Target: SCN9A; (+) strand; PAM type: YTN; PAM sequence: TTG
atttgtcactaggtcaaata

SEQ ID NO: 95160 - DNA, 20 bp, Artificial Sequence
  Description of Artificial Sequence: Synthetic oligonucleotide
  Target: SCN9A; (+) strand; PAM type: YTN; PAM sequence: TTT
gtcactaggtcaaatataca

SEQ ID NO: 95161 - DNA, 20 bp, Artificial Sequence
  Description of Artificial Sequence: Synthetic oligonucleotide
  Target: SCN9A; (+) strand; PAM type: YTN; PAM sequence: TTG
tcactaggtcaaatatacat

SEQ ID NO: 95162 - DNA, 20 bp, Artificial Sequence
  Description of Artificial Sequence: Synthetic oligonucleotide
  Target: SCN9A; (+) strand; PAM type: YTN; PAM sequence: CTA
ggtcaaatatacatccttgg

SEQ ID NO: 95163 - DNA, 20 bp, Artificial Sequence
  Description of Artificial Sequence: Synthetic oligonucleotide
  Target: SCN9A; (+) strand; PAM type: YTN; PAM sequence: CTT
ggattttgttctgcaaagaa

SEQ ID NO: 95164 - DNA, 20 bp, Artificial Sequence
  Description of Artificial Sequence: Synthetic oligonucleotide
  Target: SCN9A; (+) strand; PAM type: YTN; PAM sequence: TTG
gattttgttctgcaaagaaa

SEQ ID NO: 95165 - DNA, 20 bp, Artificial Sequence
  Description of Artificial Sequence: Synthetic oligonucleotide
  Target: SCN9A; (+) strand; PAM type: YTN; PAM sequence: TTT
tgttctgcaaagaaataaga

SEQ ID NO: 95166 - DNA, 20 bp, Artificial Sequence
  Description of Artificial Sequence: Synthetic oligonucleotide
  Target: SCN9A; (+) strand; PAM type: YTN; PAM sequence: TTT
gttctgcaaagaaataagaa

SEQ ID NO: 95167 - DNA, 20 bp, Artificial Sequence
  Description of Artificial Sequence: Synthetic oligonucleotide
  Target: SCN9A; (+) strand; PAM type: YTN; PAM sequence: TTG
ttctgcaaagaaataagaat

SEQ ID NO: 95168 - DNA, 20 bp, Artificial Sequence
  Description of Artificial Sequence: Synthetic oligonucleotide
  Target: SCN9A; (+) strand; PAM type: YTN; PAM sequence: TTC
tgcaaagaaataagaataat

SEQ ID NO: 95169 - DNA, 20 bp, Artificial Sequence
  Description of Artificial Sequence: Synthetic oligonucleotide
  Target: SCN9A; (+) strand; PAM type: YTN; PAM sequence: CTG
caaagaaataagaataatat

SEQ ID NO: 95170 - DNA, 20 bp, Artificial Sequence
  Description of Artificial Sequence: Synthetic oligonucleotide
  Target: SCN9A; (+) strand; PAM type: YTN; PAM sequence: CTT
ttcaagtattatccagaaat

SEQ ID NO: 95171 - DNA, 20 bp, Artificial Sequence
  Description of Artificial Sequence: Synthetic oligonucleotide
  Target: SCN9A; (+) strand; PAM type: YTN; PAM sequence: TTT
tcaagtattatccagaaatt

SEQ ID NO: 95172 - DNA, 20 bp, Artificial Sequence
  Description of Artificial Sequence: Synthetic oligonucleotide
  Target: SCN9A; (+) strand; PAM type: YTN; PAM sequence: TTT
caagtattatccagaaatta

SEQ ID NO: 95173 - DNA, 20 bp, Artificial Sequence
  Description of Artificial Sequence: Synthetic oligonucleotide
  Target: SCN9A; (+) strand; PAM type: YTN; PAM sequence: TTC
aagtattatccagaaattaa

SEQ ID NO: 95174 - DNA, 20 bp, Artificial Sequence
  Description of Artificial Sequence: Synthetic oligonucleotide
  Target: SCN9A; (+) strand; PAM type: YTN; PAM sequence: TTA
tccagaaattaaagatgtgc

SEQ ID NO: 95175 - DNA, 20 bp, Artificial Sequence
  Description of Artificial Sequence: Synthetic oligonucleotide
  Target: SCN9A; (+) strand; PAM type: YTN; PAM sequence: TTA
aagatgtgcattaaaaatga

SEQ ID NO: 95176 - DNA, 20 bp, Artificial Sequence
  Description of Artificial Sequence: Synthetic oligonucleotide
  Target: SCN9A; (+) strand; PAM type: YTN; PAM sequence: TTA
aaaatgaattagaaataatt

SEQ ID NO: 95177 - DNA, 20 bp, Artificial Sequence
  Description of Artificial Sequence: Synthetic oligonucleotide
  Target: SCN9A; (+) strand; PAM type: YTN; PAM sequence: TTA
gaaataatttgaaaatctat

SEQ ID NO: 95178 - DNA, 20 bp, Artificial Sequence
  Description of Artificial Sequence: Synthetic oligonucleotide
  Target: SCN9A; (+) strand; PAM type: YTN; PAM sequence: TTT
gaaaatctatatgctaaaga

SEQ ID NO: 95179 - DNA, 20 bp, Artificial Sequence
  Description of Artificial Sequence: Synthetic oligonucleotide
  Target: SCN9A; (+) strand; PAM type: YTN; PAM sequence: TTG
aaaatctatatgctaaagat

SEQ ID NO: 95180 - DNA, 20 bp, Artificial Sequence
  Description of Artificial Sequence: Synthetic oligonucleotide
  Target: SCN9A; (+) strand; PAM type: YTN; PAM sequence: CTA
tatgctaaagatatatatat

SEQ ID NO: 95181 - DNA, 20 bp, Artificial Sequence
  Description of Artificial Sequence: Synthetic oligonucleotide
  Target: SCN9A; (+) strand; PAM type: YTN; PAM sequence: CTA
aagatatatatattttttta

SEQ ID NO: 95182 - DNA, 20 bp, Artificial Sequence
  Description of Artificial Sequence: Synthetic oligonucleotide
  Target: SCN9A; (+) strand; PAM type: YTN; PAM sequence: TTT
ttttacccctggtcgaggaa

SEQ ID NO: 95183 - DNA, 20 bp, Artificial Sequence
  Description of Artificial Sequence: Synthetic oligonucleotide
  Target: SCN9A; (+) strand; PAM type: YTN; PAM sequence: TTT
tttacccctggtcgaggaat

SEQ ID NO: 95184 - DNA, 20 bp, Artificial Sequence
  Description of Artificial Sequence: Synthetic oligonucleotide
  Target: SCN9A; (+) strand; PAM type: YTN; PAM sequence: TTT
ttacccctggtcgaggaatt

SEQ ID NO: 95185 - DNA, 20 bp, Artificial Sequence
  Description of Artificial Sequence: Synthetic oligonucleotide
  Target: SCN9A; (+) strand; PAM type: YTN; PAM sequence: TTT
tacccctggtcgaggaattg

SEQ ID NO: 95186 - DNA, 20 bp, Artificial Sequence
  Description of Artificial Sequence: Synthetic oligonucleotide
  Target: SCN9A; (+) strand; PAM type: YTN; PAM sequence: TTT
acccctggtcgaggaattgg

SEQ ID NO: 95187 - DNA, 20 bp, Artificial Sequence
  Description of Artificial Sequence: Synthetic oligonucleotide
  Target: SCN9A; (+) strand; PAM type: YTN; PAM sequence: TTA
cccctggtcgaggaattggc

SEQ ID NO: 95188 - DNA, 20 bp, Artificial Sequence
  Description of Artificial Sequence: Synthetic oligonucleotide
  Target: SCN9A; (+) strand; PAM type: YTN; PAM sequence: CTG
gtcgaggaattggcttttgt

SEQ ID NO: 95189 - DNA, 20 bp, Artificial Sequence
  Description of Artificial Sequence: Synthetic oligonucleotide
  Target: SCN9A; (+) strand; PAM type: YTN; PAM sequence: TTG
gcttttgtggcttcttggac

SEQ ID NO: 95190 - DNA, 20 bp, Artificial Sequence
  Description of Artificial Sequence: Synthetic oligonucleotide
  Target: SCN9A; (+) strand; PAM type: YTN; PAM sequence: CTT
ttgtggcttcttggacccca

SEQ ID NO: 95191 - DNA, 20 bp, Artificial Sequence
  Description of Artificial Sequence: Synthetic oligonucleotide
  Target: SCN9A; (+) strand; PAM type: YTN; PAM sequence: TTT
tgtggcttcttggaccccag

SEQ ID NO: 95192 - DNA, 20 bp, Artificial Sequence
  Description of Artificial Sequence: Synthetic oligonucleotide
  Target: SCN9A; (+) strand; PAM type: YTN; PAM sequence: TTT
gtggcttcttggaccccagc

SEQ ID NO: 95193 - DNA, 20 bp, Artificial Sequence
  Description of Artificial Sequence: Synthetic oligonucleotide
  Target: SCN9A; (+) strand; PAM type: YTN; PAM sequence: TTG
tggcttcttggaccccagct

SEQ ID NO: 95194 - DNA, 20 bp, Artificial Sequence
  Description of Artificial Sequence: Synthetic oligonucleotide
  Target: SCN9A; (+) strand; PAM type: YTN; PAM sequence: CTT
cttggaccccagctttttca

SEQ ID NO: 95195 - DNA, 20 bp, Artificial Sequence
  Description of Artificial Sequence: Synthetic oligonucleotide
  Target: SCN9A; (+) strand; PAM type: YTN; PAM sequence: TTC
ttggaccccagctttttcat

SEQ ID NO: 95196 - DNA, 20 bp, Artificial Sequence
  Description of Artificial Sequence: Synthetic oligonucleotide
  Target: SCN9A; (+) strand; PAM type: YTN; PAM sequence: CTT
ggaccccagctttttcattg

SEQ ID NO: 95197 - DNA, 20 bp, Artificial Sequence
  Description of Artificial Sequence: Synthetic oligonucleotide
  Target: SCN9A; (+) strand; PAM type: YTN; PAM sequence: TTG
gaccccagctttttcattgc

SEQ ID NO: 95198 - DNA, 20 bp, Artificial Sequence
  Description of Artificial Sequence: Synthetic oligonucleotide
  Target: SCN9A; (+) strand; PAM type: YTN; PAM sequence: CTT
tttcattgcattatagtatt

SEQ ID NO: 95199 - DNA, 20 bp, Artificial Sequence
  Description of Artificial Sequence: Synthetic oligonucleotide
  Target: SCN9A; (+) strand; PAM type: YTN; PAM sequence: TTT
ttcattgcattatagtattt

SEQ ID NO: 95200 - DNA, 20 bp, Artificial Sequence
  Description of Artificial Sequence: Synthetic oligonucleotide
  Target: SCN9A; (+) strand; PAM type: YTN; PAM sequence: TTT
tcattgcattatagtatttc

SEQ ID NO: 95201 - DNA, 20 bp, Artificial Sequence
  Description of Artificial Sequence: Synthetic oligonucleotide
  Target: SCN9A; (+) strand; PAM type: YTN; PAM sequence: TTT
cattgcattatagtatttct

SEQ ID NO: 95202 - DNA, 20 bp, Artificial Sequence
  Description of Artificial Sequence: Synthetic oligonucleotide
  Target: SCN9A; (+) strand; PAM type: YTN; PAM sequence: TTC
attgcattatagtatttctt

SEQ ID NO: 95203 - DNA, 20 bp, Artificial Sequence
  Description of Artificial Sequence: Synthetic oligonucleotide
  Target: SCN9A; (+) strand; PAM type: YTN; PAM sequence: TTG
cattatagtatttcttctgt

SEQ ID NO: 95204 - DNA, 20 bp, Artificial Sequence
  Description of Artificial Sequence: Synthetic oligonucleotide
  Target: SCN9A; (+) strand; PAM type: YTN; PAM sequence: TTA
tagtatttcttctgttcttc

SEQ ID NO: 95205 - DNA, 20 bp, Artificial Sequence
  Description of Artificial Sequence: Synthetic oligonucleotide
  Target: SCN9A; (+) strand; PAM type: YTN; PAM sequence: TTT
cttctgttcttctgtcataa

SEQ ID NO: 95206 - DNA, 20 bp, Artificial Sequence
  Description of Artificial Sequence: Synthetic oligonucleotide
  Target: SCN9A; (+) strand; PAM type: YTN; PAM sequence: TTC
ttctgttcttctgtcataaa

SEQ ID NO: 95207 - DNA, 20 bp, Artificial Sequence
  Description of Artificial Sequence: Synthetic oligonucleotide
  Target: SCN9A; (+) strand; PAM type: YTN; PAM sequence: CTT
ctgttcttctgtcataaaga

SEQ ID NO: 95208 - DNA, 20 bp, Artificial Sequence
  Description of Artificial Sequence: Synthetic oligonucleotide
  Target: SCN9A; (+) strand; PAM type: YTN; PAM sequence: TTC
tgttcttctgtcataaagat

SEQ ID NO: 95209 - DNA, 20 bp, Artificial Sequence
  Description of Artificial Sequence: Synthetic oligonucleotide
  Target: SCN9A; (+) strand; PAM type: YTN; PAM sequence: CTG
ttcttctgtcataaagatgt

SEQ ID NO: 95210 - DNA, 20 bp, Artificial Sequence
  Description of Artificial Sequence: Synthetic oligonucleotide
  Target: SCN9A; (+) strand; PAM type: YTN; PAM sequence: TTC
ttctgtcataaagatgtctt

SEQ ID NO: 95211 - DNA, 20 bp, Artificial Sequence
  Description of Artificial Sequence: Synthetic oligonucleotide
  Target: SCN9A; (+) strand; PAM type: YTN; PAM sequence: CTT
ctgtcataaagatgtcttga

SEQ ID NO: 95212 - DNA, 20 bp, Artificial Sequence
  Description of Artificial Sequence: Synthetic oligonucleotide
  Target: SCN9A; (+) strand; PAM type: YTN; PAM sequence: TTC
tgtcataaagatgtcttgac

SEQ ID NO: 95213 - DNA, 20 bp, Artificial Sequence
  Description of Artificial Sequence: Synthetic oligonucleotide
  Target: SCN9A; (+) strand; PAM type: YTN; PAM sequence: CTG
tcataaagatgtcttgacct

SEQ ID NO: 95214 - DNA, 20 bp, Artificial Sequence
  Description of Artificial Sequence: Synthetic oligonucleotide
  Target: SCN9A; (+) strand; PAM type: YTN; PAM sequence: CTT
gacctccaaggtaaagaaac

SEQ ID NO: 95215 - DNA, 20 bp, Artificial Sequence
  Description of Artificial Sequence: Synthetic oligonucleotide
  Target: SCN9A; (+) strand; PAM type: YTN; PAM sequence: TTG
acctccaaggtaaagaaaca

SEQ ID NO: 95216 - DNA, 20 bp, Artificial Sequence
  Description of Artificial Sequence: Synthetic oligonucleotide
  Target: SCN9A; (+) strand; PAM type: YTN; PAM sequence: CTC
caaggtaaagaaacaaacaa

SEQ ID NO: 95217 - DNA, 20 bp, Artificial Sequence
  Description of Artificial Sequence: Synthetic oligonucleotide
  Target: SCN9A; (+) strand; PAM type: YTN; PAM sequence: TTA
aaaccagaatcattgtctac

SEQ ID NO: 95218 - DNA, 20 bp, Artificial Sequence
  Description of Artificial Sequence: Synthetic oligonucleotide
  Target: SCN9A; (+) strand; PAM type: YTN; PAM sequence: TTG
tctacatctttctatagatt

SEQ ID NO: 95219 - DNA, 20 bp, Artificial Sequence
  Description of Artificial Sequence: Synthetic oligonucleotide
  Target: SCN9A; (+) strand; PAM type: YTN; PAM sequence: CTA
catctttctatagattacta

SEQ ID NO: 95220 - DNA, 20 bp, Artificial Sequence
  Description of Artificial Sequence: Synthetic oligonucleotide
  Target: SCN9A; (+) strand; PAM type: YTN; PAM sequence: CTT
tctatagattactaaaatag

SEQ ID NO: 95221 - DNA, 20 bp, Artificial Sequence
  Description of Artificial Sequence: Synthetic oligonucleotide
  Target: SCN9A; (+) strand; PAM type: YTN; PAM sequence: TTT
ctatagattactaaaatagg

SEQ ID NO: 95222 - DNA, 20 bp, Artificial Sequence
  Description of Artificial Sequence: Synthetic oligonucleotide
  Target: SCN9A; (+) strand; PAM type: YTN; PAM sequence: TTC
tatagattactaaaataggt

SEQ ID NO: 95223 - DNA, 20 bp, Artificial Sequence
  Description of Artificial Sequence: Synthetic oligonucleotide
  Target: SCN9A; (+) strand; PAM type: YTN; PAM sequence: CTA
tagattactaaaataggtta

SEQ ID NO: 95224 - DNA, 20 bp, Artificial Sequence
  Description of Artificial Sequence: Synthetic oligonucleotide
  Target: SCN9A; (+) strand; PAM type: YTN; PAM sequence: TTA
ctaaaataggttaaaatgtg

SEQ ID NO: 95225 - DNA, 20 bp, Artificial Sequence
  Description of Artificial Sequence: Synthetic oligonucleotide
  Target: SCN9A; (+) strand; PAM type: YTN; PAM sequence: CTA
aaataggttaaaatgtgtta

SEQ ID NO: 95226 - DNA, 20 bp, Artificial Sequence
  Description of Artificial Sequence: Synthetic oligonucleotide
  Target: SCN9A; (+) strand; PAM type: YTN; PAM sequence: TTA
aaatgtgttaatatagaaat

SEQ ID NO: 95227 - DNA, 20 bp, Artificial Sequence
  Description of Artificial Sequence: Synthetic oligonucleotide
  Target: SCN9A; (+) strand; PAM type: YTN; PAM sequence: TTA
atatagaaataaaatgtatt

SEQ ID NO: 95228 - DNA, 20 bp, Artificial Sequence
  Description of Artificial Sequence: Synthetic oligonucleotide
  Target: SCN9A; (+) strand; PAM type: YTN; PAM sequence: TTT
tattatgttcatgatagcta

SEQ ID NO: 95229 - DNA, 20 bp, Artificial Sequence
  Description of Artificial Sequence: Synthetic oligonucleotide
  Target: SCN9A; (+) strand; PAM type: YTN; PAM sequence: TTT
attatgttcatgatagctat

SEQ ID NO: 95230 - DNA, 20 bp, Artificial Sequence
  Description of Artificial Sequence: Synthetic oligonucleotide
  Target: SCN9A; (+) strand; PAM type: YTN; PAM sequence: TTA
ttatgttcatgatagctata

SEQ ID NO: 95231 - DNA, 20 bp, Artificial Sequence
  Description of Artificial Sequence: Synthetic oligonucleotide
  Target: SCN9A; (+) strand; PAM type: YTN; PAM sequence: TTA
tgttcatgatagctatacat

SEQ ID NO: 95232 - DNA, 20 bp, Artificial Sequence
  Description of Artificial Sequence: Synthetic oligonucleotide
  Target: SCN9A; (+) strand; PAM type: YTN; PAM sequence: TTC
atgatagctatacataaaat

SEQ ID NO: 95233 - DNA, 20 bp, Artificial Sequence
  Description of Artificial Sequence: Synthetic oligonucleotide
  Target: SCN9A; (+) strand; PAM type: YTN; PAM sequence: CTA
tacataaaatatatcttaaa

SEQ ID NO: 95234 - DNA, 20 bp, Artificial Sequence
  Description of Artificial Sequence: Synthetic oligonucleotide
  Target: SCN9A; (+) strand; PAM type: YTN; PAM sequence: CTT
aaataattacatatgtgtag

SEQ ID NO: 95235 - DNA, 20 bp, Artificial Sequence
  Description of Artificial Sequence: Synthetic oligonucleotide
  Target: SCN9A; (+) strand; PAM type: YTN; PAM sequence: TTA
aataattacatatgtgtaga

SEQ ID NO: 95236 - DNA, 20 bp, Artificial Sequence
  Description of Artificial Sequence: Synthetic oligonucleotide
  Target: SCN9A; (+) strand; PAM type: YTN; PAM sequence: TTA
catatgtgtagaaacatggg

SEQ ID NO: 95237 - DNA, 20 bp, Artificial Sequence
  Description of Artificial Sequence: Synthetic oligonucleotide
  Target: SCN9A; (+) strand; PAM type: YTN; PAM sequence: CTC
caaacacagttaaatgtgca

SEQ ID NO: 95238 - DNA, 20 bp, Artificial Sequence
  Description of Artificial Sequence: Synthetic oligonucleotide
  Target: SCN9A; (+) strand; PAM type: YTN; PAM sequence: TTA
aatgtgcatatataaatatt

SEQ ID NO: 95239 - DNA, 20 bp, Artificial Sequence
  Description of Artificial Sequence: Synthetic oligonucleotide
  Target: SCN9A; (+) strand; PAM type: YTN; PAM sequence: TTT
gtattacatataataaggat

SEQ ID NO: 95240 - DNA, 20 bp, Artificial Sequence
  Description of Artificial Sequence: Synthetic oligonucleotide
  Target: SCN9A; (+) strand; PAM type: YTN; PAM sequence: TTG
tattacatataataaggatt

SEQ ID NO: 95241 - DNA, 20 bp, Artificial Sequence
  Description of Artificial Sequence: Synthetic oligonucleotide
  Target: SCN9A; (+) strand; PAM type: YTN; PAM sequence: TTA
catataataaggattggctc

SEQ ID NO: 95242 - DNA, 20 bp, Artificial Sequence
  Description of Artificial Sequence: Synthetic oligonucleotide
  Target: SCN9A; (+) strand; PAM type: YTN; PAM sequence: TTG
gctcaatattcttttggtgt

SEQ ID NO: 95243 - DNA, 20 bp, Artificial Sequence
  Description of Artificial Sequence: Synthetic oligonucleotide
  Target: SCN9A; (+) strand; PAM type: YTN; PAM sequence: CTC
aatattcttttggtgtgcta

SEQ ID NO: 95244 - DNA, 20 bp, Artificial Sequence
  Description of Artificial Sequence: Synthetic oligonucleotide
  Target: SCN9A; (+) strand; PAM type: YTN; PAM sequence: TTC
ttttggtgtgctaatcagtg

SEQ ID NO: 95245 - DNA, 20 bp, Artificial Sequence
  Description of Artificial Sequence: Synthetic oligonucleotide
  Target: SCN9A; (+) strand; PAM type: YTN; PAM sequence: CTT
ttggtgtgctaatcagtgtt

SEQ ID NO: 95246 - DNA, 20 bp, Artificial Sequence
  Description of Artificial Sequence: Synthetic oligonucleotide
  Target: SCN9A; (+) strand; PAM type: YTN; PAM sequence: TTT
tggtgtgctaatcagtgttg

SEQ ID NO: 95247 - DNA, 20 bp, Artificial Sequence
  Description of Artificial Sequence: Synthetic oligonucleotide
  Target: SCN9A; (+) strand; PAM type: YTN; PAM sequence: TTT
ggtgtgctaatcagtgttgt

SEQ ID NO: 95248 - DNA, 20 bp, Artificial Sequence
  Description of Artificial Sequence: Synthetic oligonucleotide
  Target: SCN9A; (+) strand; PAM type: YTN; PAM sequence: TTG
gtgtgctaatcagtgttgtt

SEQ ID NO: 95249 - DNA, 20 bp, Artificial Sequence
  Description of Artificial Sequence: Synthetic oligonucleotide
  Target: SCN9A; (+) strand; PAM type: YTN; PAM sequence: CTA
atcagtgttgttttaaacta

SEQ ID NO: 95250 - DNA, 20 bp, Artificial Sequence
  Description of Artificial Sequence: Synthetic oligonucleotide
  Target: SCN9A; (+) strand; PAM type: YTN; PAM sequence: TTG
ttttaaactatgtactttta

SEQ ID NO: 95251 - DNA, 20 bp, Artificial Sequence
  Description of Artificial Sequence: Synthetic oligonucleotide
  Target: SCN9A; (+) strand; PAM type: YTN; PAM sequence: TTT
taaactatgtacttttatct

SEQ ID NO: 95252 - DNA, 20 bp, Artificial Sequence
  Description of Artificial Sequence: Synthetic oligonucleotide
  Target: SCN9A; (+) strand; PAM type: YTN; PAM sequence: TTT
aaactatgtacttttatctt

SEQ ID NO: 95253 - DNA, 20 bp, Artificial Sequence
  Description of Artificial Sequence: Synthetic oligonucleotide
  Target: SCN9A; (+) strand; PAM type: YTN; PAM sequence: TTA
aactatgtacttttatcttt

SEQ ID NO: 95254 - DNA, 20 bp, Artificial Sequence
  Description of Artificial Sequence: Synthetic oligonucleotide
  Target: SCN9A; (+) strand; PAM type: YTN; PAM sequence: CTA
tgtacttttatcttttttat

SEQ ID NO: 95255 - DNA, 20 bp, Artificial Sequence
  Description of Artificial Sequence: Synthetic oligonucleotide
  Target: SCN9A; (+) strand; PAM type: YTN; PAM sequence: CTT
ttatcttttttatctgctag

SEQ ID NO: 95256 - DNA, 20 bp, Artificial Sequence
  Description of Artificial Sequence: Synthetic oligonucleotide
  Target: SCN9A; (+) strand; PAM type: YTN; PAM sequence: TTT
tatcttttttatctgctagc

SEQ ID NO: 95257 - DNA, 20 bp, Artificial Sequence
  Description of Artificial Sequence: Synthetic oligonucleotide
  Target: SCN9A; (+) strand; PAM type: YTN; PAM sequence: TTT
atcttttttatctgctagct

SEQ ID NO: 95258 - DNA, 20 bp, Artificial Sequence
  Description of Artificial Sequence: Synthetic oligonucleotide
  Target: SCN9A; (+) strand; PAM type: YTN; PAM sequence: TTA
tcttttttatctgctagctg

SEQ ID NO: 95259 - DNA, 20 bp, Artificial Sequence
  Description of Artificial Sequence: Synthetic oligonucleotide
  Target: SCN9A; (+) strand; PAM type: YTN; PAM sequence: CTT
ttttatctgctagctgtctt

SEQ ID NO: 95260 - DNA, 20 bp, Artificial Sequence
  Description of Artificial Sequence: Synthetic oligonucleotide
  Target: SCN9A; (+) strand; PAM type: YTN; PAM sequence: TTT
tttatctgctagctgtctta

SEQ ID NO: 95261 - DNA, 20 bp, Artificial Sequence
  Description of Artificial Sequence: Synthetic oligonucleotide
  Target: SCN9A; (+) strand; PAM type: YTN; PAM sequence: TTT
ttatctgctagctgtcttac

SEQ ID NO: 95262 - DNA, 20 bp, Artificial Sequence
  Description of Artificial Sequence: Synthetic oligonucleotide
  Target: SCN9A; (+) strand; PAM type: YTN; PAM sequence: TTT
tatctgctagctgtcttact

SEQ ID NO: 95263 - DNA, 20 bp, Artificial Sequence
  Description of Artificial Sequence: Synthetic oligonucleotide
  Target: SCN9A; (+) strand; PAM type: YTN; PAM sequence: TTT
atctgctagctgtcttactg

SEQ ID NO: 95264 - DNA, 20 bp, Artificial Sequence
  Description of Artificial Sequence: Synthetic oligonucleotide
  Target: SCN9A; (+) strand; PAM type: YTN; PAM sequence: TTA
tctgctagctgtcttactgt

SEQ ID NO: 95265 - DNA, 20 bp, Artificial Sequence
  Description of Artificial Sequence: Synthetic oligonucleotide
  Target: SCN9A; (+) strand; PAM type: YTN; PAM sequence: CTG
ctagctgtcttactgtgact

SEQ ID NO: 95266 - DNA, 20 bp, Artificial Sequence
  Description of Artificial Sequence: Synthetic oligonucleotide
  Target: SCN9A; (+) strand; PAM type: YTN; PAM sequence: CTA
gctgtcttactgtgactttt

SEQ ID NO: 95267 - DNA, 20 bp, Artificial Sequence
  Description of Artificial Sequence: Synthetic oligonucleotide
  Target: SCN9A; (+) strand; PAM type: YTN; PAM sequence: CTG
tcttactgtgacttttattg

SEQ ID NO: 95268 - DNA, 20 bp, Artificial Sequence
  Description of Artificial Sequence: Synthetic oligonucleotide
  Target: SCN9A; (+) strand; PAM type: YTN; PAM sequence: CTT
actgtgacttttattgctaa

SEQ ID NO: 95269 - DNA, 20 bp, Artificial Sequence
  Description of Artificial Sequence: Synthetic oligonucleotide
  Target: SCN9A; (+) strand; PAM type: YTN; PAM sequence: TTA
ctgtgacttttattgctaag

SEQ ID NO: 95270 - DNA, 20 bp, Artificial Sequence
  Description of Artificial Sequence: Synthetic oligonucleotide
  Target: SCN9A; (+) strand; PAM type: YTN; PAM sequence: CTG
tgacttttattgctaagaaa

SEQ ID NO: 95271 - DNA, 20 bp, Artificial Sequence
  Description of Artificial Sequence: Synthetic oligonucleotide
  Target: SCN9A; (+) strand; PAM type: YTN; PAM sequence: CTT
ttattgctaagaaaatttgt

SEQ ID NO: 95272 - DNA, 20 bp, Artificial Sequence
  Description of Artificial Sequence: Synthetic oligonucleotide
  Target: SCN9A; (+) strand; PAM type: YTN; PAM sequence: TTT
tattgctaagaaaatttgta

SEQ ID NO: 95273 - DNA, 20 bp, Artificial Sequence
  Description of Artificial Sequence: Synthetic oligonucleotide
  Target: SCN9A; (+) strand; PAM type: YTN; PAM sequence: TTT
attgctaagaaaatttgtaa

SEQ ID NO: 95274 - DNA, 20 bp, Artificial Sequence
  Description of Artificial Sequence: Synthetic oligonucleotide
  Target: SCN9A; (+) strand; PAM type: YTN; PAM sequence: TTA
ttgctaagaaaatttgtaag

SEQ ID NO: 95275 - DNA, 20 bp, Artificial Sequence
  Description of Artificial Sequence: Synthetic oligonucleotide
  Target: SCN9A; (+) strand; PAM type: YTN; PAM sequence: TTG
ctaagaaaatttgtaagaat

SEQ ID NO: 95276 - DNA, 20 bp, Artificial Sequence
  Description of Artificial Sequence: Synthetic oligonucleotide
  Target: SCN9A; (+) strand; PAM type: YTN; PAM sequence: CTA
agaaaatttgtaagaattaa

SEQ ID NO: 95277 - DNA, 20 bp, Artificial Sequence
  Description of Artificial Sequence: Synthetic oligonucleotide
  Target: SCN9A; (+) strand; PAM type: YTN; PAM sequence: TTT
gtaagaattaaaagtaatga

SEQ ID NO: 95278 - DNA, 20 bp, Artificial Sequence
  Description of Artificial Sequence: Synthetic oligonucleotide
  Target: SCN9A; (+) strand; PAM type: YTN; PAM sequence: TTG
taagaattaaaagtaatgaa

SEQ ID NO: 95279 - DNA, 20 bp, Artificial Sequence
  Description of Artificial Sequence: Synthetic oligonucleotide
  Target: SCN9A; (+) strand; PAM type: YTN; PAM sequence: TTA
aaagtaatgaatatcttctt

SEQ ID NO: 95280 - DNA, 20 bp, Artificial Sequence
  Description of Artificial Sequence: Synthetic oligonucleotide
  Target: SCN9A; (+) strand; PAM type: YTN; PAM sequence: CTT
ctttgatgatttggcaaata

SEQ ID NO: 95281 - DNA, 20 bp, Artificial Sequence
  Description of Artificial Sequence: Synthetic oligonucleotide
  Target: SCN9A; (+) strand; PAM type: YTN; PAM sequence: TTC
tttgatgatttggcaaatat

SEQ ID NO: 95282 - DNA, 20 bp, Artificial Sequence
  Description of Artificial Sequence: Synthetic oligonucleotide
  Target: SCN9A; (+) strand; PAM type: YTN; PAM sequence: CTT
tgatgatttggcaaatattt

SEQ ID NO: 95283 - DNA, 20 bp, Artificial Sequence
  Description of Artificial Sequence: Synthetic oligonucleotide
  Target: SCN9A; (+) strand; PAM type: YTN; PAM sequence: TTT
gatgatttggcaaatattta

SEQ ID NO: 95284 - DNA, 20 bp, Artificial Sequence
  Description of Artificial Sequence: Synthetic oligonucleotide
  Target: SCN9A; (+) strand; PAM type: YTN; PAM sequence: TTG
atgatttggcaaatatttag

SEQ ID NO: 95285 - DNA, 20 bp, Artificial Sequence
  Description of Artificial Sequence: Synthetic oligonucleotide
  Target: SCN9A; (+) strand; PAM type: YTN; PAM sequence: TTT
ggcaaatatttagaactttt

SEQ ID NO: 95286 - DNA, 20 bp, Artificial Sequence
  Description of Artificial Sequence: Synthetic oligonucleotide
  Target: SCN9A; (+) strand; PAM type: YTN; PAM sequence: TTG
gcaaatatttagaactttta

SEQ ID NO: 95287 - DNA, 20 bp, Artificial Sequence
  Description of Artificial Sequence: Synthetic oligonucleotide
  Target: SCN9A; (+) strand; PAM type: YTN; PAM sequence: TTT
agaacttttataaagaatag

SEQ ID NO: 95288 - DNA, 20 bp, Artificial Sequence
  Description of Artificial Sequence: Synthetic oligonucleotide
  Target: SCN9A; (+) strand; PAM type: YTN; PAM sequence: TTA
gaacttttataaagaatagg

SEQ ID NO: 95289 - DNA, 20 bp, Artificial Sequence
  Description of Artificial Sequence: Synthetic oligonucleotide
  Target: SCN9A; (+) strand; PAM type: YTN; PAM sequence: CTT
ttataaagaatagggagcca

SEQ ID NO: 95290 - DNA, 20 bp, Artificial Sequence
  Description of Artificial Sequence: Synthetic oligonucleotide
  Target: SCN9A; (+) strand; PAM type: YTN; PAM sequence: TTT
tataaagaatagggagccaa

SEQ ID NO: 95291 - DNA, 20 bp, Artificial Sequence
  Description of Artificial Sequence: Synthetic oligonucleotide
  Target: SCN9A; (+) strand; PAM type: YTN; PAM sequence: TTT
ataaagaatagggagccaaa

SEQ ID NO: 95292 - DNA, 20 bp, Artificial Sequence
  Description of Artificial Sequence: Synthetic oligonucleotide
  Target: SCN9A; (+) strand; PAM type: YTN; PAM sequence: TTA
taaagaatagggagccaaat

SEQ ID NO: 95293 - DNA, 20 bp, Artificial Sequence
  Description of Artificial Sequence: Synthetic oligonucleotide
  Target: SCN9A; (+) strand; PAM type: YTN; PAM sequence: CTC
ccattcacaattactacaaa

SEQ ID NO: 95294 - DNA, 20 bp, Artificial Sequence
  Description of Artificial Sequence: Synthetic oligonucleotide
  Target: SCN9A; (+) strand; PAM type: YTN; PAM sequence: TTC
acaattactacaaagagaat

SEQ ID NO: 95295 - DNA, 20 bp, Artificial Sequence
  Description of Artificial Sequence: Synthetic oligonucleotide
  Target: SCN9A; (+) strand; PAM type: YTN; PAM sequence: TTA
ctacaaagagaataaaatac

SEQ ID NO: 95296 - DNA, 20 bp, Artificial Sequence
  Description of Artificial Sequence: Synthetic oligonucleotide
  Target: SCN9A; (+) strand; PAM type: YTN; PAM sequence: CTA
caaagagaataaaataccta

SEQ ID NO: 95297 - DNA, 20 bp, Artificial Sequence
  Description of Artificial Sequence: Synthetic oligonucleotide
  Target: SCN9A; (+) strand; PAM type: YTN; PAM sequence: CTA
ggaatccaacttacaaggga

SEQ ID NO: 95298 - DNA, 20 bp, Artificial Sequence
  Description of Artificial Sequence: Synthetic oligonucleotide
  Target: SCN9A; (+) strand; PAM type: YTN; PAM sequence: CTT
acaagggatgtgaaggacct

SEQ ID NO: 95299 - DNA, 20 bp, Artificial Sequence
  Description of Artificial Sequence: Synthetic oligonucleotide
  Target: SCN9A; (+) strand; PAM type: YTN; PAM sequence: TTA
caagggatgtgaaggacctc

SEQ ID NO: 95300 - DNA, 20 bp, Artificial Sequence
  Description of Artificial Sequence: Synthetic oligonucleotide
  Target: SCN9A; (+) strand; PAM type: YTN; PAM sequence: CTC
ttcaaggagaactacaaacc

SEQ ID NO: 95301 - DNA, 20 bp, Artificial Sequence
  Description of Artificial Sequence: Synthetic oligonucleotide
  Target: SCN9A; (+) strand; PAM type: YTN; PAM sequence: CTT
caaggagaactacaaaccac

SEQ ID NO: 95302 - DNA, 20 bp, Artificial Sequence
  Description of Artificial Sequence: Synthetic oligonucleotide
  Target: SCN9A; (+) strand; PAM type: YTN; PAM sequence: TTC
aaggagaactacaaaccact

SEQ ID NO: 95303 - DNA, 20 bp, Artificial Sequence
  Description of Artificial Sequence: Synthetic oligonucleotide
  Target: SCN9A; (+) strand; PAM type: YTN; PAM sequence: CTA
caaaccactgctcagcgaaa

SEQ ID NO: 95304 - DNA, 20 bp, Artificial Sequence
  Description of Artificial Sequence: Synthetic oligonucleotide
  Target: SCN9A; (+) strand; PAM type: YTN; PAM sequence: CTG
ctcagcgaaataaaagagga

SEQ ID NO: 95305 - DNA, 20 bp, Artificial Sequence
  Description of Artificial Sequence: Synthetic oligonucleotide
  Target: SCN9A; (+) strand; PAM type: YTN; PAM sequence: CTC
agcgaaataaaagaggacac

SEQ ID NO: 95306 - DNA, 20 bp, Artificial Sequence
  Description of Artificial Sequence: Synthetic oligonucleotide
  Target: SCN9A; (+) strand; PAM type: YTN; PAM sequence: TTC
catgctcatggataggaaga

SEQ ID NO: 95307 - DNA, 20 bp, Artificial Sequence
  Description of Artificial Sequence: Synthetic oligonucleotide
  Target: SCN9A; (+) strand; PAM type: YTN; PAM sequence: CTC
atggataggaagactcaata

SEQ ID NO: 95308 - DNA, 20 bp, Artificial Sequence
  Description of Artificial Sequence: Synthetic oligonucleotide
  Target: SCN9A; (+) strand; PAM type: YTN; PAM sequence: CTC
aatatcatgaaaatggcatt

SEQ ID NO: 95309 - DNA, 20 bp, Artificial Sequence
  Description of Artificial Sequence: Synthetic oligonucleotide
  Target: SCN9A; (+) strand; PAM type: YTN; PAM sequence: TTA
ctgcccaaggtaatttataa

SEQ ID NO: 95310 - DNA, 20 bp, Artificial Sequence
  Description of Artificial Sequence: Synthetic oligonucleotide
  Target: SCN9A; (+) strand; PAM type: YTN; PAM sequence: CTG
cccaaggtaatttataaatt

SEQ ID NO: 95311 - DNA, 20 bp, Artificial Sequence
  Description of Artificial Sequence: Synthetic oligonucleotide
  Target: SCN9A; (+) strand; PAM type: YTN; PAM sequence: TTT
ataaattcaatgctatcccc

SEQ ID NO: 95312 - DNA, 20 bp, Artificial Sequence
  Description of Artificial Sequence: Synthetic oligonucleotide
  Target: SCN9A; (+) strand; PAM type: YTN; PAM sequence: TTA
taaattcaatgctatcccca

SEQ ID NO: 95313 - DNA, 20 bp, Artificial Sequence
  Description of Artificial Sequence: Synthetic oligonucleotide
  Target: SCN9A; (+) strand; PAM type: YTN; PAM sequence: TTC
aatgctatccccatcaagct

SEQ ID NO: 95314 - DNA, 20 bp, Artificial Sequence
  Description of Artificial Sequence: Synthetic oligonucleotide
  Target: SCN9A; (+) strand; PAM type: YTN; PAM sequence: CTA
tccccatcaagctaccactg

SEQ ID NO: 95315 - DNA, 20 bp, Artificial Sequence
  Description of Artificial Sequence: Synthetic oligonucleotide
  Target: SCN9A; (+) strand; PAM type: YTN; PAM sequence: CTA
ccactgactttcttcacaaa

SEQ ID NO: 95316 - DNA, 20 bp, Artificial Sequence
  Description of Artificial Sequence: Synthetic oligonucleotide
  Target: SCN9A; (+) strand; PAM type: YTN; PAM sequence: CTG
actttcttcacaaaattgga

SEQ ID NO: 95317 - DNA, 20 bp, Artificial Sequence
  Description of Artificial Sequence: Synthetic oligonucleotide
  Target: SCN9A; (+) strand; PAM type: YTN; PAM sequence: CTT
tcttcacaaaattggaaaaa

SEQ ID NO: 95318 - DNA, 20 bp, Artificial Sequence
  Description of Artificial Sequence: Synthetic oligonucleotide
  Target: SCN9A; (+) strand; PAM type: YTN; PAM sequence: TTT
cttcacaaaattggaaaaaa

SEQ ID NO: 95319 - DNA, 20 bp, Artificial Sequence
  Description of Artificial Sequence: Synthetic oligonucleotide
  Target: SCN9A; (+) strand; PAM type: YTN; PAM sequence: TTC
ttcacaaaattggaaaaaaa

SEQ ID NO: 95320 - DNA, 20 bp, Artificial Sequence
  Description of Artificial Sequence: Synthetic oligonucleotide
  Target: SCN9A; (+) strand; PAM type: YTN; PAM sequence: CTT
cacaaaattggaaaaaaact

SEQ ID NO: 95321 - DNA, 20 bp, Artificial Sequence
  Description of Artificial Sequence: Synthetic oligonucleotide
  Target: SCN9A; (+) strand; PAM type: YTN; PAM sequence: TTC
acaaaattggaaaaaaacta

SEQ ID NO: 95322 - DNA, 20 bp, Artificial Sequence
  Description of Artificial Sequence: Synthetic oligonucleotide
  Target: SCN9A; (+) strand; PAM type: YTN; PAM sequence: TTG
gaaaaaaactactttaaagt

SEQ ID NO: 95323 - DNA, 20 bp, Artificial Sequence
  Description of Artificial Sequence: Synthetic oligonucleotide
  Target: SCN9A; (+) strand; PAM type: YTN; PAM sequence: CTA
ctttaaagttcatatggaac

SEQ ID NO: 95324 - DNA, 20 bp, Artificial Sequence
  Description of Artificial Sequence: Synthetic oligonucleotide
  Target: SCN9A; (+) strand; PAM type: YTN; PAM sequence: CTT
taaagttcatatggaaccaa

SEQ ID NO: 95325 - DNA, 20 bp, Artificial Sequence
  Description of Artificial Sequence: Synthetic oligonucleotide
  Target: SCN9A; (+) strand; PAM type: YTN; PAM sequence: TTT
aaagttcatatggaaccaaa

SEQ ID NO: 95326 - DNA, 20 bp, Artificial Sequence
  Description of Artificial Sequence: Synthetic oligonucleotide
  Target: SCN9A; (+) strand; PAM type: YTN; PAM sequence: TTA
aagttcatatggaaccaaaa

SEQ ID NO: 95327 - DNA, 20 bp, Artificial Sequence
  Description of Artificial Sequence: Synthetic oligonucleotide
  Target: SCN9A; (+) strand; PAM type: YTN; PAM sequence: TTC
atatggaaccaaaaaagagc

SEQ ID NO: 95328 - DNA, 20 bp, Artificial Sequence
  Description of Artificial Sequence: Synthetic oligonucleotide
  Target: SCN9A; (+) strand; PAM type: YTN; PAM sequence: CTG
catagccaagataatcctaa

SEQ ID NO: 95329 - DNA, 20 bp, Artificial Sequence
  Description of Artificial Sequence: Synthetic oligonucleotide
  Target: SCN9A; (+) strand; PAM type: YTN; PAM sequence: CTA
agcaaaaagaacaaagctgg

SEQ ID NO: 95330 - DNA, 20 bp, Artificial Sequence
  Description of Artificial Sequence: Synthetic oligonucleotide
  Target: SCN9A; (+) strand; PAM type: YTN; PAM sequence: CTG
gaggcgtcacactacctgac

SEQ ID NO: 95331 - DNA, 20 bp, Artificial Sequence
  Description of Artificial Sequence: Synthetic oligonucleotide
  Target: SCN9A; (+) strand; PAM type: YTN; PAM sequence: CTA
cctgacttcaaactatacta

SEQ ID NO: 95332 - DNA, 20 bp, Artificial Sequence
  Description of Artificial Sequence: Synthetic oligonucleotide
  Target: SCN9A; (+) strand; PAM type: YTN; PAM sequence: CTG
acttcaaactatactacaag

SEQ ID NO: 95333 - DNA, 20 bp, Artificial Sequence
  Description of Artificial Sequence: Synthetic oligonucleotide
  Target: SCN9A; (+) strand; PAM type: YTN; PAM sequence: CTT
caaactatactacaaggcta

SEQ ID NO: 95334 - DNA, 20 bp, Artificial Sequence
  Description of Artificial Sequence: Synthetic oligonucleotide
  Target: SCN9A; (+) strand; PAM type: YTN; PAM sequence: TTC
aaactatactacaaggctac

SEQ ID NO: 95335 - DNA, 20 bp, Artificial Sequence
  Description of Artificial Sequence: Synthetic oligonucleotide
  Target: SCN9A; (+) strand; PAM type: YTN; PAM sequence: CTA
tactacaaggctacagtaac

SEQ ID NO: 95336 - DNA, 20 bp, Artificial Sequence
  Description of Artificial Sequence: Synthetic oligonucleotide
  Target: SCN9A; (+) strand; PAM type: YTN; PAM sequence: CTA
caaggctacagtaaccaaaa

SEQ ID NO: 95337 - DNA, 20 bp, Artificial Sequence
  Description of Artificial Sequence: Synthetic oligonucleotide
  Target: SCN9A; (+) strand; PAM type: YTN; PAM sequence: CTA
cagtaaccaaaacagcatgg

SEQ ID NO: 95338 - DNA, 20 bp, Artificial Sequence
  Description of Artificial Sequence: Synthetic oligonucleotide
  Target: SCN9A; (+) strand; PAM type: YTN; PAM sequence: CTG
gtaccaaaacagatacatac

SEQ ID NO: 95339 - DNA, 20 bp, Artificial Sequence
  Description of Artificial Sequence: Synthetic oligonucleotide
  Target: SCN9A; (+) strand; PAM type: YTN; PAM sequence: CTC
agaaataacactacacatct

SEQ ID NO: 95340 - DNA, 20 bp, Artificial Sequence
  Description of Artificial Sequence: Synthetic oligonucleotide
  Target: SCN9A; (+) strand; PAM type: YTN; PAM sequence: CTA
cacatctacaaccatctgat

SEQ ID NO: 95341 - DNA, 20 bp, Artificial Sequence
  Description of Artificial Sequence: Synthetic oligonucleotide
  Target: SCN9A; (+) strand; PAM type: YTN; PAM sequence: CTA
caaccatctgatccttgaca

SEQ ID NO: 95342 - DNA, 20 bp, Artificial Sequence
  Description of Artificial Sequence: Synthetic oligonucleotide
  Target: SCN9A; (+) strand; PAM type: YTN; PAM sequence: CTG
atccttgacaaacctcacaa

SEQ ID NO: 95343 - DNA, 20 bp, Artificial Sequence
  Description of Artificial Sequence: Synthetic oligonucleotide
  Target: SCN9A; (+) strand; PAM type: YTN; PAM sequence: CTT
gacaaacctcacaaaaacaa

SEQ ID NO: 95344 - DNA, 20 bp, Artificial Sequence
  Description of Artificial Sequence: Synthetic oligonucleotide
  Target: SCN9A; (+) strand; PAM type: YTN; PAM sequence: TTG
acaaacctcacaaaaacaag

SEQ ID NO: 95345 - DNA, 20 bp, Artificial Sequence
  Description of Artificial Sequence: Synthetic oligonucleotide
  Target: SCN9A; (+) strand; PAM type: YTN; PAM sequence: CTC
acaaaaacaagcaacgggga

SEQ ID NO: 95346 - DNA, 20 bp, Artificial Sequence
  Description of Artificial Sequence: Synthetic oligonucleotide
  Target: SCN9A; (+) strand; PAM type: YTN; PAM sequence: CTT
ccctatttaataaatgatgc

SEQ ID NO: 95347 - DNA, 20 bp, Artificial Sequence
  Description of Artificial Sequence: Synthetic oligonucleotide
  Target: SCN9A; (+) strand; PAM type: YTN; PAM sequence: TTC
cctatttaataaatgatgct

SEQ ID NO: 95348 - DNA, 20 bp, Artificial Sequence
  Description of Artificial Sequence: Synthetic oligonucleotide
  Target: SCN9A; (+) strand; PAM type: YTN; PAM sequence: CTA
tttaataaatgatgctggga

SEQ ID NO: 95349 - DNA, 20 bp, Artificial Sequence
  Description of Artificial Sequence: Synthetic oligonucleotide
  Target: SCN9A; (+) strand; PAM type: YTN; PAM sequence: TTT
aataaatgatgctgggaaaa

SEQ ID NO: 95350 - DNA, 20 bp, Artificial Sequence
  Description of Artificial Sequence: Synthetic oligonucleotide
  Target: SCN9A; (+) strand; PAM type: YTN; PAM sequence: TTA
ataaatgatgctgggaaaac

SEQ ID NO: 95351 - DNA, 20 bp, Artificial Sequence
  Description of Artificial Sequence: Synthetic oligonucleotide
  Target: SCN9A; (+) strand; PAM type: YTN; PAM sequence: CTG
ggaaaactggctagccatat

SEQ ID NO: 95352 - DNA, 20 bp, Artificial Sequence
  Description of Artificial Sequence: Synthetic oligonucleotide
  Target: SCN9A; (+) strand; PAM type: YTN; PAM sequence: CTG
gctagccatatgtagaaagt

SEQ ID NO: 95353 - DNA, 20 bp, Artificial Sequence
  Description of Artificial Sequence: Synthetic oligonucleotide
  Target: SCN9A; (+) strand; PAM type: YTN; PAM sequence: CTA
gccatatgtagaaagttgaa

SEQ ID NO: 95354 - DNA, 20 bp, Artificial Sequence
  Description of Artificial Sequence: Synthetic oligonucleotide
  Target: SCN9A; (+) strand; PAM type: YTN; PAM sequence: TTG
aaactggatcccttccttac

SEQ ID NO: 95355 - DNA, 20 bp, Artificial Sequence
  Description of Artificial Sequence: Synthetic oligonucleotide
  Target: SCN9A; (+) strand; PAM type: YTN; PAM sequence: CTG
gatcccttccttacaccttg

SEQ ID NO: 95356 - DNA, 20 bp, Artificial Sequence
  Description of Artificial Sequence: Synthetic oligonucleotide
  Target: SCN9A; (+) strand; PAM type: YTN; PAM sequence: CTT
ccttacaccttgtacaaaaa

SEQ ID NO: 95357 - DNA, 20 bp, Artificial Sequence
  Description of Artificial Sequence: Synthetic oligonucleotide
  Target: SCN9A; (+) strand; PAM type: YTN; PAM sequence: TTC
cttacaccttgtacaaaaat

SEQ ID NO: 95358 - DNA, 20 bp, Artificial Sequence
  Description of Artificial Sequence: Synthetic oligonucleotide
  Target: SCN9A; (+) strand; PAM type: YTN; PAM sequence: CTT
acaccttgtacaaaaattaa

SEQ ID NO: 95359 - DNA, 20 bp, Artificial Sequence
  Description of Artificial Sequence: Synthetic oligonucleotide
  Target: SCN9A; (+) strand; PAM type: YTN; PAM sequence: TTA
caccttgtacaaaaattaac

SEQ ID NO: 95360 - DNA, 20 bp, Artificial Sequence
  Description of Artificial Sequence: Synthetic oligonucleotide
  Target: SCN9A; (+) strand; PAM type: YTN; PAM sequence: CTT
gtacaaaaattaactcaaga

SEQ ID NO: 95361 - DNA, 20 bp, Artificial Sequence
  Description of Artificial Sequence: Synthetic oligonucleotide
  Target: SCN9A; (+) strand; PAM type: YTN; PAM sequence: TTG
tacaaaaattaactcaagat

SEQ ID NO: 95362 - DNA, 20 bp, Artificial Sequence
  Description of Artificial Sequence: Synthetic oligonucleotide
  Target: SCN9A; (+) strand; PAM type: YTN; PAM sequence: TTA
actcaagatggattaaagac

SEQ ID NO: 95363 - DNA, 20 bp, Artificial Sequence
  Description of Artificial Sequence: Synthetic oligonucleotide
  Target: SCN9A; (+) strand; PAM type: YTN; PAM sequence: CTC
aagatggattaaagacttaa

SEQ ID NO: 95364 - DNA, 20 bp, Artificial Sequence
  Description of Artificial Sequence: Synthetic oligonucleotide
  Target: SCN9A; (+) strand; PAM type: YTN; PAM sequence: TTA
aagacttaaatgtaagacct

SEQ ID NO: 95365 - DNA, 20 bp, Artificial Sequence
  Description of Artificial Sequence: Synthetic oligonucleotide
  Target: SCN9A; (+) strand; PAM type: YTN; PAM sequence: CTT
aaatgtaagacctaaaacca

SEQ ID NO: 95366 - DNA, 20 bp, Artificial Sequence
  Description of Artificial Sequence: Synthetic oligonucleotide
  Target: SCN9A; (+) strand; PAM type: YTN; PAM sequence: TTA
aatgtaagacctaaaaccat

SEQ ID NO: 95367 - DNA, 20 bp, Artificial Sequence
  Description of Artificial Sequence: Synthetic oligonucleotide
  Target: SCN9A; (+) strand; PAM type: YTN; PAM sequence: CTA
aaaccataaaaaccctagaa

SEQ ID NO: 95368 - DNA, 20 bp, Artificial Sequence
  Description of Artificial Sequence: Synthetic oligonucleotide
  Target: SCN9A; (+) strand; PAM type: YTN; PAM sequence: CTA
gaagaaactctaggcaatat

SEQ ID NO: 95369 - DNA, 20 bp, Artificial Sequence
  Description of Artificial Sequence: Synthetic oligonucleotide
  Target: SCN9A; (+) strand; PAM type: YTN; PAM sequence: CTC
taggcaatatcattcaggac

SEQ ID NO: 95370 - DNA, 20 bp, Artificial Sequence
  Description of Artificial Sequence: Synthetic oligonucleotide
  Target: SCN9A; (+) strand; PAM type: YTN; PAM sequence: CTA
ggcaatatcattcaggacat

SEQ ID NO: 95371 - DNA, 20 bp, Artificial Sequence
  Description of Artificial Sequence: Synthetic oligonucleotide
  Target: SCN9A; (+) strand; PAM type: YTN; PAM sequence: TTC
aggacataggcatgggcaaa

SEQ ID NO: 95372 - DNA, 20 bp, Artificial Sequence
  Description of Artificial Sequence: Synthetic oligonucleotide
  Target: SCN9A; (+) strand; PAM type: YTN; PAM sequence: CTT
catgactaaaacaccaaaag

SEQ ID NO: 95373 - DNA, 20 bp, Artificial Sequence
  Description of Artificial Sequence: Synthetic oligonucleotide
  Target: SCN9A; (+) strand; PAM type: YTN; PAM sequence: TTC
atgactaaaacaccaaaagc

SEQ ID NO: 95374 - DNA, 20 bp, Artificial Sequence
  Description of Artificial Sequence: Synthetic oligonucleotide
  Target: SCN9A; (+) strand; PAM type: YTN; PAM sequence: CTA
aaacaccaaaagcaatggca

SEQ ID NO: 95375 - DNA, 20 bp, Artificial Sequence
  Description of Artificial Sequence: Synthetic oligonucleotide
  Target: SCN9A; (+) strand; PAM type: YTN; PAM sequence: CTA
attaaactaaagagcttctg

SEQ ID NO: 95376 - DNA, 20 bp, Artificial Sequence
  Description of Artificial Sequence: Synthetic oligonucleotide
  Target: SCN9A; (+) strand; PAM type: YTN; PAM sequence: TTA
aactaaagagcttctgcaaa

SEQ ID NO: 95377 - DNA, 20 bp, Artificial Sequence
  Description of Artificial Sequence: Synthetic oligonucleotide
  Target: SCN9A; (+) strand; PAM type: YTN; PAM sequence: CTA
aagagcttctgcaaagcaaa

SEQ ID NO: 95378 - DNA, 20 bp, Artificial Sequence
  Description of Artificial Sequence: Synthetic oligonucleotide
  Target: SCN9A; (+) strand; PAM type: YTN; PAM sequence: CTT
ctgcaaagcaaaagaaacta

SEQ ID NO: 95379 - DNA, 20 bp, Artificial Sequence
  Description of Artificial Sequence: Synthetic oligonucleotide
  Target: SCN9A; (+) strand; PAM type: YTN; PAM sequence: TTC
tgcaaagcaaaagaaactat

SEQ ID NO: 95380 - DNA, 20 bp, Artificial Sequence
  Description of Artificial Sequence: Synthetic oligonucleotide
  Target: SCN9A; (+) strand; PAM type: YTN; PAM sequence: CTG
caaagcaaaagaaactatca

SEQ ID NO: 95381 - DNA, 20 bp, Artificial Sequence
  Description of Artificial Sequence: Synthetic oligonucleotide
  Target: SCN9A; (+) strand; PAM type: YTN; PAM sequence: CTA
tcatcagagtgaacaggcaa

SEQ ID NO: 95382 - DNA, 20 bp, Artificial Sequence
  Description of Artificial Sequence: Synthetic oligonucleotide
  Target: SCN9A; (+) strand; PAM type: YTN; PAM sequence: CTA
cagaatgggagaaaattttt

SEQ ID NO: 95383 - DNA, 20 bp, Artificial Sequence
  Description of Artificial Sequence: Synthetic oligonucleotide
  Target: SCN9A; (+) strand; PAM type: YTN; PAM sequence: TTT
ttgcaatttatccatctgac

SEQ ID NO: 95384 - DNA, 20 bp, Artificial Sequence
  Description of Artificial Sequence: Synthetic oligonucleotide
  Target: SCN9A; (+) strand; PAM type: YTN; PAM sequence: TTT
tgcaatttatccatctgaca

SEQ ID NO: 95385 - DNA, 20 bp, Artificial Sequence
  Description of Artificial Sequence: Synthetic oligonucleotide
  Target: SCN9A; (+) strand; PAM type: YTN; PAM sequence: TTT
gcaatttatccatctgacaa

SEQ ID NO: 95386 - DNA, 20 bp, Artificial Sequence
  Description of Artificial Sequence: Synthetic oligonucleotide
  Target: SCN9A; (+) strand; PAM type: YTN; PAM sequence: TTG
caatttatccatctgacaaa

SEQ ID NO: 95387 - DNA, 20 bp, Artificial Sequence
  Description of Artificial Sequence: Synthetic oligonucleotide
  Target: SCN9A; (+) strand; PAM type: YTN; PAM sequence: TTT
atccatctgacaaaagggct

SEQ ID NO: 95388 - DNA, 20 bp, Artificial Sequence
  Description of Artificial Sequence: Synthetic oligonucleotide
  Target: SCN9A; (+) strand; PAM type: YTN; PAM sequence: TTA
tccatctgacaaaagggcta

SEQ ID NO: 95389 - DNA, 20 bp, Artificial Sequence
  Description of Artificial Sequence: Synthetic oligonucleotide
  Target: SCN9A; (+) strand; PAM type: YTN; PAM sequence: CTG
acaaaagggctaatatccag

SEQ ID NO: 95390 - DNA, 20 bp, Artificial Sequence
  Description of Artificial Sequence: Synthetic oligonucleotide
  Target: SCN9A; (+) strand; PAM type: YTN; PAM sequence: CTA
atatccagaatctacaaaga

SEQ ID NO: 95391 - DNA, 20 bp, Artificial Sequence
  Description of Artificial Sequence: Synthetic oligonucleotide
  Target: SCN9A; (+) strand; PAM type: YTN; PAM sequence: CTA
caaagaacttaaacaaattt

SEQ ID NO: 95392 - DNA, 20 bp, Artificial Sequence
  Description of Artificial Sequence: Synthetic oligonucleotide
  Target: SCN9A; (+) strand; PAM type: YTN; PAM sequence: CTT
aaacaaatttacaagaaaaa

SEQ ID NO: 95393 - DNA, 20 bp, Artificial Sequence
  Description of Artificial Sequence: Synthetic oligonucleotide
  Target: SCN9A; (+) strand; PAM type: YTN; PAM sequence: TTA
aacaaatttacaagaaaaaa

SEQ ID NO: 95394 - DNA, 20 bp, Artificial Sequence
  Description of Artificial Sequence: Synthetic oligonucleotide
  Target: SCN9A; (+) strand; PAM type: YTN; PAM sequence: TTT
acaagaaaaaaacaaacaac

SEQ ID NO: 95395 - DNA, 20 bp, Artificial Sequence
  Description of Artificial Sequence: Synthetic oligonucleotide
  Target: SCN9A; (+) strand; PAM type: YTN; PAM sequence: TTA
caagaaaaaaacaaacaact

SEQ ID NO: 95396 - DNA, 20 bp, Artificial Sequence
  Description of Artificial Sequence: Synthetic oligonucleotide
  Target: SCN9A; (+) strand; PAM type: YTN; PAM sequence: CTC
catcaaaaagtgggcaaagg

SEQ ID NO: 95397 - DNA, 20 bp, Artificial Sequence
  Description of Artificial Sequence: Synthetic oligonucleotide
  Target: SCN9A; (+) strand; PAM type: YTN; PAM sequence: CTT
ctcaaaagaagacatttatg

SEQ ID NO: 95398 - DNA, 20 bp, Artificial Sequence
  Description of Artificial Sequence: Synthetic oligonucleotide
  Target: SCN9A; (+) strand; PAM type: YTN; PAM sequence: TTC
tcaaaagaagacatttatgc

SEQ ID NO: 95399 - DNA, 20 bp, Artificial Sequence
  Description of Artificial Sequence: Synthetic oligonucleotide
  Target: SCN9A; (+) strand; PAM type: YTN; PAM sequence: CTC
aaaagaagacatttatgcag

SEQ ID NO: 95400 - DNA, 20 bp, Artificial Sequence
  Description of Artificial Sequence: Synthetic oligonucleotide
  Target: SCN9A; (+) strand; PAM type: YTN; PAM sequence: TTT
atgcagccaacagacatatg

SEQ ID NO: 95401 - DNA, 20 bp, Artificial Sequence
  Description of Artificial Sequence: Synthetic oligonucleotide
  Target: SCN9A; (+) strand; PAM type: YTN; PAM sequence: TTA
tgcagccaacagacatatga

SEQ ID NO: 95402 - DNA, 20 bp, Artificial Sequence
  Description of Artificial Sequence: Synthetic oligonucleotide
  Target: SCN9A; (+) strand; PAM type: YTN; PAM sequence: CTC
atcatcactggtcatcagag

SEQ ID NO: 95403 - DNA, 20 bp, Artificial Sequence
  Description of Artificial Sequence: Synthetic oligonucleotide
  Target: SCN9A; (+) strand; PAM type: YTN; PAM sequence: CTG
gtcatcagagaaacacaaat

SEQ ID NO: 95404 - DNA, 20 bp, Artificial Sequence
  Description of Artificial Sequence: Synthetic oligonucleotide
  Target: SCN9A; (+) strand; PAM type: YTN; PAM sequence: CTC
atgccaattagaatggcaat

SEQ ID NO: 95405 - DNA, 20 bp, Artificial Sequence
  Description of Artificial Sequence: Synthetic oligonucleotide
  Target: SCN9A; (+) strand; PAM type: YTN; PAM sequence: TTA
gaatggcaatcactaaaaag

SEQ ID NO: 95406 - DNA, 20 bp, Artificial Sequence
  Description of Artificial Sequence: Synthetic oligonucleotide
  Target: SCN9A; (+) strand; PAM type: YTN; PAM sequence: CTA
aaaagtcaggaaacaacaga

SEQ ID NO: 95407 - DNA, 20 bp, Artificial Sequence
  Description of Artificial Sequence: Synthetic oligonucleotide
  Target: SCN9A; (+) strand; PAM type: YTN; PAM sequence: TTG
gagaggatgtggagaaatag

SEQ ID NO: 95408 - DNA, 20 bp, Artificial Sequence
  Description of Artificial Sequence: Synthetic oligonucleotide
  Target: SCN9A; (+) strand; PAM type: YTN; PAM sequence: CTT
ttacactgttggtgagagtg

SEQ ID NO: 95409 - DNA, 20 bp, Artificial Sequence
  Description of Artificial Sequence: Synthetic oligonucleotide
  Target: SCN9A; (+) strand; PAM type: YTN; PAM sequence: TTT
tacactgttggtgagagtgt

SEQ ID NO: 95410 - DNA, 20 bp, Artificial Sequence
  Description of Artificial Sequence: Synthetic oligonucleotide
  Target: SCN9A; (+) strand; PAM type: YTN; PAM sequence: TTT
acactgttggtgagagtgta

SEQ ID NO: 95411 - DNA, 20 bp, Artificial Sequence
  Description of Artificial Sequence: Synthetic oligonucleotide
  Target: SCN9A; (+) strand; PAM type: YTN; PAM sequence: TTA
cactgttggtgagagtgtaa

SEQ ID NO: 95412 - DNA, 20 bp, Artificial Sequence
  Description of Artificial Sequence: Synthetic oligonucleotide
  Target: SCN9A; (+) strand; PAM type: YTN; PAM sequence: CTG
ttggtgagagtgtaaaatag

SEQ ID NO: 95413 - DNA, 20 bp, Artificial Sequence
  Description of Artificial Sequence: Synthetic oligonucleotide
  Target: SCN9A; (+) strand; PAM type: YTN; PAM sequence: TTG
gtgagagtgtaaaatagttc

SEQ ID NO: 95414 - DNA, 20 bp, Artificial Sequence
  Description of Artificial Sequence: Synthetic oligonucleotide
  Target: SCN9A; (+) strand; PAM type: YTN; PAM sequence: TTC
aaccattgtggaagacagtg

SEQ ID NO: 95415 - DNA, 20 bp, Artificial Sequence
  Description of Artificial Sequence: Synthetic oligonucleotide
  Target: SCN9A; (+) strand; PAM type: YTN; PAM sequence: TTG
tggaagacagtgtgatgatt

SEQ ID NO: 95416 - DNA, 20 bp, Artificial Sequence
  Description of Artificial Sequence: Synthetic oligonucleotide
  Target: SCN9A; (+) strand; PAM type: YTN; PAM sequence: TTC
ctcaagaatctaaaactaga

SEQ ID NO: 95417 - DNA, 20 bp, Artificial Sequence
  Description of Artificial Sequence: Synthetic oligonucleotide
  Target: SCN9A; (+) strand; PAM type: YTN; PAM sequence: CTC
aagaatctaaaactagaaat

SEQ ID NO: 95418 - DNA, 20 bp, Artificial Sequence
  Description of Artificial Sequence: Synthetic oligonucleotide
  Target: SCN9A; (+) strand; PAM type: YTN; PAM sequence: CTA
aaactagaaataccatttga

SEQ ID NO: 95419 - DNA, 20 bp, Artificial Sequence
  Description of Artificial Sequence: Synthetic oligonucleotide
  Target: SCN9A; (+) strand; PAM type: YTN; PAM sequence: CTA
gaaataccatttgacccagc

SEQ ID NO: 95420 - DNA, 20 bp, Artificial Sequence
  Description of Artificial Sequence: Synthetic oligonucleotide
  Target: SCN9A; (+) strand; PAM type: YTN; PAM sequence: TTT
gacccagcaatctcattact

SEQ ID NO: 95421 - DNA, 20 bp, Artificial Sequence
  Description of Artificial Sequence: Synthetic oligonucleotide
  Target: SCN9A; (+) strand; PAM type: YTN; PAM sequence: TTG
acccagcaatctcattactg

SEQ ID NO: 95422 - DNA, 20 bp, Artificial Sequence
  Description of Artificial Sequence: Synthetic oligonucleotide
  Target: SCN9A; (+) strand; PAM type: YTN; PAM sequence: CTC
attactgggtatatactcaa

SEQ ID NO: 95423 - DNA, 20 bp, Artificial Sequence
  Description of Artificial Sequence: Synthetic oligonucleotide
  Target: SCN9A; (+) strand; PAM type: YTN; PAM sequence: TTA
ctgggtatatactcaaggga

SEQ ID NO: 95424 - DNA, 20 bp, Artificial Sequence
  Description of Artificial Sequence: Synthetic oligonucleotide
  Target: SCN9A; (+) strand; PAM type: YTN; PAM sequence: CTG
ggtatatactcaagggattg

SEQ ID NO: 95425 - DNA, 20 bp, Artificial Sequence
  Description of Artificial Sequence: Synthetic oligonucleotide
  Target: SCN9A; (+) strand; PAM type: YTN; PAM sequence: CTC
aagggattgtaaatcatgct

SEQ ID NO: 95426 - DNA, 20 bp, Artificial Sequence
  Description of Artificial Sequence: Synthetic oligonucleotide
  Target: SCN9A; (+) strand; PAM type: YTN; PAM sequence: TTG
taaatcatgctactataaag

SEQ ID NO: 95427 - DNA, 20 bp, Artificial Sequence
  Description of Artificial Sequence: Synthetic oligonucleotide
  Target: SCN9A; (+) strand; PAM type: YTN; PAM sequence: CTA
ctataaagacacatgcatat

SEQ ID NO: 95428 - DNA, 20 bp, Artificial Sequence
  Description of Artificial Sequence: Synthetic oligonucleotide
  Target: SCN9A; (+) strand; PAM type: YTN; PAM sequence: CTA
taaagacacatgcatatgta

SEQ ID NO: 95429 - DNA, 20 bp, Artificial Sequence
  Description of Artificial Sequence: Synthetic oligonucleotide
  Target: SCN9A; (+) strand; PAM type: YTN; PAM sequence: TTT
attgcagcactattcacaat

SEQ ID NO: 95430 - DNA, 20 bp, Artificial Sequence
  Description of Artificial Sequence: Synthetic oligonucleotide
  Target: SCN9A; (+) strand; PAM type: YTN; PAM sequence: TTA
ttgcagcactattcacaata

SEQ ID NO: 95431 - DNA, 20 bp, Artificial Sequence
  Description of Artificial Sequence: Synthetic oligonucleotide
  Target: SCN9A; (+) strand; PAM type: YTN; PAM sequence: TTG
cagcactattcacaatagca

SEQ ID NO: 95432 - DNA, 20 bp, Artificial Sequence
  Description of Artificial Sequence: Synthetic oligonucleotide
  Target: SCN9A; (+) strand; PAM type: YTN; PAM sequence: CTA
ttcacaatagcaaagacttg

SEQ ID NO: 95433 - DNA, 20 bp, Artificial Sequence
  Description of Artificial Sequence: Synthetic oligonucleotide
  Target: SCN9A; (+) strand; PAM type: YTN; PAM sequence: TTC
acaatagcaaagacttggaa

SEQ ID NO: 95434 - DNA, 20 bp, Artificial Sequence
  Description of Artificial Sequence: Synthetic oligonucleotide
  Target: SCN9A; (+) strand; PAM type: YTN; PAM sequence: CTT
ggaaccaacccaaatgtcca

SEQ ID NO: 95435 - DNA, 20 bp, Artificial Sequence
  Description of Artificial Sequence: Synthetic oligonucleotide
  Target: SCN9A; (+) strand; PAM type: YTN; PAM sequence: TTG
gaaccaacccaaatgtccat

SEQ ID NO: 95436 - DNA, 20 bp, Artificial Sequence
  Description of Artificial Sequence: Synthetic oligonucleotide
  Target: SCN9A; (+) strand; PAM type: YTN; PAM sequence: CTG
gataaagaaaatgtggcata

SEQ ID NO: 95437 - DNA, 20 bp, Artificial Sequence
  Description of Artificial Sequence: Synthetic oligonucleotide
  Target: SCN9A; (+) strand; PAM type: YTN; PAM sequence: CTA
tgcagccataaaaaaggatg

SEQ ID NO: 95438 - DNA, 20 bp, Artificial Sequence
  Description of Artificial Sequence: Synthetic oligonucleotide
  Target: SCN9A; (+) strand; PAM type: YTN; PAM sequence: TTC
atgtcctttgtagggacatg

SEQ ID NO: 95439 - DNA, 20 bp, Artificial Sequence
  Description of Artificial Sequence: Synthetic oligonucleotide
  Target: SCN9A; (+) strand; PAM type: YTN; PAM sequence: CTT
tgtagggacatgcatgaagc

SEQ ID NO: 95440 - DNA, 20 bp, Artificial Sequence
  Description of Artificial Sequence: Synthetic oligonucleotide
  Target: SCN9A; (+) strand; PAM type: YTN; PAM sequence: TTT
gtagggacatgcatgaagct

SEQ ID NO: 95441 - DNA, 20 bp, Artificial Sequence
  Description of Artificial Sequence: Synthetic oligonucleotide
  Target: SCN9A; (+) strand; PAM type: YTN; PAM sequence: TTG
tagggacatgcatgaagctg

SEQ ID NO: 95442 - DNA, 20 bp, Artificial Sequence
  Description of Artificial Sequence: Synthetic oligonucleotide
  Target: SCN9A; (+) strand; PAM type: YTN; PAM sequence: CTG
gaaaccatcattctcagcaa

SEQ ID NO: 95443 - DNA, 20 bp, Artificial Sequence
  Description of Artificial Sequence: Synthetic oligonucleotide
  Target: SCN9A; (+) strand; PAM type: YTN; PAM sequence: TTC
tcagcaaaatatcacaagga

SEQ ID NO: 95444 - DNA, 20 bp, Artificial Sequence
  Description of Artificial Sequence: Synthetic oligonucleotide
  Target: SCN9A; (+) strand; PAM type: YTN; PAM sequence: CTC
agcaaaatatcacaaggacg

SEQ ID NO: 95445 - DNA, 20 bp, Artificial Sequence
  Description of Artificial Sequence: Synthetic oligonucleotide
  Target: SCN9A; (+) strand; PAM type: YTN; PAM sequence: CTC
tgcatgttctcactcataag

SEQ ID NO: 95446 - DNA, 20 bp, Artificial Sequence
  Description of Artificial Sequence: Synthetic oligonucleotide
  Target: SCN9A; (+) strand; PAM type: YTN; PAM sequence: CTG
catgttctcactcataagtg

SEQ ID NO: 95447 - DNA, 20 bp, Artificial Sequence
  Description of Artificial Sequence: Synthetic oligonucleotide
  Target: SCN9A; (+) strand; PAM type: YTN; PAM sequence: TTC
tcactcataagtgggagttg

SEQ ID NO: 95448 - DNA, 20 bp, Artificial Sequence
  Description of Artificial Sequence: Synthetic oligonucleotide
  Target: SCN9A; (+) strand; PAM type: YTN; PAM sequence: CTC
actcataagtgggagttgaa

SEQ ID NO: 95449 - DNA, 20 bp, Artificial Sequence
  Description of Artificial Sequence: Synthetic oligonucleotide
  Target: SCN9A; (+) strand; PAM type: YTN; PAM sequence: CTC
ataagtgggagttgaacaat

SEQ ID NO: 95450 - DNA, 20 bp, Artificial Sequence
  Description of Artificial Sequence: Synthetic oligonucleotide
  Target: SCN9A; (+) strand; PAM type: YTN; PAM sequence: TTG
aacaatgagaacacatggac

SEQ ID NO: 95451 - DNA, 20 bp, Artificial Sequence
  Description of Artificial Sequence: Synthetic oligonucleotide
  Target: SCN9A; (+) strand; PAM type: YTN; PAM sequence: TTA
gggggttgggagctttggga

SEQ ID NO: 95452 - DNA, 20 bp, Artificial Sequence
  Description of Artificial Sequence: Synthetic oligonucleotide
  Target: SCN9A; (+) strand; PAM type: YTN; PAM sequence: TTG
ggagctttgggagggattac

SEQ ID NO: 95453 - DNA, 20 bp, Artificial Sequence
  Description of Artificial Sequence: Synthetic oligonucleotide
  Target: SCN9A; (+) strand; PAM type: YTN; PAM sequence: CTT
tgggagggattacttaggag

SEQ ID NO: 95454 - DNA, 20 bp, Artificial Sequence
  Description of Artificial Sequence: Synthetic oligonucleotide
  Target: SCN9A; (+) strand; PAM type: YTN; PAM sequence: TTT
gggagggattacttaggaga

SEQ ID NO: 95455 - DNA, 20 bp, Artificial Sequence
  Description of Artificial Sequence: Synthetic oligonucleotide
  Target: SCN9A; (+) strand; PAM type: YTN; PAM sequence: TTG
ggagggattacttaggagaa

SEQ ID NO: 95456 - DNA, 20 bp, Artificial Sequence
  Description of Artificial Sequence: Synthetic oligonucleotide
  Target: SCN9A; (+) strand; PAM type: YTN; PAM sequence: TTA
cttaggagaaatacctaatg

SEQ ID NO: 95457 - DNA, 20 bp, Artificial Sequence
  Description of Artificial Sequence: Synthetic oligonucleotide
  Target: SCN9A; (+) strand; PAM type: YTN; PAM sequence: CTT
aggagaaatacctaatgtaa

SEQ ID NO: 95458 - DNA, 20 bp, Artificial Sequence
  Description of Artificial Sequence: Synthetic oligonucleotide
  Target: SCN9A; (+) strand; PAM type: YTN; PAM sequence: TTA
ggagaaatacctaatgtaaa

SEQ ID NO: 95459 - DNA, 20 bp, Artificial Sequence
  Description of Artificial Sequence: Synthetic oligonucleotide
  Target: SCN9A; (+) strand; PAM type: YTN; PAM sequence: CTA
atgtaaatgatgagttgatt

SEQ ID NO: 95460 - DNA, 20 bp, Artificial Sequence
  Description of Artificial Sequence: Synthetic oligonucleotide
  Target: SCN9A; (+) strand; PAM type: YTN; PAM sequence: TTG
attggtgcagcaaaccaaca

SEQ ID NO: 95461 - DNA, 20 bp, Artificial Sequence
  Description of Artificial Sequence: Synthetic oligonucleotide
  Target: SCN9A; (+) strand; PAM type: YTN; PAM sequence: TTG
gtgcagcaaaccaacatggt

SEQ ID NO: 95462 - DNA, 20 bp, Artificial Sequence
  Description of Artificial Sequence: Synthetic oligonucleotide
  Target: SCN9A; (+) strand; PAM type: YTN; PAM sequence: CTA
tgtaacaaacctgcatgttt

SEQ ID NO: 95463 - DNA, 20 bp, Artificial Sequence
  Description of Artificial Sequence: Synthetic oligonucleotide
  Target: SCN9A; (+) strand; PAM type: YTN; PAM sequence: CTG
catgttttgcacatgtaccc

SEQ ID NO: 95464 - DNA, 20 bp, Artificial Sequence
  Description of Artificial Sequence: Synthetic oligonucleotide
  Target: SCN9A; (+) strand; PAM type: YTN; PAM sequence: TTT
tgcacatgtaccctagaact

SEQ ID NO: 95465 - DNA, 20 bp, Artificial Sequence
  Description of Artificial Sequence: Synthetic oligonucleotide
  Target: SCN9A; (+) strand; PAM type: YTN; PAM sequence: TTT
gcacatgtaccctagaactt

SEQ ID NO: 95466 - DNA, 20 bp, Artificial Sequence
  Description of Artificial Sequence: Synthetic oligonucleotide
  Target: SCN9A; (+) strand; PAM type: YTN; PAM sequence: TTG
cacatgtaccctagaactta

SEQ ID NO: 95467 - DNA, 20 bp, Artificial Sequence
  Description of Artificial Sequence: Synthetic oligonucleotide
  Target: SCN9A; (+) strand; PAM type: YTN; PAM sequence: CTA
gaacttaaagtataataata

SEQ ID NO: 95468 - DNA, 20 bp, Artificial Sequence
  Description of Artificial Sequence: Synthetic oligonucleotide
  Target: SCN9A; (+) strand; PAM type: YTN; PAM sequence: CTT
aaagtataataataaaaaaa

SEQ ID NO: 95469 - DNA, 20 bp, Artificial Sequence
  Description of Artificial Sequence: Synthetic oligonucleotide
  Target: SCN9A; (+) strand; PAM type: YTN; PAM sequence: TTA
aagtataataataaaaaaag

SEQ ID NO: 95470 - DNA, 20 bp, Artificial Sequence
  Description of Artificial Sequence: Synthetic oligonucleotide
  Target: SCN9A; (+) strand; PAM type: YTN; PAM sequence: CTA
catacaataaccaaaattgt

SEQ ID NO: 95471 - DNA, 20 bp, Artificial Sequence
  Description of Artificial Sequence: Synthetic oligonucleotide
  Target: SCN9A; (+) strand; PAM type: YTN; PAM sequence: TTG
tattaattttatattcattt

SEQ ID NO: 95472 - DNA, 20 bp, Artificial Sequence
  Description of Artificial Sequence: Synthetic oligonucleotide
  Target: SCN9A; (+) strand; PAM type: YTN; PAM sequence: TTA
attttatattcattttaata

SEQ ID NO: 95473 - DNA, 20 bp, Artificial Sequence
  Description of Artificial Sequence: Synthetic oligonucleotide
  Target: SCN9A; (+) strand; PAM type: YTN; PAM sequence: TTT
tatattcattttaatatacc

SEQ ID NO: 95474 - DNA, 20 bp, Artificial Sequence
  Description of Artificial Sequence: Synthetic oligonucleotide
  Target: SCN9A; (+) strand; PAM type: YTN; PAM sequence: TTT
atattcattttaatatacca

SEQ ID NO: 95475 - DNA, 20 bp, Artificial Sequence
  Description of Artificial Sequence: Synthetic oligonucleotide
  Target: SCN9A; (+) strand; PAM type: YTN; PAM sequence: TTA
tattcattttaatataccat

SEQ ID NO: 95476 - DNA, 20 bp, Artificial Sequence
  Description of Artificial Sequence: Synthetic oligonucleotide
  Target: SCN9A; (+) strand; PAM type: YTN; PAM sequence: TTC
attttaatataccattattc

SEQ ID NO: 95477 - DNA, 20 bp, Artificial Sequence
  Description of Artificial Sequence: Synthetic oligonucleotide
  Target: SCN9A; (+) strand; PAM type: YTN; PAM sequence: TTT
taatataccattattccttt

SEQ ID NO: 95478 - DNA, 20 bp, Artificial Sequence
  Description of Artificial Sequence: Synthetic oligonucleotide
  Target: SCN9A; (+) strand; PAM type: YTN; PAM sequence: TTT
aatataccattattccttta

SEQ ID NO: 95479 - DNA, 20 bp, Artificial Sequence
  Description of Artificial Sequence: Synthetic oligonucleotide
  Target: SCN9A; (+) strand; PAM type: YTN; PAM sequence: TTA
atataccattattcctttac

SEQ ID NO: 95480 - DNA, 20 bp, Artificial Sequence
  Description of Artificial Sequence: Synthetic oligonucleotide
  Target: SCN9A; (+) strand; PAM type: YTN; PAM sequence: TTA
ttcctttacataaaaaatga

SEQ ID NO: 95481 - DNA, 20 bp, Artificial Sequence
  Description of Artificial Sequence: Synthetic oligonucleotide
  Target: SCN9A; (+) strand; PAM type: YTN; PAM sequence: TTC
ctttacataaaaaatgaata

SEQ ID NO: 95482 - DNA, 20 bp, Artificial Sequence
  Description of Artificial Sequence: Synthetic oligonucleotide
  Target: SCN9A; (+) strand; PAM type: YTN; PAM sequence: CTT
tacataaaaaatgaatataa

SEQ ID NO: 95483 - DNA, 20 bp, Artificial Sequence
  Description of Artificial Sequence: Synthetic oligonucleotide
  Target: SCN9A; (+) strand; PAM type: YTN; PAM sequence: TTT
acataaaaaatgaatataaa

SEQ ID NO: 95484 - DNA, 20 bp, Artificial Sequence
  Description of Artificial Sequence: Synthetic oligonucleotide
  Target: SCN9A; (+) strand; PAM type: YTN; PAM sequence: TTA
cataaaaaatgaatataaac

SEQ ID NO: 95485 - DNA, 20 bp, Artificial Sequence
  Description of Artificial Sequence: Synthetic oligonucleotide
  Target: SCN9A; (+) strand; PAM type: YTN; PAM sequence: CTA
aaatgataatatacatttct

SEQ ID NO: 95486 - DNA, 20 bp, Artificial Sequence
  Description of Artificial Sequence: Synthetic oligonucleotide
  Target: SCN9A; (+) strand; PAM type: YTN; PAM sequence: TTT
ctatatctctatttcaagaa

SEQ ID NO: 95487 - DNA, 20 bp, Artificial Sequence
  Description of Artificial Sequence: Synthetic oligonucleotide
  Target: SCN9A; (+) strand; PAM type: YTN; PAM sequence: TTC
tatatctctatttcaagaaa

SEQ ID NO: 95488 - DNA, 20 bp, Artificial Sequence
  Description of Artificial Sequence: Synthetic oligonucleotide
  Target: SCN9A; (+) strand; PAM type: YTN; PAM sequence: CTA
tatctctatttcaagaaact

SEQ ID NO: 95489 - DNA, 20 bp, Artificial Sequence
  Description of Artificial Sequence: Synthetic oligonucleotide
  Target: SCN9A; (+) strand; PAM type: YTN; PAM sequence: CTC
tatttcaagaaactctttga

SEQ ID NO: 95490 - DNA, 20 bp, Artificial Sequence
  Description of Artificial Sequence: Synthetic oligonucleotide
  Target: SCN9A; (+) strand; PAM type: YTN; PAM sequence: CTA
tttcaagaaactctttgact

SEQ ID NO: 95491 - DNA, 20 bp, Artificial Sequence
  Description of Artificial Sequence: Synthetic oligonucleotide
  Target: SCN9A; (+) strand; PAM type: YTN; PAM sequence: TTT
caagaaactctttgactacc

SEQ ID NO: 95492 - DNA, 20 bp, Artificial Sequence
  Description of Artificial Sequence: Synthetic oligonucleotide
  Target: SCN9A; (+) strand; PAM type: YTN; PAM sequence: TTC
aagaaactctttgactacct

SEQ ID NO: 95493 - DNA, 20 bp, Artificial Sequence
  Description of Artificial Sequence: Synthetic oligonucleotide
  Target: SCN9A; (+) strand; PAM type: YTN; PAM sequence: CTC
tttgactacctttttaattc

SEQ ID NO: 95494 - DNA, 20 bp, Artificial Sequence
  Description of Artificial Sequence: Synthetic oligonucleotide
  Target: SCN9A; (+) strand; PAM type: YTN; PAM sequence: CTT
tgactacctttttaattcta

SEQ ID NO: 95495 - DNA, 20 bp, Artificial Sequence
  Description of Artificial Sequence: Synthetic oligonucleotide
  Target: SCN9A; (+) strand; PAM type: YTN; PAM sequence: TTT
gactacctttttaattctaa

SEQ ID NO: 95496 - DNA, 20 bp, Artificial Sequence
  Description of Artificial Sequence: Synthetic oligonucleotide
  Target: SCN9A; (+) strand; PAM type: YTN; PAM sequence: TTG
actacctttttaattctaaa

SEQ ID NO: 95497 - DNA, 20 bp, Artificial Sequence
  Description of Artificial Sequence: Synthetic oligonucleotide
  Target: SCN9A; (+) strand; PAM type: YTN; PAM sequence: CTA
cctttttaattctaaataaa

SEQ ID NO: 95498 - DNA, 20 bp, Artificial Sequence
  Description of Artificial Sequence: Synthetic oligonucleotide
  Target: SCN9A; (+) strand; PAM type: YTN; PAM sequence: CTT
tttaattctaaataaaggat

SEQ ID NO: 95499 - DNA, 20 bp, Artificial Sequence
  Description of Artificial Sequence: Synthetic oligonucleotide
  Target: SCN9A; (+) strand; PAM type: YTN; PAM sequence: TTT
ttaattctaaataaaggatt

SEQ ID NO: 95500 - DNA, 20 bp, Artificial Sequence
  Description of Artificial Sequence: Synthetic oligonucleotide
  Target: SCN9A; (+) strand; PAM type: YTN; PAM sequence: TTT
taattctaaataaaggattt

SEQ ID NO: 95501 - DNA, 20 bp, Artificial Sequence
  Description of Artificial Sequence: Synthetic oligonucleotide
  Target: SCN9A; (+) strand; PAM type: YTN; PAM sequence: TTT
aattctaaataaaggatttc

SEQ ID NO: 95502 - DNA, 20 bp, Artificial Sequence
  Description of Artificial Sequence: Synthetic oligonucleotide
  Target: SCN9A; (+) strand; PAM type: YTN; PAM sequence: TTA
attctaaataaaggatttca

SEQ ID NO: 95503 - DNA, 20 bp, Artificial Sequence
  Description of Artificial Sequence: Synthetic oligonucleotide
  Target: SCN9A; (+) strand; PAM type: YTN; PAM sequence: TTC
taaataaaggatttcaacat

SEQ ID NO: 95504 - DNA, 20 bp, Artificial Sequence
  Description of Artificial Sequence: Synthetic oligonucleotide
  Target: SCN9A; (+) strand; PAM type: YTN; PAM sequence: CTA
aataaaggatttcaacataa

SEQ ID NO: 95505 - DNA, 20 bp, Artificial Sequence
  Description of Artificial Sequence: Synthetic oligonucleotide
  Target: SCN9A; (+) strand; PAM type: YTN; PAM sequence: TTT
caacataaacactttattgg

SEQ ID NO: 95506 - DNA, 20 bp, Artificial Sequence
  Description of Artificial Sequence: Synthetic oligonucleotide
  Target: SCN9A; (+) strand; PAM type: YTN; PAM sequence: TTC
aacataaacactttattgga

SEQ ID NO: 95507 - DNA, 20 bp, Artificial Sequence
  Description of Artificial Sequence: Synthetic oligonucleotide
  Target: SCN9A; (+) strand; PAM type: YTN; PAM sequence: CTT
tattggatgtcaacattatc

SEQ ID NO: 95508 - DNA, 20 bp, Artificial Sequence
  Description of Artificial Sequence: Synthetic oligonucleotide
  Target: SCN9A; (+) strand; PAM type: YTN; PAM sequence: TTT
attggatgtcaacattatcc

SEQ ID NO: 95509 - DNA, 20 bp, Artificial Sequence
  Description of Artificial Sequence: Synthetic oligonucleotide
  Target: SCN9A; (+) strand; PAM type: YTN; PAM sequence: TTA
ttggatgtcaacattatcct

SEQ ID NO: 95510 - DNA, 20 bp, Artificial Sequence
  Description of Artificial Sequence: Synthetic oligonucleotide
  Target: SCN9A; (+) strand; PAM type: YTN; PAM sequence: TTG
gatgtcaacattatccttga

SEQ ID NO: 95511 - DNA, 20 bp, Artificial Sequence
  Description of Artificial Sequence: Synthetic oligonucleotide
  Target: SCN9A; (+) strand; PAM type: YTN; PAM sequence: TTA
tccttgatagatttctaggt

SEQ ID NO: 95512 - DNA, 20 bp, Artificial Sequence
  Description of Artificial Sequence: Synthetic oligonucleotide
  Target: SCN9A; (+) strand; PAM type: YTN; PAM sequence: CTT
gatagatttctaggtactga

SEQ ID NO: 95513 - DNA, 20 bp, Artificial Sequence
  Description of Artificial Sequence: Synthetic oligonucleotide
  Target: SCN9A; (+) strand; PAM type: YTN; PAM sequence: TTG
atagatttctaggtactgag

SEQ ID NO: 95514 - DNA, 20 bp, Artificial Sequence
  Description of Artificial Sequence: Synthetic oligonucleotide
  Target: SCN9A; (+) strand; PAM type: YTN; PAM sequence: TTT
ctaggtactgaggaagttat

SEQ ID NO: 95515 - DNA, 20 bp, Artificial Sequence
  Description of Artificial Sequence: Synthetic oligonucleotide
  Target: SCN9A; (+) strand; PAM type: YTN; PAM sequence: TTC
taggtactgaggaagttatc

SEQ ID NO: 95516 - DNA, 20 bp, Artificial Sequence
  Description of Artificial Sequence: Synthetic oligonucleotide
  Target: SCN9A; (+) strand; PAM type: YTN; PAM sequence: CTA
ggtactgaggaagttatcaa

SEQ ID NO: 95517 - DNA, 20 bp, Artificial Sequence
  Description of Artificial Sequence: Synthetic oligonucleotide
  Target: SCN9A; (+) strand; PAM type: YTN; PAM sequence: CTG
aggaagttatcaattatcat

SEQ ID NO: 95518 - DNA, 20 bp, Artificial Sequence
  Description of Artificial Sequence: Synthetic oligonucleotide
  Target: SCN9A; (+) strand; PAM type: YTN; PAM sequence: TTA
tcaattatcatacccaaact

SEQ ID NO: 95519 - DNA, 20 bp, Artificial Sequence
  Description of Artificial Sequence: Synthetic oligonucleotide
  Target: SCN9A; (+) strand; PAM type: YTN; PAM sequence: TTA
tcatacccaaactgaaggac

SEQ ID NO: 95520 - DNA, 20 bp, Artificial Sequence
  Description of Artificial Sequence: Synthetic oligonucleotide
  Target: SCN9A; (+) strand; PAM type: YTN; PAM sequence: CTG
aaggactttccaattgatta

SEQ ID NO: 95521 - DNA, 20 bp, Artificial Sequence
  Description of Artificial Sequence: Synthetic oligonucleotide
  Target: SCN9A; (+) strand; PAM type: YTN; PAM sequence: CTT
tccaattgattacataaaag

SEQ ID NO: 95522 - DNA, 20 bp, Artificial Sequence
  Description of Artificial Sequence: Synthetic oligonucleotide
  Target: SCN9A; (+) strand; PAM type: YTN; PAM sequence: TTT
ccaattgattacataaaaga

SEQ ID NO: 95523 - DNA, 20 bp, Artificial Sequence
  Description of Artificial Sequence: Synthetic oligonucleotide
  Target: SCN9A; (+) strand; PAM type: YTN; PAM sequence: TTC
caattgattacataaaagaa

SEQ ID NO: 95524 - DNA, 20 bp, Artificial Sequence
  Description of Artificial Sequence: Synthetic oligonucleotide
  Target: SCN9A; (+) strand; PAM type: YTN; PAM sequence: TTG
attacataaaagaaaatata

SEQ ID NO: 95525 - DNA, 20 bp, Artificial Sequence
  Description of Artificial Sequence: Synthetic oligonucleotide
  Target: SCN9A; (+) strand; PAM type: YTN; PAM sequence: TTA
cataaaagaaaatataactt

SEQ ID NO: 95526 - DNA, 20 bp, Artificial Sequence
  Description of Artificial Sequence: Synthetic oligonucleotide
  Target: SCN9A; (+) strand; PAM type: YTN; PAM sequence: CTT
ttaaaattcaacagtaaata

SEQ ID NO: 95527 - DNA, 20 bp, Artificial Sequence
  Description of Artificial Sequence: Synthetic oligonucleotide
  Target: SCN9A; (+) strand; PAM type: YTN; PAM sequence: TTT
taaaattcaacagtaaataa

SEQ ID NO: 95528 - DNA, 20 bp, Artificial Sequence
  Description of Artificial Sequence: Synthetic oligonucleotide
  Target: SCN9A; (+) strand; PAM type: YTN; PAM sequence: TTT
aaaattcaacagtaaataac

SEQ ID NO: 95529 - DNA, 20 bp, Artificial Sequence
  Description of Artificial Sequence: Synthetic oligonucleotide
  Target: SCN9A; (+) strand; PAM type: YTN; PAM sequence: TTA
aaattcaacagtaaataaca

SEQ ID NO: 95530 - DNA, 20 bp, Artificial Sequence
  Description of Artificial Sequence: Synthetic oligonucleotide
  Target: SCN9A; (+) strand; PAM type: YTN; PAM sequence: TTC
aacagtaaataacataacat

SEQ ID NO: 95531 - DNA, 20 bp, Artificial Sequence
  Description of Artificial Sequence: Synthetic oligonucleotide
  Target: SCN9A; (+) strand; PAM type: YTN; PAM sequence: CTA
aatgaggtttttgactggaa

SEQ ID NO: 95532 - DNA, 20 bp, Artificial Sequence
  Description of Artificial Sequence: Synthetic oligonucleotide
  Target: SCN9A; (+) strand; PAM type: YTN; PAM sequence: TTT
ttgactggaaaagcctaaat

SEQ ID NO: 95533 - DNA, 20 bp, Artificial Sequence
  Description of Artificial Sequence: Synthetic oligonucleotide
  Target: SCN9A; (+) strand; PAM type: YTN; PAM sequence: TTT
tgactggaaaagcctaaatc

SEQ ID NO: 95534 - DNA, 20 bp, Artificial Sequence
  Description of Artificial Sequence: Synthetic oligonucleotide
  Target: SCN9A; (+) strand; PAM type: YTN; PAM sequence: TTT
gactggaaaagcctaaatct

SEQ ID NO: 95535 - DNA, 20 bp, Artificial Sequence
  Description of Artificial Sequence: Synthetic oligonucleotide
  Target: SCN9A; (+) strand; PAM type: YTN; PAM sequence: TTG
actggaaaagcctaaatctt

SEQ ID NO: 95536 - DNA, 20 bp, Artificial Sequence
  Description of Artificial Sequence: Synthetic oligonucleotide
  Target: SCN9A; (+) strand; PAM type: YTN; PAM sequence: CTG
gaaaagcctaaatcttacaa

SEQ ID NO: 95537 - DNA, 20 bp, Artificial Sequence
  Description of Artificial Sequence: Synthetic oligonucleotide
  Target: SCN9A; (+) strand; PAM type: YTN; PAM sequence: CTA
aatcttacaaaggggggcta

SEQ ID NO: 95538 - DNA, 20 bp, Artificial Sequence
  Description of Artificial Sequence: Synthetic oligonucleotide
  Target: SCN9A; (+) strand; PAM type: YTN; PAM sequence: CTT
acaaaggggggctagaagct

SEQ ID NO: 95539 - DNA, 20 bp, Artificial Sequence
  Description of Artificial Sequence: Synthetic oligonucleotide
  Target: SCN9A; (+) strand; PAM type: YTN; PAM sequence: TTA
caaaggggggctagaagctt

SEQ ID NO: 95540 - DNA, 20 bp, Artificial Sequence
  Description of Artificial Sequence: Synthetic oligonucleotide
  Target: SCN9A; (+) strand; PAM type: YTN; PAM sequence: CTA
gaagcttcagttgctccctt

SEQ ID NO: 95541 - DNA, 20 bp, Artificial Sequence
  Description of Artificial Sequence: Synthetic oligonucleotide
  Target: SCN9A; (+) strand; PAM type: YTN; PAM sequence: CTT
cagttgctccctttgttctc

SEQ ID NO: 95542 - DNA, 20 bp, Artificial Sequence
  Description of Artificial Sequence: Synthetic oligonucleotide
  Target: SCN9A; (+) strand; PAM type: YTN; PAM sequence: TTC
agttgctccctttgttctct

SEQ ID NO: 95543 - DNA, 20 bp, Artificial Sequence
  Description of Artificial Sequence: Synthetic oligonucleotide
  Target: SCN9A; (+) strand; PAM type: YTN; PAM sequence: TTG
ctccctttgttctctgctaa

SEQ ID NO: 95544 - DNA, 20 bp, Artificial Sequence
  Description of Artificial Sequence: Synthetic oligonucleotide
  Target: SCN9A; (+) strand; PAM type: YTN; PAM sequence: CTC
cctttgttctctgctaattt

SEQ ID NO: 95545 - DNA, 20 bp, Artificial Sequence
  Description of Artificial Sequence: Synthetic oligonucleotide
  Target: SCN9A; (+) strand; PAM type: YTN; PAM sequence: CTT
tgttctctgctaatttctta

SEQ ID NO: 95546 - DNA, 20 bp, Artificial Sequence
  Description of Artificial Sequence: Synthetic oligonucleotide
  Target: SCN9A; (+) strand; PAM type: YTN; PAM sequence: TTT
gttctctgctaatttcttaa

SEQ ID NO: 95547 - DNA, 20 bp, Artificial Sequence
  Description of Artificial Sequence: Synthetic oligonucleotide
  Target: SCN9A; (+) strand; PAM type: YTN; PAM sequence: TTG
ttctctgctaatttcttaag

SEQ ID NO: 95548 - DNA, 20 bp, Artificial Sequence
  Description of Artificial Sequence: Synthetic oligonucleotide
  Target: SCN9A; (+) strand; PAM type: YTN; PAM sequence: TTC
tctgctaatttcttaagtta

SEQ ID NO: 95549 - DNA, 20 bp, Artificial Sequence
  Description of Artificial Sequence: Synthetic oligonucleotide
  Target: SCN9A; (+) strand; PAM type: YTN; PAM sequence: CTC
tgctaatttcttaagttagc

SEQ ID NO: 95550 - DNA, 20 bp, Artificial Sequence
  Description of Artificial Sequence: Synthetic oligonucleotide
  Target: SCN9A; (+) strand; PAM type: YTN; PAM sequence: CTG
ctaatttcttaagttagctg

SEQ ID NO: 95551 - DNA, 20 bp, Artificial Sequence
  Description of Artificial Sequence: Synthetic oligonucleotide
  Target: SCN9A; (+) strand; PAM type: YTN; PAM sequence: CTA
atttcttaagttagctgtaa

SEQ ID NO: 95552 - DNA, 20 bp, Artificial Sequence
  Description of Artificial Sequence: Synthetic oligonucleotide
  Target: SCN9A; (+) strand; PAM type: YTN; PAM sequence: TTT
cttaagttagctgtaagttt

SEQ ID NO: 95553 - DNA, 20 bp, Artificial Sequence
  Description of Artificial Sequence: Synthetic oligonucleotide
  Target: SCN9A; (+) strand; PAM type: YTN; PAM sequence: TTC
ttaagttagctgtaagtttt

SEQ ID NO: 95554 - DNA, 20 bp, Artificial Sequence
  Description of Artificial Sequence: Synthetic oligonucleotide
  Target: SCN9A; (+) strand; PAM type: YTN; PAM sequence: CTT
aagttagctgtaagttttac

SEQ ID NO: 95555 - DNA, 20 bp, Artificial Sequence
  Description of Artificial Sequence: Synthetic oligonucleotide
  Target: SCN9A; (+) strand; PAM type: YTN; PAM sequence: TTA
agttagctgtaagttttaca

SEQ ID NO: 95556 - DNA, 20 bp, Artificial Sequence
  Description of Artificial Sequence: Synthetic oligonucleotide
  Target: SCN9A; (+) strand; PAM type: YTN; PAM sequence: TTA
gctgtaagttttacagattt

SEQ ID NO: 95557 - DNA, 20 bp, Artificial Sequence
  Description of Artificial Sequence: Synthetic oligonucleotide
  Target: SCN9A; (+) strand; PAM type: YTN; PAM sequence: CTG
taagttttacagatttatgt

SEQ ID NO: 95558 - DNA, 20 bp, Artificial Sequence
  Description of Artificial Sequence: Synthetic oligonucleotide
  Target: SCN9A; (+) strand; PAM type: YTN; PAM sequence: TTT
tacagatttatgtatattct

SEQ ID NO: 95559 - DNA, 20 bp, Artificial Sequence
  Description of Artificial Sequence: Synthetic oligonucleotide
  Target: SCN9A; (+) strand; PAM type: YTN; PAM sequence: TTT
acagatttatgtatattcta

SEQ ID NO: 95560 - DNA, 20 bp, Artificial Sequence
  Description of Artificial Sequence: Synthetic oligonucleotide
  Target: SCN9A; (+) strand; PAM type: YTN; PAM sequence: TTA
cagatttatgtatattctac

SEQ ID NO: 95561 - DNA, 20 bp, Artificial Sequence
  Description of Artificial Sequence: Synthetic oligonucleotide
  Target: SCN9A; (+) strand; PAM type: YTN; PAM sequence: TTT
atgtatattctacattagtc

SEQ ID NO: 95562 - DNA, 20 bp, Artificial Sequence
  Description of Artificial Sequence: Synthetic oligonucleotide
  Target: SCN9A; (+) strand; PAM type: YTN; PAM sequence: TTA
tgtatattctacattagtct

SEQ ID NO: 95563 - DNA, 20 bp, Artificial Sequence
  Description of Artificial Sequence: Synthetic oligonucleotide
  Target: SCN9A; (+) strand; PAM type: YTN; PAM sequence: TTC
tacattagtctataatttca

SEQ ID NO: 95564 - DNA, 20 bp, Artificial Sequence
  Description of Artificial Sequence: Synthetic oligonucleotide
  Target: SCN9A; (+) strand; PAM type: YTN; PAM sequence: CTA
cattagtctataatttcacc

SEQ ID NO: 95565 - DNA, 20 bp, Artificial Sequence
  Description of Artificial Sequence: Synthetic oligonucleotide
  Target: SCN9A; (+) strand; PAM type: YTN; PAM sequence: TTA
gtctataatttcaccttttt

SEQ ID NO: 95566 - DNA, 20 bp, Artificial Sequence
  Description of Artificial Sequence: Synthetic oligonucleotide
  Target: SCN9A; (+) strand; PAM type: YTN; PAM sequence: CTA
taatttcacctttttaagtc

SEQ ID NO: 95567 - DNA, 20 bp, Artificial Sequence
  Description of Artificial Sequence: Synthetic oligonucleotide
  Target: SCN9A; (+) strand; PAM type: YTN; PAM sequence: TTT
cacctttttaagtcacagca

SEQ ID NO: 95568 - DNA, 20 bp, Artificial Sequence
  Description of Artificial Sequence: Synthetic oligonucleotide
  Target: SCN9A; (+) strand; PAM type: YTN; PAM sequence: TTC
acctttttaagtcacagcat

SEQ ID NO: 95569 - DNA, 20 bp, Artificial Sequence
  Description of Artificial Sequence: Synthetic oligonucleotide
  Target: SCN9A; (+) strand; PAM type: YTN; PAM sequence: CTT
tttaagtcacagcataaatt

SEQ ID NO: 95570 - DNA, 20 bp, Artificial Sequence
  Description of Artificial Sequence: Synthetic oligonucleotide
  Target: SCN9A; (+) strand; PAM type: YTN; PAM sequence: TTT
ttaagtcacagcataaatta

SEQ ID NO: 95571 - DNA, 20 bp, Artificial Sequence
  Description of Artificial Sequence: Synthetic oligonucleotide
  Target: SCN9A; (+) strand; PAM type: YTN; PAM sequence: TTT
taagtcacagcataaattag

SEQ ID NO: 95572 - DNA, 20 bp, Artificial Sequence
  Description of Artificial Sequence: Synthetic oligonucleotide
  Target: SCN9A; (+) strand; PAM type: YTN; PAM sequence: TTT
aagtcacagcataaattagt

SEQ ID NO: 95573 - DNA, 20 bp, Artificial Sequence
  Description of Artificial Sequence: Synthetic oligonucleotide
  Target: SCN9A; (+) strand; PAM type: YTN; PAM sequence: TTA
agtcacagcataaattagta

SEQ ID NO: 95574 - DNA, 20 bp, Artificial Sequence
  Description of Artificial Sequence: Synthetic oligonucleotide
  Target: SCN9A; (+) strand; PAM type: YTN; PAM sequence: TTA
gtataatccatataattaag

SEQ ID NO: 95575 - DNA, 20 bp, Artificial Sequence
  Description of Artificial Sequence: Synthetic oligonucleotide
  Target: SCN9A; (+) strand; PAM type: YTN; PAM sequence: TTA
agaatttattttcaaggatt

SEQ ID NO: 95576 - DNA, 20 bp, Artificial Sequence
  Description of Artificial Sequence: Synthetic oligonucleotide
  Target: SCN9A; (+) strand; PAM type: YTN; PAM sequence: TTT
attttcaaggatttatagtt

SEQ ID NO: 95577 - DNA, 20 bp, Artificial Sequence
  Description of Artificial Sequence: Synthetic oligonucleotide
  Target: SCN9A; (+) strand; PAM type: YTN; PAM sequence: TTA
ttttcaaggatttatagttc

SEQ ID NO: 95578 - DNA, 20 bp, Artificial Sequence
  Description of Artificial Sequence: Synthetic oligonucleotide
  Target: SCN9A; (+) strand; PAM type: YTN; PAM sequence: TTT
tcaaggatttatagttctga

SEQ ID NO: 95579 - DNA, 20 bp, Artificial Sequence
  Description of Artificial Sequence: Synthetic oligonucleotide
  Target: SCN9A; (+) strand; PAM type: YTN; PAM sequence: TTT
caaggatttatagttctgag

SEQ ID NO: 95580 - DNA, 20 bp, Artificial Sequence
  Description of Artificial Sequence: Synthetic oligonucleotide
  Target: SCN9A; (+) strand; PAM type: YTN; PAM sequence: TTC
aaggatttatagttctgaga

SEQ ID NO: 95581 - DNA, 20 bp, Artificial Sequence
  Description of Artificial Sequence: Synthetic oligonucleotide
  Target: SCN9A; (+) strand; PAM type: YTN; PAM sequence: TTT
atagttctgagatcattact

SEQ ID NO: 95582 - DNA, 20 bp, Artificial Sequence
  Description of Artificial Sequence: Synthetic oligonucleotide
  Target: SCN9A; (+) strand; PAM type: YTN; PAM sequence: TTA
tagttctgagatcattactt

SEQ ID NO: 95583 - DNA, 20 bp, Artificial Sequence
  Description of Artificial Sequence: Synthetic oligonucleotide
  Target: SCN9A; (+) strand; PAM type: YTN; PAM sequence: TTC
tgagatcattacttaacttg

SEQ ID NO: 95584 - DNA, 20 bp, Artificial Sequence
  Description of Artificial Sequence: Synthetic oligonucleotide
  Target: SCN9A; (+) strand; PAM type: YTN; PAM sequence: CTG
agatcattacttaacttgta

SEQ ID NO: 95585 - DNA, 20 bp, Artificial Sequence
  Description of Artificial Sequence: Synthetic oligonucleotide
  Target: SCN9A; (+) strand; PAM type: YTN; PAM sequence: TTA
cttaacttgtagggtgctgg

SEQ ID NO: 95586 - DNA, 20 bp, Artificial Sequence
  Description of Artificial Sequence: Synthetic oligonucleotide
  Target: SCN9A; (+) strand; PAM type: YTN; PAM sequence: CTT
aacttgtagggtgctggaat

SEQ ID NO: 95587 - DNA, 20 bp, Artificial Sequence
  Description of Artificial Sequence: Synthetic oligonucleotide
  Target: SCN9A; (+) strand; PAM type: YTN; PAM sequence: TTA
acttgtagggtgctggaatt

SEQ ID NO: 95588 - DNA, 20 bp, Artificial Sequence
  Description of Artificial Sequence: Synthetic oligonucleotide
  Target: SCN9A; (+) strand; PAM type: YTN; PAM sequence: CTT
gtagggtgctggaattaaag

SEQ ID NO: 95589 - DNA, 20 bp, Artificial Sequence
  Description of Artificial Sequence: Synthetic oligonucleotide
  Target: SCN9A; (+) strand; PAM type: YTN; PAM sequence: TTG
tagggtgctggaattaaaga

SEQ ID NO: 95590 - DNA, 20 bp, Artificial Sequence
  Description of Artificial Sequence: Synthetic oligonucleotide
  Target: SCN9A; (+) strand; PAM type: YTN; PAM sequence: CTG
gaattaaagatgacctggtt

SEQ ID NO: 95591 - DNA, 20 bp, Artificial Sequence
  Description of Artificial Sequence: Synthetic oligonucleotide
  Target: SCN9A; (+) strand; PAM type: YTN; PAM sequence: TTA
aagatgacctggttatggtt

SEQ ID NO: 95592 - DNA, 20 bp, Artificial Sequence
  Description of Artificial Sequence: Synthetic oligonucleotide
  Target: SCN9A; (+) strand; PAM type: YTN; PAM sequence: CTG
gttatggtttccctttattc

SEQ ID NO: 95593 - DNA, 20 bp, Artificial Sequence
  Description of Artificial Sequence: Synthetic oligonucleotide
  Target: SCN9A; (+) strand; PAM type: YTN; PAM sequence: TTA
tggtttccctttattctctt

SEQ ID NO: 95594 - DNA, 20 bp, Artificial Sequence
  Description of Artificial Sequence: Synthetic oligonucleotide
  Target: SCN9A; (+) strand; PAM type: YTN; PAM sequence: TTT
ccctttattctcttggattt

SEQ ID NO: 95595 - DNA, 20 bp, Artificial Sequence
  Description of Artificial Sequence: Synthetic oligonucleotide
  Target: SCN9A; (+) strand; PAM type: YTN; PAM sequence: TTC
cctttattctcttggatttg

SEQ ID NO: 95596 - DNA, 20 bp, Artificial Sequence
  Description of Artificial Sequence: Synthetic oligonucleotide
  Target: SCN9A; (+) strand; PAM type: YTN; PAM sequence: CTT
tattctcttggatttggtaa

SEQ ID NO: 95597 - DNA, 20 bp, Artificial Sequence
  Description of Artificial Sequence: Synthetic oligonucleotide
  Target: SCN9A; (+) strand; PAM type: YTN; PAM sequence: TTT
attctcttggatttggtaat

SEQ ID NO: 95598 - DNA, 20 bp, Artificial Sequence
  Description of Artificial Sequence: Synthetic oligonucleotide
  Target: SCN9A; (+) strand; PAM type: YTN; PAM sequence: TTA
ttctcttggatttggtaata

SEQ ID NO: 95599 - DNA, 20 bp, Artificial Sequence
  Description of Artificial Sequence: Synthetic oligonucleotide
  Target: SCN9A; (+) strand; PAM type: YTN; PAM sequence: TTC
tcttggatttggtaatattc

SEQ ID NO: 95600 - DNA, 20 bp, Artificial Sequence
  Description of Artificial Sequence: Synthetic oligonucleotide
  Target: SCN9A; (+) strand; PAM type: YTN; PAM sequence: CTC
ttggatttggtaatattcag

SEQ ID NO: 95601 - DNA, 20 bp, Artificial Sequence
  Description of Artificial Sequence: Synthetic oligonucleotide
  Target: SCN9A; (+) strand; PAM type: YTN; PAM sequence: CTT
ggatttggtaatattcagct

SEQ ID NO: 95602 - DNA, 20 bp, Artificial Sequence
  Description of Artificial Sequence: Synthetic oligonucleotide
  Target: SCN9A; (+) strand; PAM type: YTN; PAM sequence: TTG
gatttggtaatattcagctt

SEQ ID NO: 95603 - DNA, 20 bp, Artificial Sequence
  Description of Artificial Sequence: Synthetic oligonucleotide
  Target: SCN9A; (+) strand; PAM type: YTN; PAM sequence: TTT
ggtaatattcagcttcctct

SEQ ID NO: 95604 - DNA, 20 bp, Artificial Sequence
  Description of Artificial Sequence: Synthetic oligonucleotide
  Target: SCN9A; (+) strand; PAM type: YTN; PAM sequence: TTG
gtaatattcagcttcctctt

SEQ ID NO: 95605 - DNA, 20 bp, Artificial Sequence
  Description of Artificial Sequence: Synthetic oligonucleotide
  Target: SCN9A; (+) strand; PAM type: YTN; PAM sequence: TTC
agcttcctcttatttactta

SEQ ID NO: 95606 - DNA, 20 bp, Artificial Sequence
  Description of Artificial Sequence: Synthetic oligonucleotide
  Target: SCN9A; (+) strand; PAM type: YTN; PAM sequence: CTT
cctcttatttacttattttt

SEQ ID NO: 95607 - DNA, 20 bp, Artificial Sequence
  Description of Artificial Sequence: Synthetic oligonucleotide
  Target: SCN9A; (+) strand; PAM type: YTN; PAM sequence: TTC
ctcttatttacttatttttt

SEQ ID NO: 95608 - DNA, 20 bp, Artificial Sequence
  Description of Artificial Sequence: Synthetic oligonucleotide
  Target: SCN9A; (+) strand; PAM type: YTN; PAM sequence: CTC
ttatttacttatttttttaa

SEQ ID NO: 95609 - DNA, 20 bp, Artificial Sequence
  Description of Artificial Sequence: Synthetic oligonucleotide
  Target: SCN9A; (+) strand; PAM type: YTN; PAM sequence: CTT
atttacttatttttttaatt

SEQ ID NO: 95610 - DNA, 20 bp, Artificial Sequence
  Description of Artificial Sequence: Synthetic oligonucleotide
  Target: SCN9A; (+) strand; PAM type: YTN; PAM sequence: TTA
tttacttatttttttaattg

SEQ ID NO: 95611 - DNA, 20 bp, Artificial Sequence
  Description of Artificial Sequence: Synthetic oligonucleotide
  Target: SCN9A; (+) strand; PAM type: YTN; PAM sequence: TTT
acttatttttttaattgttt

SEQ ID NO: 95612 - DNA, 20 bp, Artificial Sequence
  Description of Artificial Sequence: Synthetic oligonucleotide
  Target: SCN9A; (+) strand; PAM type: YTN; PAM sequence: TTA
cttatttttttaattgtttg

SEQ ID NO: 95613 - DNA, 20 bp, Artificial Sequence
  Description of Artificial Sequence: Synthetic oligonucleotide
  Target: SCN9A; (+) strand; PAM type: YTN; PAM sequence: CTT
atttttttaattgtttgcta

SEQ ID NO: 95614 - DNA, 20 bp, Artificial Sequence
  Description of Artificial Sequence: Synthetic oligonucleotide
  Target: SCN9A; (+) strand; PAM type: YTN; PAM sequence: TTA
tttttttaattgtttgctat

SEQ ID NO: 95615 - DNA, 20 bp, Artificial Sequence
  Description of Artificial Sequence: Synthetic oligonucleotide
  Target: SCN9A; (+) strand; PAM type: YTN; PAM sequence: TTT
ttttaattgtttgctattga

SEQ ID NO: 95616 - DNA, 20 bp, Artificial Sequence
  Description of Artificial Sequence: Synthetic oligonucleotide
  Target: SCN9A; (+) strand; PAM type: YTN; PAM sequence: TTT
tttaattgtttgctattgaa

SEQ ID NO: 95617 - DNA, 20 bp, Artificial Sequence
  Description of Artificial Sequence: Synthetic oligonucleotide
  Target: SCN9A; (+) strand; PAM type: YTN; PAM sequence: TTT
ttaattgtttgctattgaat

SEQ ID NO: 95618 - DNA, 20 bp, Artificial Sequence
  Description of Artificial Sequence: Synthetic oligonucleotide
  Target: SCN9A; (+) strand; PAM type: YTN; PAM sequence: TTT
taattgtttgctattgaatg

SEQ ID NO: 95619 - DNA, 20 bp, Artificial Sequence
  Description of Artificial Sequence: Synthetic oligonucleotide
  Target: SCN9A; (+) strand; PAM type: YTN; PAM sequence: TTT
aattgtttgctattgaatgg

SEQ ID NO: 95620 - DNA, 20 bp, Artificial Sequence
  Description of Artificial Sequence: Synthetic oligonucleotide
  Target: SCN9A; (+) strand; PAM type: YTN; PAM sequence: TTA
attgtttgctattgaatggg

SEQ ID NO: 95621 - DNA, 20 bp, Artificial Sequence
  Description of Artificial Sequence: Synthetic oligonucleotide
  Target: SCN9A; (+) strand; PAM type: YTN; PAM sequence: TTG
tttgctattgaatgggaagc

SEQ ID NO: 95622 - DNA, 20 bp, Artificial Sequence
  Description of Artificial Sequence: Synthetic oligonucleotide
  Target: SCN9A; (+) strand; PAM type: YTN; PAM sequence: TTT
gctattgaatgggaagcttc

SEQ ID NO: 95623 - DNA, 20 bp, Artificial Sequence
  Description of Artificial Sequence: Synthetic oligonucleotide
  Target: SCN9A; (+) strand; PAM type: YTN; PAM sequence: TTG
ctattgaatgggaagcttcc

SEQ ID NO: 95624 - DNA, 20 bp, Artificial Sequence
  Description of Artificial Sequence: Synthetic oligonucleotide
  Target: SCN9A; (+) strand; PAM type: YTN; PAM sequence: CTA
ttgaatgggaagcttcccat

SEQ ID NO: 95625 - DNA, 20 bp, Artificial Sequence
  Description of Artificial Sequence: Synthetic oligonucleotide
  Target: SCN9A; (+) strand; PAM type: YTN; PAM sequence: TTG
aatgggaagcttcccattat

SEQ ID NO: 95626 - DNA, 20 bp, Artificial Sequence
  Description of Artificial Sequence: Synthetic oligonucleotide
  Target: SCN9A; (+) strand; PAM type: YTN; PAM sequence: CTT
cccattatattgaattttct

SEQ ID NO: 95627 - DNA, 20 bp, Artificial Sequence
  Description of Artificial Sequence: Synthetic oligonucleotide
  Target: SCN9A; (+) strand; PAM type: YTN; PAM sequence: TTC
ccattatattgaattttctt

SEQ ID NO: 95628 - DNA, 20 bp, Artificial Sequence
  Description of Artificial Sequence: Synthetic oligonucleotide
  Target: SCN9A; (+) strand; PAM type: YTN; PAM sequence: TTA
tattgaattttcttattcat

SEQ ID NO: 95629 - DNA, 20 bp, Artificial Sequence
  Description of Artificial Sequence: Synthetic oligonucleotide
  Target: SCN9A; (+) strand; PAM type: YTN; PAM sequence: TTG
aattttcttattcatcaaac

SEQ ID NO: 95630 - DNA, 20 bp, Artificial Sequence
  Description of Artificial Sequence: Synthetic oligonucleotide
  Target: SCN9A; (+) strand; PAM type: YTN; PAM sequence: TTT
tcttattcatcaaacaccta

SEQ ID NO: 95631 - DNA, 20 bp, Artificial Sequence
  Description of Artificial Sequence: Synthetic oligonucleotide
  Target: SCN9A; (+) strand; PAM type: YTN; PAM sequence: TTT
cttattcatcaaacacctaa

SEQ ID NO: 95632 - DNA, 20 bp, Artificial Sequence
  Description of Artificial Sequence: Synthetic oligonucleotide
  Target: SCN9A; (+) strand; PAM type: YTN; PAM sequence: TTC
ttattcatcaaacacctaat

SEQ ID NO: 95633 - DNA, 20 bp, Artificial Sequence
  Description of Artificial Sequence: Synthetic oligonucleotide
  Target: SCN9A; (+) strand; PAM type: YTN; PAM sequence: CTT
attcatcaaacacctaatgg

SEQ ID NO: 95634 - DNA, 20 bp, Artificial Sequence
  Description of Artificial Sequence: Synthetic oligonucleotide
  Target: SCN9A; (+) strand; PAM type: YTN; PAM sequence: TTA
ttcatcaaacacctaatggt

SEQ ID NO: 95635 - DNA, 20 bp, Artificial Sequence
  Description of Artificial Sequence: Synthetic oligonucleotide
  Target: SCN9A; (+) strand; PAM type: YTN; PAM sequence: TTC
atcaaacacctaatggtaac

SEQ ID NO: 95636 - DNA, 20 bp, Artificial Sequence
  Description of Artificial Sequence: Synthetic oligonucleotide
  Target: SCN9A; (+) strand; PAM type: YTN; PAM sequence: CTA
atggtaaccagacttccctt

SEQ ID NO: 95637 - DNA, 20 bp, Artificial Sequence
  Description of Artificial Sequence: Synthetic oligonucleotide
  Target: SCN9A; (+) strand; PAM type: YTN; PAM sequence: CTT
ccctttctgccttagagtgt

SEQ ID NO: 95638 - DNA, 20 bp, Artificial Sequence
  Description of Artificial Sequence: Synthetic oligonucleotide
  Target: SCN9A; (+) strand; PAM type: YTN; PAM sequence: TTC
cctttctgccttagagtgtt

SEQ ID NO: 95639 - DNA, 20 bp, Artificial Sequence
  Description of Artificial Sequence: Synthetic oligonucleotide
  Target: SCN9A; (+) strand; PAM type: YTN; PAM sequence: CTT
tctgccttagagtgtttttg

SEQ ID NO: 95640 - DNA, 20 bp, Artificial Sequence
  Description of Artificial Sequence: Synthetic oligonucleotide
  Target: SCN9A; (+) strand; PAM type: YTN; PAM sequence: TTT
ctgccttagagtgtttttgt

SEQ ID NO: 95641 - DNA, 20 bp, Artificial Sequence
  Description of Artificial Sequence: Synthetic oligonucleotide
  Target: SCN9A; (+) strand; PAM type: YTN; PAM sequence: TTC
tgccttagagtgtttttgtt

SEQ ID NO: 95642 - DNA, 20 bp, Artificial Sequence
  Description of Artificial Sequence: Synthetic oligonucleotide
  Target: SCN9A; (+) strand; PAM type: YTN; PAM sequence: CTG
ccttagagtgtttttgttgt

SEQ ID NO: 95643 - DNA, 20 bp, Artificial Sequence
  Description of Artificial Sequence: Synthetic oligonucleotide
  Target: SCN9A; (+) strand; PAM type: YTN; PAM sequence: CTT
agagtgtttttgttgttgtt

SEQ ID NO: 95644 - DNA, 20 bp, Artificial Sequence
  Description of Artificial Sequence: Synthetic oligonucleotide
  Target: SCN9A; (+) strand; PAM type: YTN; PAM sequence: TTA
gagtgtttttgttgttgttg

SEQ ID NO: 95645 - DNA, 20 bp, Artificial Sequence
  Description of Artificial Sequence: Synthetic oligonucleotide
  Target: SCN9A; (+) strand; PAM type: YTN; PAM sequence: TTT
ttgttgttgttgttgttgtt

SEQ ID NO: 95646 - DNA, 20 bp, Artificial Sequence
  Description of Artificial Sequence: Synthetic oligonucleotide
  Target: SCN9A; (+) strand; PAM type: YTN; PAM sequence: TTT
tgttgttgttgttgttgttg

SEQ ID NO: 95647 - DNA, 20 bp, Artificial Sequence
  Description of Artificial Sequence: Synthetic oligonucleotide
  Target: SCN9A; (+) strand; PAM type: YTN; PAM sequence: TTT
gttgttgttgttgttgttgt

SEQ ID NO: 95648 - DNA, 20 bp, Artificial Sequence
  Description of Artificial Sequence: Synthetic oligonucleotide
  Target: SCN9A; (+) strand; PAM type: YTN; PAM sequence: TTG
ttgttgttgttgttgttgtt

SEQ ID NO: 95649 - DNA, 20 bp, Artificial Sequence
  Description of Artificial Sequence: Synthetic oligonucleotide
  Target: SCN9A; (+) strand; PAM type: YTN; PAM sequence: TTG
ttgttgttgttgttgttgtt

SEQ ID NO: 95650 - DNA, 20 bp, Artificial Sequence
  Description of Artificial Sequence: Synthetic oligonucleotide
  Target: SCN9A; (+) strand; PAM type: YTN; PAM sequence: TTG
ttgttgttgttgttgttgtt

SEQ ID NO: 95651 - DNA, 20 bp, Artificial Sequence
  Description of Artificial Sequence: Synthetic oligonucleotide
  Target: SCN9A; (+) strand; PAM type: YTN; PAM sequence: TTG
ttgttgttgttgttgttttt

SEQ ID NO: 95652 - DNA, 20 bp, Artificial Sequence
  Description of Artificial Sequence: Synthetic oligonucleotide
  Target: SCN9A; (+) strand; PAM type: YTN; PAM sequence: TTG
ttgttgttgttgtttttgat

SEQ ID NO: 95653 - DNA, 20 bp, Artificial Sequence
  Description of Artificial Sequence: Synthetic oligonucleotide
  Target: SCN9A; (+) strand; PAM type: YTN; PAM sequence: TTG
ttgttgttgtttttgatgga

SEQ ID NO: 95654 - DNA, 20 bp, Artificial Sequence
  Description of Artificial Sequence: Synthetic oligonucleotide
  Target: SCN9A; (+) strand; PAM type: YTN; PAM sequence: TTG
ttgttgtttttgatggagtc

SEQ ID NO: 95655 - DNA, 20 bp, Artificial Sequence
  Description of Artificial Sequence: Synthetic oligonucleotide
  Target: SCN9A; (+) strand; PAM type: YTN; PAM sequence: TTG
ttgtttttgatggagtcttg

SEQ ID NO: 95656 - DNA, 20 bp, Artificial Sequence
  Description of Artificial Sequence: Synthetic oligonucleotide
  Target: SCN9A; (+) strand; PAM type: YTN; PAM sequence: TTG
tttttgatggagtcttgctc

SEQ ID NO: 95657 - DNA, 20 bp, Artificial Sequence
  Description of Artificial Sequence: Synthetic oligonucleotide
  Target: SCN9A; (+) strand; PAM type: YTN; PAM sequence: TTT
ttgatggagtcttgctctga

SEQ ID NO: 95658 - DNA, 20 bp, Artificial Sequence
  Description of Artificial Sequence: Synthetic oligonucleotide
  Target: SCN9A; (+) strand; PAM type: YTN; PAM sequence: TTT
tgatggagtcttgctctgag

SEQ ID NO: 95659 - DNA, 20 bp, Artificial Sequence
  Description of Artificial Sequence: Synthetic oligonucleotide
  Target: SCN9A; (+) strand; PAM type: YTN; PAM sequence: TTT
gatggagtcttgctctgagg

SEQ ID NO: 95660 - DNA, 20 bp, Artificial Sequence
  Description of Artificial Sequence: Synthetic oligonucleotide
  Target: SCN9A; (+) strand; PAM type: YTN; PAM sequence: TTG
atggagtcttgctctgaggc

SEQ ID NO: 95661 - DNA, 20 bp, Artificial Sequence
  Description of Artificial Sequence: Synthetic oligonucleotide
  Target: SCN9A; (+) strand; PAM type: YTN; PAM sequence: CTT
gctctgaggcacaggctgga

SEQ ID NO: 95662 - DNA, 20 bp, Artificial Sequence
  Description of Artificial Sequence: Synthetic oligonucleotide
  Target: SCN9A; (+) strand; PAM type: YTN; PAM sequence: TTG
ctctgaggcacaggctggag

SEQ ID NO: 95663 - DNA, 20 bp, Artificial Sequence
  Description of Artificial Sequence: Synthetic oligonucleotide
  Target: SCN9A; (+) strand; PAM type: YTN; PAM sequence: CTC
tgaggcacaggctggagtgc

SEQ ID NO: 95664 - DNA, 20 bp, Artificial Sequence
  Description of Artificial Sequence: Synthetic oligonucleotide
  Target: SCN9A; (+) strand; PAM type: YTN; PAM sequence: CTG
aggcacaggctggagtgcag

SEQ ID NO: 95665 - DNA, 20 bp, Artificial Sequence
  Description of Artificial Sequence: Synthetic oligonucleotide
  Target: SCN9A; (+) strand; PAM type: YTN; PAM sequence: CTG
gagtgcagtgccaccatctt

SEQ ID NO: 95666 - DNA, 20 bp, Artificial Sequence
  Description of Artificial Sequence: Synthetic oligonucleotide
  Target: SCN9A; (+) strand; PAM type: YTN; PAM sequence: CTT
ggctcactgcaacctccacc

SEQ ID NO: 95667 - DNA, 20 bp, Artificial Sequence
  Description of Artificial Sequence: Synthetic oligonucleotide
  Target: SCN9A; (+) strand; PAM type: YTN; PAM sequence: TTG
gctcactgcaacctccacct

SEQ ID NO: 95668 - DNA, 20 bp, Artificial Sequence
  Description of Artificial Sequence: Synthetic oligonucleotide
  Target: SCN9A; (+) strand; PAM type: YTN; PAM sequence: CTC
actgcaacctccacctcctg

SEQ ID NO: 95669 - DNA, 20 bp, Artificial Sequence
  Description of Artificial Sequence: Synthetic oligonucleotide
  Target: SCN9A; (+) strand; PAM type: YTN; PAM sequence: CTG
caacctccacctcctgggtt

SEQ ID NO: 95670 - DNA, 20 bp, Artificial Sequence
  Description of Artificial Sequence: Synthetic oligonucleotide
  Target: SCN9A; (+) strand; PAM type: YTN; PAM sequence: CTC
cacctcctgggttcaagtaa

SEQ ID NO: 95671 - DNA, 20 bp, Artificial Sequence
  Description of Artificial Sequence: Synthetic oligonucleotide
  Target: SCN9A; (+) strand; PAM type: YTN; PAM sequence: CTC
ctgggttcaagtaattctca

SEQ ID NO: 95672 - DNA, 20 bp, Artificial Sequence
  Description of Artificial Sequence: Synthetic oligonucleotide
  Target: SCN9A; (+) strand; PAM type: YTN; PAM sequence: CTG
ggttcaagtaattctcatgt

SEQ ID NO: 95673 - DNA, 20 bp, Artificial Sequence
  Description of Artificial Sequence: Synthetic oligonucleotide
  Target: SCN9A; (+) strand; PAM type: YTN; PAM sequence: TTC
aagtaattctcatgtctcag

SEQ ID NO: 95674 - DNA, 20 bp, Artificial Sequence
  Description of Artificial Sequence: Synthetic oligonucleotide
  Target: SCN9A; (+) strand; PAM type: YTN; PAM sequence: TTC
tcatgtctcagcctcccaag

SEQ ID NO: 95675 - DNA, 20 bp, Artificial Sequence
  Description of Artificial Sequence: Synthetic oligonucleotide
  Target: SCN9A; (+) strand; PAM type: YTN; PAM sequence: CTC
atgtctcagcctcccaagta

SEQ ID NO: 95676 - DNA, 20 bp, Artificial Sequence
  Description of Artificial Sequence: Synthetic oligonucleotide
  Target: SCN9A; (+) strand; PAM type: YTN; PAM sequence: CTC
agcctcccaagtagctggga

SEQ ID NO: 95677 - DNA, 20 bp, Artificial Sequence
  Description of Artificial Sequence: Synthetic oligonucleotide
  Target: SCN9A; (+) strand; PAM type: YTN; PAM sequence: CTC
ccaagtagctgggattacag

SEQ ID NO: 95678 - DNA, 20 bp, Artificial Sequence
  Description of Artificial Sequence: Synthetic oligonucleotide
  Target: SCN9A; (+) strand; PAM type: YTN; PAM sequence: CTG
ggattacaggtgcatgccac

SEQ ID NO: 95679 - DNA, 20 bp, Artificial Sequence
  Description of Artificial Sequence: Synthetic oligonucleotide
  Target: SCN9A; (+) strand; PAM type: YTN; PAM sequence: TTA
caggtgcatgccaccacatc

SEQ ID NO: 95680 - DNA, 20 bp, Artificial Sequence
  Description of Artificial Sequence: Synthetic oligonucleotide
  Target: SCN9A; (+) strand; PAM type: YTN; PAM sequence: CTA
atttttgtatttttagtaga

SEQ ID NO: 95681 - DNA, 20 bp, Artificial Sequence
  Description of Artificial Sequence: Synthetic oligonucleotide
  Target: SCN9A; (+) strand; PAM type: YTN; PAM sequence: TTT
ttgtatttttagtagagaca

SEQ ID NO: 95682 - DNA, 20 bp, Artificial Sequence
  Description of Artificial Sequence: Synthetic oligonucleotide
  Target: SCN9A; (+) strand; PAM type: YTN; PAM sequence: TTT
tgtatttttagtagagacag

SEQ ID NO: 95683 - DNA, 20 bp, Artificial Sequence
  Description of Artificial Sequence: Synthetic oligonucleotide
  Target: SCN9A; (+) strand; PAM type: YTN; PAM sequence: TTT
gtatttttagtagagacagg

SEQ ID NO: 95684 - DNA, 20 bp, Artificial Sequence
  Description of Artificial Sequence: Synthetic oligonucleotide
  Target: SCN9A; (+) strand; PAM type: YTN; PAM sequence: TTG
tatttttagtagagacaggg

SEQ ID NO: 95685 - DNA, 20 bp, Artificial Sequence
  Description of Artificial Sequence: Synthetic oligonucleotide
  Target: SCN9A; (+) strand; PAM type: YTN; PAM sequence: TTT
ttagtagagacagggtttca

SEQ ID NO: 95686 - DNA, 20 bp, Artificial Sequence
  Description of Artificial Sequence: Synthetic oligonucleotide
  Target: SCN9A; (+) strand; PAM type: YTN; PAM sequence: TTT
tagtagagacagggtttcac

SEQ ID NO: 95687 - DNA, 20 bp, Artificial Sequence
  Description of Artificial Sequence: Synthetic oligonucleotide
  Target: SCN9A; (+) strand; PAM type: YTN; PAM sequence: TTT
agtagagacagggtttcacc

SEQ ID NO: 95688 - DNA, 20 bp, Artificial Sequence
  Description of Artificial Sequence: Synthetic oligonucleotide
  Target: SCN9A; (+) strand; PAM type: YTN; PAM sequence: TTA
gtagagacagggtttcacca

SEQ ID NO: 95689 - DNA, 20 bp, Artificial Sequence
  Description of Artificial Sequence: Synthetic oligonucleotide
  Target: SCN9A; (+) strand; PAM type: YTN; PAM sequence: TTT
caccatgttggctggtctgg

SEQ ID NO: 95690 - DNA, 20 bp, Artificial Sequence
  Description of Artificial Sequence: Synthetic oligonucleotide
  Target: SCN9A; (+) strand; PAM type: YTN; PAM sequence: TTC
accatgttggctggtctggt

SEQ ID NO: 95691 - DNA, 20 bp, Artificial Sequence
  Description of Artificial Sequence: Synthetic oligonucleotide
  Target: SCN9A; (+) strand; PAM type: YTN; PAM sequence: TTG
gctggtctggttttgaactc

SEQ ID NO: 95692 - DNA, 20 bp, Artificial Sequence
  Description of Artificial Sequence: Synthetic oligonucleotide
  Target: SCN9A; (+) strand; PAM type: YTN; PAM sequence: CTG
gtctggttttgaactcctgg

SEQ ID NO: 95693 - DNA, 20 bp, Artificial Sequence
  Description of Artificial Sequence: Synthetic oligonucleotide
  Target: SCN9A; (+) strand; PAM type: YTN; PAM sequence: CTG
gttttgaactcctggcctca

SEQ ID NO: 95694 - DNA, 20 bp, Artificial Sequence
  Description of Artificial Sequence: Synthetic oligonucleotide
  Target: SCN9A; (+) strand; PAM type: YTN; PAM sequence: TTT
tgaactcctggcctcaagtg

SEQ ID NO: 95695 - DNA, 20 bp, Artificial Sequence
  Description of Artificial Sequence: Synthetic oligonucleotide
  Target: SCN9A; (+) strand; PAM type: YTN; PAM sequence: TTT
gaactcctggcctcaagtga

SEQ ID NO: 95696 - DNA, 20 bp, Artificial Sequence
  Description of Artificial Sequence: Synthetic oligonucleotide
  Target: SCN9A; (+) strand; PAM type: YTN; PAM sequence: TTG
aactcctggcctcaagtgat

SEQ ID NO: 95697 - DNA, 20 bp, Artificial Sequence
  Description of Artificial Sequence: Synthetic oligonucleotide
  Target: SCN9A; (+) strand; PAM type: YTN; PAM sequence: CTC
ctggcctcaagtgatctgcc

SEQ ID NO: 95698 - DNA, 20 bp, Artificial Sequence
  Description of Artificial Sequence: Synthetic oligonucleotide
  Target: SCN9A; (+) strand; PAM type: YTN; PAM sequence: CTG
gcctcaagtgatctgccagc

SEQ ID NO: 95699 - DNA, 20 bp, Artificial Sequence
  Description of Artificial Sequence: Synthetic oligonucleotide
  Target: SCN9A; (+) strand; PAM type: YTN; PAM sequence: CTC
aagtgatctgccagccttgg

SEQ ID NO: 95700 - DNA, 20 bp, Artificial Sequence
  Description of Artificial Sequence: Synthetic oligonucleotide
  Target: SCN9A; (+) strand; PAM type: YTN; PAM sequence: CTG
ccagccttggcctcccaaag

SEQ ID NO: 95701 - DNA, 20 bp, Artificial Sequence
  Description of Artificial Sequence: Synthetic oligonucleotide
  Target: SCN9A; (+) strand; PAM type: YTN; PAM sequence: CTT
ggcctcccaaagtgctggga

SEQ ID NO: 95702 - DNA, 20 bp, Artificial Sequence
  Description of Artificial Sequence: Synthetic oligonucleotide
  Target: SCN9A; (+) strand; PAM type: YTN; PAM sequence: TTG
gcctcccaaagtgctgggat

SEQ ID NO: 95703 - DNA, 20 bp, Artificial Sequence
  Description of Artificial Sequence: Synthetic oligonucleotide
  Target: SCN9A; (+) strand; PAM type: YTN; PAM sequence: CTC
ccaaagtgctgggattacag

SEQ ID NO: 95704 - DNA, 20 bp, Artificial Sequence
  Description of Artificial Sequence: Synthetic oligonucleotide
  Target: SCN9A; (+) strand; PAM type: YTN; PAM sequence: CTG
ggattacaggcgtgagccac

SEQ ID NO: 95705 - DNA, 20 bp, Artificial Sequence
  Description of Artificial Sequence: Synthetic oligonucleotide
  Target: SCN9A; (+) strand; PAM type: YTN; PAM sequence: TTA
caggcgtgagccaccatatc

SEQ ID NO: 95706 - DNA, 20 bp, Artificial Sequence
  Description of Artificial Sequence: Synthetic oligonucleotide
  Target: SCN9A; (+) strand; PAM type: YTN; PAM sequence: CTT
agagtgttttaattcagctt

SEQ ID NO: 95707 - DNA, 20 bp, Artificial Sequence
  Description of Artificial Sequence: Synthetic oligonucleotide
  Target: SCN9A; (+) strand; PAM type: YTN; PAM sequence: TTA
gagtgttttaattcagcttt

SEQ ID NO: 95708 - DNA, 20 bp, Artificial Sequence
  Description of Artificial Sequence: Synthetic oligonucleotide
  Target: SCN9A; (+) strand; PAM type: YTN; PAM sequence: TTT
taattcagctttcctctatt

SEQ ID NO: 95709 - DNA, 20 bp, Artificial Sequence
  Description of Artificial Sequence: Synthetic oligonucleotide
  Target: SCN9A; (+) strand; PAM type: YTN; PAM sequence: TTT
aattcagctttcctctattt

SEQ ID NO: 95710 - DNA, 20 bp, Artificial Sequence
  Description of Artificial Sequence: Synthetic oligonucleotide
  Target: SCN9A; (+) strand; PAM type: YTN; PAM sequence: TTA
attcagctttcctctattta

SEQ ID NO: 95711 - DNA, 20 bp, Artificial Sequence
  Description of Artificial Sequence: Synthetic oligonucleotide
  Target: SCN9A; (+) strand; PAM type: YTN; PAM sequence: TTC
agctttcctctatttaatat

SEQ ID NO: 95712 - DNA, 20 bp, Artificial Sequence
  Description of Artificial Sequence: Synthetic oligonucleotide
  Target: SCN9A; (+) strand; PAM type: YTN; PAM sequence: CTT
tcctctatttaatatgcagt

SEQ ID NO: 95713 - DNA, 20 bp, Artificial Sequence
  Description of Artificial Sequence: Synthetic oligonucleotide
  Target: SCN9A; (+) strand; PAM type: YTN; PAM sequence: TTT
cctctatttaatatgcagtc

SEQ ID NO: 95714 - DNA, 20 bp, Artificial Sequence
  Description of Artificial Sequence: Synthetic oligonucleotide
  Target: SCN9A; (+) strand; PAM type: YTN; PAM sequence: TTC
ctctatttaatatgcagtct

SEQ ID NO: 95715 - DNA, 20 bp, Artificial Sequence
  Description of Artificial Sequence: Synthetic oligonucleotide
  Target: SCN9A; (+) strand; PAM type: YTN; PAM sequence: CTC
tatttaatatgcagtcttta

SEQ ID NO: 95716 - DNA, 20 bp, Artificial Sequence
  Description of Artificial Sequence: Synthetic oligonucleotide
  Target: SCN9A; (+) strand; PAM type: YTN; PAM sequence: CTA
tttaatatgcagtctttatg

SEQ ID NO: 95717 - DNA, 20 bp, Artificial Sequence
  Description of Artificial Sequence: Synthetic oligonucleotide
  Target: SCN9A; (+) strand; PAM type: YTN; PAM sequence: TTT
aatatgcagtctttatgtaa

SEQ ID NO: 95718 - DNA, 20 bp, Artificial Sequence
  Description of Artificial Sequence: Synthetic oligonucleotide
  Target: SCN9A; (+) strand; PAM type: YTN; PAM sequence: TTA
atatgcagtctttatgtaat

SEQ ID NO: 95719 - DNA, 20 bp, Artificial Sequence
  Description of Artificial Sequence: Synthetic oligonucleotide
  Target: SCN9A; (+) strand; PAM type: YTN; PAM sequence: CTT
tatgtaattttcatattcat

SEQ ID NO: 95720 - DNA, 20 bp, Artificial Sequence
  Description of Artificial Sequence: Synthetic oligonucleotide
  Target: SCN9A; (+) strand; PAM type: YTN; PAM sequence: TTT
atgtaattttcatattcatc

SEQ ID NO: 95721 - DNA, 20 bp, Artificial Sequence
  Description of Artificial Sequence: Synthetic oligonucleotide
  Target: SCN9A; (+) strand; PAM type: YTN; PAM sequence: TTA
tgtaattttcatattcatct

SEQ ID NO: 95722 - DNA, 20 bp, Artificial Sequence
  Description of Artificial Sequence: Synthetic oligonucleotide
  Target: SCN9A; (+) strand; PAM type: YTN; PAM sequence: TTT
tcatattcatctcacctact

SEQ ID NO: 95723 - DNA, 20 bp, Artificial Sequence
  Description of Artificial Sequence: Synthetic oligonucleotide
  Target: SCN9A; (+) strand; PAM type: YTN; PAM sequence: TTT
catattcatctcacctactg

SEQ ID NO: 95724 - DNA, 20 bp, Artificial Sequence
  Description of Artificial Sequence: Synthetic oligonucleotide
  Target: SCN9A; (+) strand; PAM type: YTN; PAM sequence: TTC
atattcatctcacctactgg

SEQ ID NO: 95725 - DNA, 20 bp, Artificial Sequence
  Description of Artificial Sequence: Synthetic oligonucleotide
  Target: SCN9A; (+) strand; PAM type: YTN; PAM sequence: TTC
atctcacctactggcaaggc

SEQ ID NO: 95726 - DNA, 20 bp, Artificial Sequence
  Description of Artificial Sequence: Synthetic oligonucleotide
  Target: SCN9A; (+) strand; PAM type: YTN; PAM sequence: CTC
acctactggcaaggcatgag

SEQ ID NO: 95727 - DNA, 20 bp, Artificial Sequence
  Description of Artificial Sequence: Synthetic oligonucleotide
  Target: SCN9A; (+) strand; PAM type: YTN; PAM sequence: CTA
ctggcaaggcatgagagaga

SEQ ID NO: 95728 - DNA, 20 bp, Artificial Sequence
  Description of Artificial Sequence: Synthetic oligonucleotide
  Target: SCN9A; (+) strand; PAM type: YTN; PAM sequence: CTG
gcaaggcatgagagagacag

SEQ ID NO: 95729 - DNA, 20 bp, Artificial Sequence
  Description of Artificial Sequence: Synthetic oligonucleotide
  Target: SCN9A; (+) strand; PAM type: YTN; PAM sequence: CTT
catgtcaatgtcaagagaaa

SEQ ID NO: 95730 - DNA, 20 bp, Artificial Sequence
  Description of Artificial Sequence: Synthetic oligonucleotide
  Target: SCN9A; (+) strand; PAM type: YTN; PAM sequence: TTC
atgtcaatgtcaagagaaac

SEQ ID NO: 95731 - DNA, 20 bp, Artificial Sequence
  Description of Artificial Sequence: Synthetic oligonucleotide
  Target: SCN9A; (+) strand; PAM type: YTN; PAM sequence: CTT
tactgttcattaatggggac

SEQ ID NO: 95732 - DNA, 20 bp, Artificial Sequence
  Description of Artificial Sequence: Synthetic oligonucleotide
  Target: SCN9A; (+) strand; PAM type: YTN; PAM sequence: TTT
actgttcattaatggggact

SEQ ID NO: 95733 - DNA, 20 bp, Artificial Sequence
  Description of Artificial Sequence: Synthetic oligonucleotide
  Target: SCN9A; (+) strand; PAM type: YTN; PAM sequence: TTA
ctgttcattaatggggactg

SEQ ID NO: 95734 - DNA, 20 bp, Artificial Sequence
  Description of Artificial Sequence: Synthetic oligonucleotide
  Target: SCN9A; (+) strand; PAM type: YTN; PAM sequence: CTG
ttcattaatggggactgaaa

SEQ ID NO: 95735 - DNA, 20 bp, Artificial Sequence
  Description of Artificial Sequence: Synthetic oligonucleotide
  Target: SCN9A; (+) strand; PAM type: YTN; PAM sequence: TTC
attaatggggactgaaaatt

SEQ ID NO: 95736 - DNA, 20 bp, Artificial Sequence
  Description of Artificial Sequence: Synthetic oligonucleotide
  Target: SCN9A; (+) strand; PAM type: YTN; PAM sequence: TTA
atggggactgaaaattacag

SEQ ID NO: 95737 - DNA, 20 bp, Artificial Sequence
  Description of Artificial Sequence: Synthetic oligonucleotide
  Target: SCN9A; (+) strand; PAM type: YTN; PAM sequence: CTG
aaaattacagcatgccaaga

SEQ ID NO: 95738 - DNA, 20 bp, Artificial Sequence
  Description of Artificial Sequence: Synthetic oligonucleotide
  Target: SCN9A; (+) strand; PAM type: YTN; PAM sequence: TTA
cagcatgccaagaacttgac

SEQ ID NO: 95739 - DNA, 20 bp, Artificial Sequence
  Description of Artificial Sequence: Synthetic oligonucleotide
  Target: SCN9A; (+) strand; PAM type: YTN; PAM sequence: CTT
gacagaagaagctggagaaa

SEQ ID NO: 95740 - DNA, 20 bp, Artificial Sequence
  Description of Artificial Sequence: Synthetic oligonucleotide
  Target: SCN9A; (+) strand; PAM type: YTN; PAM sequence: TTG
acagaagaagctggagaaaa

SEQ ID NO: 95741 - DNA, 20 bp, Artificial Sequence
  Description of Artificial Sequence: Synthetic oligonucleotide
  Target: SCN9A; (+) strand; PAM type: YTN; PAM sequence: CTG
gagaaaaactgaggagaaaa

SEQ ID NO: 95742 - DNA, 20 bp, Artificial Sequence
  Description of Artificial Sequence: Synthetic oligonucleotide
  Target: SCN9A; (+) strand; PAM type: YTN; PAM sequence: CTG
aggagaaaactccaactttg

SEQ ID NO: 95743 - DNA, 20 bp, Artificial Sequence
  Description of Artificial Sequence: Synthetic oligonucleotide
  Target: SCN9A; (+) strand; PAM type: YTN; PAM sequence: CTC
caactttgaagagaaaatca

SEQ ID NO: 95744 - DNA, 20 bp, Artificial Sequence
  Description of Artificial Sequence: Synthetic oligonucleotide
  Target: SCN9A; (+) strand; PAM type: YTN; PAM sequence: CTT
tgaagagaaaatcaaagtaa

SEQ ID NO: 95745 - DNA, 20 bp, Artificial Sequence
  Description of Artificial Sequence: Synthetic oligonucleotide
  Target: SCN9A; (+) strand; PAM type: YTN; PAM sequence: TTT
gaagagaaaatcaaagtaat

SEQ ID NO: 95746 - DNA, 20 bp, Artificial Sequence
  Description of Artificial Sequence: Synthetic oligonucleotide
  Target: SCN9A; (+) strand; PAM type: YTN; PAM sequence: TTG
aagagaaaatcaaagtaata

SEQ ID NO: 95747 - DNA, 20 bp, Artificial Sequence
  Description of Artificial Sequence: Synthetic oligonucleotide
  Target: SCN9A; (+) strand; PAM type: YTN; PAM sequence: TTT
tgttttcccctaatgatatc

SEQ ID NO: 95748 - DNA, 20 bp, Artificial Sequence
  Description of Artificial Sequence: Synthetic oligonucleotide
  Target: SCN9A; (+) strand; PAM type: YTN; PAM sequence: TTT
gttttcccctaatgatatcc

SEQ ID NO: 95749 - DNA, 20 bp, Artificial Sequence
  Description of Artificial Sequence: Synthetic oligonucleotide
  Target: SCN9A; (+) strand; PAM type: YTN; PAM sequence: TTG
ttttcccctaatgatatcct

SEQ ID NO: 95750 - DNA, 20 bp, Artificial Sequence
  Description of Artificial Sequence: Synthetic oligonucleotide
  Target: SCN9A; (+) strand; PAM type: YTN; PAM sequence: TTT
tcccctaatgatatcctggt

SEQ ID NO: 95751 - DNA, 20 bp, Artificial Sequence
  Description of Artificial Sequence: Synthetic oligonucleotide
  Target: SCN9A; (+) strand; PAM type: YTN; PAM sequence: TTT
cccctaatgatatcctggtt

SEQ ID NO: 95752 - DNA, 20 bp, Artificial Sequence
  Description of Artificial Sequence: Synthetic oligonucleotide
  Target: SCN9A; (+) strand; PAM type: YTN; PAM sequence: TTC
ccctaatgatatcctggttg

SEQ ID NO: 95753 - DNA, 20 bp, Artificial Sequence
  Description of Artificial Sequence: Synthetic oligonucleotide
  Target: SCN9A; (+) strand; PAM type: YTN; PAM sequence: CTA
atgatatcctggttgtcaat

SEQ ID NO: 95754 - DNA, 20 bp, Artificial Sequence
  Description of Artificial Sequence: Synthetic oligonucleotide
  Target: SCN9A; (+) strand; PAM type: YTN; PAM sequence: CTG
gttgtcaatatgatgaagaa

SEQ ID NO: 95755 - DNA, 20 bp, Artificial Sequence
  Description of Artificial Sequence: Synthetic oligonucleotide
  Target: SCN9A; (+) strand; PAM type: YTN; PAM sequence: TTG
tcaatatgatgaagaatggg

SEQ ID NO: 95756 - DNA, 20 bp, Artificial Sequence
  Description of Artificial Sequence: Synthetic oligonucleotide
  Target: SCN9A; (+) strand; PAM type: YTN; PAM sequence: CTA
ataggagattatgaattaat

SEQ ID NO: 95757 - DNA, 20 bp, Artificial Sequence
  Description of Artificial Sequence: Synthetic oligonucleotide
  Target: SCN9A; (+) strand; PAM type: YTN; PAM sequence: TTA
tgaattaattcaatagagaa

SEQ ID NO: 95758 - DNA, 20 bp, Artificial Sequence
  Description of Artificial Sequence: Synthetic oligonucleotide
  Target: SCN9A; (+) strand; PAM type: YTN; PAM sequence: TTA
attcaatagagaaacttgcg

SEQ ID NO: 95759 - DNA, 20 bp, Artificial Sequence
  Description of Artificial Sequence: Synthetic oligonucleotide
  Target: SCN9A; (+) strand; PAM type: YTN; PAM sequence: TTC
aatagagaaacttgcgtggg

SEQ ID NO: 95760 - DNA, 20 bp, Artificial Sequence
  Description of Artificial Sequence: Synthetic oligonucleotide
  Target: SCN9A; (+) strand; PAM type: YTN; PAM sequence: CTT
gcgtgggtgttttgttttcc

SEQ ID NO: 95761 - DNA, 20 bp, Artificial Sequence
  Description of Artificial Sequence: Synthetic oligonucleotide
  Target: SCN9A; (+) strand; PAM type: YTN; PAM sequence: TTG
cgtgggtgttttgttttcct

SEQ ID NO: 95762 - DNA, 20 bp, Artificial Sequence
  Description of Artificial Sequence: Synthetic oligonucleotide
  Target: SCN9A; (+) strand; PAM type: YTN; PAM sequence: TTT
tgttttcctatagcttattt

SEQ ID NO: 95763 - DNA, 20 bp, Artificial Sequence
  Description of Artificial Sequence: Synthetic oligonucleotide
  Target: SCN9A; (+) strand; PAM type: YTN; PAM sequence: TTT
gttttcctatagcttattta

SEQ ID NO: 95764 - DNA, 20 bp, Artificial Sequence
  Description of Artificial Sequence: Synthetic oligonucleotide
  Target: SCN9A; (+) strand; PAM type: YTN; PAM sequence: TTG
ttttcctatagcttatttag

SEQ ID NO: 95765 - DNA, 20 bp, Artificial Sequence
  Description of Artificial Sequence: Synthetic oligonucleotide
  Target: SCN9A; (+) strand; PAM type: YTN; PAM sequence: TTT
tcctatagcttatttaggcc

SEQ ID NO: 95766 - DNA, 20 bp, Artificial Sequence
  Description of Artificial Sequence: Synthetic oligonucleotide
  Target: SCN9A; (+) strand; PAM type: YTN; PAM sequence: TTT
cctatagcttatttaggcct

SEQ ID NO: 95767 - DNA, 20 bp, Artificial Sequence
  Description of Artificial Sequence: Synthetic oligonucleotide
  Target: SCN9A; (+) strand; PAM type: YTN; PAM sequence: TTC
ctatagcttatttaggcctt

SEQ ID NO: 95768 - DNA, 20 bp, Artificial Sequence
  Description of Artificial Sequence: Synthetic oligonucleotide
  Target: SCN9A; (+) strand; PAM type: YTN; PAM sequence: CTA
tagcttatttaggccttgtg

SEQ ID NO: 95769 - DNA, 20 bp, Artificial Sequence
  Description of Artificial Sequence: Synthetic oligonucleotide
  Target: SCN9A; (+) strand; PAM type: YTN; PAM sequence: CTT
atttaggccttgtgcaaaat

SEQ ID NO: 95770 - DNA, 20 bp, Artificial Sequence
  Description of Artificial Sequence: Synthetic oligonucleotide
  Target: SCN9A; (+) strand; PAM type: YTN; PAM sequence: TTA
tttaggccttgtgcaaaatg

SEQ ID NO: 95771 - DNA, 20 bp, Artificial Sequence
  Description of Artificial Sequence: Synthetic oligonucleotide
  Target: SCN9A; (+) strand; PAM type: YTN; PAM sequence: TTT
aggccttgtgcaaaatgtat

SEQ ID NO: 95772 - DNA, 20 bp, Artificial Sequence
  Description of Artificial Sequence: Synthetic oligonucleotide
  Target: SCN9A; (+) strand; PAM type: YTN; PAM sequence: TTA
ggccttgtgcaaaatgtatc

SEQ ID NO: 95773 - DNA, 20 bp, Artificial Sequence
  Description of Artificial Sequence: Synthetic oligonucleotide
  Target: SCN9A; (+) strand; PAM type: YTN; PAM sequence: CTT
gtgcaaaatgtatcccttta

SEQ ID NO: 95774 - DNA, 20 bp, Artificial Sequence
  Description of Artificial Sequence: Synthetic oligonucleotide
  Target: SCN9A; (+) strand; PAM type: YTN; PAM sequence: TTG
tgcaaaatgtatccctttaa

SEQ ID NO: 95775 - DNA, 20 bp, Artificial Sequence
  Description of Artificial Sequence: Synthetic oligonucleotide
  Target: SCN9A; (+) strand; PAM type: YTN; PAM sequence: CTT
taaaacctaggtggaaggaa

SEQ ID NO: 95776 - DNA, 20 bp, Artificial Sequence
  Description of Artificial Sequence: Synthetic oligonucleotide
  Target: SCN9A; (+) strand; PAM type: YTN; PAM sequence: TTT
aaaacctaggtggaaggaat

SEQ ID NO: 95777 - DNA, 20 bp, Artificial Sequence
  Description of Artificial Sequence: Synthetic oligonucleotide
  Target: SCN9A; (+) strand; PAM type: YTN; PAM sequence: TTA
aaacctaggtggaaggaatt

SEQ ID NO: 95778 - DNA, 20 bp, Artificial Sequence
  Description of Artificial Sequence: Synthetic oligonucleotide
  Target: SCN9A; (+) strand; PAM type: YTN; PAM sequence: CTA
ggtggaaggaattctgtaag

SEQ ID NO: 95779 - DNA, 20 bp, Artificial Sequence
  Description of Artificial Sequence: Synthetic oligonucleotide
  Target: SCN9A; (+) strand; PAM type: YTN; PAM sequence: TTC
tgtaagtcaggctagttttt

SEQ ID NO: 95780 - DNA, 20 bp, Artificial Sequence
  Description of Artificial Sequence: Synthetic oligonucleotide
  Target: SCN9A; (+) strand; PAM type: YTN; PAM sequence: CTG
taagtcaggctagttttttt

SEQ ID NO: 95781 - DNA, 20 bp, Artificial Sequence
  Description of Artificial Sequence: Synthetic oligonucleotide
  Target: SCN9A; (+) strand; PAM type: YTN; PAM sequence: CTA
gtttttttctgtgttacaat

SEQ ID NO: 95782 - DNA, 20 bp, Artificial Sequence
  Description of Artificial Sequence: Synthetic oligonucleotide
  Target: SCN9A; (+) strand; PAM type: YTN; PAM sequence: TTT
ttttctgtgttacaatctac

SEQ ID NO: 95783 - DNA, 20 bp, Artificial Sequence
  Description of Artificial Sequence: Synthetic oligonucleotide
  Target: SCN9A; (+) strand; PAM type: YTN; PAM sequence: TTT
tttctgtgttacaatctaca

SEQ ID NO: 95784 - DNA, 20 bp, Artificial Sequence
  Description of Artificial Sequence: Synthetic oligonucleotide
  Target: SCN9A; (+) strand; PAM type: YTN; PAM sequence: TTT
ttctgtgttacaatctacat

SEQ ID NO: 95785 - DNA, 20 bp, Artificial Sequence
  Description of Artificial Sequence: Synthetic oligonucleotide
  Target: SCN9A; (+) strand; PAM type: YTN; PAM sequence: TTT
tctgtgttacaatctacatt

SEQ ID NO: 95786 - DNA, 20 bp, Artificial Sequence
  Description of Artificial Sequence: Synthetic oligonucleotide
  Target: SCN9A; (+) strand; PAM type: YTN; PAM sequence: TTT
ctgtgttacaatctacattg

SEQ ID NO: 95787 - DNA, 20 bp, Artificial Sequence
  Description of Artificial Sequence: Synthetic oligonucleotide
  Target: SCN9A; (+) strand; PAM type: YTN; PAM sequence: TTC
tgtgttacaatctacattga

SEQ ID NO: 95788 - DNA, 20 bp, Artificial Sequence
  Description of Artificial Sequence: Synthetic oligonucleotide
  Target: SCN9A; (+) strand; PAM type: YTN; PAM sequence: CTG
tgttacaatctacattgagg

SEQ ID NO: 95789 - DNA, 20 bp, Artificial Sequence
  Description of Artificial Sequence: Synthetic oligonucleotide
  Target: SCN9A; (+) strand; PAM type: YTN; PAM sequence: TTA
caatctacattgaggctgta

SEQ ID NO: 95790 - DNA, 20 bp, Artificial Sequence
  Description of Artificial Sequence: Synthetic oligonucleotide
  Target: SCN9A; (+) strand; PAM type: YTN; PAM sequence: CTA
cattgaggctgtattacata

SEQ ID NO: 95791 - DNA, 20 bp, Artificial Sequence
  Description of Artificial Sequence: Synthetic oligonucleotide
  Target: SCN9A; (+) strand; PAM type: YTN; PAM sequence: TTG
aggctgtattacatagtaat

SEQ ID NO: 95792 - DNA, 20 bp, Artificial Sequence
  Description of Artificial Sequence: Synthetic oligonucleotide
  Target: SCN9A; (+) strand; PAM type: YTN; PAM sequence: CTG
tattacatagtaataaagac

SEQ ID NO: 95793 - DNA, 20 bp, Artificial Sequence
  Description of Artificial Sequence: Synthetic oligonucleotide
  Target: SCN9A; (+) strand; PAM type: YTN; PAM sequence: TTA
catagtaataaagacttctt

SEQ ID NO: 95794 - DNA, 20 bp, Artificial Sequence
  Description of Artificial Sequence: Synthetic oligonucleotide
  Target: SCN9A; (+) strand; PAM type: YTN; PAM sequence: CTT
cttcacttctggtgtcagat

SEQ ID NO: 95795 - DNA, 20 bp, Artificial Sequence
  Description of Artificial Sequence: Synthetic oligonucleotide
  Target: SCN9A; (+) strand; PAM type: YTN; PAM sequence: TTC
ttcacttctggtgtcagatc

SEQ ID NO: 95796 - DNA, 20 bp, Artificial Sequence
  Description of Artificial Sequence: Synthetic oligonucleotide
  Target: SCN9A; (+) strand; PAM type: YTN; PAM sequence: CTT
cacttctggtgtcagatcat

SEQ ID NO: 95797 - DNA, 20 bp, Artificial Sequence
  Description of Artificial Sequence: Synthetic oligonucleotide
  Target: SCN9A; (+) strand; PAM type: YTN; PAM sequence: TTC
acttctggtgtcagatcatc

SEQ ID NO: 95798 - DNA, 20 bp, Artificial Sequence
  Description of Artificial Sequence: Synthetic oligonucleotide
  Target: SCN9A; (+) strand; PAM type: YTN; PAM sequence: CTT
ctggtgtcagatcatctttg

SEQ ID NO: 95799 - DNA, 20 bp, Artificial Sequence
  Description of Artificial Sequence: Synthetic oligonucleotide
  Target: SCN9A; (+) strand; PAM type: YTN; PAM sequence: TTC
tggtgtcagatcatctttgt

SEQ ID NO: 95800 - DNA, 20 bp, Artificial Sequence
  Description of Artificial Sequence: Synthetic oligonucleotide
  Target: SCN9A; (+) strand; PAM type: YTN; PAM sequence: CTG
gtgtcagatcatctttgttc

SEQ ID NO: 95801 - DNA, 20 bp, Artificial Sequence
  Description of Artificial Sequence: Synthetic oligonucleotide
  Target: SCN9A; (+) strand; PAM type: YTN; PAM sequence: CTT
tgttcaagtcctttcttttg

SEQ ID NO: 95802 - DNA, 20 bp, Artificial Sequence
  Description of Artificial Sequence: Synthetic oligonucleotide
  Target: SCN9A; (+) strand; PAM type: YTN; PAM sequence: TTT
gttcaagtcctttcttttgt

SEQ ID NO: 95803 - DNA, 20 bp, Artificial Sequence
  Description of Artificial Sequence: Synthetic oligonucleotide
  Target: SCN9A; (+) strand; PAM type: YTN; PAM sequence: TTG
ttcaagtcctttcttttgtc

SEQ ID NO: 95804 - DNA, 20 bp, Artificial Sequence
  Description of Artificial Sequence: Synthetic oligonucleotide
  Target: SCN9A; (+) strand; PAM type: YTN; PAM sequence: TTC
aagtcctttcttttgtcctt

SEQ ID NO: 95805 - DNA, 20 bp, Artificial Sequence
  Description of Artificial Sequence: Synthetic oligonucleotide
  Target: SCN9A; (+) strand; PAM type: YTN; PAM sequence: CTT
tcttttgtccttgggtaagt

SEQ ID NO: 95806 - DNA, 20 bp, Artificial Sequence
  Description of Artificial Sequence: Synthetic oligonucleotide
  Target: SCN9A; (+) strand; PAM type: YTN; PAM sequence: TTT
cttttgtccttgggtaagtt

SEQ ID NO: 95807 - DNA, 20 bp, Artificial Sequence
  Description of Artificial Sequence: Synthetic oligonucleotide
  Target: SCN9A; (+) strand; PAM type: YTN; PAM sequence: TTC
ttttgtccttgggtaagttt

SEQ ID NO: 95808 - DNA, 20 bp, Artificial Sequence
  Description of Artificial Sequence: Synthetic oligonucleotide
  Target: SCN9A; (+) strand; PAM type: YTN; PAM sequence: CTT
ttgtccttgggtaagtttct

SEQ ID NO: 95809 - DNA, 20 bp, Artificial Sequence
  Description of Artificial Sequence: Synthetic oligonucleotide
  Target: SCN9A; (+) strand; PAM type: YTN; PAM sequence: TTT
tgtccttgggtaagtttctt

SEQ ID NO: 95810 - DNA, 20 bp, Artificial Sequence
  Description of Artificial Sequence: Synthetic oligonucleotide
  Target: SCN9A; (+) strand; PAM type: YTN; PAM sequence: TTT
gtccttgggtaagtttctta

SEQ ID NO: 95811 - DNA, 20 bp, Artificial Sequence
  Description of Artificial Sequence: Synthetic oligonucleotide
  Target: SCN9A; (+) strand; PAM type: YTN; PAM sequence: TTG
tccttgggtaagtttcttaa

SEQ ID NO: 95812 - DNA, 20 bp, Artificial Sequence
  Description of Artificial Sequence: Synthetic oligonucleotide
  Target: SCN9A; (+) strand; PAM type: YTN; PAM sequence: CTT
gggtaagtttcttaattctt

SEQ ID NO: 95813 - DNA, 20 bp, Artificial Sequence
  Description of Artificial Sequence: Synthetic oligonucleotide
  Target: SCN9A; (+) strand; PAM type: YTN; PAM sequence: TTG
ggtaagtttcttaattcttt

SEQ ID NO: 95814 - DNA, 20 bp, Artificial Sequence
  Description of Artificial Sequence: Synthetic oligonucleotide
  Target: SCN9A; (+) strand; PAM type: YTN; PAM sequence: TTT
cttaattctttaagtaaaac

SEQ ID NO: 95815 - DNA, 20 bp, Artificial Sequence
  Description of Artificial Sequence: Synthetic oligonucleotide
  Target: SCN9A; (+) strand; PAM type: YTN; PAM sequence: TTC
ttaattctttaagtaaaacc

SEQ ID NO: 95816 - DNA, 20 bp, Artificial Sequence
  Description of Artificial Sequence: Synthetic oligonucleotide
  Target: SCN9A; (+) strand; PAM type: YTN; PAM sequence: CTT
aattctttaagtaaaaccac

SEQ ID NO: 95817 - DNA, 20 bp, Artificial Sequence
  Description of Artificial Sequence: Synthetic oligonucleotide
  Target: SCN9A; (+) strand; PAM type: YTN; PAM sequence: TTA
attctttaagtaaaaccacc

SEQ ID NO: 95818 - DNA, 20 bp, Artificial Sequence
  Description of Artificial Sequence: Synthetic oligonucleotide
  Target: SCN9A; (+) strand; PAM type: YTN; PAM sequence: TTC
tttaagtaaaaccacctcat

SEQ ID NO: 95819 - DNA, 20 bp, Artificial Sequence
  Description of Artificial Sequence: Synthetic oligonucleotide
  Target: SCN9A; (+) strand; PAM type: YTN; PAM sequence: CTT
taagtaaaaccacctcatca

SEQ ID NO: 95820 - DNA, 20 bp, Artificial Sequence
  Description of Artificial Sequence: Synthetic oligonucleotide
  Target: SCN9A; (+) strand; PAM type: YTN; PAM sequence: TTT
aagtaaaaccacctcatcat

SEQ ID NO: 95821 - DNA, 20 bp, Artificial Sequence
  Description of Artificial Sequence: Synthetic oligonucleotide
  Target: SCN9A; (+) strand; PAM type: YTN; PAM sequence: TTA
agtaaaaccacctcatcatt

SEQ ID NO: 95822 - DNA, 20 bp, Artificial Sequence
  Description of Artificial Sequence: Synthetic oligonucleotide
  Target: SCN9A; (+) strand; PAM type: YTN; PAM sequence: CTC
atcattataagagtagtcac

SEQ ID NO: 95823 - DNA, 20 bp, Artificial Sequence
  Description of Artificial Sequence: Synthetic oligonucleotide
  Target: SCN9A; (+) strand; PAM type: YTN; PAM sequence: TTA
taagagtagtcactgcattt

SEQ ID NO: 95824 - DNA, 20 bp, Artificial Sequence
  Description of Artificial Sequence: Synthetic oligonucleotide
  Target: SCN9A; (+) strand; PAM type: YTN; PAM sequence: CTG
catttgtgtttgctgagaag

SEQ ID NO: 95825 - DNA, 20 bp, Artificial Sequence
  Description of Artificial Sequence: Synthetic oligonucleotide
  Target: SCN9A; (+) strand; PAM type: YTN; PAM sequence: TTT
gtgtttgctgagaagataaa

SEQ ID NO: 95826 - DNA, 20 bp, Artificial Sequence
  Description of Artificial Sequence: Synthetic oligonucleotide
  Target: SCN9A; (+) strand; PAM type: YTN; PAM sequence: TTG
tgtttgctgagaagataaat

SEQ ID NO: 95827 - DNA, 20 bp, Artificial Sequence
  Description of Artificial Sequence: Synthetic oligonucleotide
  Target: SCN9A; (+) strand; PAM type: YTN; PAM sequence: TTT
gctgagaagataaattgagg

SEQ ID NO: 95828 - DNA, 20 bp, Artificial Sequence
  Description of Artificial Sequence: Synthetic oligonucleotide
  Target: SCN9A; (+) strand; PAM type: YTN; PAM sequence: TTG
ctgagaagataaattgaggt

SEQ ID NO: 95829 - DNA, 20 bp, Artificial Sequence
  Description of Artificial Sequence: Synthetic oligonucleotide
  Target: SCN9A; (+) strand; PAM type: YTN; PAM sequence: CTG
agaagataaattgaggtaat

SEQ ID NO: 95830 - DNA, 20 bp, Artificial Sequence
  Description of Artificial Sequence: Synthetic oligonucleotide
  Target: SCN9A; (+) strand; PAM type: YTN; PAM sequence: TTG
aggtaatgcatgaagaatac

SEQ ID NO: 95831 - DNA, 20 bp, Artificial Sequence
  Description of Artificial Sequence: Synthetic oligonucleotide
  Target: SCN9A; (+) strand; PAM type: YTN; PAM sequence: CTT
agcataatatctggcacatg

SEQ ID NO: 95832 - DNA, 20 bp, Artificial Sequence
  Description of Artificial Sequence: Synthetic oligonucleotide
  Target: SCN9A; (+) strand; PAM type: YTN; PAM sequence: TTA
gcataatatctggcacatgg

SEQ ID NO: 95833 - DNA, 20 bp, Artificial Sequence
  Description of Artificial Sequence: Synthetic oligonucleotide
  Target: SCN9A; (+) strand; PAM type: YTN; PAM sequence: CTG
gcacatggtaagtcttcatt

SEQ ID NO: 95834 - DNA, 20 bp, Artificial Sequence
  Description of Artificial Sequence: Synthetic oligonucleotide
  Target: SCN9A; (+) strand; PAM type: YTN; PAM sequence: CTT
cattaaattttagttactat

SEQ ID NO: 95835 - DNA, 20 bp, Artificial Sequence
  Description of Artificial Sequence: Synthetic oligonucleotide
  Target: SCN9A; (+) strand; PAM type: YTN; PAM sequence: TTC
attaaattttagttactatt

SEQ ID NO: 95836 - DNA, 20 bp, Artificial Sequence
  Description of Artificial Sequence: Synthetic oligonucleotide
  Target: SCN9A; (+) strand; PAM type: YTN; PAM sequence: TTA
aattttagttactattactg

SEQ ID NO: 95837 - DNA, 20 bp, Artificial Sequence
  Description of Artificial Sequence: Synthetic oligonucleotide
  Target: SCN9A; (+) strand; PAM type: YTN; PAM sequence: TTT
tagttactattactgttggt

SEQ ID NO: 95838 - DNA, 20 bp, Artificial Sequence
  Description of Artificial Sequence: Synthetic oligonucleotide
  Target: SCN9A; (+) strand; PAM type: YTN; PAM sequence: TTT
agttactattactgttggtg

SEQ ID NO: 95839 - DNA, 20 bp, Artificial Sequence
  Description of Artificial Sequence: Synthetic oligonucleotide
  Target: SCN9A; (+) strand; PAM type: YTN; PAM sequence: TTA
gttactattactgttggtgc

SEQ ID NO: 95840 - DNA, 20 bp, Artificial Sequence
  Description of Artificial Sequence: Synthetic oligonucleotide
  Target: SCN9A; (+) strand; PAM type: YTN; PAM sequence: TTA
ctattactgttggtgctatt

SEQ ID NO: 95841 - DNA, 20 bp, Artificial Sequence
  Description of Artificial Sequence: Synthetic oligonucleotide
  Target: SCN9A; (+) strand; PAM type: YTN; PAM sequence: CTA
ttactgttggtgctattaaa

SEQ ID NO: 95842 - DNA, 20 bp, Artificial Sequence
  Description of Artificial Sequence: Synthetic oligonucleotide
  Target: SCN9A; (+) strand; PAM type: YTN; PAM sequence: TTA
ctgttggtgctattaaactt

SEQ ID NO: 95843 - DNA, 20 bp, Artificial Sequence
  Description of Artificial Sequence: Synthetic oligonucleotide
  Target: SCN9A; (+) strand; PAM type: YTN; PAM sequence: CTG
ttggtgctattaaacttcct

SEQ ID NO: 95844 - DNA, 20 bp, Artificial Sequence
  Description of Artificial Sequence: Synthetic oligonucleotide
  Target: SCN9A; (+) strand; PAM type: YTN; PAM sequence: TTG
gtgctattaaacttcctgat

SEQ ID NO: 95845 - DNA, 20 bp, Artificial Sequence
  Description of Artificial Sequence: Synthetic oligonucleotide
  Target: SCN9A; (+) strand; PAM type: YTN; PAM sequence: CTA
ttaaacttcctgataagatg

SEQ ID NO: 95846 - DNA, 20 bp, Artificial Sequence
  Description of Artificial Sequence: Synthetic oligonucleotide
  Target: SCN9A; (+) strand; PAM type: YTN; PAM sequence: TTA
aacttcctgataagatgaga

SEQ ID NO: 95847 - DNA, 20 bp, Artificial Sequence
  Description of Artificial Sequence: Synthetic oligonucleotide
  Target: SCN9A; (+) strand; PAM type: YTN; PAM sequence: CTT
cctgataagatgagagttaa

SEQ ID NO: 95848 - DNA, 20 bp, Artificial Sequence
  Description of Artificial Sequence: Synthetic oligonucleotide
  Target: SCN9A; (+) strand; PAM type: YTN; PAM sequence: TTC
ctgataagatgagagttaat

SEQ ID NO: 95849 - DNA, 20 bp, Artificial Sequence
  Description of Artificial Sequence: Synthetic oligonucleotide
  Target: SCN9A; (+) strand; PAM type: YTN; PAM sequence: CTG
ataagatgagagttaatgaa

SEQ ID NO: 95850 - DNA, 20 bp, Artificial Sequence
  Description of Artificial Sequence: Synthetic oligonucleotide
  Target: SCN9A; (+) strand; PAM type: YTN; PAM sequence: TTA
atgaaatgaggttattgtta

SEQ ID NO: 95851 - DNA, 20 bp, Artificial Sequence
  Description of Artificial Sequence: Synthetic oligonucleotide
  Target: SCN9A; (+) strand; PAM type: YTN; PAM sequence: TTA
ttgttaacatttactccata

SEQ ID NO: 95852 - DNA, 20 bp, Artificial Sequence
  Description of Artificial Sequence: Synthetic oligonucleotide
  Target: SCN9A; (+) strand; PAM type: YTN; PAM sequence: TTG
ttaacatttactccatagtt

SEQ ID NO: 95853 - DNA, 20 bp, Artificial Sequence
  Description of Artificial Sequence: Synthetic oligonucleotide
  Target: SCN9A; (+) strand; PAM type: YTN; PAM sequence: TTA
acatttactccatagttgct

SEQ ID NO: 95854 - DNA, 20 bp, Artificial Sequence
  Description of Artificial Sequence: Synthetic oligonucleotide
  Target: SCN9A; (+) strand; PAM type: YTN; PAM sequence: TTT
actccatagttgctcaaatt

SEQ ID NO: 95855 - DNA, 20 bp, Artificial Sequence
  Description of Artificial Sequence: Synthetic oligonucleotide
  Target: SCN9A; (+) strand; PAM type: YTN; PAM sequence: TTA
ctccatagttgctcaaattt

SEQ ID NO: 95856 - DNA, 20 bp, Artificial Sequence
  Description of Artificial Sequence: Synthetic oligonucleotide
  Target: SCN9A; (+) strand; PAM type: YTN; PAM sequence: CTC
catagttgctcaaatttgta

SEQ ID NO: 95857 - DNA, 20 bp, Artificial Sequence
  Description of Artificial Sequence: Synthetic oligonucleotide
  Target: SCN9A; (+) strand; PAM type: YTN; PAM sequence: TTG
ctcaaatttgtaattatata

SEQ ID NO: 95858 - DNA, 20 bp, Artificial Sequence
  Description of Artificial Sequence: Synthetic oligonucleotide
  Target: SCN9A; (+) strand; PAM type: YTN; PAM sequence: CTC
aaatttgtaattatatattt

SEQ ID NO: 95859 - DNA, 20 bp, Artificial Sequence
  Description of Artificial Sequence: Synthetic oligonucleotide
  Target: SCN9A; (+) strand; PAM type: YTN; PAM sequence: TTT
gtaattatatatttgtatat

SEQ ID NO: 95860 - DNA, 20 bp, Artificial Sequence
  Description of Artificial Sequence: Synthetic oligonucleotide
  Target: SCN9A; (+) strand; PAM type: YTN; PAM sequence: TTG
taattatatatttgtatatc

SEQ ID NO: 95861 - DNA, 20 bp, Artificial Sequence
  Description of Artificial Sequence: Synthetic oligonucleotide
  Target: SCN9A; (+) strand; PAM type: YTN; PAM sequence: TTA
tatatttgtatatcatgtaa

SEQ ID NO: 95862 - DNA, 20 bp, Artificial Sequence
  Description of Artificial Sequence: Synthetic oligonucleotide
  Target: SCN9A; (+) strand; PAM type: YTN; PAM sequence: TTT
gtatatcatgtaatcttcct

SEQ ID NO: 95863 - DNA, 20 bp, Artificial Sequence
  Description of Artificial Sequence: Synthetic oligonucleotide
  Target: SCN9A; (+) strand; PAM type: YTN; PAM sequence: TTG
tatatcatgtaatcttcctt

SEQ ID NO: 95864 - DNA, 20 bp, Artificial Sequence
  Description of Artificial Sequence: Synthetic oligonucleotide
  Target: SCN9A; (+) strand; PAM type: YTN; PAM sequence: CTT
cctttttataacttgaactc

SEQ ID NO: 95865 - DNA, 20 bp, Artificial Sequence
  Description of Artificial Sequence: Synthetic oligonucleotide
  Target: SCN9A; (+) strand; PAM type: YTN; PAM sequence: TTC
ctttttataacttgaactca

SEQ ID NO: 95866 - DNA, 20 bp, Artificial Sequence
  Description of Artificial Sequence: Synthetic oligonucleotide
  Target: SCN9A; (+) strand; PAM type: YTN; PAM sequence: CTT
tttataacttgaactcatta

SEQ ID NO: 95867 - DNA, 20 bp, Artificial Sequence
  Description of Artificial Sequence: Synthetic oligonucleotide
  Target: SCN9A; (+) strand; PAM type: YTN; PAM sequence: TTT
ttataacttgaactcattaa

SEQ ID NO: 95868 - DNA, 20 bp, Artificial Sequence
  Description of Artificial Sequence: Synthetic oligonucleotide
  Target: SCN9A; (+) strand; PAM type: YTN; PAM sequence: TTT
tataacttgaactcattaat

SEQ ID NO: 95869 - DNA, 20 bp, Artificial Sequence
  Description of Artificial Sequence: Synthetic oligonucleotide
  Target: SCN9A; (+) strand; PAM type: YTN; PAM sequence: TTT
ataacttgaactcattaatg

SEQ ID NO: 95870 - DNA, 20 bp, Artificial Sequence
  Description of Artificial Sequence: Synthetic oligonucleotide
  Target: SCN9A; (+) strand; PAM type: YTN; PAM sequence: TTA
taacttgaactcattaatga

SEQ ID NO: 95871 - DNA, 20 bp, Artificial Sequence
  Description of Artificial Sequence: Synthetic oligonucleotide
  Target: SCN9A; (+) strand; PAM type: YTN; PAM sequence: CTT
gaactcattaatgacttttg

SEQ ID NO: 95872 - DNA, 20 bp, Artificial Sequence
  Description of Artificial Sequence: Synthetic oligonucleotide
  Target: SCN9A; (+) strand; PAM type: YTN; PAM sequence: TTG
aactcattaatgacttttgt

SEQ ID NO: 95873 - DNA, 20 bp, Artificial Sequence
  Description of Artificial Sequence: Synthetic oligonucleotide
  Target: SCN9A; (+) strand; PAM type: YTN; PAM sequence: CTC
attaatgacttttgttctaa

SEQ ID NO: 95874 - DNA, 20 bp, Artificial Sequence
  Description of Artificial Sequence: Synthetic oligonucleotide
  Target: SCN9A; (+) strand; PAM type: YTN; PAM sequence: TTA
atgacttttgttctaatagt

SEQ ID NO: 95875 - DNA, 20 bp, Artificial Sequence
  Description of Artificial Sequence: Synthetic oligonucleotide
  Target: SCN9A; (+) strand; PAM type: YTN; PAM sequence: CTT
ttgttctaatagtagtatgt

SEQ ID NO: 95876 - DNA, 20 bp, Artificial Sequence
  Description of Artificial Sequence: Synthetic oligonucleotide
  Target: SCN9A; (+) strand; PAM type: YTN; PAM sequence: TTT
tgttctaatagtagtatgtt

SEQ ID NO: 95877 - DNA, 20 bp, Artificial Sequence
  Description of Artificial Sequence: Synthetic oligonucleotide
  Target: SCN9A; (+) strand; PAM type: YTN; PAM sequence: TTT
gttctaatagtagtatgttt

SEQ ID NO: 95878 - DNA, 20 bp, Artificial Sequence
  Description of Artificial Sequence: Synthetic oligonucleotide
  Target: SCN9A; (+) strand; PAM type: YTN; PAM sequence: TTG
ttctaatagtagtatgtttt

SEQ ID NO: 95879 - DNA, 20 bp, Artificial Sequence
  Description of Artificial Sequence: Synthetic oligonucleotide
  Target: SCN9A; (+) strand; PAM type: YTN; PAM sequence: TTC
taatagtagtatgttttatg

SEQ ID NO: 95880 - DNA, 20 bp, Artificial Sequence
  Description of Artificial Sequence: Synthetic oligonucleotide
  Target: SCN9A; (+) strand; PAM type: YTN; PAM sequence: CTA
atagtagtatgttttatgat

SEQ ID NO: 95881 - DNA, 20 bp, Artificial Sequence
  Description of Artificial Sequence: Synthetic oligonucleotide
  Target: SCN9A; (+) strand; PAM type: YTN; PAM sequence: TTT
tatgattattaaaaactaat

SEQ ID NO: 95882 - DNA, 20 bp, Artificial Sequence
  Description of Artificial Sequence: Synthetic oligonucleotide
  Target: SCN9A; (+) strand; PAM type: YTN; PAM sequence: TTT
atgattattaaaaactaatt

SEQ ID NO: 95883 - DNA, 20 bp, Artificial Sequence
  Description of Artificial Sequence: Synthetic oligonucleotide
  Target: SCN9A; (+) strand; PAM type: YTN; PAM sequence: TTA
tgattattaaaaactaattt

SEQ ID NO: 95884 - DNA, 20 bp, Artificial Sequence
  Description of Artificial Sequence: Synthetic oligonucleotide
  Target: SCN9A; (+) strand; PAM type: YTN; PAM sequence: TTA
ttaaaaactaatttcacatg

SEQ ID NO: 95885 - DNA, 20 bp, Artificial Sequence
  Description of Artificial Sequence: Synthetic oligonucleotide
  Target: SCN9A; (+) strand; PAM type: YTN; PAM sequence: TTA
aaaactaatttcacatgaaa

SEQ ID NO: 95886 - DNA, 20 bp, Artificial Sequence
  Description of Artificial Sequence: Synthetic oligonucleotide
  Target: SCN9A; (+) strand; PAM type: YTN; PAM sequence: CTA
atttcacatgaaatcattag

SEQ ID NO: 95887 - DNA, 20 bp, Artificial Sequence
  Description of Artificial Sequence: Synthetic oligonucleotide
  Target: SCN9A; (+) strand; PAM type: YTN; PAM sequence: TTT
cacatgaaatcattagaggt

SEQ ID NO: 95888 - DNA, 20 bp, Artificial Sequence
  Description of Artificial Sequence: Synthetic oligonucleotide
  Target: SCN9A; (+) strand; PAM type: YTN; PAM sequence: TTC
acatgaaatcattagaggtg

SEQ ID NO: 95889 - DNA, 20 bp, Artificial Sequence
  Description of Artificial Sequence: Synthetic oligonucleotide
  Target: SCN9A; (+) strand; PAM type: YTN; PAM sequence: TTA
gaggtgaaaaaagtacttat

SEQ ID NO: 95890 - DNA, 20 bp, Artificial Sequence
  Description of Artificial Sequence: Synthetic oligonucleotide
  Target: SCN9A; (+) strand; PAM type: YTN; PAM sequence: CTT
atgaggatgatgaatagttg

SEQ ID NO: 95891 - DNA, 20 bp, Artificial Sequence
  Description of Artificial Sequence: Synthetic oligonucleotide
  Target: SCN9A; (+) strand; PAM type: YTN; PAM sequence: TTA
tgaggatgatgaatagttgg

SEQ ID NO: 95892 - DNA, 20 bp, Artificial Sequence
  Description of Artificial Sequence: Synthetic oligonucleotide
  Target: SCN9A; (+) strand; PAM type: YTN; PAM sequence: TTG
gaaaaactagtaaaataggg

SEQ ID NO: 95893 - DNA, 20 bp, Artificial Sequence
  Description of Artificial Sequence: Synthetic oligonucleotide
  Target: SCN9A; (+) strand; PAM type: YTN; PAM sequence: CTA
gtaaaatagggttggttatt

SEQ ID NO: 95894 - DNA, 20 bp, Artificial Sequence
  Description of Artificial Sequence: Synthetic oligonucleotide
  Target: SCN9A; (+) strand; PAM type: YTN; PAM sequence: TTG
gttattagaaagaggcatgg

SEQ ID NO: 95895 - DNA, 20 bp, Artificial Sequence
  Description of Artificial Sequence: Synthetic oligonucleotide
  Target: SCN9A; (+) strand; PAM type: YTN; PAM sequence: TTA
ttagaaagaggcatgggtag

SEQ ID NO: 95896 - DNA, 20 bp, Artificial Sequence
  Description of Artificial Sequence: Synthetic oligonucleotide
  Target: SCN9A; (+) strand; PAM type: YTN; PAM sequence: TTA
gaaagaggcatgggtagttg

SEQ ID NO: 95897 - DNA, 20 bp, Artificial Sequence
  Description of Artificial Sequence: Synthetic oligonucleotide
  Target: SCN9A; (+) strand; PAM type: YTN; PAM sequence: TTG
atagagccataagctttgat

SEQ ID NO: 95898 - DNA, 20 bp, Artificial Sequence
  Description of Artificial Sequence: Synthetic oligonucleotide
  Target: SCN9A; (+) strand; PAM type: YTN; PAM sequence: CTT
tgatcaaattattgaagtta

SEQ ID NO: 95899 - DNA, 20 bp, Artificial Sequence
  Description of Artificial Sequence: Synthetic oligonucleotide
  Target: SCN9A; (+) strand; PAM type: YTN; PAM sequence: TTT
gatcaaattattgaagttaa

SEQ ID NO: 95900 - DNA, 20 bp, Artificial Sequence
  Description of Artificial Sequence: Synthetic oligonucleotide
  Target: SCN9A; (+) strand; PAM type: YTN; PAM sequence: TTG
atcaaattattgaagttaaa

SEQ ID NO: 95901 - DNA, 20 bp, Artificial Sequence
  Description of Artificial Sequence: Synthetic oligonucleotide
  Target: SCN9A; (+) strand; PAM type: YTN; PAM sequence: TTA
ttgaagttaaaaagcagtaa

SEQ ID NO: 95902 - DNA, 20 bp, Artificial Sequence
  Description of Artificial Sequence: Synthetic oligonucleotide
  Target: SCN9A; (+) strand; PAM type: YTN; PAM sequence: TTG
aagttaaaaagcagtaagtg

SEQ ID NO: 95903 - DNA, 20 bp, Artificial Sequence
  Description of Artificial Sequence: Synthetic oligonucleotide
  Target: SCN9A; (+) strand; PAM type: YTN; PAM sequence: TTA
aaaagcagtaagtggcaaca

SEQ ID NO: 95904 - DNA, 20 bp, Artificial Sequence
  Description of Artificial Sequence: Synthetic oligonucleotide
  Target: SCN9A; (+) strand; PAM type: YTN; PAM sequence: TTG
cattgtggaaaagatatggg

SEQ ID NO: 95905 - DNA, 20 bp, Artificial Sequence
  Description of Artificial Sequence: Synthetic oligonucleotide
  Target: SCN9A; (+) strand; PAM type: YTN; PAM sequence: TTG
tggaaaagatatgggttttc

SEQ ID NO: 95906 - DNA, 20 bp, Artificial Sequence
  Description of Artificial Sequence: Synthetic oligonucleotide
  Target: SCN9A; (+) strand; PAM type: YTN; PAM sequence: TTT
tcaaatcaaacaggcatttc

SEQ ID NO: 95907 - DNA, 20 bp, Artificial Sequence
  Description of Artificial Sequence: Synthetic oligonucleotide
  Target: SCN9A; (+) strand; PAM type: YTN; PAM sequence: TTT
caaatcaaacaggcatttca

SEQ ID NO: 95908 - DNA, 20 bp, Artificial Sequence
  Description of Artificial Sequence: Synthetic oligonucleotide
  Target: SCN9A; (+) strand; PAM type: YTN; PAM sequence: TTC
aaatcaaacaggcatttcaa

SEQ ID NO: 95909 - DNA, 20 bp, Artificial Sequence
  Description of Artificial Sequence: Synthetic oligonucleotide
  Target: SCN9A; (+) strand; PAM type: YTN; PAM sequence: TTT
caatcataactgtgctggta

SEQ ID NO: 95910 - DNA, 20 bp, Artificial Sequence
  Description of Artificial Sequence: Synthetic oligonucleotide
  Target: SCN9A; (+) strand; PAM type: YTN; PAM sequence: TTC
aatcataactgtgctggtat

SEQ ID NO: 95911 - DNA, 20 bp, Artificial Sequence
  Description of Artificial Sequence: Synthetic oligonucleotide
  Target: SCN9A; (+) strand; PAM type: YTN; PAM sequence: CTG
tgctggtatcctgttacttg

SEQ ID NO: 95912 - DNA, 20 bp, Artificial Sequence
  Description of Artificial Sequence: Synthetic oligonucleotide
  Target: SCN9A; (+) strand; PAM type: YTN; PAM sequence: CTG
gtatcctgttacttggtttg

SEQ ID NO: 95913 - DNA, 20 bp, Artificial Sequence
  Description of Artificial Sequence: Synthetic oligonucleotide
  Target: SCN9A; (+) strand; PAM type: YTN; PAM sequence: CTG
ttacttggtttgaaacaatt

SEQ ID NO: 95914 - DNA, 20 bp, Artificial Sequence
  Description of Artificial Sequence: Synthetic oligonucleotide
  Target: SCN9A; (+) strand; PAM type: YTN; PAM sequence: TTA
cttggtttgaaacaatttat

SEQ ID NO: 95915 - DNA, 20 bp, Artificial Sequence
  Description of Artificial Sequence: Synthetic oligonucleotide
  Target: SCN9A; (+) strand; PAM type: YTN; PAM sequence: CTT
ggtttgaaacaatttatcca

SEQ ID NO: 95916 - DNA, 20 bp, Artificial Sequence
  Description of Artificial Sequence: Synthetic oligonucleotide
  Target: SCN9A; (+) strand; PAM type: YTN; PAM sequence: TTG
gtttgaaacaatttatccat

SEQ ID NO: 95917 - DNA, 20 bp, Artificial Sequence
  Description of Artificial Sequence: Synthetic oligonucleotide
  Target: SCN9A; (+) strand; PAM type: YTN; PAM sequence: TTT
gaaacaatttatccatcctt

SEQ ID NO: 95918 - DNA, 20 bp, Artificial Sequence
  Description of Artificial Sequence: Synthetic oligonucleotide
  Target: SCN9A; (+) strand; PAM type: YTN; PAM sequence: TTG
aaacaatttatccatccttt

SEQ ID NO: 95919 - DNA, 20 bp, Artificial Sequence
  Description of Artificial Sequence: Synthetic oligonucleotide
  Target: SCN9A; (+) strand; PAM type: YTN; PAM sequence: TTT
atccatcctttctaggggct

SEQ ID NO: 95920 - DNA, 20 bp, Artificial Sequence
  Description of Artificial Sequence: Synthetic oligonucleotide
  Target: SCN9A; (+) strand; PAM type: YTN; PAM sequence: TTA
tccatcctttctaggggcta

SEQ ID NO: 95921 - DNA, 20 bp, Artificial Sequence
  Description of Artificial Sequence: Synthetic oligonucleotide
  Target: SCN9A; (+) strand; PAM type: YTN; PAM sequence: CTT
tctaggggctaatttattca

SEQ ID NO: 95922 - DNA, 20 bp, Artificial Sequence
  Description of Artificial Sequence: Synthetic oligonucleotide
  Target: SCN9A; (+) strand; PAM type: YTN; PAM sequence: TTT
ctaggggctaatttattcat

SEQ ID NO: 95923 - DNA, 20 bp, Artificial Sequence
  Description of Artificial Sequence: Synthetic oligonucleotide
  Target: SCN9A; (+) strand; PAM type: YTN; PAM sequence: TTC
taggggctaatttattcatt

SEQ ID NO: 95924 - DNA, 20 bp, Artificial Sequence
  Description of Artificial Sequence: Synthetic oligonucleotide
  Target: SCN9A; (+) strand; PAM type: YTN; PAM sequence: CTA
ggggctaatttattcatttt

SEQ ID NO: 95925 - DNA, 20 bp, Artificial Sequence
  Description of Artificial Sequence: Synthetic oligonucleotide
  Target: SCN9A; (+) strand; PAM type: YTN; PAM sequence: CTA
atttattcattttcatcaag

SEQ ID NO: 95926 - DNA, 20 bp, Artificial Sequence
  Description of Artificial Sequence: Synthetic oligonucleotide
  Target: SCN9A; (+) strand; PAM type: YTN; PAM sequence: TTT
attcattttcatcaagatac

SEQ ID NO: 95927 - DNA, 20 bp, Artificial Sequence
  Description of Artificial Sequence: Synthetic oligonucleotide
  Target: SCN9A; (+) strand; PAM type: YTN; PAM sequence: TTA
ttcattttcatcaagatacc

SEQ ID NO: 95928 - DNA, 20 bp, Artificial Sequence
  Description of Artificial Sequence: Synthetic oligonucleotide
  Target: SCN9A; (+) strand; PAM type: YTN; PAM sequence: TTC
attttcatcaagataccact

SEQ ID NO: 95929 - DNA, 20 bp, Artificial Sequence
  Description of Artificial Sequence: Synthetic oligonucleotide
  Target: SCN9A; (+) strand; PAM type: YTN; PAM sequence: TTT
tcatcaagataccactttca

SEQ ID NO: 95930 - DNA, 20 bp, Artificial Sequence
  Description of Artificial Sequence: Synthetic oligonucleotide
  Target: SCN9A; (+) strand; PAM type: YTN; PAM sequence: TTT
catcaagataccactttcaa

SEQ ID NO: 95931 - DNA, 20 bp, Artificial Sequence
  Description of Artificial Sequence: Synthetic oligonucleotide
  Target: SCN9A; (+) strand; PAM type: YTN; PAM sequence: TTC
atcaagataccactttcaag

SEQ ID NO: 95932 - DNA, 20 bp, Artificial Sequence
  Description of Artificial Sequence: Synthetic oligonucleotide
  Target: SCN9A; (+) strand; PAM type: YTN; PAM sequence: CTT
tcaagggagggagaggagtg

SEQ ID NO: 95933 - DNA, 20 bp, Artificial Sequence
  Description of Artificial Sequence: Synthetic oligonucleotide
  Target: SCN9A; (+) strand; PAM type: YTN; PAM sequence: TTT
caagggagggagaggagtgg

SEQ ID NO: 95934 - DNA, 20 bp, Artificial Sequence
  Description of Artificial Sequence: Synthetic oligonucleotide
  Target: SCN9A; (+) strand; PAM type: YTN; PAM sequence: TTC
aagggagggagaggagtgga

SEQ ID NO: 95935 - DNA, 20 bp, Artificial Sequence
  Description of Artificial Sequence: Synthetic oligonucleotide
  Target: SCN9A; (+) strand; PAM type: YTN; PAM sequence: CTT
gccattcagtgtgctgcact

SEQ ID NO: 95936 - DNA, 20 bp, Artificial Sequence
  Description of Artificial Sequence: Synthetic oligonucleotide
  Target: SCN9A; (+) strand; PAM type: YTN; PAM sequence: TTG
ccattcagtgtgctgcacta

SEQ ID NO: 95937 - DNA, 20 bp, Artificial Sequence
  Description of Artificial Sequence: Synthetic oligonucleotide
  Target: SCN9A; (+) strand; PAM type: YTN; PAM sequence: TTC
agtgtgctgcactagggtcc

SEQ ID NO: 95938 - DNA, 20 bp, Artificial Sequence
  Description of Artificial Sequence: Synthetic oligonucleotide
  Target: SCN9A; (+) strand; PAM type: YTN; PAM sequence: CTG
cactagggtccagtttcact

SEQ ID NO: 95939 - DNA, 20 bp, Artificial Sequence
  Description of Artificial Sequence: Synthetic oligonucleotide
  Target: SCN9A; (+) strand; PAM type: YTN; PAM sequence: CTA
gggtccagtttcactcttgc

SEQ ID NO: 95940 - DNA, 20 bp, Artificial Sequence
  Description of Artificial Sequence: Synthetic oligonucleotide
  Target: SCN9A; (+) strand; PAM type: YTN; PAM sequence: TTT
cactcttgcctcatatggag

SEQ ID NO: 95941 - DNA, 20 bp, Artificial Sequence
  Description of Artificial Sequence: Synthetic oligonucleotide
  Target: SCN9A; (+) strand; PAM type: YTN; PAM sequence: TTC
actcttgcctcatatggagc

SEQ ID NO: 95942 - DNA, 20 bp, Artificial Sequence
  Description of Artificial Sequence: Synthetic oligonucleotide
  Target: SCN9A; (+) strand; PAM type: YTN; PAM sequence: CTC
ttgcctcatatggagcactg

SEQ ID NO: 95943 - DNA, 20 bp, Artificial Sequence
  Description of Artificial Sequence: Synthetic oligonucleotide
  Target: SCN9A; (+) strand; PAM type: YTN; PAM sequence: CTT
gcctcatatggagcactgaa

SEQ ID NO: 95944 - DNA, 20 bp, Artificial Sequence
  Description of Artificial Sequence: Synthetic oligonucleotide
  Target: SCN9A; (+) strand; PAM type: YTN; PAM sequence: TTG
cctcatatggagcactgaaa

SEQ ID NO: 95945 - DNA, 20 bp, Artificial Sequence
  Description of Artificial Sequence: Synthetic oligonucleotide
  Target: SCN9A; (+) strand; PAM type: YTN; PAM sequence: CTC
atatggagcactgaaagaac

SEQ ID NO: 95946 - DNA, 20 bp, Artificial Sequence
  Description of Artificial Sequence: Synthetic oligonucleotide
  Target: SCN9A; (+) strand; PAM type: YTN; PAM sequence: CTG
aaagaaccagtatgattaga

SEQ ID NO: 95947 - DNA, 20 bp, Artificial Sequence
  Description of Artificial Sequence: Synthetic oligonucleotide
  Target: SCN9A; (+) strand; PAM type: YTN; PAM sequence: TTA
gaacaattgatacagctaca

SEQ ID NO: 95948 - DNA, 20 bp, Artificial Sequence
  Description of Artificial Sequence: Synthetic oligonucleotide
  Target: SCN9A; (+) strand; PAM type: YTN; PAM sequence: TTG
atacagctacaaacatagga

SEQ ID NO: 95949 - DNA, 20 bp, Artificial Sequence
  Description of Artificial Sequence: Synthetic oligonucleotide
  Target: SCN9A; (+) strand; PAM type: YTN; PAM sequence: CTA
caaacataggaaaaggggac

SEQ ID NO: 95950 - DNA, 20 bp, Artificial Sequence
  Description of Artificial Sequence: Synthetic oligonucleotide
  Target: SCN9A; (+) strand; PAM type: YTN; PAM sequence: TTA
gctgtttgagagactctcag

SEQ ID NO: 95951 - DNA, 20 bp, Artificial Sequence
  Description of Artificial Sequence: Synthetic oligonucleotide
  Target: SCN9A; (+) strand; PAM type: YTN; PAM sequence: CTG
tttgagagactctcagtatc

SEQ ID NO: 95952 - DNA, 20 bp, Artificial Sequence
  Description of Artificial Sequence: Synthetic oligonucleotide
  Target: SCN9A; (+) strand; PAM type: YTN; PAM sequence: TTT
gagagactctcagtatctct

SEQ ID NO: 95953 - DNA, 20 bp, Artificial Sequence
  Description of Artificial Sequence: Synthetic oligonucleotide
  Target: SCN9A; (+) strand; PAM type: YTN; PAM sequence: TTG
agagactctcagtatctcta

SEQ ID NO: 95954 - DNA, 20 bp, Artificial Sequence
  Description of Artificial Sequence: Synthetic oligonucleotide
  Target: SCN9A; (+) strand; PAM type: YTN; PAM sequence: CTC
tcagtatctctagccaggct

SEQ ID NO: 95955 - DNA, 20 bp, Artificial Sequence
  Description of Artificial Sequence: Synthetic oligonucleotide
  Target: SCN9A; (+) strand; PAM type: YTN; PAM sequence: CTC
agtatctctagccaggctga

SEQ ID NO: 95956 - DNA, 20 bp, Artificial Sequence
  Description of Artificial Sequence: Synthetic oligonucleotide
  Target: SCN9A; (+) strand; PAM type: YTN; PAM sequence: CTC
tagccaggctgactggcaaa

SEQ ID NO: 95957 - DNA, 20 bp, Artificial Sequence
  Description of Artificial Sequence: Synthetic oligonucleotide
  Target: SCN9A; (+) strand; PAM type: YTN; PAM sequence: CTA
gccaggctgactggcaaagg

SEQ ID NO: 95958 - DNA, 20 bp, Artificial Sequence
  Description of Artificial Sequence: Synthetic oligonucleotide
  Target: SCN9A; (+) strand; PAM type: YTN; PAM sequence: CTG
actggcaaaggtcttgccct

SEQ ID NO: 95959 - DNA, 20 bp, Artificial Sequence
  Description of Artificial Sequence: Synthetic oligonucleotide
  Target: SCN9A; (+) strand; PAM type: YTN; PAM sequence: CTG
gcaaaggtcttgccctgtca

SEQ ID NO: 95960 - DNA, 20 bp, Artificial Sequence
  Description of Artificial Sequence: Synthetic oligonucleotide
  Target: SCN9A; (+) strand; PAM type: YTN; PAM sequence: CTT
gccctgtcaaagtcagtcca

SEQ ID NO: 95961 - DNA, 20 bp, Artificial Sequence
  Description of Artificial Sequence: Synthetic oligonucleotide
  Target: SCN9A; (+) strand; PAM type: YTN; PAM sequence: TTG
ccctgtcaaagtcagtccat

SEQ ID NO: 95962 - DNA, 20 bp, Artificial Sequence
  Description of Artificial Sequence: Synthetic oligonucleotide
  Target: SCN9A; (+) strand; PAM type: YTN; PAM sequence: CTG
tcaaagtcagtccataaatc

SEQ ID NO: 95963 - DNA, 20 bp, Artificial Sequence
  Description of Artificial Sequence: Synthetic oligonucleotide
  Target: SCN9A; (+) strand; PAM type: YTN; PAM sequence: CTT
ggtggctgttttgtgtcctt

SEQ ID NO: 95964 - DNA, 20 bp, Artificial Sequence
  Description of Artificial Sequence: Synthetic oligonucleotide
  Target: SCN9A; (+) strand; PAM type: YTN; PAM sequence: TTG
gtggctgttttgtgtccttt

SEQ ID NO: 95965 - DNA, 20 bp, Artificial Sequence
  Description of Artificial Sequence: Synthetic oligonucleotide
  Target: SCN9A; (+) strand; PAM type: YTN; PAM sequence: CTG
ttttgtgtcctttgtgacat

SEQ ID NO: 95966 - DNA, 20 bp, Artificial Sequence
  Description of Artificial Sequence: Synthetic oligonucleotide
  Target: SCN9A; (+) strand; PAM type: YTN; PAM sequence: TTT
tgtgtcctttgtgacattgt

SEQ ID NO: 95967 - DNA, 20 bp, Artificial Sequence
  Description of Artificial Sequence: Synthetic oligonucleotide
  Target: SCN9A; (+) strand; PAM type: YTN; PAM sequence: TTT
gtgtcctttgtgacattgtg

SEQ ID NO: 95968 - DNA, 20 bp, Artificial Sequence
  Description of Artificial Sequence: Synthetic oligonucleotide
  Target: SCN9A; (+) strand; PAM type: YTN; PAM sequence: TTG
tgtcctttgtgacattgtgt

SEQ ID NO: 95969 - DNA, 20 bp, Artificial Sequence
  Description of Artificial Sequence: Synthetic oligonucleotide
  Target: SCN9A; (+) strand; PAM type: YTN; PAM sequence: CTT
tgtgacattgtgtcggatgg

SEQ ID NO: 95970 - DNA, 20 bp, Artificial Sequence
  Description of Artificial Sequence: Synthetic oligonucleotide
  Target: SCN9A; (+) strand; PAM type: YTN; PAM sequence: TTT
gtgacattgtgtcggatggc

SEQ ID NO: 95971 - DNA, 20 bp, Artificial Sequence
  Description of Artificial Sequence: Synthetic oligonucleotide
  Target: SCN9A; (+) strand; PAM type: YTN; PAM sequence: TTG
tgacattgtgtcggatggct

SEQ ID NO: 95972 - DNA, 20 bp, Artificial Sequence
  Description of Artificial Sequence: Synthetic oligonucleotide
  Target: SCN9A; (+) strand; PAM type: YTN; PAM sequence: TTG
tgtcggatggctgacaggtg

SEQ ID NO: 95973 - DNA, 20 bp, Artificial Sequence
  Description of Artificial Sequence: Synthetic oligonucleotide
  Target: SCN9A; (+) strand; PAM type: YTN; PAM sequence: CTG
acaggtggctattcttccaa

SEQ ID NO: 95974 - DNA, 20 bp, Artificial Sequence
  Description of Artificial Sequence: Synthetic oligonucleotide
  Target: SCN9A; (+) strand; PAM type: YTN; PAM sequence: CTA
ttcttccaatgcacagacac

SEQ ID NO: 95975 - DNA, 20 bp, Artificial Sequence
  Description of Artificial Sequence: Synthetic oligonucleotide
  Target: SCN9A; (+) strand; PAM type: YTN; PAM sequence: TTC
ttccaatgcacagacaccaa

SEQ ID NO: 95976 - DNA, 20 bp, Artificial Sequence
  Description of Artificial Sequence: Synthetic oligonucleotide
  Target: SCN9A; (+) strand; PAM type: YTN; PAM sequence: CTT
ccaatgcacagacaccaatg

SEQ ID NO: 95977 - DNA, 20 bp, Artificial Sequence
  Description of Artificial Sequence: Synthetic oligonucleotide
  Target: SCN9A; (+) strand; PAM type: YTN; PAM sequence: TTC
caatgcacagacaccaatgc

SEQ ID NO: 95978 - DNA, 20 bp, Artificial Sequence
  Description of Artificial Sequence: Synthetic oligonucleotide
  Target: SCN9A; (+) strand; PAM type: YTN; PAM sequence: TTA
gggaaacaacaaaaagggat

SEQ ID NO: 95979 - DNA, 20 bp, Artificial Sequence
  Description of Artificial Sequence: Synthetic oligonucleotide
  Target: SCN9A; (+) strand; PAM type: YTN; PAM sequence: TTA
ctgaccctaaagaaatagag

SEQ ID NO: 95980 - DNA, 20 bp, Artificial Sequence
  Description of Artificial Sequence: Synthetic oligonucleotide
  Target: SCN9A; (+) strand; PAM type: YTN; PAM sequence: CTG
accctaaagaaatagagatt

SEQ ID NO: 95981 - DNA, 20 bp, Artificial Sequence
  Description of Artificial Sequence: Synthetic oligonucleotide
  Target: SCN9A; (+) strand; PAM type: YTN; PAM sequence: CTA
aagaaatagagatttataaa

SEQ ID NO: 95982 - DNA, 20 bp, Artificial Sequence
  Description of Artificial Sequence: Synthetic oligonucleotide
  Target: SCN9A; (+) strand; PAM type: YTN; PAM sequence: TTT
ataaattgcctaaaaaagaa

SEQ ID NO: 95983 - DNA, 20 bp, Artificial Sequence
  Description of Artificial Sequence: Synthetic oligonucleotide
  Target: SCN9A; (+) strand; PAM type: YTN; PAM sequence: TTA
taaattgcctaaaaaagaat

SEQ ID NO: 95984 - DNA, 20 bp, Artificial Sequence
  Description of Artificial Sequence: Synthetic oligonucleotide
  Target: SCN9A; (+) strand; PAM type: YTN; PAM sequence: TTG
cctaaaaaagaattcaaaat

SEQ ID NO: 95985 - DNA, 20 bp, Artificial Sequence
  Description of Artificial Sequence: Synthetic oligonucleotide
  Target: SCN9A; (+) strand; PAM type: YTN; PAM sequence: CTA
aaaaagaattcaaaataatt

SEQ ID NO: 95986 - DNA, 20 bp, Artificial Sequence
  Description of Artificial Sequence: Synthetic oligonucleotide
  Target: SCN9A; (+) strand; PAM type: YTN; PAM sequence: TTC
aaaataattatcctaatgaa

SEQ ID NO: 95987 - DNA, 20 bp, Artificial Sequence
  Description of Artificial Sequence: Synthetic oligonucleotide
  Target: SCN9A; (+) strand; PAM type: YTN; PAM sequence: TTA
tcctaatgaagtttagcaaa

SEQ ID NO: 95988 - DNA, 20 bp, Artificial Sequence
  Description of Artificial Sequence: Synthetic oligonucleotide
  Target: SCN9A; (+) strand; PAM type: YTN; PAM sequence: CTA
atgaagtttagcaaagtacc

SEQ ID NO: 95989 - DNA, 20 bp, Artificial Sequence
  Description of Artificial Sequence: Synthetic oligonucleotide
  Target: SCN9A; (+) strand; PAM type: YTN; PAM sequence: TTT
agcaaagtaccagagaacag

SEQ ID NO: 95990 - DNA, 20 bp, Artificial Sequence
  Description of Artificial Sequence: Synthetic oligonucleotide
  Target: SCN9A; (+) strand; PAM type: YTN; PAM sequence: TTA
gcaaagtaccagagaacaga

SEQ ID NO: 95991 - DNA, 20 bp, Artificial Sequence
  Description of Artificial Sequence: Synthetic oligonucleotide
  Target: SCN9A; (+) strand; PAM type: YTN; PAM sequence: CTA
aacaaaatcaggaagatgat

SEQ ID NO: 95992 - DNA, 20 bp, Artificial Sequence
  Description of Artificial Sequence: Synthetic oligonucleotide
  Target: SCN9A; (+) strand; PAM type: YTN; PAM sequence: CTA
tacacacacacacaaaaagt

SEQ ID NO: 95993 - DNA, 20 bp, Artificial Sequence
  Description of Artificial Sequence: Synthetic oligonucleotide
  Target: SCN9A; (+) strand; PAM type: YTN; PAM sequence: CTC
tggaattgaagaatacaata

SEQ ID NO: 95994 - DNA, 20 bp, Artificial Sequence
  Description of Artificial Sequence: Synthetic oligonucleotide
  Target: SCN9A; (+) strand; PAM type: YTN; PAM sequence: CTG
gaattgaagaatacaataat

SEQ ID NO: 95995 - DNA, 20 bp, Artificial Sequence
  Description of Artificial Sequence: Synthetic oligonucleotide
  Target: SCN9A; (+) strand; PAM type: YTN; PAM sequence: TTG
aagaatacaataattgaact

SEQ ID NO: 95996 - DNA, 20 bp, Artificial Sequence
  Description of Artificial Sequence: Synthetic oligonucleotide
  Target: SCN9A; (+) strand; PAM type: YTN; PAM sequence: TTG
aactaaaaaactccctagag

SEQ ID NO: 95997 - DNA, 20 bp, Artificial Sequence
  Description of Artificial Sequence: Synthetic oligonucleotide
  Target: SCN9A; (+) strand; PAM type: YTN; PAM sequence: CTA
aaaaactccctagaggattc

SEQ ID NO: 95998 - DNA, 20 bp, Artificial Sequence
  Description of Artificial Sequence: Synthetic oligonucleotide
  Target: SCN9A; (+) strand; PAM type: YTN; PAM sequence: CTC
cctagaggattcaatagcag

SEQ ID NO: 95999 - DNA, 20 bp, Artificial Sequence
  Description of Artificial Sequence: Synthetic oligonucleotide
  Target: SCN9A; (+) strand; PAM type: YTN; PAM sequence: CTA
gaggattcaatagcagactt

SEQ ID NO: 96000 - DNA, 20 bp, Artificial Sequence
  Description of Artificial Sequence: Synthetic oligonucleotide
  Target: SCN9A; (+) strand; PAM type: YTN; PAM sequence: TTC
aatagcagacttgatcaaac

SEQ ID NO: 96001 - DNA, 20 bp, Artificial Sequence
  Description of Artificial Sequence: Synthetic oligonucleotide
  Target: SCN9A; (+) strand; PAM type: YTN; PAM sequence: CTT
gatcaaactggagaaagaat

SEQ ID NO: 96002 - DNA, 20 bp, Artificial Sequence
  Description of Artificial Sequence: Synthetic oligonucleotide
  Target: SCN9A; (+) strand; PAM type: YTN; PAM sequence: TTG
atcaaactggagaaagaatc

SEQ ID NO: 96003 - DNA, 20 bp, Artificial Sequence
  Description of Artificial Sequence: Synthetic oligonucleotide
  Target: SCN9A; (+) strand; PAM type: YTN; PAM sequence: CTG
gagaaagaatcaacaaacca

SEQ ID NO: 96004 - DNA, 20 bp, Artificial Sequence
  Description of Artificial Sequence: Synthetic oligonucleotide
  Target: SCN9A; (+) strand; PAM type: YTN; PAM sequence: CTG
ggtaaaggatatgaacagac

SEQ ID NO: 96005 - DNA, 20 bp, Artificial Sequence
  Description of Artificial Sequence: Synthetic oligonucleotide
  Target: SCN9A; (+) strand; PAM type: YTN; PAM sequence: CTT
ctcaaaagaagacatttatg

SEQ ID NO: 96006 - DNA, 20 bp, Artificial Sequence
  Description of Artificial Sequence: Synthetic oligonucleotide
  Target: SCN9A; (+) strand; PAM type: YTN; PAM sequence: TTC
tcaaaagaagacatttatgc

SEQ ID NO: 96007 - DNA, 20 bp, Artificial Sequence
  Description of Artificial Sequence: Synthetic oligonucleotide
  Target: SCN9A; (+) strand; PAM type: YTN; PAM sequence: CTC
aaaagaagacatttatgcag

SEQ ID NO: 96008 - DNA, 20 bp, Artificial Sequence
  Description of Artificial Sequence: Synthetic oligonucleotide
  Target: SCN9A; (+) strand; PAM type: YTN; PAM sequence: TTT
atgcagccaaaaaacacatg

SEQ ID NO: 96009 - DNA, 20 bp, Artificial Sequence
  Description of Artificial Sequence: Synthetic oligonucleotide
  Target: SCN9A; (+) strand; PAM type: YTN; PAM sequence: TTA
tgcagccaaaaaacacatga

SEQ ID NO: 96010 - DNA, 20 bp, Artificial Sequence
  Description of Artificial Sequence: Synthetic oligonucleotide
  Target: SCN9A; (+) strand; PAM type: YTN; PAM sequence: CTC
atcatcactggccatcagag

SEQ ID NO: 96011 - DNA, 20 bp, Artificial Sequence
  Description of Artificial Sequence: Synthetic oligonucleotide
  Target: SCN9A; (+) strand; PAM type: YTN; PAM sequence: CTG
gccatcagagaaatgcaaat

SEQ ID NO: 96012 - DNA, 20 bp, Artificial Sequence
  Description of Artificial Sequence: Synthetic oligonucleotide
  Target: SCN9A; (+) strand; PAM type: YTN; PAM sequence: CTC
ataccagttagaatggtgat

SEQ ID NO: 96013 - DNA, 20 bp, Artificial Sequence
  Description of Artificial Sequence: Synthetic oligonucleotide
  Target: SCN9A; (+) strand; PAM type: YTN; PAM sequence: TTA
gaatggtgatcattaaaaag

SEQ ID NO: 96014 - DNA, 20 bp, Artificial Sequence
  Description of Artificial Sequence: Synthetic oligonucleotide
  Target: SCN9A; (+) strand; PAM type: YTN; PAM sequence: TTA
aaaagtcaggaaacaacagg

SEQ ID NO: 96015 - DNA, 20 bp, Artificial Sequence
  Description of Artificial Sequence: Synthetic oligonucleotide
  Target: SCN9A; (+) strand; PAM type: YTN; PAM sequence: CTG
gagaggatgtggagaaatag

SEQ ID NO: 96016 - DNA, 20 bp, Artificial Sequence
  Description of Artificial Sequence: Synthetic oligonucleotide
  Target: SCN9A; (+) strand; PAM type: YTN; PAM sequence: CTT
ttacactgttggtgggactg

SEQ ID NO: 96017 - DNA, 20 bp, Artificial Sequence
  Description of Artificial Sequence: Synthetic oligonucleotide
  Target: SCN9A; (+) strand; PAM type: YTN; PAM sequence: TTT
tacactgttggtgggactgt

SEQ ID NO: 96018 - DNA, 20 bp, Artificial Sequence
  Description of Artificial Sequence: Synthetic oligonucleotide
  Target: SCN9A; (+) strand; PAM type: YTN; PAM sequence: TTT
acactgttggtgggactgta

SEQ ID NO: 96019 - DNA, 20 bp, Artificial Sequence
  Description of Artificial Sequence: Synthetic oligonucleotide
  Target: SCN9A; (+) strand; PAM type: YTN; PAM sequence: TTA
cactgttggtgggactgtaa

SEQ ID NO: 96020 - DNA, 20 bp, Artificial Sequence
  Description of Artificial Sequence: Synthetic oligonucleotide
  Target: SCN9A; (+) strand; PAM type: YTN; PAM sequence: CTG
ttggtgggactgtaaactag

SEQ ID NO: 96021 - DNA, 20 bp, Artificial Sequence
  Description of Artificial Sequence: Synthetic oligonucleotide
  Target: SCN9A; (+) strand; PAM type: YTN; PAM sequence: TTG
gtgggactgtaaactagttc

SEQ ID NO: 96022 - DNA, 20 bp, Artificial Sequence
  Description of Artificial Sequence: Synthetic oligonucleotide
  Target: SCN9A; (+) strand; PAM type: YTN; PAM sequence: CTG
taaactagttcaaccactgt

SEQ ID NO: 96023 - DNA, 20 bp, Artificial Sequence
  Description of Artificial Sequence: Synthetic oligonucleotide
  Target: SCN9A; (+) strand; PAM type: YTN; PAM sequence: CTA
gttcaaccactgtggaagtc

SEQ ID NO: 96024 - DNA, 20 bp, Artificial Sequence
  Description of Artificial Sequence: Synthetic oligonucleotide
  Target: SCN9A; (+) strand; PAM type: YTN; PAM sequence: TTC
aaccactgtggaagtccgtg

SEQ ID NO: 96025 - DNA, 20 bp, Artificial Sequence
  Description of Artificial Sequence: Synthetic oligonucleotide
  Target: SCN9A; (+) strand; PAM type: YTN; PAM sequence: CTG
tggaagtccgtgtggcgatt

SEQ ID NO: 96026 - DNA, 20 bp, Artificial Sequence
  Description of Artificial Sequence: Synthetic oligonucleotide
  Target: SCN9A; (+) strand; PAM type: YTN; PAM sequence: TTC
ctcaaggatctagaactaga

SEQ ID NO: 96027 - DNA, 20 bp, Artificial Sequence
  Description of Artificial Sequence: Synthetic oligonucleotide
  Target: SCN9A; (+) strand; PAM type: YTN; PAM sequence: CTC
aaggatctagaactagaaat

SEQ ID NO: 96028 - DNA, 20 bp, Artificial Sequence
  Description of Artificial Sequence: Synthetic oligonucleotide
  Target: SCN9A; (+) strand; PAM type: YTN; PAM sequence: CTA
gaactagaaataccatttga

SEQ ID NO: 96029 - DNA, 20 bp, Artificial Sequence
  Description of Artificial Sequence: Synthetic oligonucleotide
  Target: SCN9A; (+) strand; PAM type: YTN; PAM sequence: CTA
gaaataccatttgacccagc

SEQ ID NO: 96030 - DNA, 20 bp, Artificial Sequence
  Description of Artificial Sequence: Synthetic oligonucleotide
  Target: SCN9A; (+) strand; PAM type: YTN; PAM sequence: TTT
gacccagccatcccatgact

SEQ ID NO: 96031 - DNA, 20 bp, Artificial Sequence
  Description of Artificial Sequence: Synthetic oligonucleotide
  Target: SCN9A; (+) strand; PAM type: YTN; PAM sequence: TTG
acccagccatcccatgactg

SEQ ID NO: 96032 - DNA, 20 bp, Artificial Sequence
  Description of Artificial Sequence: Synthetic oligonucleotide
  Target: SCN9A; (+) strand; PAM type: YTN; PAM sequence: CTG
ggtatatacccaaaggatta

SEQ ID NO: 96033 - DNA, 20 bp, Artificial Sequence
  Description of Artificial Sequence: Synthetic oligonucleotide
  Target: SCN9A; (+) strand; PAM type: YTN; PAM sequence: TTA
taaatcatgctgctataaag

SEQ ID NO: 96034 - DNA, 20 bp, Artificial Sequence
  Description of Artificial Sequence: Synthetic oligonucleotide
  Target: SCN9A; (+) strand; PAM type: YTN; PAM sequence: CTG
ctataaagacgcatgcacac

SEQ ID NO: 96035 - DNA, 20 bp, Artificial Sequence
  Description of Artificial Sequence: Synthetic oligonucleotide
  Target: SCN9A; (+) strand; PAM type: YTN; PAM sequence: CTA
taaagacgcatgcacacgta

SEQ ID NO: 96036 - DNA, 20 bp, Artificial Sequence
  Description of Artificial Sequence: Synthetic oligonucleotide
  Target: SCN9A; (+) strand; PAM type: YTN; PAM sequence: TTT
attgcggcactattcacaat

SEQ ID NO: 96037 - DNA, 20 bp, Artificial Sequence
  Description of Artificial Sequence: Synthetic oligonucleotide
  Target: SCN9A; (+) strand; PAM type: YTN; PAM sequence: TTA
ttgcggcactattcacaata

SEQ ID NO: 96038 - DNA, 20 bp, Artificial Sequence
  Description of Artificial Sequence: Synthetic oligonucleotide
  Target: SCN9A; (+) strand; PAM type: YTN; PAM sequence: TTG
cggcactattcacaatagca

SEQ ID NO: 96039 - DNA, 20 bp, Artificial Sequence
  Description of Artificial Sequence: Synthetic oligonucleotide
  Target: SCN9A; (+) strand; PAM type: YTN; PAM sequence: CTA
ttcacaatagcaaagacttg

SEQ ID NO: 96040 - DNA, 20 bp, Artificial Sequence
  Description of Artificial Sequence: Synthetic oligonucleotide
  Target: SCN9A; (+) strand; PAM type: YTN; PAM sequence: TTC
acaatagcaaagacttggaa

SEQ ID NO: 96041 - DNA, 20 bp, Artificial Sequence
  Description of Artificial Sequence: Synthetic oligonucleotide
  Target: SCN9A; (+) strand; PAM type: YTN; PAM sequence: CTT
ggaaccaagccaaatgtcca

SEQ ID NO: 96042 - DNA, 20 bp, Artificial Sequence
  Description of Artificial Sequence: Synthetic oligonucleotide
  Target: SCN9A; (+) strand; PAM type: YTN; PAM sequence: TTG
gaaccaagccaaatgtccaa

SEQ ID NO: 96043 - DNA, 20 bp, Artificial Sequence
  Description of Artificial Sequence: Synthetic oligonucleotide
  Target: SCN9A; (+) strand; PAM type: YTN; PAM sequence: CTG
gattaagaaaatatggcaca

SEQ ID NO: 96044 - DNA, 20 bp, Artificial Sequence
  Description of Artificial Sequence: Synthetic oligonucleotide
  Target: SCN9A; (+) strand; PAM type: YTN; PAM sequence: TTA
agaaaatatggcacatatac

SEQ ID NO: 96045 - DNA, 20 bp, Artificial Sequence
  Description of Artificial Sequence: Synthetic oligonucleotide
  Target: SCN9A; (+) strand; PAM type: YTN; PAM sequence: CTA
tgcagccataaaaaaggatg

SEQ ID NO: 96046 - DNA, 20 bp, Artificial Sequence
  Description of Artificial Sequence: Synthetic oligonucleotide
  Target: SCN9A; (+) strand; PAM type: YTN; PAM sequence: CTC
aagtcctttgcagggacatg

SEQ ID NO: 96047 - DNA, 20 bp, Artificial Sequence
  Description of Artificial Sequence: Synthetic oligonucleotide
  Target: SCN9A; (+) strand; PAM type: YTN; PAM sequence: CTT
tgcagggacatgcatgaagc

SEQ ID NO: 96048 - DNA, 20 bp, Artificial Sequence
  Description of Artificial Sequence: Synthetic oligonucleotide
  Target: SCN9A; (+) strand; PAM type: YTN; PAM sequence: TTT
gcagggacatgcatgaagct

SEQ ID NO: 96049 - DNA, 20 bp, Artificial Sequence
  Description of Artificial Sequence: Synthetic oligonucleotide
  Target: SCN9A; (+) strand; PAM type: YTN; PAM sequence: TTG
cagggacatgcatgaagctg

SEQ ID NO: 96050 - DNA, 20 bp, Artificial Sequence
  Description of Artificial Sequence: Synthetic oligonucleotide
  Target: SCN9A; (+) strand; PAM type: YTN; PAM sequence: CTG
gaaaccatcattctcagcaa

SEQ ID NO: 96051 - DNA, 20 bp, Artificial Sequence
  Description of Artificial Sequence: Synthetic oligonucleotide
  Target: SCN9A; (+) strand; PAM type: YTN; PAM sequence: TTC
tcagcaaactatcgcaagga

SEQ ID NO: 96052 - DNA, 20 bp, Artificial Sequence
  Description of Artificial Sequence: Synthetic oligonucleotide
  Target: SCN9A; (+) strand; PAM type: YTN; PAM sequence: CTC
agcaaactatcgcaaggaaa

SEQ ID NO: 96053 - DNA, 20 bp, Artificial Sequence
  Description of Artificial Sequence: Synthetic oligonucleotide
  Target: SCN9A; (+) strand; PAM type: YTN; PAM sequence: CTA
tcgcaaggaaaaaaaccaaa

SEQ ID NO: 96054 - DNA, 20 bp, Artificial Sequence
  Description of Artificial Sequence: Synthetic oligonucleotide
  Target: SCN9A; (+) strand; PAM type: YTN; PAM sequence: CTG
cactttctcactcataggtg

SEQ ID NO: 96055 - DNA, 20 bp, Artificial Sequence
  Description of Artificial Sequence: Synthetic oligonucleotide
  Target: SCN9A; (+) strand; PAM type: YTN; PAM sequence: CTT
tctcactcataggtgggaat

SEQ ID NO: 96056 - DNA, 20 bp, Artificial Sequence
  Description of Artificial Sequence: Synthetic oligonucleotide
  Target: SCN9A; (+) strand; PAM type: YTN; PAM sequence: TTT
ctcactcataggtgggaatt

SEQ ID NO: 96057 - DNA, 20 bp, Artificial Sequence
  Description of Artificial Sequence: Synthetic oligonucleotide
  Target: SCN9A; (+) strand; PAM type: YTN; PAM sequence: TTC
tcactcataggtgggaattg

SEQ ID NO: 96058 - DNA, 20 bp, Artificial Sequence
  Description of Artificial Sequence: Synthetic oligonucleotide
  Target: SCN9A; (+) strand; PAM type: YTN; PAM sequence: CTC
actcataggtgggaattgaa

SEQ ID NO: 96059 - DNA, 20 bp, Artificial Sequence
  Description of Artificial Sequence: Synthetic oligonucleotide
  Target: SCN9A; (+) strand; PAM type: YTN; PAM sequence: CTC
ataggtgggaattgaacaat

SEQ ID NO: 96060 - DNA, 20 bp, Artificial Sequence
  Description of Artificial Sequence: Synthetic oligonucleotide
  Target: SCN9A; (+) strand; PAM type: YTN; PAM sequence: TTG
aacaatgagaacacatggac

SEQ ID NO: 96061 - DNA, 20 bp, Artificial Sequence
  Description of Artificial Sequence: Synthetic oligonucleotide
  Target: SCN9A; (+) strand; PAM type: YTN; PAM sequence: CTG
ttgtggggtggggggaggag

SEQ ID NO: 96062 - DNA, 20 bp, Artificial Sequence
  Description of Artificial Sequence: Synthetic oligonucleotide
  Target: SCN9A; (+) strand; PAM type: YTN; PAM sequence: TTG
tggggtggggggaggagggg

SEQ ID NO: 96063 - DNA, 20 bp, Artificial Sequence
  Description of Artificial Sequence: Synthetic oligonucleotide
  Target: SCN9A; (+) strand; PAM type: YTN; PAM sequence: CTA
acattaggagatatacctaa

SEQ ID NO: 96064 - DNA, 20 bp, Artificial Sequence
  Description of Artificial Sequence: Synthetic oligonucleotide
  Target: SCN9A; (+) strand; PAM type: YTN; PAM sequence: TTA
ggagatatacctaatgttaa

SEQ ID NO: 96065 - DNA, 20 bp, Artificial Sequence
  Description of Artificial Sequence: Synthetic oligonucleotide
  Target: SCN9A; (+) strand; PAM type: YTN; PAM sequence: CTA
atgttaaatgatgagttaat

SEQ ID NO: 96066 - DNA, 20 bp, Artificial Sequence
  Description of Artificial Sequence: Synthetic oligonucleotide
  Target: SCN9A; (+) strand; PAM type: YTN; PAM sequence: TTA
aatgatgagttaatgggtgt

SEQ ID NO: 96067 - DNA, 20 bp, Artificial Sequence
  Description of Artificial Sequence: Synthetic oligonucleotide
  Target: SCN9A; (+) strand; PAM type: YTN; PAM sequence: TTA
atgggtgtagcacaccaaca

SEQ ID NO: 96068 - DNA, 20 bp, Artificial Sequence
  Description of Artificial Sequence: Synthetic oligonucleotide
  Target: SCN9A; (+) strand; PAM type: YTN; PAM sequence: CTA
acctgcacgttgtgcacatg

SEQ ID NO: 96069 - DNA, 20 bp, Artificial Sequence
  Description of Artificial Sequence: Synthetic oligonucleotide
  Target: SCN9A; (+) strand; PAM type: YTN; PAM sequence: CTG
cacgttgtgcacatgtaccc

SEQ ID NO: 96070 - DNA, 20 bp, Artificial Sequence
  Description of Artificial Sequence: Synthetic oligonucleotide
  Target: SCN9A; (+) strand; PAM type: YTN; PAM sequence: TTG
tgcacatgtaccctaaaact

SEQ ID NO: 96071 - DNA, 20 bp, Artificial Sequence
  Description of Artificial Sequence: Synthetic oligonucleotide
  Target: SCN9A; (+) strand; PAM type: YTN; PAM sequence: CTA
aaacttaaagtataataaaa

SEQ ID NO: 96072 - DNA, 20 bp, Artificial Sequence
  Description of Artificial Sequence: Synthetic oligonucleotide
  Target: SCN9A; (+) strand; PAM type: YTN; PAM sequence: CTT
aaagtataataaaaaataaa

SEQ ID NO: 96073 - DNA, 20 bp, Artificial Sequence
  Description of Artificial Sequence: Synthetic oligonucleotide
  Target: SCN9A; (+) strand; PAM type: YTN; PAM sequence: TTA
aagtataataaaaaataaaa

SEQ ID NO: 96074 - DNA, 20 bp, Artificial Sequence
  Description of Artificial Sequence: Synthetic oligonucleotide
  Target: SCN9A; (+) strand; PAM type: YTN; PAM sequence: TTA
aaaaaccctcaaaagatgga

SEQ ID NO: 96075 - DNA, 20 bp, Artificial Sequence
  Description of Artificial Sequence: Synthetic oligonucleotide
  Target: SCN9A; (+) strand; PAM type: YTN; PAM sequence: CTC
aaaagatggacaccaaaaaa

SEQ ID NO: 96076 - DNA, 20 bp, Artificial Sequence
  Description of Artificial Sequence: Synthetic oligonucleotide
  Target: SCN9A; (+) strand; PAM type: YTN; PAM sequence: TTT
aaaattatccagtcagtgga

SEQ ID NO: 96077 - DNA, 20 bp, Artificial Sequence
  Description of Artificial Sequence: Synthetic oligonucleotide
  Target: SCN9A; (+) strand; PAM type: YTN; PAM sequence: TTA
aaattatccagtcagtggag

SEQ ID NO: 96078 - DNA, 20 bp, Artificial Sequence
  Description of Artificial Sequence: Synthetic oligonucleotide
  Target: SCN9A; (+) strand; PAM type: YTN; PAM sequence: TTA
tccagtcagtggagcaagaa

SEQ ID NO: 96079 - DNA, 20 bp, Artificial Sequence
  Description of Artificial Sequence: Synthetic oligonucleotide
  Target: SCN9A; (+) strand; PAM type: YTN; PAM sequence: TTC
atgggacatcattaagtgga

SEQ ID NO: 96080 - DNA, 20 bp, Artificial Sequence
  Description of Artificial Sequence: Synthetic oligonucleotide
  Target: SCN9A; (+) strand; PAM type: YTN; PAM sequence: TTA
agtggaacaatatatgcatt

SEQ ID NO: 96081 - DNA, 20 bp, Artificial Sequence
  Description of Artificial Sequence: Synthetic oligonucleotide
  Target: SCN9A; (+) strand; PAM type: YTN; PAM sequence: TTA
tgaaatcacagagaagacag

SEQ ID NO: 96082 - DNA, 20 bp, Artificial Sequence
  Description of Artificial Sequence: Synthetic oligonucleotide
  Target: SCN9A; (+) strand; PAM type: YTN; PAM sequence: TTT
tttaaatgactaaaatatgt

SEQ ID NO: 96083 - DNA, 20 bp, Artificial Sequence
  Description of Artificial Sequence: Synthetic oligonucleotide
  Target: SCN9A; (+) strand; PAM type: YTN; PAM sequence: TTT
ttaaatgactaaaatatgtt

SEQ ID NO: 96084 - DNA, 20 bp, Artificial Sequence
  Description of Artificial Sequence: Synthetic oligonucleotide
  Target: SCN9A; (+) strand; PAM type: YTN; PAM sequence: TTT
taaatgactaaaatatgttc

SEQ ID NO: 96085 - DNA, 20 bp, Artificial Sequence
  Description of Artificial Sequence: Synthetic oligonucleotide
  Target: SCN9A; (+) strand; PAM type: YTN; PAM sequence: TTT
aaatgactaaaatatgttca

SEQ ID NO: 96086 - DNA, 20 bp, Artificial Sequence
  Description of Artificial Sequence: Synthetic oligonucleotide
  Target: SCN9A; (+) strand; PAM type: YTN; PAM sequence: TTA
aatgactaaaatatgttcaa

SEQ ID NO: 96087 - DNA, 20 bp, Artificial Sequence
  Description of Artificial Sequence: Synthetic oligonucleotide
  Target: SCN9A; (+) strand; PAM type: YTN; PAM sequence: CTA
aaatatgttcaaatttgggg

SEQ ID NO: 96088 - DNA, 20 bp, Artificial Sequence
  Description of Artificial Sequence: Synthetic oligonucleotide
  Target: SCN9A; (+) strand; PAM type: YTN; PAM sequence: TTC
aaatttggggagagatatga

SEQ ID NO: 96089 - DNA, 20 bp, Artificial Sequence
  Description of Artificial Sequence: Synthetic oligonucleotide
  Target: SCN9A; (+) strand; PAM type: YTN; PAM sequence: TTT
ggggagagatatgaacatct

SEQ ID NO: 96090 - DNA, 20 bp, Artificial Sequence
  Description of Artificial Sequence: Synthetic oligonucleotide
  Target: SCN9A; (+) strand; PAM type: YTN; PAM sequence: TTG
gggagagatatgaacatcta

SEQ ID NO: 96091 - DNA, 20 bp, Artificial Sequence
  Description of Artificial Sequence: Synthetic oligonucleotide
  Target: SCN9A; (+) strand; PAM type: YTN; PAM sequence: CTA
aattcaggaaactcaaagaa

SEQ ID NO: 96092 - DNA, 20 bp, Artificial Sequence
  Description of Artificial Sequence: Synthetic oligonucleotide
  Target: SCN9A; (+) strand; PAM type: YTN; PAM sequence: TTC
aggaaactcaaagaatccca

SEQ ID NO: 96093 - DNA, 20 bp, Artificial Sequence
  Description of Artificial Sequence: Synthetic oligonucleotide
  Target: SCN9A; (+) strand; PAM type: YTN; PAM sequence: CTC
aaagaatcccaaataggaca

SEQ ID NO: 96094 - DNA, 20 bp, Artificial Sequence
  Description of Artificial Sequence: Synthetic oligonucleotide
  Target: SCN9A; (+) strand; PAM type: YTN; PAM sequence: CTA
aagaagtctcggctgggcat

SEQ ID NO: 96095 - DNA, 20 bp, Artificial Sequence
  Description of Artificial Sequence: Synthetic oligonucleotide
  Target: SCN9A; (+) strand; PAM type: YTN; PAM sequence: CTC
ggctgggcatggtggctcac

SEQ ID NO: 96096 - DNA, 20 bp, Artificial Sequence
  Description of Artificial Sequence: Synthetic oligonucleotide
  Target: SCN9A; (+) strand; PAM type: YTN; PAM sequence: CTG
ggcatggtggctcacacctg

SEQ ID NO: 96097 - DNA, 20 bp, Artificial Sequence
  Description of Artificial Sequence: Synthetic oligonucleotide
  Target: SCN9A; (+) strand; PAM type: YTN; PAM sequence: CTC
acacctgtaatcccagcact

SEQ ID NO: 96098 - DNA, 20 bp, Artificial Sequence
  Description of Artificial Sequence: Synthetic oligonucleotide
  Target: SCN9A; (+) strand; PAM type: YTN; PAM sequence: CTG
taatcccagcactttgaggg

SEQ ID NO: 96099 - DNA, 20 bp, Artificial Sequence
  Description of Artificial Sequence: Synthetic oligonucleotide
  Target: SCN9A; (+) strand; PAM type: YTN; PAM sequence: CTT
tgaggggctgagcgggagtg

SEQ ID NO: 96100 - DNA, 20 bp, Artificial Sequence
  Description of Artificial Sequence: Synthetic oligonucleotide
  Target: SCN9A; (+) strand; PAM type: YTN; PAM sequence: TTT
gaggggctgagcgggagtgg

SEQ ID NO: 96101 - DNA, 20 bp, Artificial Sequence
  Description of Artificial Sequence: Synthetic oligonucleotide
  Target: SCN9A; (+) strand; PAM type: YTN; PAM sequence: TTG
aggggctgagcgggagtgga

SEQ ID NO: 96102 - DNA, 20 bp, Artificial Sequence
  Description of Artificial Sequence: Synthetic oligonucleotide
  Target: SCN9A; (+) strand; PAM type: YTN; PAM sequence: CTG
agcgggagtggatcacctga

SEQ ID NO: 96103 - DNA, 20 bp, Artificial Sequence
  Description of Artificial Sequence: Synthetic oligonucleotide
  Target: SCN9A; (+) strand; PAM type: YTN; PAM sequence: CTG
aggtcaggagttcaagacca

SEQ ID NO: 96104 - DNA, 20 bp, Artificial Sequence
  Description of Artificial Sequence: Synthetic oligonucleotide
  Target: SCN9A; (+) strand; PAM type: YTN; PAM sequence: TTC
aagaccagcctggccaacat

SEQ ID NO: 96105 - DNA, 20 bp, Artificial Sequence
  Description of Artificial Sequence: Synthetic oligonucleotide
  Target: SCN9A; (+) strand; PAM type: YTN; PAM sequence: CTG
gccaacatggcaaaaccaca

SEQ ID NO: 96106 - DNA, 20 bp, Artificial Sequence
  Description of Artificial Sequence: Synthetic oligonucleotide
  Target: SCN9A; (+) strand; PAM type: YTN; PAM sequence: CTC
taccaaaaattacaaaaatc

SEQ ID NO: 96107 - DNA, 20 bp, Artificial Sequence
  Description of Artificial Sequence: Synthetic oligonucleotide
  Target: SCN9A; (+) strand; PAM type: YTN; PAM sequence: CTA
ccaaaaattacaaaaatcag

SEQ ID NO: 96108 - DNA, 20 bp, Artificial Sequence
  Description of Artificial Sequence: Synthetic oligonucleotide
  Target: SCN9A; (+) strand; PAM type: YTN; PAM sequence: TTA
caaaaatcagctgggtgtgg

SEQ ID NO: 96109 - DNA, 20 bp, Artificial Sequence
  Description of Artificial Sequence: Synthetic oligonucleotide
  Target: SCN9A; (+) strand; PAM type: YTN; PAM sequence: CTG
ggtgtggtggtgggtgccta

SEQ ID NO: 96110 - DNA, 20 bp, Artificial Sequence
  Description of Artificial Sequence: Synthetic oligonucleotide
  Target: SCN9A; (+) strand; PAM type: YTN; PAM sequence: CTA
taatcccagctactcgggag

SEQ ID NO: 96111 - DNA, 20 bp, Artificial Sequence
  Description of Artificial Sequence: Synthetic oligonucleotide
  Target: SCN9A; (+) strand; PAM type: YTN; PAM sequence: CTA
ctcgggaggctgaggcagag

SEQ ID NO: 96112 - DNA, 20 bp, Artificial Sequence
  Description of Artificial Sequence: Synthetic oligonucleotide
  Target: SCN9A; (+) strand; PAM type: YTN; PAM sequence: CTC
gggaggctgaggcagagaga

SEQ ID NO: 96113 - DNA, 20 bp, Artificial Sequence
  Description of Artificial Sequence: Synthetic oligonucleotide
  Target: SCN9A; (+) strand; PAM type: YTN; PAM sequence: CTG
aggcagagagaattgcttga

SEQ ID NO: 96114 - DNA, 20 bp, Artificial Sequence
  Description of Artificial Sequence: Synthetic oligonucleotide
  Target: SCN9A; (+) strand; PAM type: YTN; PAM sequence: TTG
cttgaacccacgaggtggaa

SEQ ID NO: 96115 - DNA, 20 bp, Artificial Sequence
  Description of Artificial Sequence: Synthetic oligonucleotide
  Target: SCN9A; (+) strand; PAM type: YTN; PAM sequence: CTT
gaacccacgaggtggaagtt

SEQ ID NO: 96116 - DNA, 20 bp, Artificial Sequence
  Description of Artificial Sequence: Synthetic oligonucleotide
  Target: SCN9A; (+) strand; PAM type: YTN; PAM sequence: TTG
aacccacgaggtggaagttg

SEQ ID NO: 96117 - DNA, 20 bp, Artificial Sequence
  Description of Artificial Sequence: Synthetic oligonucleotide
  Target: SCN9A; (+) strand; PAM type: YTN; PAM sequence: TTG
cagtgagccaagatcatgct

SEQ ID NO: 96118 - DNA, 20 bp, Artificial Sequence
  Description of Artificial Sequence: Synthetic oligonucleotide
  Target: SCN9A; (+) strand; PAM type: YTN; PAM sequence: CTA
ctgcactccagcctgggcaa

SEQ ID NO: 96119 - DNA, 20 bp, Artificial Sequence
  Description of Artificial Sequence: Synthetic oligonucleotide
  Target: SCN9A; (+) strand; PAM type: YTN; PAM sequence: CTG
cactccagcctgggcaacac

SEQ ID NO: 96120 - DNA, 20 bp, Artificial Sequence
  Description of Artificial Sequence: Synthetic oligonucleotide
  Target: SCN9A; (+) strand; PAM type: YTN; PAM sequence: CTC
cagcctgggcaacacggtga

SEQ ID NO: 96121 - DNA, 20 bp, Artificial Sequence
  Description of Artificial Sequence: Synthetic oligonucleotide
  Target: SCN9A; (+) strand; PAM type: YTN; PAM sequence: CTG
ggcaacacggtgaaactcta

SEQ ID NO: 96122 - DNA, 20 bp, Artificial Sequence
  Description of Artificial Sequence: Synthetic oligonucleotide
  Target: SCN9A; (+) strand; PAM type: YTN; PAM sequence: CTC
tatctcggaaaaaaaagaaa

SEQ ID NO: 96123 - DNA, 20 bp, Artificial Sequence
  Description of Artificial Sequence: Synthetic oligonucleotide
  Target: SCN9A; (+) strand; PAM type: YTN; PAM sequence: CTA
tctcggaaaaaaaagaaaga

SEQ ID NO: 96124 - DNA, 20 bp, Artificial Sequence
  Description of Artificial Sequence: Synthetic oligonucleotide
  Target: SCN9A; (+) strand; PAM type: YTN; PAM sequence: CTC
ggaaaaaaaagaaagaaagt

SEQ ID NO: 96125 - DNA, 20 bp, Artificial Sequence
  Description of Artificial Sequence: Synthetic oligonucleotide
  Target: SCN9A; (+) strand; PAM type: YTN; PAM sequence: CTC
cactagagacataatatcat

SEQ ID NO: 96126 - DNA, 20 bp, Artificial Sequence
  Description of Artificial Sequence: Synthetic oligonucleotide
  Target: SCN9A; (+) strand; PAM type: YTN; PAM sequence: CTA
gagacataatatcatcaaat

SEQ ID NO: 96127 - DNA, 20 bp, Artificial Sequence
  Description of Artificial Sequence: Synthetic oligonucleotide
  Target: SCN9A; (+) strand; PAM type: YTN; PAM sequence: TTG
ccaaaagtgaaagggaagtt

SEQ ID NO: 96128 - DNA, 20 bp, Artificial Sequence
  Description of Artificial Sequence: Synthetic oligonucleotide
  Target: SCN9A; (+) strand; PAM type: YTN; PAM sequence: TTT
gaaagcagcaagaaaaaaac

SEQ ID NO: 96129 - DNA, 20 bp, Artificial Sequence
  Description of Artificial Sequence: Synthetic oligonucleotide
  Target: SCN9A; (+) strand; PAM type: YTN; PAM sequence: TTG
aaagcagcaagaaaaaaact

SEQ ID NO: 96130 - DNA, 20 bp, Artificial Sequence
  Description of Artificial Sequence: Synthetic oligonucleotide
  Target: SCN9A; (+) strand; PAM type: YTN; PAM sequence: CTG
aattgtcatgtccaaaagag

SEQ ID NO: 96131 - DNA, 20 bp, Artificial Sequence
  Description of Artificial Sequence: Synthetic oligonucleotide
  Target: SCN9A; (+) strand; PAM type: YTN; PAM sequence: TTG
tcatgtccaaaagagctctc

SEQ ID NO: 96132 - DNA, 20 bp, Artificial Sequence
  Description of Artificial Sequence: Synthetic oligonucleotide
  Target: SCN9A; (+) strand; PAM type: YTN; PAM sequence: CTC
tcttaagatgaacagcagat

SEQ ID NO: 96133 - DNA, 20 bp, Artificial Sequence
  Description of Artificial Sequence: Synthetic oligonucleotide
  Target: SCN9A; (+) strand; PAM type: YTN; PAM sequence: CTC
ttaagatgaacagcagattt

SEQ ID NO: 96134 - DNA, 20 bp, Artificial Sequence
  Description of Artificial Sequence: Synthetic oligonucleotide
  Target: SCN9A; (+) strand; PAM type: YTN; PAM sequence: CTT
aagatgaacagcagatttct

SEQ ID NO: 96135 - DNA, 20 bp, Artificial Sequence
  Description of Artificial Sequence: Synthetic oligonucleotide
  Target: SCN9A; (+) strand; PAM type: YTN; PAM sequence: TTA
agatgaacagcagatttctc

SEQ ID NO: 96136 - DNA, 20 bp, Artificial Sequence
  Description of Artificial Sequence: Synthetic oligonucleotide
  Target: SCN9A; (+) strand; PAM type: YTN; PAM sequence: TTT
ctcagtggaaactttaaaag

SEQ ID NO: 96137 - DNA, 20 bp, Artificial Sequence
  Description of Artificial Sequence: Synthetic oligonucleotide
  Target: SCN9A; (+) strand; PAM type: YTN; PAM sequence: TTC
tcagtggaaactttaaaaga

SEQ ID NO: 96138 - DNA, 20 bp, Artificial Sequence
  Description of Artificial Sequence: Synthetic oligonucleotide
  Target: SCN9A; (+) strand; PAM type: YTN; PAM sequence: CTC
agtggaaactttaaaagagc

SEQ ID NO: 96139 - DNA, 20 bp, Artificial Sequence
  Description of Artificial Sequence: Synthetic oligonucleotide
  Target: SCN9A; (+) strand; PAM type: YTN; PAM sequence: CTT
taaaagagcaaataaagtga

SEQ ID NO: 96140 - DNA, 20 bp, Artificial Sequence
  Description of Artificial Sequence: Synthetic oligonucleotide
  Target: SCN9A; (+) strand; PAM type: YTN; PAM sequence: TTT
aaaagagcaaataaagtgaa

SEQ ID NO: 96141 - DNA, 20 bp, Artificial Sequence
  Description of Artificial Sequence: Synthetic oligonucleotide
  Target: SCN9A; (+) strand; PAM type: YTN; PAM sequence: TTA
aaagagcaaataaagtgaaa

SEQ ID NO: 96142 - DNA, 20 bp, Artificial Sequence
  Description of Artificial Sequence: Synthetic oligonucleotide
  Target: SCN9A; (+) strand; PAM type: YTN; PAM sequence: TTC
aaaatacttaaagaaaaaaa

SEQ ID NO: 96143 - DNA, 20 bp, Artificial Sequence
  Description of Artificial Sequence: Synthetic oligonucleotide
  Target: SCN9A; (+) strand; PAM type: YTN; PAM sequence: CTT
aaagaaaaaaactgctgacc

SEQ ID NO: 96144 - DNA, 20 bp, Artificial Sequence
  Description of Artificial Sequence: Synthetic oligonucleotide
  Target: SCN9A; (+) strand; PAM type: YTN; PAM sequence: TTA
aagaaaaaaactgctgacca

SEQ ID NO: 96145 - DNA, 20 bp, Artificial Sequence
  Description of Artificial Sequence: Synthetic oligonucleotide
  Target: SCN9A; (+) strand; PAM type: YTN; PAM sequence: CTG
ctgaccaagaataatatacc

SEQ ID NO: 96146 - DNA, 20 bp, Artificial Sequence
  Description of Artificial Sequence: Synthetic oligonucleotide
  Target: SCN9A; (+) strand; PAM type: YTN; PAM sequence: CTG
accaagaataatatacctgg

SEQ ID NO: 96147 - DNA, 20 bp, Artificial Sequence
  Description of Artificial Sequence: Synthetic oligonucleotide
  Target: SCN9A; (+) strand; PAM type: YTN; PAM sequence: CTG
gaaaaactgtcctttaaaat

SEQ ID NO: 96148 - DNA, 20 bp, Artificial Sequence
  Description of Artificial Sequence: Synthetic oligonucleotide
  Target: SCN9A; (+) strand; PAM type: YTN; PAM sequence: CTG
tcctttaaaattaaggaagg

SEQ ID NO: 96149 - DNA, 20 bp, Artificial Sequence
  Description of Artificial Sequence: Synthetic oligonucleotide
  Target: SCN9A; (+) strand; PAM type: YTN; PAM sequence: CTT
taaaattaaggaaggataaa

SEQ ID NO: 96150 - DNA, 20 bp, Artificial Sequence
  Description of Artificial Sequence: Synthetic oligonucleotide
  Target: SCN9A; (+) strand; PAM type: YTN; PAM sequence: TTT
aaaattaaggaaggataaaa

SEQ ID NO: 96151 - DNA, 20 bp, Artificial Sequence
  Description of Artificial Sequence: Synthetic oligonucleotide
  Target: SCN9A; (+) strand; PAM type: YTN; PAM sequence: TTA
aaattaaggaaggataaaaa

SEQ ID NO: 96152 - DNA, 20 bp, Artificial Sequence
  Description of Artificial Sequence: Synthetic oligonucleotide
  Target: SCN9A; (+) strand; PAM type: YTN; PAM sequence: TTA
aggaaggataaaaactttct

SEQ ID NO: 96153 - DNA, 20 bp, Artificial Sequence
  Description of Artificial Sequence: Synthetic oligonucleotide
  Target: SCN9A; (+) strand; PAM type: YTN; PAM sequence: CTT
tctcatacaagcaaatgctg

SEQ ID NO: 96154 - DNA, 20 bp, Artificial Sequence
  Description of Artificial Sequence: Synthetic oligonucleotide
  Target: SCN9A; (+) strand; PAM type: YTN; PAM sequence: TTT
ctcatacaagcaaatgctga

SEQ ID NO: 96155 - DNA, 20 bp, Artificial Sequence
  Description of Artificial Sequence: Synthetic oligonucleotide
  Target: SCN9A; (+) strand; PAM type: YTN; PAM sequence: TTC
tcatacaagcaaatgctgag

SEQ ID NO: 96156 - DNA, 20 bp, Artificial Sequence
  Description of Artificial Sequence: Synthetic oligonucleotide
  Target: SCN9A; (+) strand; PAM type: YTN; PAM sequence: CTC
atacaagcaaatgctgaggg

SEQ ID NO: 96157 - DNA, 20 bp, Artificial Sequence
  Description of Artificial Sequence: Synthetic oligonucleotide
  Target: SCN9A; (+) strand; PAM type: YTN; PAM sequence: CTG
agggagttcatcaccactag

SEQ ID NO: 96158 - DNA, 20 bp, Artificial Sequence
  Description of Artificial Sequence: Synthetic oligonucleotide
  Target: SCN9A; (+) strand; PAM type: YTN; PAM sequence: TTC
atcaccactagatttatctt

SEQ ID NO: 96159 - DNA, 20 bp, Artificial Sequence
  Description of Artificial Sequence: Synthetic oligonucleotide
  Target: SCN9A; (+) strand; PAM type: YTN; PAM sequence: CTA
gatttatcttataggaaatg

SEQ ID NO: 96160 - DNA, 20 bp, Artificial Sequence
  Description of Artificial Sequence: Synthetic oligonucleotide
  Target: SCN9A; (+) strand; PAM type: YTN; PAM sequence: TTT
atcttataggaaatgctaaa

SEQ ID NO: 96161 - DNA, 20 bp, Artificial Sequence
  Description of Artificial Sequence: Synthetic oligonucleotide
  Target: SCN9A; (+) strand; PAM type: YTN; PAM sequence: TTA
tcttataggaaatgctaaag

SEQ ID NO: 96162 - DNA, 20 bp, Artificial Sequence
  Description of Artificial Sequence: Synthetic oligonucleotide
  Target: SCN9A; (+) strand; PAM type: YTN; PAM sequence: CTT
ataggaaatgctaaagtgag

SEQ ID NO: 96163 - DNA, 20 bp, Artificial Sequence
  Description of Artificial Sequence: Synthetic oligonucleotide
  Target: SCN9A; (+) strand; PAM type: YTN; PAM sequence: TTA
taggaaatgctaaagtgagt

SEQ ID NO: 96164 - DNA, 20 bp, Artificial Sequence
  Description of Artificial Sequence: Synthetic oligonucleotide
  Target: SCN9A; (+) strand; PAM type: YTN; PAM sequence: CTA
aagtgagttcttcaagttga

SEQ ID NO: 96165 - DNA, 20 bp, Artificial Sequence
  Description of Artificial Sequence: Synthetic oligonucleotide
  Target: SCN9A; (+) strand; PAM type: YTN; PAM sequence: TTC
ttcaagttgaaacgaaagca

SEQ ID NO: 96166 - DNA, 20 bp, Artificial Sequence
  Description of Artificial Sequence: Synthetic oligonucleotide
  Target: SCN9A; (+) strand; PAM type: YTN; PAM sequence: CTT
caagttgaaacgaaagcatg

SEQ ID NO: 96167 - DNA, 20 bp, Artificial Sequence
  Description of Artificial Sequence: Synthetic oligonucleotide
  Target: SCN9A; (+) strand; PAM type: YTN; PAM sequence: TTC
aagttgaaacgaaagcatgg

SEQ ID NO: 96168 - DNA, 20 bp, Artificial Sequence
  Description of Artificial Sequence: Synthetic oligonucleotide
  Target: SCN9A; (+) strand; PAM type: YTN; PAM sequence: TTG
aaacgaaagcatggtaaaga

SEQ ID NO: 96169 - DNA, 20 bp, Artificial Sequence
  Description of Artificial Sequence: Synthetic oligonucleotide
  Target: SCN9A; (+) strand; PAM type: YTN; PAM sequence: CTC
actagtaaaggtaaatacat

SEQ ID NO: 96170 - DNA, 20 bp, Artificial Sequence
  Description of Artificial Sequence: Synthetic oligonucleotide
  Target: SCN9A; (+) strand; PAM type: YTN; PAM sequence: CTA
gtaaaggtaaatacatggac

SEQ ID NO: 96171 - DNA, 20 bp, Artificial Sequence
  Description of Artificial Sequence: Synthetic oligonucleotide
  Target: SCN9A; (+) strand; PAM type: YTN; PAM sequence: CTG
taatactctaatagtattat

SEQ ID NO: 96172 - DNA, 20 bp, Artificial Sequence
  Description of Artificial Sequence: Synthetic oligonucleotide
  Target: SCN9A; (+) strand; PAM type: YTN; PAM sequence: CTC
taatagtattatataaatca

SEQ ID NO: 96173 - DNA, 20 bp, Artificial Sequence
  Description of Artificial Sequence: Synthetic oligonucleotide
  Target: SCN9A; (+) strand; PAM type: YTN; PAM sequence: CTA
atagtattatataaatcatt

SEQ ID NO: 96174 - DNA, 20 bp, Artificial Sequence
  Description of Artificial Sequence: Synthetic oligonucleotide
  Target: SCN9A; (+) strand; PAM type: YTN; PAM sequence: TTA
tataaatcatttataattct

SEQ ID NO: 96175 - DNA, 20 bp, Artificial Sequence
  Description of Artificial Sequence: Synthetic oligonucleotide
  Target: SCN9A; (+) strand; PAM type: YTN; PAM sequence: TTT
ataattctaatataaaagtt

SEQ ID NO: 96176 - DNA, 20 bp, Artificial Sequence
  Description of Artificial Sequence: Synthetic oligonucleotide
  Target: SCN9A; (+) strand; PAM type: YTN; PAM sequence: TTA
taattctaatataaaagtta

SEQ ID NO: 96177 - DNA, 20 bp, Artificial Sequence
  Description of Artificial Sequence: Synthetic oligonucleotide
  Target: SCN9A; (+) strand; PAM type: YTN; PAM sequence: TTC
taatataaaagttaaatgtc

SEQ ID NO: 96178 - DNA, 20 bp, Artificial Sequence
  Description of Artificial Sequence: Synthetic oligonucleotide
  Target: SCN9A; (+) strand; PAM type: YTN; PAM sequence: CTA
atataaaagttaaatgtcaa

SEQ ID NO: 96179 - DNA, 20 bp, Artificial Sequence
  Description of Artificial Sequence: Synthetic oligonucleotide
  Target: SCN9A; (+) strand; PAM type: YTN; PAM sequence: TTA
aatgtcaaaataattaagaa

SEQ ID NO: 96180 - DNA, 20 bp, Artificial Sequence
  Description of Artificial Sequence: Synthetic oligonucleotide
  Target: SCN9A; (+) strand; PAM type: YTN; PAM sequence: TTA
agaataactaaaattacaaa

SEQ ID NO: 96181 - DNA, 20 bp, Artificial Sequence
  Description of Artificial Sequence: Synthetic oligonucleotide
  Target: SCN9A; (+) strand; PAM type: YTN; PAM sequence: CTA
aaattacaaaaatgtgtttg

SEQ ID NO: 96182 - DNA, 20 bp, Artificial Sequence
  Description of Artificial Sequence: Synthetic oligonucleotide
  Target: SCN9A; (+) strand; PAM type: YTN; PAM sequence: TTA
caaaaatgtgtttgtagaaa

SEQ ID NO: 96183 - DNA, 20 bp, Artificial Sequence
  Description of Artificial Sequence: Synthetic oligonucleotide
  Target: SCN9A; (+) strand; PAM type: YTN; PAM sequence: TTT
gtagaaacacattataaaaa

SEQ ID NO: 96184 - DNA, 20 bp, Artificial Sequence
  Description of Artificial Sequence: Synthetic oligonucleotide
  Target: SCN9A; (+) strand; PAM type: YTN; PAM sequence: TTG
tagaaacacattataaaaag

SEQ ID NO: 96185 - DNA, 20 bp, Artificial Sequence
  Description of Artificial Sequence: Synthetic oligonucleotide
  Target: SCN9A; (+) strand; PAM type: YTN; PAM sequence: TTA
taaaaagatgtaaattgtga

SEQ ID NO: 96186 - DNA, 20 bp, Artificial Sequence
  Description of Artificial Sequence: Synthetic oligonucleotide
  Target: SCN9A; (+) strand; PAM type: YTN; PAM sequence: TTG
tgacataacaaaaagtgtga

SEQ ID NO: 96187 - DNA, 20 bp, Artificial Sequence
  Description of Artificial Sequence: Synthetic oligonucleotide
  Target: SCN9A; (+) strand; PAM type: YTN; PAM sequence: TTA
aaagtgaagatttttgatat

SEQ ID NO: 96188 - DNA, 20 bp, Artificial Sequence
  Description of Artificial Sequence: Synthetic oligonucleotide
  Target: SCN9A; (+) strand; PAM type: YTN; PAM sequence: TTT
ttgatatatgattgaagtta

SEQ ID NO: 96189 - DNA, 20 bp, Artificial Sequence
  Description of Artificial Sequence: Synthetic oligonucleotide
  Target: SCN9A; (+) strand; PAM type: YTN; PAM sequence: TTT
tgatatatgattgaagttaa

SEQ ID NO: 96190 - DNA, 20 bp, Artificial Sequence
  Description of Artificial Sequence: Synthetic oligonucleotide
  Target: SCN9A; (+) strand; PAM type: YTN; PAM sequence: TTT
gatatatgattgaagttaag

SEQ ID NO: 96191 - DNA, 20 bp, Artificial Sequence
  Description of Artificial Sequence: Synthetic oligonucleotide
  Target: SCN9A; (+) strand; PAM type: YTN; PAM sequence: TTG
atatatgattgaagttaagt

SEQ ID NO: 96192 - DNA, 20 bp, Artificial Sequence
  Description of Artificial Sequence: Synthetic oligonucleotide
  Target: SCN9A; (+) strand; PAM type: YTN; PAM sequence: TTG
aagttaagttgttatcagct

SEQ ID NO: 96193 - DNA, 20 bp, Artificial Sequence
  Description of Artificial Sequence: Synthetic oligonucleotide
  Target: SCN9A; (+) strand; PAM type: YTN; PAM sequence: TTA
agttgttatcagcttaaagt

SEQ ID NO: 96194 - DNA, 20 bp, Artificial Sequence
  Description of Artificial Sequence: Synthetic oligonucleotide
  Target: SCN9A; (+) strand; PAM type: YTN; PAM sequence: TTG
ttatcagcttaaagtagact

SEQ ID NO: 96195 - DNA, 20 bp, Artificial Sequence
  Description of Artificial Sequence: Synthetic oligonucleotide
  Target: SCN9A; (+) strand; PAM type: YTN; PAM sequence: TTA
tcagcttaaagtagactatt

SEQ ID NO: 96196 - DNA, 20 bp, Artificial Sequence
  Description of Artificial Sequence: Synthetic oligonucleotide
  Target: SCN9A; (+) strand; PAM type: YTN; PAM sequence: CTT
aaagtagactattataagat

SEQ ID NO: 96197 - DNA, 20 bp, Artificial Sequence
  Description of Artificial Sequence: Synthetic oligonucleotide
  Target: SCN9A; (+) strand; PAM type: YTN; PAM sequence: TTA
aagtagactattataagata

SEQ ID NO: 96198 - DNA, 20 bp, Artificial Sequence
  Description of Artificial Sequence: Synthetic oligonucleotide
  Target: SCN9A; (+) strand; PAM type: YTN; PAM sequence: CTA
ttataagatatttgtgattg

SEQ ID NO: 96199 - DNA, 20 bp, Artificial Sequence
  Description of Artificial Sequence: Synthetic oligonucleotide
  Target: SCN9A; (+) strand; PAM type: YTN; PAM sequence: TTA
taagatatttgtgattgcct

SEQ ID NO: 96200 - DNA, 20 bp, Artificial Sequence
  Description of Artificial Sequence: Synthetic oligonucleotide
  Target: SCN9A; (+) strand; PAM type: YTN; PAM sequence: TTT
gtgattgcctcatgataacc

SEQ ID NO: 96201 - DNA, 20 bp, Artificial Sequence
  Description of Artificial Sequence: Synthetic oligonucleotide
  Target: SCN9A; (+) strand; PAM type: YTN; PAM sequence: TTG
tgattgcctcatgataacca

SEQ ID NO: 96202 - DNA, 20 bp, Artificial Sequence
  Description of Artificial Sequence: Synthetic oligonucleotide
  Target: SCN9A; (+) strand; PAM type: YTN; PAM sequence: TTG
cctcatgataaccacaagga

SEQ ID NO: 96203 - DNA, 20 bp, Artificial Sequence
  Description of Artificial Sequence: Synthetic oligonucleotide
  Target: SCN9A; (+) strand; PAM type: YTN; PAM sequence: CTC
atgataaccacaaggaaaat

SEQ ID NO: 96204 - DNA, 20 bp, Artificial Sequence
  Description of Artificial Sequence: Synthetic oligonucleotide
  Target: SCN9A; (+) strand; PAM type: YTN; PAM sequence: TTA
agagagaaaaagacagaaaa

SEQ ID NO: 96205 - DNA, 20 bp, Artificial Sequence
  Description of Artificial Sequence: Synthetic oligonucleotide
  Target: SCN9A; (+) strand; PAM type: YTN; PAM sequence: TTA
caaaacagaaaaatttaaca

SEQ ID NO: 96206 - DNA, 20 bp, Artificial Sequence
  Description of Artificial Sequence: Synthetic oligonucleotide
  Target: SCN9A; (+) strand; PAM type: YTN; PAM sequence: TTT
aacaaaaaggcaatagtaag

SEQ ID NO: 96207 - DNA, 20 bp, Artificial Sequence
  Description of Artificial Sequence: Synthetic oligonucleotide
  Target: SCN9A; (+) strand; PAM type: YTN; PAM sequence: TTA
acaaaaaggcaatagtaagt

SEQ ID NO: 96208 - DNA, 20 bp, Artificial Sequence
  Description of Artificial Sequence: Synthetic oligonucleotide
  Target: SCN9A; (+) strand; PAM type: YTN; PAM sequence: TTA
cctaccaatgattatttcaa

SEQ ID NO: 96209 - DNA, 20 bp, Artificial Sequence
  Description of Artificial Sequence: Synthetic oligonucleotide
  Target: SCN9A; (+) strand; PAM type: YTN; PAM sequence: CTA
ccaatgattatttcaaatac

SEQ ID NO: 96210 - DNA, 20 bp, Artificial Sequence
  Description of Artificial Sequence: Synthetic oligonucleotide
  Target: SCN9A; (+) strand; PAM type: YTN; PAM sequence: TTA
tttcaaatacaaatggatta

SEQ ID NO: 96211 - DNA, 20 bp, Artificial Sequence
  Description of Artificial Sequence: Synthetic oligonucleotide
  Target: SCN9A; (+) strand; PAM type: YTN; PAM sequence: TTT
caaatacaaatggattaaac

SEQ ID NO: 96212 - DNA, 20 bp, Artificial Sequence
  Description of Artificial Sequence: Synthetic oligonucleotide
  Target: SCN9A; (+) strand; PAM type: YTN; PAM sequence: TTC
aaatacaaatggattaaact

SEQ ID NO: 96213 - DNA, 20 bp, Artificial Sequence
  Description of Artificial Sequence: Synthetic oligonucleotide
  Target: SCN9A; (+) strand; PAM type: YTN; PAM sequence: TTA
aacttcccaatcaaaagacc

SEQ ID NO: 96214 - DNA, 20 bp, Artificial Sequence
  Description of Artificial Sequence: Synthetic oligonucleotide
  Target: SCN9A; (+) strand; PAM type: YTN; PAM sequence: CTT
cccaatcaaaagacctacaa

SEQ ID NO: 96215 - DNA, 20 bp, Artificial Sequence
  Description of Artificial Sequence: Synthetic oligonucleotide
  Target: SCN9A; (+) strand; PAM type: YTN; PAM sequence: TTC
ccaatcaaaagacctacaat

SEQ ID NO: 96216 - DNA, 20 bp, Artificial Sequence
  Description of Artificial Sequence: Synthetic oligonucleotide
  Target: SCN9A; (+) strand; PAM type: YTN; PAM sequence: CTA
caatggctgcatagatttat

SEQ ID NO: 96217 - DNA, 20 bp, Artificial Sequence
  Description of Artificial Sequence: Synthetic oligonucleotide
  Target: SCN9A; (+) strand; PAM type: YTN; PAM sequence: CTG
catagatttatgaaaacaag

SEQ ID NO: 96218 - DNA, 20 bp, Artificial Sequence
  Description of Artificial Sequence: Synthetic oligonucleotide
  Target: SCN9A; (+) strand; PAM type: YTN; PAM sequence: TTT
atgaaaacaagatccagtta

SEQ ID NO: 96219 - DNA, 20 bp, Artificial Sequence
  Description of Artificial Sequence: Synthetic oligonucleotide
  Target: SCN9A; (+) strand; PAM type: YTN; PAM sequence: TTA
tgaaaacaagatccagttat

SEQ ID NO: 96220 - DNA, 20 bp, Artificial Sequence
  Description of Artificial Sequence: Synthetic oligonucleotide
  Target: SCN9A; (+) strand; PAM type: YTN; PAM sequence: TTA
tatgctgtctccagatactc

SEQ ID NO: 96221 - DNA, 20 bp, Artificial Sequence
  Description of Artificial Sequence: Synthetic oligonucleotide
  Target: SCN9A; (+) strand; PAM type: YTN; PAM sequence: CTG
tctccagatactcgtttcag

SEQ ID NO: 96222 - DNA, 20 bp, Artificial Sequence
  Description of Artificial Sequence: Synthetic oligonucleotide
  Target: SCN9A; (+) strand; PAM type: YTN; PAM sequence: CTC
cagatactcgtttcagattt

SEQ ID NO: 96223 - DNA, 20 bp, Artificial Sequence
  Description of Artificial Sequence: Synthetic oligonucleotide
  Target: SCN9A; (+) strand; PAM type: YTN; PAM sequence: CTC
gtttcagatttaagaaaaca

SEQ ID NO: 96224 - DNA, 20 bp, Artificial Sequence
  Description of Artificial Sequence: Synthetic oligonucleotide
  Target: SCN9A; (+) strand; PAM type: YTN; PAM sequence: TTT
cagatttaagaaaacatagt

SEQ ID NO: 96225 - DNA, 20 bp, Artificial Sequence
  Description of Artificial Sequence: Synthetic oligonucleotide
  Target: SCN9A; (+) strand; PAM type: YTN; PAM sequence: TTC
agatttaagaaaacatagtt

SEQ ID NO: 96226 - DNA, 20 bp, Artificial Sequence
  Description of Artificial Sequence: Synthetic oligonucleotide
  Target: SCN9A; (+) strand; PAM type: YTN; PAM sequence: TTT
aagaaaacatagtttgaaag

SEQ ID NO: 96227 - DNA, 20 bp, Artificial Sequence
  Description of Artificial Sequence: Synthetic oligonucleotide
  Target: SCN9A; (+) strand; PAM type: YTN; PAM sequence: TTA
agaaaacatagtttgaaagt

SEQ ID NO: 96228 - DNA, 20 bp, Artificial Sequence
  Description of Artificial Sequence: Synthetic oligonucleotide
  Target: SCN9A; (+) strand; PAM type: YTN; PAM sequence: TTT
gaaagttaattgataaaaaa

SEQ ID NO: 96229 - DNA, 20 bp, Artificial Sequence
  Description of Artificial Sequence: Synthetic oligonucleotide
  Target: SCN9A; (+) strand; PAM type: YTN; PAM sequence: TTG
aaagttaattgataaaaaag

SEQ ID NO: 96230 - DNA, 20 bp, Artificial Sequence
  Description of Artificial Sequence: Synthetic oligonucleotide
  Target: SCN9A; (+) strand; PAM type: YTN; PAM sequence: TTA
attgataaaaaagatacatt

SEQ ID NO: 96231 - DNA, 20 bp, Artificial Sequence
  Description of Artificial Sequence: Synthetic oligonucleotide
  Target: SCN9A; (+) strand; PAM type: YTN; PAM sequence: TTG
ataaaaaagatacattttgt

SEQ ID NO: 96232 - DNA, 20 bp, Artificial Sequence
  Description of Artificial Sequence: Synthetic oligonucleotide
  Target: SCN9A; (+) strand; PAM type: YTN; PAM sequence: TTT
tgtagaaatggtaaccaaaa

SEQ ID NO: 96233 - DNA, 20 bp, Artificial Sequence
  Description of Artificial Sequence: Synthetic oligonucleotide
  Target: SCN9A; (+) strand; PAM type: YTN; PAM sequence: TTT
gtagaaatggtaaccaaaag

SEQ ID NO: 96234 - DNA, 20 bp, Artificial Sequence
  Description of Artificial Sequence: Synthetic oligonucleotide
  Target: SCN9A; (+) strand; PAM type: YTN; PAM sequence: TTG
tagaaatggtaaccaaaaga

SEQ ID NO: 96235 - DNA, 20 bp, Artificial Sequence
  Description of Artificial Sequence: Synthetic oligonucleotide
  Target: SCN9A; (+) strand; PAM type: YTN; PAM sequence: CTA
tacagtcgtccttcagtatc

SEQ ID NO: 96236 - DNA, 20 bp, Artificial Sequence
  Description of Artificial Sequence: Synthetic oligonucleotide
  Target: SCN9A; (+) strand; PAM type: YTN; PAM sequence: CTT
cagtatctacagggtcatgg

SEQ ID NO: 96237 - DNA, 20 bp, Artificial Sequence
  Description of Artificial Sequence: Synthetic oligonucleotide
  Target: SCN9A; (+) strand; PAM type: YTN; PAM sequence: TTC
agtatctacagggtcatggt

SEQ ID NO: 96238 - DNA, 20 bp, Artificial Sequence
  Description of Artificial Sequence: Synthetic oligonucleotide
  Target: SCN9A; (+) strand; PAM type: YTN; PAM sequence: CTA
cagggtcatggtttcagaac

SEQ ID NO: 96239 - DNA, 20 bp, Artificial Sequence
  Description of Artificial Sequence: Synthetic oligonucleotide
  Target: SCN9A; (+) strand; PAM type: YTN; PAM sequence: TTT
cagaaccccaagggatacca

SEQ ID NO: 96240 - DNA, 20 bp, Artificial Sequence
  Description of Artificial Sequence: Synthetic oligonucleotide
  Target: SCN9A; (+) strand; PAM type: YTN; PAM sequence: TTC
agaaccccaagggataccaa

SEQ ID NO: 96241 - DNA, 20 bp, Artificial Sequence
  Description of Artificial Sequence: Synthetic oligonucleotide
  Target: SCN9A; (+) strand; PAM type: YTN; PAM sequence: TTG
aggatgcttaagtcccacag

SEQ ID NO: 96242 - DNA, 20 bp, Artificial Sequence
  Description of Artificial Sequence: Synthetic oligonucleotide
  Target: SCN9A; (+) strand; PAM type: YTN; PAM sequence: CTT
aagtcccacagtcagtcttg

SEQ ID NO: 96243 - DNA, 20 bp, Artificial Sequence
  Description of Artificial Sequence: Synthetic oligonucleotide
  Target: SCN9A; (+) strand; PAM type: YTN; PAM sequence: TTA
agtcccacagtcagtcttgc

SEQ ID NO: 96244 - DNA, 20 bp, Artificial Sequence
  Description of Artificial Sequence: Synthetic oligonucleotide
  Target: SCN9A; (+) strand; PAM type: YTN; PAM sequence: CTT
gcaggacctgtggataaaaa

SEQ ID NO: 96245 - DNA, 20 bp, Artificial Sequence
  Description of Artificial Sequence: Synthetic oligonucleotide
  Target: SCN9A; (+) strand; PAM type: YTN; PAM sequence: TTG
caggacctgtggataaaaaa

SEQ ID NO: 96246 - DNA, 20 bp, Artificial Sequence
  Description of Artificial Sequence: Synthetic oligonucleotide
  Target: SCN9A; (+) strand; PAM type: YTN; PAM sequence: CTG
tggataaaaaaatttgaccc

SEQ ID NO: 96247 - DNA, 20 bp, Artificial Sequence
  Description of Artificial Sequence: Synthetic oligonucleotide
  Target: SCN9A; (+) strand; PAM type: YTN; PAM sequence: TTT
gaccctctgtatctgtggat

SEQ ID NO: 96248 - DNA, 20 bp, Artificial Sequence
  Description of Artificial Sequence: Synthetic oligonucleotide
  Target: SCN9A; (+) strand; PAM type: YTN; PAM sequence: TTG
accctctgtatctgtggatt

SEQ ID NO: 96249 - DNA, 20 bp, Artificial Sequence
  Description of Artificial Sequence: Synthetic oligonucleotide
  Target: SCN9A; (+) strand; PAM type: YTN; PAM sequence: CTC
tgtatctgtggatttcacat

SEQ ID NO: 96250 - DNA, 20 bp, Artificial Sequence
  Description of Artificial Sequence: Synthetic oligonucleotide
  Target: SCN9A; (+) strand; PAM type: YTN; PAM sequence: CTG
tatctgtggatttcacattc

SEQ ID NO: 96251 - DNA, 20 bp, Artificial Sequence
  Description of Artificial Sequence: Synthetic oligonucleotide
  Target: SCN9A; (+) strand; PAM type: YTN; PAM sequence: CTG
tggatttcacattccatgaa

SEQ ID NO: 96252 - DNA, 20 bp, Artificial Sequence
  Description of Artificial Sequence: Synthetic oligonucleotide
  Target: SCN9A; (+) strand; PAM type: YTN; PAM sequence: TTT
cacattccatgaatacagtg

SEQ ID NO: 96253 - DNA, 20 bp, Artificial Sequence
  Description of Artificial Sequence: Synthetic oligonucleotide
  Target: SCN9A; (+) strand; PAM type: YTN; PAM sequence: TTC
acattccatgaatacagtgt

SEQ ID NO: 96254 - DNA, 20 bp, Artificial Sequence
  Description of Artificial Sequence: Synthetic oligonucleotide
  Target: SCN9A; (+) strand; PAM type: YTN; PAM sequence: TTC
catgaatacagtgttttcaa

SEQ ID NO: 96255 - DNA, 20 bp, Artificial Sequence
  Description of Artificial Sequence: Synthetic oligonucleotide
  Target: SCN9A; (+) strand; PAM type: YTN; PAM sequence: TTT
tcaatcagcattggctgaat

SEQ ID NO: 96256 - DNA, 20 bp, Artificial Sequence
  Description of Artificial Sequence: Synthetic oligonucleotide
  Target: SCN9A; (+) strand; PAM type: YTN; PAM sequence: TTT
caatcagcattggctgaatc

SEQ ID NO: 96257 - DNA, 20 bp, Artificial Sequence
  Description of Artificial Sequence: Synthetic oligonucleotide
  Target: SCN9A; (+) strand; PAM type: YTN; PAM sequence: TTC
aatcagcattggctgaatct

SEQ ID NO: 96258 - DNA, 20 bp, Artificial Sequence
  Description of Artificial Sequence: Synthetic oligonucleotide
  Target: SCN9A; (+) strand; PAM type: YTN; PAM sequence: TTG
gctgaatctacagatgtaaa

SEQ ID NO: 96259 - DNA, 20 bp, Artificial Sequence
  Description of Artificial Sequence: Synthetic oligonucleotide
  Target: SCN9A; (+) strand; PAM type: YTN; PAM sequence: CTG
aatctacagatgtaaaaccc

SEQ ID NO: 96260 - DNA, 20 bp, Artificial Sequence
  Description of Artificial Sequence: Synthetic oligonucleotide
  Target: SCN9A; (+) strand; PAM type: YTN; PAM sequence: CTA
cagatgtaaaacccacagac

SEQ ID NO: 96261 - DNA, 20 bp, Artificial Sequence
  Description of Artificial Sequence: Synthetic oligonucleotide
  Target: SCN9A; (+) strand; PAM type: YTN; PAM sequence: CTG
taattatatcagccaaaata

SEQ ID NO: 96262 - DNA, 20 bp, Artificial Sequence
  Description of Artificial Sequence: Synthetic oligonucleotide
  Target: SCN9A; (+) strand; PAM type: YTN; PAM sequence: TTA
tatcagccaaaatagatttt

SEQ ID NO: 96263 - DNA, 20 bp, Artificial Sequence
  Description of Artificial Sequence: Synthetic oligonucleotide
  Target: SCN9A; (+) strand; PAM type: YTN; PAM sequence: TTT
taaataaaaaactgtcacaa

SEQ ID NO: 96264 - DNA, 20 bp, Artificial Sequence
  Description of Artificial Sequence: Synthetic oligonucleotide
  Target: SCN9A; (+) strand; PAM type: YTN; PAM sequence: TTT
aaataaaaaactgtcacaag

SEQ ID NO: 96265 - DNA, 20 bp, Artificial Sequence
  Description of Artificial Sequence: Synthetic oligonucleotide
  Target: SCN9A; (+) strand; PAM type: YTN; PAM sequence: TTA
aataaaaaactgtcacaaga

SEQ ID NO: 96266 - DNA, 20 bp, Artificial Sequence
  Description of Artificial Sequence: Synthetic oligonucleotide
  Target: SCN9A; (+) strand; PAM type: YTN; PAM sequence: CTG
tcacaagagacaaagtaggt

SEQ ID NO: 96267 - DNA, 20 bp, Artificial Sequence
  Description of Artificial Sequence: Synthetic oligonucleotide
  Target: SCN9A; (+) strand; PAM type: YTN; PAM sequence: TTA
attcatcaagaagatataac

SEQ ID NO: 96268 - DNA, 20 bp, Artificial Sequence
  Description of Artificial Sequence: Synthetic oligonucleotide
  Target: SCN9A; (+) strand; PAM type: YTN; PAM sequence: TTC
atcaagaagatataacaatt

SEQ ID NO: 96269 - DNA, 20 bp, Artificial Sequence
  Description of Artificial Sequence: Synthetic oligonucleotide
  Target: SCN9A; (+) strand; PAM type: YTN; PAM sequence: TTA
taaatatatgtgaatccatc

SEQ ID NO: 96270 - DNA, 20 bp, Artificial Sequence
  Description of Artificial Sequence: Synthetic oligonucleotide
  Target: SCN9A; (+) strand; PAM type: YTN; PAM sequence: TTG
acagatctgaagggataaac

SEQ ID NO: 96271 - DNA, 20 bp, Artificial Sequence
  Description of Artificial Sequence: Synthetic oligonucleotide
  Target: SCN9A; (+) strand; PAM type: YTN; PAM sequence: CTG
aagggataaacatgcagcaa

SEQ ID NO: 96272 - DNA, 20 bp, Artificial Sequence
  Description of Artificial Sequence: Synthetic oligonucleotide
  Target: SCN9A; (+) strand; PAM type: YTN; PAM sequence: CTT
gcaataatgaacagaacagc

SEQ ID NO: 96273 - DNA, 20 bp, Artificial Sequence
  Description of Artificial Sequence: Synthetic oligonucleotide
  Target: SCN9A; (+) strand; PAM type: YTN; PAM sequence: TTG
caataatgaacagaacagcc

SEQ ID NO: 96274 - DNA, 20 bp, Artificial Sequence
  Description of Artificial Sequence: Synthetic oligonucleotide
  Target: SCN9A; (+) strand; PAM type: YTN; PAM sequence: CTA
taaacaaactgtggatttga

SEQ ID NO: 96275 - DNA, 20 bp, Artificial Sequence
  Description of Artificial Sequence: Synthetic oligonucleotide
  Target: SCN9A; (+) strand; PAM type: YTN; PAM sequence: CTG
tggatttgaacaacgctata

SEQ ID NO: 96276 - DNA, 20 bp, Artificial Sequence
  Description of Artificial Sequence: Synthetic oligonucleotide
  Target: SCN9A; (+) strand; PAM type: YTN; PAM sequence: TTT
gaacaacgctatagaccaaa

SEQ ID NO: 96277 - DNA, 20 bp, Artificial Sequence
  Description of Artificial Sequence: Synthetic oligonucleotide
  Target: SCN9A; (+) strand; PAM type: YTN; PAM sequence: TTG
aacaacgctatagaccaaat

SEQ ID NO: 96278 - DNA, 20 bp, Artificial Sequence
  Description of Artificial Sequence: Synthetic oligonucleotide
  Target: SCN9A; (+) strand; PAM type: YTN; PAM sequence: CTA
tagaccaaatggatcacaaa

SEQ ID NO: 96279 - DNA, 20 bp, Artificial Sequence
  Description of Artificial Sequence: Synthetic oligonucleotide
  Target: SCN9A; (+) strand; PAM type: YTN; PAM sequence: CTA
cccaacagcatcttaatata

SEQ ID NO: 96280 - DNA, 20 bp, Artificial Sequence
  Description of Artificial Sequence: Synthetic oligonucleotide
  Target: SCN9A; (+) strand; PAM type: YTN; PAM sequence: CTT
aatataccatcttttcaagt

SEQ ID NO: 96281 - DNA, 20 bp, Artificial Sequence
  Description of Artificial Sequence: Synthetic oligonucleotide
  Target: SCN9A; (+) strand; PAM type: YTN; PAM sequence: TTA
atataccatcttttcaagtg

SEQ ID NO: 96282 - DNA, 20 bp, Artificial Sequence
  Description of Artificial Sequence: Synthetic oligonucleotide
  Target: SCN9A; (+) strand; PAM type: YTN; PAM sequence: CTT
ttcaagtgcgcacagaatat

SEQ ID NO: 96283 - DNA, 20 bp, Artificial Sequence
  Description of Artificial Sequence: Synthetic oligonucleotide
  Target: SCN9A; (+) strand; PAM type: YTN; PAM sequence: TTT
tcaagtgcgcacagaatatt

SEQ ID NO: 96284 - DNA, 20 bp, Artificial Sequence
  Description of Artificial Sequence: Synthetic oligonucleotide
  Target: SCN9A; (+) strand; PAM type: YTN; PAM sequence: TTT
caagtgcgcacagaatattc

SEQ ID NO: 96285 - DNA, 20 bp, Artificial Sequence
  Description of Artificial Sequence: Synthetic oligonucleotide
  Target: SCN9A; (+) strand; PAM type: YTN; PAM sequence: TTC
aagtgcgcacagaatattct

SEQ ID NO: 96286 - DNA, 20 bp, Artificial Sequence
  Description of Artificial Sequence: Synthetic oligonucleotide
  Target: SCN9A; (+) strand; PAM type: YTN; PAM sequence: TTC
tcaggatagatcacatatca

SEQ ID NO: 96287 - DNA, 20 bp, Artificial Sequence
  Description of Artificial Sequence: Synthetic oligonucleotide
  Target: SCN9A; (+) strand; PAM type: YTN; PAM sequence: CTC
aggatagatcacatatcagg

SEQ ID NO: 96288 - DNA, 20 bp, Artificial Sequence
  Description of Artificial Sequence: Synthetic oligonucleotide
  Target: SCN9A; (+) strand; PAM type: YTN; PAM sequence: TTT
gttttgacaactgttaagaa

SEQ ID NO: 96289 - DNA, 20 bp, Artificial Sequence
  Description of Artificial Sequence: Synthetic oligonucleotide
  Target: SCN9A; (+) strand; PAM type: YTN; PAM sequence: TTG
ttttgacaactgttaagaag

SEQ ID NO: 96290 - DNA, 20 bp, Artificial Sequence
  Description of Artificial Sequence: Synthetic oligonucleotide
  Target: SCN9A; (+) strand; PAM type: YTN; PAM sequence: TTT
tgacaactgttaagaagttg

SEQ ID NO: 96291 - DNA, 20 bp, Artificial Sequence
  Description of Artificial Sequence: Synthetic oligonucleotide
  Target: SCN9A; (+) strand; PAM type: YTN; PAM sequence: TTT
gacaactgttaagaagttga

SEQ ID NO: 96292 - DNA, 20 bp, Artificial Sequence
  Description of Artificial Sequence: Synthetic oligonucleotide
  Target: SCN9A; (+) strand; PAM type: YTN; PAM sequence: TTG
acaactgttaagaagttgaa

SEQ ID NO: 96293 - DNA, 20 bp, Artificial Sequence
  Description of Artificial Sequence: Synthetic oligonucleotide
  Target: SCN9A; (+) strand; PAM type: YTN; PAM sequence: CTG
ttaagaagttgaaatcatac

SEQ ID NO: 96294 - DNA, 20 bp, Artificial Sequence
  Description of Artificial Sequence: Synthetic oligonucleotide
  Target: SCN9A; (+) strand; PAM type: YTN; PAM sequence: TTA
agaagttgaaatcataccag

SEQ ID NO: 96295 - DNA, 20 bp, Artificial Sequence
  Description of Artificial Sequence: Synthetic oligonucleotide
  Target: SCN9A; (+) strand; PAM type: YTN; PAM sequence: TTG
aaatcataccagatatcttt

SEQ ID NO: 96296 - DNA, 20 bp, Artificial Sequence
  Description of Artificial Sequence: Synthetic oligonucleotide
  Target: SCN9A; (+) strand; PAM type: YTN; PAM sequence: CTT
ttatgaccacaatggaagga

SEQ ID NO: 96297 - DNA, 20 bp, Artificial Sequence
  Description of Artificial Sequence: Synthetic oligonucleotide
  Target: SCN9A; (+) strand; PAM type: YTN; PAM sequence: TTT
tatgaccacaatggaaggaa

SEQ ID NO: 96298 - DNA, 20 bp, Artificial Sequence
  Description of Artificial Sequence: Synthetic oligonucleotide
  Target: SCN9A; (+) strand; PAM type: YTN; PAM sequence: TTT
atgaccacaatggaaggaaa

SEQ ID NO: 96299 - DNA, 20 bp, Artificial Sequence
  Description of Artificial Sequence: Synthetic oligonucleotide
  Target: SCN9A; (+) strand; PAM type: YTN; PAM sequence: TTA
tgaccacaatggaaggaaac

SEQ ID NO: 96300 - DNA, 20 bp, Artificial Sequence
  Description of Artificial Sequence: Synthetic oligonucleotide
  Target: SCN9A; (+) strand; PAM type: YTN; PAM sequence: CTG
gaagtcagtaatagaaggaa

SEQ ID NO: 96301 - DNA, 20 bp, Artificial Sequence
  Description of Artificial Sequence: Synthetic oligonucleotide
  Target: SCN9A; (+) strand; PAM type: YTN; PAM sequence: CTG
aaaaattcacaaatatgtgg

SEQ ID NO: 96302 - DNA, 20 bp, Artificial Sequence
  Description of Artificial Sequence: Synthetic oligonucleotide
  Target: SCN9A; (+) strand; PAM type: YTN; PAM sequence: TTC
acaaatatgtggaaattaaa

SEQ ID NO: 96303 - DNA, 20 bp, Artificial Sequence
  Description of Artificial Sequence: Synthetic oligonucleotide
  Target: SCN9A; (+) strand; PAM type: YTN; PAM sequence: TTA
aacaacactctcttgaaaaa

SEQ ID NO: 96304 - DNA, 20 bp, Artificial Sequence
  Description of Artificial Sequence: Synthetic oligonucleotide
  Target: SCN9A; (+) strand; PAM type: YTN; PAM sequence: CTC
tcttgaaaaagcaatgggtc

SEQ ID NO: 96305 - DNA, 20 bp, Artificial Sequence
  Description of Artificial Sequence: Synthetic oligonucleotide
  Target: SCN9A; (+) strand; PAM type: YTN; PAM sequence: CTC
ttgaaaaagcaatgggtcaa

SEQ ID NO: 96306 - DNA, 20 bp, Artificial Sequence
  Description of Artificial Sequence: Synthetic oligonucleotide
  Target: SCN9A; (+) strand; PAM type: YTN; PAM sequence: CTT
gaaaaagcaatgggtcaaag

SEQ ID NO: 96307 - DNA, 20 bp, Artificial Sequence
  Description of Artificial Sequence: Synthetic oligonucleotide
  Target: SCN9A; (+) strand; PAM type: YTN; PAM sequence: TTG
aaaaagcaatgggtcaaaga

SEQ ID NO: 96308 - DNA, 20 bp, Artificial Sequence
  Description of Artificial Sequence: Synthetic oligonucleotide
  Target: SCN9A; (+) strand; PAM type: YTN; PAM sequence: TTT
aaaagtatcttgaaacaaac

SEQ ID NO: 96309 - DNA, 20 bp, Artificial Sequence
  Description of Artificial Sequence: Synthetic oligonucleotide
  Target: SCN9A; (+) strand; PAM type: YTN; PAM sequence: TTA
aaagtatcttgaaacaaaca

SEQ ID NO: 96310 - DNA, 20 bp, Artificial Sequence
  Description of Artificial Sequence: Synthetic oligonucleotide
  Target: SCN9A; (+) strand; PAM type: YTN; PAM sequence: CTT
gaaacaaacaaaaatgaaag

SEQ ID NO: 96311 - DNA, 20 bp, Artificial Sequence
  Description of Artificial Sequence: Synthetic oligonucleotide
  Target: SCN9A; (+) strand; PAM type: YTN; PAM sequence: TTG
aaacaaacaaaaatgaaagc

SEQ ID NO: 96312 - DNA, 20 bp, Artificial Sequence
  Description of Artificial Sequence: Synthetic oligonucleotide
  Target: SCN9A; (+) strand; PAM type: YTN; PAM sequence: TTT
ccaaaatttatgagatgcag

SEQ ID NO: 96313 - DNA, 20 bp, Artificial Sequence
  Description of Artificial Sequence: Synthetic oligonucleotide
  Target: SCN9A; (+) strand; PAM type: YTN; PAM sequence: TTC
caaaatttatgagatgcagc

SEQ ID NO: 96314 - DNA, 20 bp, Artificial Sequence
  Description of Artificial Sequence: Synthetic oligonucleotide
  Target: SCN9A; (+) strand; PAM type: YTN; PAM sequence: TTT
atgagatgcagcaaaagcag

SEQ ID NO: 96315 - DNA, 20 bp, Artificial Sequence
  Description of Artificial Sequence: Synthetic oligonucleotide
  Target: SCN9A; (+) strand; PAM type: YTN; PAM sequence: TTA
tgagatgcagcaaaagcagt

SEQ ID NO: 96316 - DNA, 20 bp, Artificial Sequence
  Description of Artificial Sequence: Synthetic oligonucleotide
  Target: SCN9A; (+) strand; PAM type: YTN; PAM sequence: CTT
attgagatacatgtctacat

SEQ ID NO: 96317 - DNA, 20 bp, Artificial Sequence
  Description of Artificial Sequence: Synthetic oligonucleotide
  Target: SCN9A; (+) strand; PAM type: YTN; PAM sequence: TTA
ttgagatacatgtctacatt

SEQ ID NO: 96318 - DNA, 20 bp, Artificial Sequence
  Description of Artificial Sequence: Synthetic oligonucleotide
  Target: SCN9A; (+) strand; PAM type: YTN; PAM sequence: TTG
agatacatgtctacattata

SEQ ID NO: 96319 - DNA, 20 bp, Artificial Sequence
  Description of Artificial Sequence: Synthetic oligonucleotide
  Target: SCN9A; (+) strand; PAM type: YTN; PAM sequence: CTA
cattataaaaagaaatatct

SEQ ID NO: 96320 - DNA, 20 bp, Artificial Sequence
  Description of Artificial Sequence: Synthetic oligonucleotide
  Target: SCN9A; (+) strand; PAM type: YTN; PAM sequence: TTA
taaaaagaaatatctcatat

SEQ ID NO: 96321 - DNA, 20 bp, Artificial Sequence
  Description of Artificial Sequence: Synthetic oligonucleotide
  Target: SCN9A; (+) strand; PAM type: YTN; PAM sequence: CTC
atataaacaatatagattta

SEQ ID NO: 96322 - DNA, 20 bp, Artificial Sequence
  Description of Artificial Sequence: Synthetic oligonucleotide
  Target: SCN9A; (+) strand; PAM type: YTN; PAM sequence: TTT
acatgtctaggaactagaaa

SEQ ID NO: 96323 - DNA, 20 bp, Artificial Sequence
  Description of Artificial Sequence: Synthetic oligonucleotide
  Target: SCN9A; (+) strand; PAM type: YTN; PAM sequence: TTA
catgtctaggaactagaaaa

SEQ ID NO: 96324 - DNA, 20 bp, Artificial Sequence
  Description of Artificial Sequence: Synthetic oligonucleotide
  Target: SCN9A; (+) strand; PAM type: YTN; PAM sequence: CTA
ggaactagaaaaagaacaaa

SEQ ID NO: 96325 - DNA, 20 bp, Artificial Sequence
  Description of Artificial Sequence: Synthetic oligonucleotide
  Target: SCN9A; (+) strand; PAM type: YTN; PAM sequence: CTA
gaaaaagaacaaactaagcc

SEQ ID NO: 96326 - DNA, 20 bp, Artificial Sequence
  Description of Artificial Sequence: Synthetic oligonucleotide
  Target: SCN9A; (+) strand; PAM type: YTN; PAM sequence: CTA
agcccaacatcagcaaaagg

SEQ ID NO: 96327 - DNA, 20 bp, Artificial Sequence
  Description of Artificial Sequence: Synthetic oligonucleotide
  Target: SCN9A; (+) strand; PAM type: YTN; PAM sequence: TTA
gagctaagtaagtgaaatag

SEQ ID NO: 96328 - DNA, 20 bp, Artificial Sequence
  Description of Artificial Sequence: Synthetic oligonucleotide
  Target: SCN9A; (+) strand; PAM type: YTN; PAM sequence: CTA
agtaagtgaaatagagaata

SEQ ID NO: 96329 - DNA, 20 bp, Artificial Sequence
  Description of Artificial Sequence: Synthetic oligonucleotide
  Target: SCN9A; (+) strand; PAM type: YTN; PAM sequence: CTA
agaattggttttttcgaaag

SEQ ID NO: 96330 - DNA, 20 bp, Artificial Sequence
  Description of Artificial Sequence: Synthetic oligonucleotide
  Target: SCN9A; (+) strand; PAM type: YTN; PAM sequence: TTG
gttttttcgaaagataaaat

SEQ ID NO: 96331 - DNA, 20 bp, Artificial Sequence
  Description of Artificial Sequence: Synthetic oligonucleotide
  Target: SCN9A; (+) strand; PAM type: YTN; PAM sequence: TTT
tttcgaaagataaaatagac

SEQ ID NO: 96332 - DNA, 20 bp, Artificial Sequence
  Description of Artificial Sequence: Synthetic oligonucleotide
  Target: SCN9A; (+) strand; PAM type: YTN; PAM sequence: TTT
ttcgaaagataaaatagaca

SEQ ID NO: 96333 - DNA, 20 bp, Artificial Sequence
  Description of Artificial Sequence: Synthetic oligonucleotide
  Target: SCN9A; (+) strand; PAM type: YTN; PAM sequence: TTT
tcgaaagataaaatagacaa

SEQ ID NO: 96334 - DNA, 20 bp, Artificial Sequence
  Description of Artificial Sequence: Synthetic oligonucleotide
  Target: SCN9A; (+) strand; PAM type: YTN; PAM sequence: TTT
cgaaagataaaatagacaaa

SEQ ID NO: 96335 - DNA, 20 bp, Artificial Sequence
  Description of Artificial Sequence: Synthetic oligonucleotide
  Target: SCN9A; (+) strand; PAM type: YTN; PAM sequence: TTC
gaaagataaaatagacaaat

SEQ ID NO: 96336 - DNA, 20 bp, Artificial Sequence
  Description of Artificial Sequence: Synthetic oligonucleotide
  Target: SCN9A; (+) strand; PAM type: YTN; PAM sequence: CTT
agcaagcataactaagaaaa

SEQ ID NO: 96337 - DNA, 20 bp, Artificial Sequence
  Description of Artificial Sequence: Synthetic oligonucleotide
  Target: SCN9A; (+) strand; PAM type: YTN; PAM sequence: TTA
gcaagcataactaagaaaaa

SEQ ID NO: 96338 - DNA, 20 bp, Artificial Sequence
  Description of Artificial Sequence: Synthetic oligonucleotide
  Target: SCN9A; (+) strand; PAM type: YTN; PAM sequence: CTA
agaaaaaagatagaggactc

SEQ ID NO: 96339 - DNA, 20 bp, Artificial Sequence
  Description of Artificial Sequence: Synthetic oligonucleotide
  Target: SCN9A; (+) strand; PAM type: YTN; PAM sequence: CTC
aaatatgtaaaaccagaaat

SEQ ID NO: 96340 - DNA, 20 bp, Artificial Sequence
  Description of Artificial Sequence: Synthetic oligonucleotide
  Target: SCN9A; (+) strand; PAM type: YTN; PAM sequence: TTT
acaactgattttatgggaat

SEQ ID NO: 96341 - DNA, 20 bp, Artificial Sequence
  Description of Artificial Sequence: Synthetic oligonucleotide
  Target: SCN9A; (+) strand; PAM type: YTN; PAM sequence: TTA
caactgattttatgggaata

SEQ ID NO: 96342 - DNA, 20 bp, Artificial Sequence
  Description of Artificial Sequence: Synthetic oligonucleotide
  Target: SCN9A; (+) strand; PAM type: YTN; PAM sequence: CTG
attttatgggaataagaagg

SEQ ID NO: 96343 - DNA, 20 bp, Artificial Sequence
  Description of Artificial Sequence: Synthetic oligonucleotide
  Target: SCN9A; (+) strand; PAM type: YTN; PAM sequence: TTT
tatgggaataagaaggatca

SEQ ID NO: 96344 - DNA, 20 bp, Artificial Sequence
  Description of Artificial Sequence: Synthetic oligonucleotide
  Target: SCN9A; (+) strand; PAM type: YTN; PAM sequence: TTT
atgggaataagaaggatcaa

SEQ ID NO: 96345 - DNA, 20 bp, Artificial Sequence
  Description of Artificial Sequence: Synthetic oligonucleotide
  Target: SCN9A; (+) strand; PAM type: YTN; PAM sequence: TTA
tgggaataagaaggatcaaa

SEQ ID NO: 96346 - DNA, 20 bp, Artificial Sequence
  Description of Artificial Sequence: Synthetic oligonucleotide
  Target: SCN9A; (+) strand; PAM type: YTN; PAM sequence: CTA
ccatgaacaattatacacca

SEQ ID NO: 96347 - DNA, 20 bp, Artificial Sequence
  Description of Artificial Sequence: Synthetic oligonucleotide
  Target: SCN9A; (+) strand; PAM type: YTN; PAM sequence: TTA
tacaccaacaaattggataa

SEQ ID NO: 96348 - DNA, 20 bp, Artificial Sequence
  Description of Artificial Sequence: Synthetic oligonucleotide
  Target: SCN9A; (+) strand; PAM type: YTN; PAM sequence: TTG
gataacttagaaggaatagg

SEQ ID NO: 96349 - DNA, 20 bp, Artificial Sequence
  Description of Artificial Sequence: Synthetic oligonucleotide
  Target: SCN9A; (+) strand; PAM type: YTN; PAM sequence: CTT
agaaggaataggtaaattcc

SEQ ID NO: 96350 - DNA, 20 bp, Artificial Sequence
  Description of Artificial Sequence: Synthetic oligonucleotide
  Target: SCN9A; (+) strand; PAM type: YTN; PAM sequence: TTA
gaaggaataggtaaattcca

SEQ ID NO: 96351 - DNA, 20 bp, Artificial Sequence
  Description of Artificial Sequence: Synthetic oligonucleotide
  Target: SCN9A; (+) strand; PAM type: YTN; PAM sequence: TTC
caaaaatatacaacctacca

SEQ ID NO: 96352 - DNA, 20 bp, Artificial Sequence
  Description of Artificial Sequence: Synthetic oligonucleotide
  Target: SCN9A; (+) strand; PAM type: YTN; PAM sequence: CTA
ccaagactgaatcatgagga

SEQ ID NO: 96353 - DNA, 20 bp, Artificial Sequence
  Description of Artificial Sequence: Synthetic oligonucleotide
  Target: SCN9A; (+) strand; PAM type: YTN; PAM sequence: CTG
aatcatgaggaaatagaata

SEQ ID NO: 96354 - DNA, 20 bp, Artificial Sequence
  Description of Artificial Sequence: Synthetic oligonucleotide
  Target: SCN9A; (+) strand; PAM type: YTN; PAM sequence: CTG
aatagacaaattgaaccaat

SEQ ID NO: 96355 - DNA, 20 bp, Artificial Sequence
  Description of Artificial Sequence: Synthetic oligonucleotide
  Target: SCN9A; (+) strand; PAM type: YTN; PAM sequence: TTG
aaccaataataataataata

SEQ ID NO: 96356 - DNA, 20 bp, Artificial Sequence
  Description of Artificial Sequence: Synthetic oligonucleotide
  Target: SCN9A; (+) strand; PAM type: YTN; PAM sequence: CTC
ccaaaaaagaaatgtacagg

SEQ ID NO: 96357 - DNA, 20 bp, Artificial Sequence
  Description of Artificial Sequence: Synthetic oligonucleotide
  Target: SCN9A; (+) strand; PAM type: YTN; PAM sequence: CTT
ctctggagaagtccaaccaa

SEQ ID NO: 96358 - DNA, 20 bp, Artificial Sequence
  Description of Artificial Sequence: Synthetic oligonucleotide
  Target: SCN9A; (+) strand; PAM type: YTN; PAM sequence: TTC
tctggagaagtccaaccaaa

SEQ ID NO: 96359 - DNA, 20 bp, Artificial Sequence
  Description of Artificial Sequence: Synthetic oligonucleotide
  Target: SCN9A; (+) strand; PAM type: YTN; PAM sequence: CTC
tggagaagtccaaccaaaca

SEQ ID NO: 96360 - DNA, 20 bp, Artificial Sequence
  Description of Artificial Sequence: Synthetic oligonucleotide
  Target: SCN9A; (+) strand; PAM type: YTN; PAM sequence: CTG
gagaagtccaaccaaacatt

SEQ ID NO: 96361 - DNA, 20 bp, Artificial Sequence
  Description of Artificial Sequence: Synthetic oligonucleotide
  Target: SCN9A; (+) strand; PAM type: YTN; PAM sequence: TTT
aaagaagaaacaacattaat

SEQ ID NO: 96362 - DNA, 20 bp, Artificial Sequence
  Description of Artificial Sequence: Synthetic oligonucleotide
  Target: SCN9A; (+) strand; PAM type: YTN; PAM sequence: TTA
aagaagaaacaacattaatt

SEQ ID NO: 96363 - DNA, 20 bp, Artificial Sequence
  Description of Artificial Sequence: Synthetic oligonucleotide
  Target: SCN9A; (+) strand; PAM type: YTN; PAM sequence: TTA
attcttctcaaactctctta

SEQ ID NO: 96364 - DNA, 20 bp, Artificial Sequence
  Description of Artificial Sequence: Synthetic oligonucleotide
  Target: SCN9A; (+) strand; PAM type: YTN; PAM sequence: TTC
ttctcaaactctcttaaaac

SEQ ID NO: 96365 - DNA, 20 bp, Artificial Sequence
  Description of Artificial Sequence: Synthetic oligonucleotide
  Target: SCN9A; (+) strand; PAM type: YTN; PAM sequence: CTT
ctcaaactctcttaaaactt

SEQ ID NO: 96366 - DNA, 20 bp, Artificial Sequence
  Description of Artificial Sequence: Synthetic oligonucleotide
  Target: SCN9A; (+) strand; PAM type: YTN; PAM sequence: TTC
tcaaactctcttaaaacttt

SEQ ID NO: 96367 - DNA, 20 bp, Artificial Sequence
  Description of Artificial Sequence: Synthetic oligonucleotide
  Target: SCN9A; (+) strand; PAM type: YTN; PAM sequence: CTC
aaactctcttaaaactttga

SEQ ID NO: 96368 - DNA, 20 bp, Artificial Sequence
  Description of Artificial Sequence: Synthetic oligonucleotide
  Target: SCN9A; (+) strand; PAM type: YTN; PAM sequence: CTC
tcttaaaactttgaagagga

SEQ ID NO: 96369 - DNA, 20 bp, Artificial Sequence
  Description of Artificial Sequence: Synthetic oligonucleotide
  Target: SCN9A; (+) strand; PAM type: YTN; PAM sequence: CTC
ttaaaactttgaagaggaaa

SEQ ID NO: 96370 - DNA, 20 bp, Artificial Sequence
  Description of Artificial Sequence: Synthetic oligonucleotide
  Target: SCN9A; (+) strand; PAM type: YTN; PAM sequence: CTT
aaaactttgaagaggaaaga

SEQ ID NO: 96371 - DNA, 20 bp, Artificial Sequence
  Description of Artificial Sequence: Synthetic oligonucleotide
  Target: SCN9A; (+) strand; PAM type: YTN; PAM sequence: TTA
aaactttgaagaggaaagaa

SEQ ID NO: 96372 - DNA, 20 bp, Artificial Sequence
  Description of Artificial Sequence: Synthetic oligonucleotide
  Target: SCN9A; (+) strand; PAM type: YTN; PAM sequence: CTT
tgaagaggaaagaacacttc

SEQ ID NO: 96373 - DNA, 20 bp, Artificial Sequence
  Description of Artificial Sequence: Synthetic oligonucleotide
  Target: SCN9A; (+) strand; PAM type: YTN; PAM sequence: TTT
gaagaggaaagaacacttcg

SEQ ID NO: 96374 - DNA, 20 bp, Artificial Sequence
  Description of Artificial Sequence: Synthetic oligonucleotide
  Target: SCN9A; (+) strand; PAM type: YTN; PAM sequence: TTG
aagaggaaagaacacttcga

SEQ ID NO: 96375 - DNA, 20 bp, Artificial Sequence
  Description of Artificial Sequence: Synthetic oligonucleotide
  Target: SCN9A; (+) strand; PAM type: YTN; PAM sequence: CTT
cgaaagtcattttatggggc

SEQ ID NO: 96376 - DNA, 20 bp, Artificial Sequence
  Description of Artificial Sequence: Synthetic oligonucleotide
  Target: SCN9A; (+) strand; PAM type: YTN; PAM sequence: TTC
gaaagtcattttatggggcc

SEQ ID NO: 96377 - DNA, 20 bp, Artificial Sequence
  Description of Artificial Sequence: Synthetic oligonucleotide
  Target: SCN9A; (+) strand; PAM type: YTN; PAM sequence: TTT
tatggggccagaattattct

SEQ ID NO: 96378 - DNA, 20 bp, Artificial Sequence
  Description of Artificial Sequence: Synthetic oligonucleotide
  Target: SCN9A; (+) strand; PAM type: YTN; PAM sequence: TTT
atggggccagaattattctc

SEQ ID NO: 96379 - DNA, 20 bp, Artificial Sequence
  Description of Artificial Sequence: Synthetic oligonucleotide
  Target: SCN9A; (+) strand; PAM type: YTN; PAM sequence: TTA
tggggccagaattattctca

SEQ ID NO: 96380 - DNA, 20 bp, Artificial Sequence
  Description of Artificial Sequence: Synthetic oligonucleotide
  Target: SCN9A; (+) strand; PAM type: YTN; PAM sequence: TTA
ttctcatatcaaagccagac

SEQ ID NO: 96381 - DNA, 20 bp, Artificial Sequence
  Description of Artificial Sequence: Synthetic oligonucleotide
  Target: SCN9A; (+) strand; PAM type: YTN; PAM sequence: TTC
tcatatcaaagccagacaaa

SEQ ID NO: 96382 - DNA, 20 bp, Artificial Sequence
  Description of Artificial Sequence: Synthetic oligonucleotide
  Target: SCN9A; (+) strand; PAM type: YTN; PAM sequence: CTC
atatcaaagccagacaaaga

SEQ ID NO: 96383 - DNA, 20 bp, Artificial Sequence
  Description of Artificial Sequence: Synthetic oligonucleotide
  Target: SCN9A; (+) strand; PAM type: YTN; PAM sequence: CTG
taagaaaagaaaattacagc

SEQ ID NO: 96384 - DNA, 20 bp, Artificial Sequence
  Description of Artificial Sequence: Synthetic oligonucleotide
  Target: SCN9A; (+) strand; PAM type: YTN; PAM sequence: TTA
cagcttttgaaggaagtgac

SEQ ID NO: 96385 - DNA, 20 bp, Artificial Sequence
  Description of Artificial Sequence: Synthetic oligonucleotide
  Target: SCN9A; (+) strand; PAM type: YTN; PAM sequence: CTT
ttgaaggaagtgacttcagc

SEQ ID NO: 96386 - DNA, 20 bp, Artificial Sequence
  Description of Artificial Sequence: Synthetic oligonucleotide
  Target: SCN9A; (+) strand; PAM type: YTN; PAM sequence: TTT
tgaaggaagtgacttcagca

SEQ ID NO: 96387 - DNA, 20 bp, Artificial Sequence
  Description of Artificial Sequence: Synthetic oligonucleotide
  Target: SCN9A; (+) strand; PAM type: YTN; PAM sequence: TTT
gaaggaagtgacttcagcaa

SEQ ID NO: 96388 - DNA, 20 bp, Artificial Sequence
  Description of Artificial Sequence: Synthetic oligonucleotide
  Target: SCN9A; (+) strand; PAM type: YTN; PAM sequence: TTG
aaggaagtgacttcagcaac

SEQ ID NO: 96389 - DNA, 20 bp, Artificial Sequence
  Description of Artificial Sequence: Synthetic oligonucleotide
  Target: SCN9A; (+) strand; PAM type: YTN; PAM sequence: CTT
cagcaacattgtggaatagg

SEQ ID NO: 96390 - DNA, 20 bp, Artificial Sequence
  Description of Artificial Sequence: Synthetic oligonucleotide
  Target: SCN9A; (+) strand; PAM type: YTN; PAM sequence: TTC
agcaacattgtggaatagga

SEQ ID NO: 96391 - DNA, 20 bp, Artificial Sequence
  Description of Artificial Sequence: Synthetic oligonucleotide
  Target: SCN9A; (+) strand; PAM type: YTN; PAM sequence: TTG
tggaataggaggtttatgac

SEQ ID NO: 96392 - DNA, 20 bp, Artificial Sequence
  Description of Artificial Sequence: Synthetic oligonucleotide
  Target: SCN9A; (+) strand; PAM type: YTN; PAM sequence: TTT
atgactattttttctctcat

SEQ ID NO: 96393 - DNA, 20 bp, Artificial Sequence
  Description of Artificial Sequence: Synthetic oligonucleotide
  Target: SCN9A; (+) strand; PAM type: YTN; PAM sequence: TTA
tgactattttttctctcatg

SEQ ID NO: 96394 - DNA, 20 bp, Artificial Sequence
  Description of Artificial Sequence: Synthetic oligonucleotide
  Target: SCN9A; (+) strand; PAM type: YTN; PAM sequence: CTA
ttttttctctcatggacgta

SEQ ID NO: 96395 - DNA, 20 bp, Artificial Sequence
  Description of Artificial Sequence: Synthetic oligonucleotide
  Target: SCN9A; (+) strand; PAM type: YTN; PAM sequence: TTT
tttctctcatggacgtacca

SEQ ID NO: 96396 - DNA, 20 bp, Artificial Sequence
  Description of Artificial Sequence: Synthetic oligonucleotide
  Target: SCN9A; (+) strand; PAM type: YTN; PAM sequence: TTT
ttctctcatggacgtaccaa

SEQ ID NO: 96397 - DNA, 20 bp, Artificial Sequence
  Description of Artificial Sequence: Synthetic oligonucleotide
  Target: SCN9A; (+) strand; PAM type: YTN; PAM sequence: TTT
tctctcatggacgtaccaag

SEQ ID NO: 96398 - DNA, 20 bp, Artificial Sequence
  Description of Artificial Sequence: Synthetic oligonucleotide
  Target: SCN9A; (+) strand; PAM type: YTN; PAM sequence: TTT
ctctcatggacgtaccaagt

SEQ ID NO: 96399 - DNA, 20 bp, Artificial Sequence
  Description of Artificial Sequence: Synthetic oligonucleotide
  Target: SCN9A; (+) strand; PAM type: YTN; PAM sequence: TTC
tctcatggacgtaccaagta

SEQ ID NO: 96400 - DNA, 20 bp, Artificial Sequence
  Description of Artificial Sequence: Synthetic oligonucleotide
  Target: SCN9A; (+) strand; PAM type: YTN; PAM sequence: CTC
tcatggacgtaccaagtaaa

SEQ ID NO: 96401 - DNA, 20 bp, Artificial Sequence
  Description of Artificial Sequence: Synthetic oligonucleotide
  Target: SCN9A; (+) strand; PAM type: YTN; PAM sequence: CTC
atggacgtaccaagtaaaca

SEQ ID NO: 96402 - DNA, 20 bp, Artificial Sequence
  Description of Artificial Sequence: Synthetic oligonucleotide
  Target: SCN9A; (+) strand; PAM type: YTN; PAM sequence: CTA
catacacatggatcagttct

SEQ ID NO: 96403 - DNA, 20 bp, Artificial Sequence
  Description of Artificial Sequence: Synthetic oligonucleotide
  Target: SCN9A; (+) strand; PAM type: YTN; PAM sequence: TTC
tctccagagaaacccagaat

SEQ ID NO: 96404 - DNA, 20 bp, Artificial Sequence
  Description of Artificial Sequence: Synthetic oligonucleotide
  Target: SCN9A; (+) strand; PAM type: YTN; PAM sequence: CTC
tccagagaaacccagaatcc

SEQ ID NO: 96405 - DNA, 20 bp, Artificial Sequence
  Description of Artificial Sequence: Synthetic oligonucleotide
  Target: SCN9A; (+) strand; PAM type: YTN; PAM sequence: CTC
cagagaaacccagaatccag

SEQ ID NO: 96406 - DNA, 20 bp, Artificial Sequence
  Description of Artificial Sequence: Synthetic oligonucleotide
  Target: SCN9A; (+) strand; PAM type: YTN; PAM sequence: CTC
atgcacaccagaggacagaa

SEQ ID NO: 96407 - DNA, 20 bp, Artificial Sequence
  Description of Artificial Sequence: Synthetic oligonucleotide
  Target: SCN9A; (+) strand; PAM type: YTN; PAM sequence: CTC
atgcactaaccccaccctga

SEQ ID NO: 96408 - DNA, 20 bp, Artificial Sequence
  Description of Artificial Sequence: Synthetic oligonucleotide
  Target: SCN9A; (+) strand; PAM type: YTN; PAM sequence: CTA
accccaccctgagcacagtg

SEQ ID NO: 96409 - DNA, 20 bp, Artificial Sequence
  Description of Artificial Sequence: Synthetic oligonucleotide
  Target: SCN9A; (+) strand; PAM type: YTN; PAM sequence: CTG
agcacagtgccttacatttg

SEQ ID NO: 96410 - DNA, 20 bp, Artificial Sequence
  Description of Artificial Sequence: Synthetic oligonucleotide
  Target: SCN9A; (+) strand; PAM type: YTN; PAM sequence: CTT
acatttgggaagaaaaccaa

SEQ ID NO: 96411 - DNA, 20 bp, Artificial Sequence
  Description of Artificial Sequence: Synthetic oligonucleotide
  Target: SCN9A; (+) strand; PAM type: YTN; PAM sequence: TTA
catttgggaagaaaaccaaa

SEQ ID NO: 96412 - DNA, 20 bp, Artificial Sequence
  Description of Artificial Sequence: Synthetic oligonucleotide
  Target: SCN9A; (+) strand; PAM type: YTN; PAM sequence: TTT
gggaagaaaaccaaatttgc

SEQ ID NO: 96413 - DNA, 20 bp, Artificial Sequence
  Description of Artificial Sequence: Synthetic oligonucleotide
  Target: SCN9A; (+) strand; PAM type: YTN; PAM sequence: TTG
ggaagaaaaccaaatttgca

SEQ ID NO: 96414 - DNA, 20 bp, Artificial Sequence
  Description of Artificial Sequence: Synthetic oligonucleotide
  Target: SCN9A; (+) strand; PAM type: YTN; PAM sequence: TTT
gcagctacttcccaagggtt

SEQ ID NO: 96415 - DNA, 20 bp, Artificial Sequence
  Description of Artificial Sequence: Synthetic oligonucleotide
  Target: SCN9A; (+) strand; PAM type: YTN; PAM sequence: TTG
cagctacttcccaagggttg

SEQ ID NO: 96416 - DNA, 20 bp, Artificial Sequence
  Description of Artificial Sequence: Synthetic oligonucleotide
  Target: SCN9A; (+) strand; PAM type: YTN; PAM sequence: CTA
cttcccaagggttgagaaac

SEQ ID NO: 96417 - DNA, 20 bp, Artificial Sequence
  Description of Artificial Sequence: Synthetic oligonucleotide
  Target: SCN9A; (+) strand; PAM type: YTN; PAM sequence: CTT
cccaagggttgagaaactat

SEQ ID NO: 96418 - DNA, 20 bp, Artificial Sequence
  Description of Artificial Sequence: Synthetic oligonucleotide
  Target: SCN9A; (+) strand; PAM type: YTN; PAM sequence: TTC
ccaagggttgagaaactata

SEQ ID NO: 96419 - DNA, 20 bp, Artificial Sequence
  Description of Artificial Sequence: Synthetic oligonucleotide
  Target: SCN9A; (+) strand; PAM type: YTN; PAM sequence: TTG
agaaactatagcacacatat

SEQ ID NO: 96420 - DNA, 20 bp, Artificial Sequence
  Description of Artificial Sequence: Synthetic oligonucleotide
  Target: SCN9A; (+) strand; PAM type: YTN; PAM sequence: CTA
tagcacacatatagaaccca

SEQ ID NO: 96421 - DNA, 20 bp, Artificial Sequence
  Description of Artificial Sequence: Synthetic oligonucleotide
  Target: SCN9A; (+) strand; PAM type: YTN; PAM sequence: CTT
ttttttaatttaaggaaatg

SEQ ID NO: 96422 - DNA, 20 bp, Artificial Sequence
  Description of Artificial Sequence: Synthetic oligonucleotide
  Target: SCN9A; (+) strand; PAM type: YTN; PAM sequence: TTT
tttttaatttaaggaaatgt

SEQ ID NO: 96423 - DNA, 20 bp, Artificial Sequence
  Description of Artificial Sequence: Synthetic oligonucleotide
  Target: SCN9A; (+) strand; PAM type: YTN; PAM sequence: TTT
ttttaatttaaggaaatgta

SEQ ID NO: 96424 - DNA, 20 bp, Artificial Sequence
  Description of Artificial Sequence: Synthetic oligonucleotide
  Target: SCN9A; (+) strand; PAM type: YTN; PAM sequence: TTT
tttaatttaaggaaatgtat

SEQ ID NO: 96425 - DNA, 20 bp, Artificial Sequence
  Description of Artificial Sequence: Synthetic oligonucleotide
  Target: SCN9A; (+) strand; PAM type: YTN; PAM sequence: TTT
ttaatttaaggaaatgtatt

SEQ ID NO: 96426 - DNA, 20 bp, Artificial Sequence
  Description of Artificial Sequence: Synthetic oligonucleotide
  Target: SCN9A; (+) strand; PAM type: YTN; PAM sequence: TTT
taatttaaggaaatgtattt

SEQ ID NO: 96427 - DNA, 20 bp, Artificial Sequence
  Description of Artificial Sequence: Synthetic oligonucleotide
  Target: SCN9A; (+) strand; PAM type: YTN; PAM sequence: TTT
aatttaaggaaatgtattta

SEQ ID NO: 96428 - DNA, 20 bp, Artificial Sequence
  Description of Artificial Sequence: Synthetic oligonucleotide
  Target: SCN9A; (+) strand; PAM type: YTN; PAM sequence: TTA
atttaaggaaatgtatttat

SEQ ID NO: 96429 - DNA, 20 bp, Artificial Sequence
  Description of Artificial Sequence: Synthetic oligonucleotide
  Target: SCN9A; (+) strand; PAM type: YTN; PAM sequence: TTT
aaggaaatgtatttatttct

SEQ ID NO: 96430 - DNA, 20 bp, Artificial Sequence
  Description of Artificial Sequence: Synthetic oligonucleotide
  Target: SCN9A; (+) strand; PAM type: YTN; PAM sequence: TTA
aggaaatgtatttatttcta

SEQ ID NO: 96431 - DNA, 20 bp, Artificial Sequence
  Description of Artificial Sequence: Synthetic oligonucleotide
  Target: SCN9A; (+) strand; PAM type: YTN; PAM sequence: TTT
atttctagaaaatgcttttt

SEQ ID NO: 96432 - DNA, 20 bp, Artificial Sequence
  Description of Artificial Sequence: Synthetic oligonucleotide
  Target: SCN9A; (+) strand; PAM type: YTN; PAM sequence: TTA
tttctagaaaatgctttttc

SEQ ID NO: 96433 - DNA, 20 bp, Artificial Sequence
  Description of Artificial Sequence: Synthetic oligonucleotide
  Target: SCN9A; (+) strand; PAM type: YTN; PAM sequence: TTT
ctagaaaatgctttttctag

SEQ ID NO: 96434 - DNA, 20 bp, Artificial Sequence
  Description of Artificial Sequence: Synthetic oligonucleotide
  Target: SCN9A; (+) strand; PAM type: YTN; PAM sequence: TTC
tagaaaatgctttttctaga

SEQ ID NO: 96435 - DNA, 20 bp, Artificial Sequence
  Description of Artificial Sequence: Synthetic oligonucleotide
  Target: SCN9A; (+) strand; PAM type: YTN; PAM sequence: CTA
gaaaatgctttttctagagt

SEQ ID NO: 96436 - DNA, 20 bp, Artificial Sequence
  Description of Artificial Sequence: Synthetic oligonucleotide
  Target: SCN9A; (+) strand; PAM type: YTN; PAM sequence: CTT
tttctagagtgtaaagagag

SEQ ID NO: 96437 - DNA, 20 bp, Artificial Sequence
  Description of Artificial Sequence: Synthetic oligonucleotide
  Target: SCN9A; (+) strand; PAM type: YTN; PAM sequence: TTT
ttctagagtgtaaagagaga

SEQ ID NO: 96438 - DNA, 20 bp, Artificial Sequence
  Description of Artificial Sequence: Synthetic oligonucleotide
  Target: SCN9A; (+) strand; PAM type: YTN; PAM sequence: TTT
tctagagtgtaaagagagaa

SEQ ID NO: 96439 - DNA, 20 bp, Artificial Sequence
  Description of Artificial Sequence: Synthetic oligonucleotide
  Target: SCN9A; (+) strand; PAM type: YTN; PAM sequence: TTT
ctagagtgtaaagagagaag

SEQ ID NO: 96440 - DNA, 20 bp, Artificial Sequence
  Description of Artificial Sequence: Synthetic oligonucleotide
  Target: SCN9A; (+) strand; PAM type: YTN; PAM sequence: TTC
tagagtgtaaagagagaaga

SEQ ID NO: 96441 - DNA, 20 bp, Artificial Sequence
  Description of Artificial Sequence: Synthetic oligonucleotide
  Target: SCN9A; (+) strand; PAM type: YTN; PAM sequence: CTA
gagtgtaaagagagaagaga

SEQ ID NO: 96442 - DNA, 20 bp, Artificial Sequence
  Description of Artificial Sequence: Synthetic oligonucleotide
  Target: SCN9A; (+) strand; PAM type: YTN; PAM sequence: CTA
tattataaaatcatcttcat

SEQ ID NO: 96443 - DNA, 20 bp, Artificial Sequence
  Description of Artificial Sequence: Synthetic oligonucleotide
  Target: SCN9A; (+) strand; PAM type: YTN; PAM sequence: TTA
taaaatcatcttcataattg

SEQ ID NO: 96444 - DNA, 20 bp, Artificial Sequence
  Description of Artificial Sequence: Synthetic oligonucleotide
  Target: SCN9A; (+) strand; PAM type: YTN; PAM sequence: CTT
cataattgccttggttttcc

SEQ ID NO: 96445 - DNA, 20 bp, Artificial Sequence
  Description of Artificial Sequence: Synthetic oligonucleotide
  Target: SCN9A; (+) strand; PAM type: YTN; PAM sequence: TTC
ataattgccttggttttcca

SEQ ID NO: 96446 - DNA, 20 bp, Artificial Sequence
  Description of Artificial Sequence: Synthetic oligonucleotide
  Target: SCN9A; (+) strand; PAM type: YTN; PAM sequence: TTG
ccttggttttccattttgta

SEQ ID NO: 96447 - DNA, 20 bp, Artificial Sequence
  Description of Artificial Sequence: Synthetic oligonucleotide
  Target: SCN9A; (+) strand; PAM type: YTN; PAM sequence: CTT
ggttttccattttgtagaac

SEQ ID NO: 96448 - DNA, 20 bp, Artificial Sequence
  Description of Artificial Sequence: Synthetic oligonucleotide
  Target: SCN9A; (+) strand; PAM type: YTN; PAM sequence: TTG
gttttccattttgtagaacc

SEQ ID NO: 96449 - DNA, 20 bp, Artificial Sequence
  Description of Artificial Sequence: Synthetic oligonucleotide
  Target: SCN9A; (+) strand; PAM type: YTN; PAM sequence: TTT
tccattttgtagaacccaac

SEQ ID NO: 96450 - DNA, 20 bp, Artificial Sequence
  Description of Artificial Sequence: Synthetic oligonucleotide
  Target: SCN9A; (+) strand; PAM type: YTN; PAM sequence: TTT
ccattttgtagaacccaact

SEQ ID NO: 96451 - DNA, 20 bp, Artificial Sequence
  Description of Artificial Sequence: Synthetic oligonucleotide
  Target: SCN9A; (+) strand; PAM type: YTN; PAM sequence: TTC
cattttgtagaacccaactt

SEQ ID NO: 96452 - DNA, 20 bp, Artificial Sequence
  Description of Artificial Sequence: Synthetic oligonucleotide
  Target: SCN9A; (+) strand; PAM type: YTN; PAM sequence: TTT
tgtagaacccaacttttata

SEQ ID NO: 96453 - DNA, 20 bp, Artificial Sequence
  Description of Artificial Sequence: Synthetic oligonucleotide
  Target: SCN9A; (+) strand; PAM type: YTN; PAM sequence: TTT
gtagaacccaacttttatag

SEQ ID NO: 96454 - DNA, 20 bp, Artificial Sequence
  Description of Artificial Sequence: Synthetic oligonucleotide
  Target: SCN9A; (+) strand; PAM type: YTN; PAM sequence: TTG
tagaacccaacttttatagg

SEQ ID NO: 96455 - DNA, 20 bp, Artificial Sequence
  Description of Artificial Sequence: Synthetic oligonucleotide
  Target: SCN9A; (+) strand; PAM type: YTN; PAM sequence: CTT
ttataggccctgacacagag

SEQ ID NO: 96456 - DNA, 20 bp, Artificial Sequence
  Description of Artificial Sequence: Synthetic oligonucleotide
  Target: SCN9A; (+) strand; PAM type: YTN; PAM sequence: TTT
tataggccctgacacagagc

SEQ ID NO: 96457 - DNA, 20 bp, Artificial Sequence
  Description of Artificial Sequence: Synthetic oligonucleotide
  Target: SCN9A; (+) strand; PAM type: YTN; PAM sequence: TTT
ataggccctgacacagagct

SEQ ID NO: 96458 - DNA, 20 bp, Artificial Sequence
  Description of Artificial Sequence: Synthetic oligonucleotide
  Target: SCN9A; (+) strand; PAM type: YTN; PAM sequence: TTA
taggccctgacacagagctt

SEQ ID NO: 96459 - DNA, 20 bp, Artificial Sequence
  Description of Artificial Sequence: Synthetic oligonucleotide
  Target: SCN9A; (+) strand; PAM type: YTN; PAM sequence: CTG
acacagagcttggcttttag

SEQ ID NO: 96460 - DNA, 20 bp, Artificial Sequence
  Description of Artificial Sequence: Synthetic oligonucleotide
  Target: SCN9A; (+) strand; PAM type: YTN; PAM sequence: CTT
ggcttttagatcaccatgct

SEQ ID NO: 96461 - DNA, 20 bp, Artificial Sequence
  Description of Artificial Sequence: Synthetic oligonucleotide
  Target: SCN9A; (+) strand; PAM type: YTN; PAM sequence: TTG
gcttttagatcaccatgctt

SEQ ID NO: 96462 - DNA, 20 bp, Artificial Sequence
  Description of Artificial Sequence: Synthetic oligonucleotide
  Target: SCN9A; (+) strand; PAM type: YTN; PAM sequence: CTT
ttagatcaccatgcttgagg

SEQ ID NO: 96463 - DNA, 20 bp, Artificial Sequence
  Description of Artificial Sequence: Synthetic oligonucleotide
  Target: SCN9A; (+) strand; PAM type: YTN; PAM sequence: TTT
tagatcaccatgcttgagga

SEQ ID NO: 96464 - DNA, 20 bp, Artificial Sequence
  Description of Artificial Sequence: Synthetic oligonucleotide
  Target: SCN9A; (+) strand; PAM type: YTN; PAM sequence: TTT
agatcaccatgcttgaggaa

SEQ ID NO: 96465 - DNA, 20 bp, Artificial Sequence
  Description of Artificial Sequence: Synthetic oligonucleotide
  Target: SCN9A; (+) strand; PAM type: YTN; PAM sequence: TTA
gatcaccatgcttgaggaat

SEQ ID NO: 96466 - DNA, 20 bp, Artificial Sequence
  Description of Artificial Sequence: Synthetic oligonucleotide
  Target: SCN9A; (+) strand; PAM type: YTN; PAM sequence: CTT
gaggaatggcagagataagc

SEQ ID NO: 96467 - DNA, 20 bp, Artificial Sequence
  Description of Artificial Sequence: Synthetic oligonucleotide
  Target: SCN9A; (+) strand; PAM type: YTN; PAM sequence: TTG
aggaatggcagagataagcc

SEQ ID NO: 96468 - DNA, 20 bp, Artificial Sequence
  Description of Artificial Sequence: Synthetic oligonucleotide
  Target: SCN9A; (+) strand; PAM type: YTN; PAM sequence: TTG
gagttttctctcaagtacaa

SEQ ID NO: 96469 - DNA, 20 bp, Artificial Sequence
  Description of Artificial Sequence: Synthetic oligonucleotide
  Target: SCN9A; (+) strand; PAM type: YTN; PAM sequence: TTT
tctctcaagtacaaaaaacg

SEQ ID NO: 96470 - DNA, 20 bp, Artificial Sequence
  Description of Artificial Sequence: Synthetic oligonucleotide
  Target: SCN9A; (+) strand; PAM type: YTN; PAM sequence: TTT
ctctcaagtacaaaaaacga

SEQ ID NO: 96471 - DNA, 20 bp, Artificial Sequence
  Description of Artificial Sequence: Synthetic oligonucleotide
  Target: SCN9A; (+) strand; PAM type: YTN; PAM sequence: TTC
tctcaagtacaaaaaacgat

SEQ ID NO: 96472 - DNA, 20 bp, Artificial Sequence
  Description of Artificial Sequence: Synthetic oligonucleotide
  Target: SCN9A; (+) strand; PAM type: YTN; PAM sequence: CTC
tcaagtacaaaaaacgatgg

SEQ ID NO: 96473 - DNA, 20 bp, Artificial Sequence
  Description of Artificial Sequence: Synthetic oligonucleotide
  Target: SCN9A; (+) strand; PAM type: YTN; PAM sequence: CTC
aagtacaaaaaacgatgggg

SEQ ID NO: 96474 - DNA, 20 bp, Artificial Sequence
  Description of Artificial Sequence: Synthetic oligonucleotide
  Target: SCN9A; (+) strand; PAM type: YTN; PAM sequence: TTT
tgaactgcctgagcactctc

SEQ ID NO: 96475 - DNA, 20 bp, Artificial Sequence
  Description of Artificial Sequence: Synthetic oligonucleotide
  Target: SCN9A; (+) strand; PAM type: YTN; PAM sequence: TTT
gaactgcctgagcactctca

SEQ ID NO: 96476 - DNA, 20 bp, Artificial Sequence
  Description of Artificial Sequence: Synthetic oligonucleotide
  Target: SCN9A; (+) strand; PAM type: YTN; PAM sequence: TTG
aactgcctgagcactctcag

SEQ ID NO: 96477 - DNA, 20 bp, Artificial Sequence
  Description of Artificial Sequence: Synthetic oligonucleotide
  Target: SCN9A; (+) strand; PAM type: YTN; PAM sequence: CTG
cctgagcactctcagaagct

SEQ ID NO: 96478 - DNA, 20 bp, Artificial Sequence
  Description of Artificial Sequence: Synthetic oligonucleotide
  Target: SCN9A; (+) strand; PAM type: YTN; PAM sequence: CTG
agcactctcagaagctttaa

SEQ ID NO: 96479 - DNA, 20 bp, Artificial Sequence
  Description of Artificial Sequence: Synthetic oligonucleotide
  Target: SCN9A; (+) strand; PAM type: YTN; PAM sequence: CTC
tcagaagctttaattcctgg

SEQ ID NO: 96480 - DNA, 20 bp, Artificial Sequence
  Description of Artificial Sequence: Synthetic oligonucleotide
  Target: SCN9A; (+) strand; PAM type: YTN; PAM sequence: CTC
agaagctttaattcctggga

SEQ ID NO: 96481 - DNA, 20 bp, Artificial Sequence
  Description of Artificial Sequence: Synthetic oligonucleotide
  Target: SCN9A; (+) strand; PAM type: YTN; PAM sequence: CTT
taattcctgggatcagacca

SEQ ID NO: 96482 - DNA, 20 bp, Artificial Sequence
  Description of Artificial Sequence: Synthetic oligonucleotide
  Target: SCN9A; (+) strand; PAM type: YTN; PAM sequence: TTT
aattcctgggatcagaccat

SEQ ID NO: 96483 - DNA, 20 bp, Artificial Sequence
  Description of Artificial Sequence: Synthetic oligonucleotide
  Target: SCN9A; (+) strand; PAM type: YTN; PAM sequence: TTA
attcctgggatcagaccatc

SEQ ID NO: 96484 - DNA, 20 bp, Artificial Sequence
  Description of Artificial Sequence: Synthetic oligonucleotide
  Target: SCN9A; (+) strand; PAM type: YTN; PAM sequence: TTC
ctgggatcagaccatcttcc

SEQ ID NO: 96485 - DNA, 20 bp, Artificial Sequence
  Description of Artificial Sequence: Synthetic oligonucleotide
  Target: SCN9A; (+) strand; PAM type: YTN; PAM sequence: CTG
ggatcagaccatcttccaac

SEQ ID NO: 96486 - DNA, 20 bp, Artificial Sequence
  Description of Artificial Sequence: Synthetic oligonucleotide
  Target: SCN9A; (+) strand; PAM type: YTN; PAM sequence: CTT
ccaacttccccatggaaacc

SEQ ID NO: 96487 - DNA, 20 bp, Artificial Sequence
  Description of Artificial Sequence: Synthetic oligonucleotide
  Target: SCN9A; (+) strand; PAM type: YTN; PAM sequence: TTC
caacttccccatggaaacca

SEQ ID NO: 96488 - DNA, 20 bp, Artificial Sequence
  Description of Artificial Sequence: Synthetic oligonucleotide
  Target: SCN9A; (+) strand; PAM type: YTN; PAM sequence: CTT
ccccatggaaaccattaggc

SEQ ID NO: 96489 - DNA, 20 bp, Artificial Sequence
  Description of Artificial Sequence: Synthetic oligonucleotide
  Target: SCN9A; (+) strand; PAM type: YTN; PAM sequence: TTC
cccatggaaaccattaggct

SEQ ID NO: 96490 - DNA, 20 bp, Artificial Sequence
  Description of Artificial Sequence: Synthetic oligonucleotide
  Target: SCN9A; (+) strand; PAM type: YTN; PAM sequence: TTA
ggctacacgttttccagccg

SEQ ID NO: 96491 - DNA, 20 bp, Artificial Sequence
  Description of Artificial Sequence: Synthetic oligonucleotide
  Target: SCN9A; (+) strand; PAM type: YTN; PAM sequence: CTA
cacgttttccagccgctccc

SEQ ID NO: 96492 - DNA, 20 bp, Artificial Sequence
  Description of Artificial Sequence: Synthetic oligonucleotide
  Target: SCN9A; (+) strand; PAM type: YTN; PAM sequence: TTT
tccagccgctccctgtggtt

SEQ ID NO: 96493 - DNA, 20 bp, Artificial Sequence
  Description of Artificial Sequence: Synthetic oligonucleotide
  Target: SCN9A; (+) strand; PAM type: YTN; PAM sequence: TTT
ccagccgctccctgtggttc

SEQ ID NO: 96494 - DNA, 20 bp, Artificial Sequence
  Description of Artificial Sequence: Synthetic oligonucleotide
  Target: SCN9A; (+) strand; PAM type: YTN; PAM sequence: TTC
cagccgctccctgtggttct

SEQ ID NO: 96495 - DNA, 20 bp, Artificial Sequence
  Description of Artificial Sequence: Synthetic oligonucleotide
  Target: SCN9A; (+) strand; PAM type: YTN; PAM sequence: CTC
cctgtggttctggcctcttc

SEQ ID NO: 96496 - DNA, 20 bp, Artificial Sequence
  Description of Artificial Sequence: Synthetic oligonucleotide
  Target: SCN9A; (+) strand; PAM type: YTN; PAM sequence: CTG
tggttctggcctcttccagt

SEQ ID NO: 96497 - DNA, 20 bp, Artificial Sequence
  Description of Artificial Sequence: Synthetic oligonucleotide
  Target: SCN9A; (+) strand; PAM type: YTN; PAM sequence: TTC
tggcctcttccagtacttgg

SEQ ID NO: 96498 - DNA, 20 bp, Artificial Sequence
  Description of Artificial Sequence: Synthetic oligonucleotide
  Target: SCN9A; (+) strand; PAM type: YTN; PAM sequence: CTG
gcctcttccagtacttggaa

SEQ ID NO: 96499 - DNA, 20 bp, Artificial Sequence
  Description of Artificial Sequence: Synthetic oligonucleotide
  Target: SCN9A; (+) strand; PAM type: YTN; PAM sequence: CTC
ttccagtacttggaaatcta

SEQ ID NO: 96500 - DNA, 20 bp, Artificial Sequence
  Description of Artificial Sequence: Synthetic oligonucleotide
  Target: SCN9A; (+) strand; PAM type: YTN; PAM sequence: CTT
ccagtacttggaaatctaca

SEQ ID NO: 96501 - DNA, 20 bp, Artificial Sequence
  Description of Artificial Sequence: Synthetic oligonucleotide
  Target: SCN9A; (+) strand; PAM type: YTN; PAM sequence: TTC
cagtacttggaaatctacat

SEQ ID NO: 96502 - DNA, 20 bp, Artificial Sequence
  Description of Artificial Sequence: Synthetic oligonucleotide
  Target: SCN9A; (+) strand; PAM type: YTN; PAM sequence: CTT
ggaaatctacatagcaaatg

SEQ ID NO: 96503 - DNA, 20 bp, Artificial Sequence
  Description of Artificial Sequence: Synthetic oligonucleotide
  Target: SCN9A; (+) strand; PAM type: YTN; PAM sequence: TTG
gaaatctacatagcaaatga

SEQ ID NO: 96504 - DNA, 20 bp, Artificial Sequence
  Description of Artificial Sequence: Synthetic oligonucleotide
  Target: SCN9A; (+) strand; PAM type: YTN; PAM sequence: CTA
catagcaaatgaagaataaa

SEQ ID NO: 96505 - DNA, 20 bp, Artificial Sequence
  Description of Artificial Sequence: Synthetic oligonucleotide
  Target: SCN9A; (+) strand; PAM type: YTN; PAM sequence: CTT
cttcagcctaaacaagagga

SEQ ID NO: 96506 - DNA, 20 bp, Artificial Sequence
  Description of Artificial Sequence: Synthetic oligonucleotide
  Target: SCN9A; (+) strand; PAM type: YTN; PAM sequence: TTC
ttcagcctaaacaagaggaa

SEQ ID NO: 96507 - DNA, 20 bp, Artificial Sequence
  Description of Artificial Sequence: Synthetic oligonucleotide
  Target: SCN9A; (+) strand; PAM type: YTN; PAM sequence: CTT
cagcctaaacaagaggaata

SEQ ID NO: 96508 - DNA, 20 bp, Artificial Sequence
  Description of Artificial Sequence: Synthetic oligonucleotide
  Target: SCN9A; (+) strand; PAM type: YTN; PAM sequence: TTC
agcctaaacaagaggaataa

SEQ ID NO: 96509 - DNA, 20 bp, Artificial Sequence
  Description of Artificial Sequence: Synthetic oligonucleotide
  Target: SCN9A; (+) strand; PAM type: YTN; PAM sequence: CTA
aacaagaggaataacattcc

SEQ ID NO: 96510 - DNA, 20 bp, Artificial Sequence
  Description of Artificial Sequence: Synthetic oligonucleotide
  Target: SCN9A; (+) strand; PAM type: YTN; PAM sequence: TTC
cccacgccttcttccctggc

SEQ ID NO: 96511 - DNA, 20 bp, Artificial Sequence
  Description of Artificial Sequence: Synthetic oligonucleotide
  Target: SCN9A; (+) strand; PAM type: YTN; PAM sequence: CTT
cttccctggcttcctccaga

SEQ ID NO: 96512 - DNA, 20 bp, Artificial Sequence
  Description of Artificial Sequence: Synthetic oligonucleotide
  Target: SCN9A; (+) strand; PAM type: YTN; PAM sequence: TTC
ttccctggcttcctccagag

SEQ ID NO: 96513 - DNA, 20 bp, Artificial Sequence
  Description of Artificial Sequence: Synthetic oligonucleotide
  Target: SCN9A; (+) strand; PAM type: YTN; PAM sequence: CTT
ccctggcttcctccagagac

SEQ ID NO: 96514 - DNA, 20 bp, Artificial Sequence
  Description of Artificial Sequence: Synthetic oligonucleotide
  Target: SCN9A; (+) strand; PAM type: YTN; PAM sequence: TTC
cctggcttcctccagagaca

SEQ ID NO: 96515 - DNA, 20 bp, Artificial Sequence
  Description of Artificial Sequence: Synthetic oligonucleotide
  Target: SCN9A; (+) strand; PAM type: YTN; PAM sequence: CTG
gcttcctccagagacaatcc

SEQ ID NO: 96516 - DNA, 20 bp, Artificial Sequence
  Description of Artificial Sequence: Synthetic oligonucleotide
  Target: SCN9A; (+) strand; PAM type: YTN; PAM sequence: CTT
cctccagagacaatcccaac

SEQ ID NO: 96517 - DNA, 20 bp, Artificial Sequence
  Description of Artificial Sequence: Synthetic oligonucleotide
  Target: SCN9A; (+) strand; PAM type: YTN; PAM sequence: TTC
ctccagagacaatcccaact

SEQ ID NO: 96518 - DNA, 20 bp, Artificial Sequence
  Description of Artificial Sequence: Synthetic oligonucleotide
  Target: SCN9A; (+) strand; PAM type: YTN; PAM sequence: CTC
cagagacaatcccaactcta

SEQ ID NO: 96519 - DNA, 20 bp, Artificial Sequence
  Description of Artificial Sequence: Synthetic oligonucleotide
  Target: SCN9A; (+) strand; PAM type: YTN; PAM sequence: CTC
tacaatctttcttttttttt

SEQ ID NO: 96520 - DNA, 20 bp, Artificial Sequence
  Description of Artificial Sequence: Synthetic oligonucleotide
  Target: SCN9A; (+) strand; PAM type: YTN; PAM sequence: CTA
caatctttcttttttttttt

SEQ ID NO: 96521 - DNA, 20 bp, Artificial Sequence
  Description of Artificial Sequence: Synthetic oligonucleotide
  Target: SCN9A; (+) strand; PAM type: YTN; PAM sequence: CTT
tctttttttttttttttttt

SEQ ID NO: 96522 - DNA, 20 bp, Artificial Sequence
  Description of Artificial Sequence: Synthetic oligonucleotide
  Target: SCN9A; (+) strand; PAM type: YTN; PAM sequence: TTT
cttttttttttttttttttt

SEQ ID NO: 96523 - DNA, 20 bp, Artificial Sequence
  Description of Artificial Sequence: Synthetic oligonucleotide
  Target: SCN9A; (+) strand; PAM type: YTN; PAM sequence: TTC
tttttttttttttttttttt

SEQ ID NO: 96524 - DNA, 20 bp, Artificial Sequence
  Description of Artificial Sequence: Synthetic oligonucleotide
  Target: SCN9A; (+) strand; PAM type: YTN; PAM sequence: CTT
tttttttttttttttttttg

SEQ ID NO: 96525 - DNA, 20 bp, Artificial Sequence
  Description of Artificial Sequence: Synthetic oligonucleotide
  Target: SCN9A; (+) strand; PAM type: YTN; PAM sequence: TTT
ttttttttttttttttttga

SEQ ID NO: 96526 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttttttgag

SEQ ID NO: 96527 - DNA, 20 bp, Artificial Sequence
  Description of Artificial Sequence: Synthetic oligonucleotide
  Target: SCN9A; (+) strand; PAM type: YTN; PAM sequence: TTT
ttttttttttttttttgaga

SEQ ID NO: 96528 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttttgagat

SEQ ID NO: 96529 - DNA, 20 bp, Artificial Sequence
  Description of Artificial Sequence: Synthetic oligonucleotide
  Target: SCN9A; (+) strand; PAM type: YTN; PAM sequence: TTT
ttttttttttttttgagatg

SEQ ID NO: 96530 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttgagatgg

SEQ ID NO: 96531 - DNA, 20 bp, Artificial Sequence
  Description of Artificial Sequence: Synthetic oligonucleotide
  Target: SCN9A; (+) strand; PAM type: YTN; PAM sequence: TTT
ttttttttttttgagatgga

SEQ ID NO: 96532 - DNA, 20 bp, Artificial Sequence
  Description of Artificial Sequence: Synthetic oligonucleotide
  Target: SCN9A; (+) strand; PAM type: YTN; PAM sequence: TTT
tttttttttttgagatggag

SEQ ID NO: 96533 - DNA, 20 bp, Artificial Sequence
  Description of Artificial Sequence: Synthetic oligonucleotide
  Target: SCN9A; (+) strand; PAM type: YTN; PAM sequence: TTT
ttttttttttgagatggagt

SEQ ID NO: 96534 - DNA, 20 bp, Artificial Sequence
  Description of Artificial Sequence: Synthetic oligonucleotide
  Target: SCN9A; (+) strand; PAM type: YTN; PAM sequence: TTT
tttttttttgagatggagtc

SEQ ID NO: 96535 - DNA, 20 bp, Artificial Sequence
  Description of Artificial Sequence: Synthetic oligonucleotide
  Target: SCN9A; (+) strand; PAM type: YTN; PAM sequence: TTT
ttttttttgagatggagtct

SEQ ID NO: 96536 - DNA, 20 bp, Artificial Sequence
  Description of Artificial Sequence: Synthetic oligonucleotide
  Target: SCN9A; (+) strand; PAM type: YTN; PAM sequence: TTT
tttttttgagatggagtctc

SEQ ID NO: 96537 - DNA, 20 bp, Artificial Sequence
  Description of Artificial Sequence: Synthetic oligonucleotide
  Target: SCN9A; (+) strand; PAM type: YTN; PAM sequence: TTT
ttttttgagatggagtctcg

SEQ ID NO: 96538 - DNA, 20 bp, Artificial Sequence
  Description of Artificial Sequence: Synthetic oligonucleotide
  Target: SCN9A; (+) strand; PAM type: YTN; PAM sequence: TTT
tttttgagatggagtctcgc

SEQ ID NO: 96539 - DNA, 20 bp, Artificial Sequence
  Description of Artificial Sequence: Synthetic oligonucleotide
  Target: SCN9A; (+) strand; PAM type: YTN; PAM sequence: TTT
ttttgagatggagtctcgct

SEQ ID NO: 96540 - DNA, 20 bp, Artificial Sequence
  Description of Artificial Sequence: Synthetic oligonucleotide
  Target: SCN9A; (+) strand; PAM type: YTN; PAM sequence: TTT
tttgagatggagtctcgctg

SEQ ID NO: 96541 - DNA, 20 bp, Artificial Sequence
  Description of Artificial Sequence: Synthetic oligonucleotide
  Target: SCN9A; (+) strand; PAM type: YTN; PAM sequence: TTT
ttgagatggagtctcgctgt

SEQ ID NO: 96542 - DNA, 20 bp, Artificial Sequence
  Description of Artificial Sequence: Synthetic oligonucleotide
  Target: SCN9A; (+) strand; PAM type: YTN; PAM sequence: TTT
tgagatggagtctcgctgtc

SEQ ID NO: 96543 - DNA, 20 bp, Artificial Sequence
  Description of Artificial Sequence: Synthetic oligonucleotide
  Target: SCN9A; (+) strand; PAM type: YTN; PAM sequence: TTT
gagatggagtctcgctgtct

SEQ ID NO: 96544 - DNA, 20 bp, Artificial Sequence
  Description of Artificial Sequence: Synthetic oligonucleotide
  Target: SCN9A; (+) strand; PAM type: YTN; PAM sequence: TTG
agatggagtctcgctgtctc

SEQ ID NO: 96545 - DNA, 20 bp, Artificial Sequence
  Description of Artificial Sequence: Synthetic oligonucleotide
  Target: SCN9A; (+) strand; PAM type: YTN; PAM sequence: CTC
gctgtctcgctctgtcgccc

SEQ ID NO: 96546 - DNA, 20 bp, Artificial Sequence
  Description of Artificial Sequence: Synthetic oligonucleotide
  Target: SCN9A; (+) strand; PAM type: YTN; PAM sequence: CTG
tctcgctctgtcgcccaggc

SEQ ID NO: 96547 - DNA, 20 bp, Artificial Sequence
  Description of Artificial Sequence: Synthetic oligonucleotide
  Target: SCN9A; (+) strand; PAM type: YTN; PAM sequence: CTC
gctctgtcgcccaggctgga

SEQ ID NO: 96548 - DNA, 20 bp, Artificial Sequence
  Description of Artificial Sequence: Synthetic oligonucleotide
  Target: SCN9A; (+) strand; PAM type: YTN; PAM sequence: CTC
tgtcgcccaggctggagtgc

SEQ ID NO: 96549 - DNA, 20 bp, Artificial Sequence
  Description of Artificial Sequence: Synthetic oligonucleotide
  Target: SCN9A; (+) strand; PAM type: YTN; PAM sequence: CTG
tcgcccaggctggagtgcag

SEQ ID NO: 96550 - DNA, 20 bp, Artificial Sequence
  Description of Artificial Sequence: Synthetic oligonucleotide
  Target: SCN9A; (+) strand; PAM type: YTN; PAM sequence: CTG
gagtgcagtggcgcaatctc

SEQ ID NO: 96551 - DNA, 20 bp, Artificial Sequence
  Description of Artificial Sequence: Synthetic oligonucleotide
  Target: SCN9A; (+) strand; PAM type: YTN; PAM sequence: CTC
ggctcactgcaagctccgcc

SEQ ID NO: 96552 - DNA, 20 bp, Artificial Sequence
  Description of Artificial Sequence: Synthetic oligonucleotide
  Target: SCN9A; (+) strand; PAM type: YTN; PAM sequence: CTC
actgcaagctccgcctcccg

SEQ ID NO: 96553 - DNA, 20 bp, Artificial Sequence
  Description of Artificial Sequence: Synthetic oligonucleotide
  Target: SCN9A; (+) strand; PAM type: YTN; PAM sequence: CTG
caagctccgcctcccgggtt

SEQ ID NO: 96554 - DNA, 20 bp, Artificial Sequence
  Description of Artificial Sequence: Synthetic oligonucleotide
  Target: SCN9A; (+) strand; PAM type: YTN; PAM sequence: CTC
cgcctcccgggttcatgcca

SEQ ID NO: 96555 - DNA, 20 bp, Artificial Sequence
  Description of Artificial Sequence: Synthetic oligonucleotide
  Target: SCN9A; (+) strand; PAM type: YTN; PAM sequence: CTC
ccgggttcatgccattctcc

SEQ ID NO: 96556 - DNA, 20 bp, Artificial Sequence
  Description of Artificial Sequence: Synthetic oligonucleotide
  Target: SCN9A; (+) strand; PAM type: YTN; PAM sequence: TTC
atgccattctcctgcctcag

SEQ ID NO: 96557 - DNA, 20 bp, Artificial Sequence
  Description of Artificial Sequence: Synthetic oligonucleotide
  Target: SCN9A; (+) strand; PAM type: YTN; PAM sequence: TTC
tcctgcctcagcctcccgag

SEQ ID NO: 96558 - DNA, 20 bp, Artificial Sequence
  Description of Artificial Sequence: Synthetic oligonucleotide
  Target: SCN9A; (+) strand; PAM type: YTN; PAM sequence: CTC
ctgcctcagcctcccgagta

SEQ ID NO: 96559 - DNA, 20 bp, Artificial Sequence
  Description of Artificial Sequence: Synthetic oligonucleotide
  Target: SCN9A; (+) strand; PAM type: YTN; PAM sequence: CTG
cctcagcctcccgagtagct

SEQ ID NO: 96560 - DNA, 20 bp, Artificial Sequence
  Description of Artificial Sequence: Synthetic oligonucleotide
  Target: SCN9A; (+) strand; PAM type: YTN; PAM sequence: CTC
agcctcccgagtagctggga

SEQ ID NO: 96561 - DNA, 20 bp, Artificial Sequence
  Description of Artificial Sequence: Synthetic oligonucleotide
  Target: SCN9A; (+) strand; PAM type: YTN; PAM sequence: CTC
ccgagtagctgggactacag

SEQ ID NO: 96562 - DNA, 20 bp, Artificial Sequence
  Description of Artificial Sequence: Synthetic oligonucleotide
  Target: SCN9A; (+) strand; PAM type: YTN; PAM sequence: CTG
ggactacaggcgcccgctac

SEQ ID NO: 96563 - DNA, 20 bp, Artificial Sequence
  Description of Artificial Sequence: Synthetic oligonucleotide
  Target: SCN9A; (+) strand; PAM type: YTN; PAM sequence: CTA
caggcgcccgctaccacgcc

SEQ ID NO: 96564 - DNA, 20 bp, Artificial Sequence
  Description of Artificial Sequence: Synthetic oligonucleotide
  Target: SCN9A; (+) strand; PAM type: YTN; PAM sequence: CTA
ccacgcccggctaatttttt

SEQ ID NO: 96565 - DNA, 20 bp, Artificial Sequence
  Description of Artificial Sequence: Synthetic oligonucleotide
  Target: SCN9A; (+) strand; PAM type: YTN; PAM sequence: CTA
attttttgtatttttagtag

SEQ ID NO: 96566 - DNA, 20 bp, Artificial Sequence
  Description of Artificial Sequence: Synthetic oligonucleotide
  Target: SCN9A; (+) strand; PAM type: YTN; PAM sequence: TTT
tttgtatttttagtagagac

SEQ ID NO: 96567 - DNA, 20 bp, Artificial Sequence
  Description of Artificial Sequence: Synthetic oligonucleotide
  Target: SCN9A; (+) strand; PAM type: YTN; PAM sequence: TTT
ttgtatttttagtagagacg

SEQ ID NO: 96568 - DNA, 20 bp, Artificial Sequence
  Description of Artificial Sequence: Synthetic oligonucleotide
  Target: SCN9A; (+) strand; PAM type: YTN; PAM sequence: TTT
tgtatttttagtagagacgg

SEQ ID NO: 96569 - DNA, 20 bp, Artificial Sequence
  Description of Artificial Sequence: Synthetic oligonucleotide
  Target: SCN9A; (+) strand; PAM type: YTN; PAM sequence: TTT
gtatttttagtagagacggg

SEQ ID NO: 96570 - DNA, 20 bp, Artificial Sequence
  Description of Artificial Sequence: Synthetic oligonucleotide
  Target: SCN9A; (+) strand; PAM type: YTN; PAM sequence: TTG
tatttttagtagagacgggg

SEQ ID NO: 96571 - DNA, 20 bp, Artificial Sequence
  Description of Artificial Sequence: Synthetic oligonucleotide
  Target: SCN9A; (+) strand; PAM type: YTN; PAM sequence: TTT
ttagtagagacggggtttca

SEQ ID NO: 96572 - DNA, 20 bp, Artificial Sequence
  Description of Artificial Sequence: Synthetic oligonucleotide
  Target: SCN9A; (+) strand; PAM type: YTN; PAM sequence: TTT
tagtagagacggggtttcac

SEQ ID NO: 96573 - DNA, 20 bp, Artificial Sequence
  Description of Artificial Sequence: Synthetic oligonucleotide
  Target: SCN9A; (+) strand; PAM type: YTN; PAM sequence: TTT
agtagagacggggtttcacc

SEQ ID NO: 96574 - DNA, 20 bp, Artificial Sequence
  Description of Artificial Sequence: Synthetic oligonucleotide
  Target: SCN9A; (+) strand; PAM type: YTN; PAM sequence: TTA
gtagagacggggtttcaccg

SEQ ID NO: 96575 - DNA, 20 bp, Artificial Sequence
  Description of Artificial Sequence: Synthetic oligonucleotide
  Target: SCN9A; (+) strand; PAM type: YTN; PAM sequence: TTT
caccgtgttagccaggatgg

SEQ ID NO: 96576 - DNA, 20 bp, Artificial Sequence
  Description of Artificial Sequence: Synthetic oligonucleotide
  Target: SCN9A; (+) strand; PAM type: YTN; PAM sequence: TTC
accgtgttagccaggatggt

SEQ ID NO: 96577 - DNA, 20 bp, Artificial Sequence
  Description of Artificial Sequence: Synthetic oligonucleotide
  Target: SCN9A; (+) strand; PAM type: YTN; PAM sequence: TTA
gccaggatggtctcgatctc

SEQ ID NO: 96578 - DNA, 20 bp, Artificial Sequence
  Description of Artificial Sequence: Synthetic oligonucleotide
  Target: SCN9A; (+) strand; PAM type: YTN; PAM sequence: CTC
gatctcctgacctcgtgatc

SEQ ID NO: 96579 - DNA, 20 bp, Artificial Sequence
  Description of Artificial Sequence: Synthetic oligonucleotide
  Target: SCN9A; (+) strand; PAM type: YTN; PAM sequence: CTC
ctgacctcgtgatccgcccg

SEQ ID NO: 96580 - DNA, 20 bp, Artificial Sequence
  Description of Artificial Sequence: Synthetic oligonucleotide
  Target: SCN9A; (+) strand; PAM type: YTN; PAM sequence: CTG
acctcgtgatccgcccgcct

SEQ ID NO: 96581 - DNA, 20 bp, Artificial Sequence
  Description of Artificial Sequence: Synthetic oligonucleotide
  Target: SCN9A; (+) strand; PAM type: YTN; PAM sequence: CTC
gtgatccgcccgcctcggcc

SEQ ID NO: 96582 - DNA, 20 bp, Artificial Sequence
  Description of Artificial Sequence: Synthetic oligonucleotide
  Target: SCN9A; (+) strand; PAM type: YTN; PAM sequence: CTC
ggcctcccaaagtgctggga

SEQ ID NO: 96583 - DNA, 20 bp, Artificial Sequence
  Description of Artificial Sequence: Synthetic oligonucleotide
  Target: SCN9A; (+) strand; PAM type: YTN; PAM sequence: CTC
ccaaagtgctgggattacag

SEQ ID NO: 96584 - DNA, 20 bp, Artificial Sequence
  Description of Artificial Sequence: Synthetic oligonucleotide
  Target: SCN9A; (+) strand; PAM type: YTN; PAM sequence: CTG
ggattacaggcgtgagccac

SEQ ID NO: 96585 - DNA, 20 bp, Artificial Sequence
  Description of Artificial Sequence: Synthetic oligonucleotide
  Target: SCN9A; (+) strand; PAM type: YTN; PAM sequence: TTA
caggcgtgagccaccgcgcc

SEQ ID NO: 96586 - DNA, 20 bp, Artificial Sequence
  Description of Artificial Sequence: Synthetic oligonucleotide
  Target: SCN9A; (+) strand; PAM type: YTN; PAM sequence: CTT
tcttttaaaagatgtggaag

SEQ ID NO: 96587 - DNA, 20 bp, Artificial Sequence
  Description of Artificial Sequence: Synthetic oligonucleotide
  Target: SCN9A; (+) strand; PAM type: YTN; PAM sequence: TTT
cttttaaaagatgtggaagg

SEQ ID NO: 96588 - DNA, 20 bp, Artificial Sequence
  Description of Artificial Sequence: Synthetic oligonucleotide
  Target: SCN9A; (+) strand; PAM type: YTN; PAM sequence: TTC
ttttaaaagatgtggaaggt

SEQ ID NO: 96589 - DNA, 20 bp, Artificial Sequence
  Description of Artificial Sequence: Synthetic oligonucleotide
  Target: SCN9A; (+) strand; PAM type: YTN; PAM sequence: CTT
ttaaaagatgtggaaggtct

SEQ ID NO: 96590 - DNA, 20 bp, Artificial Sequence
  Description of Artificial Sequence: Synthetic oligonucleotide
  Target: SCN9A; (+) strand; PAM type: YTN; PAM sequence: TTT
taaaagatgtggaaggtctc

SEQ ID NO: 96591 - DNA, 20 bp, Artificial Sequence
  Description of Artificial Sequence: Synthetic oligonucleotide
  Target: SCN9A; (+) strand; PAM type: YTN; PAM sequence: TTT
aaaagatgtggaaggtctct

SEQ ID NO: 96592 - DNA, 20 bp, Artificial Sequence
  Description of Artificial Sequence: Synthetic oligonucleotide
  Target: SCN9A; (+) strand; PAM type: YTN; PAM sequence: TTA
aaagatgtggaaggtctcta

SEQ ID NO: 96593 - DNA, 20 bp, Artificial Sequence
  Description of Artificial Sequence: Synthetic oligonucleotide
  Target: SCN9A; (+) strand; PAM type: YTN; PAM sequence: CTC
taccaccaagaacaggaagg

SEQ ID NO: 96594 - DNA, 20 bp, Artificial Sequence
  Description of Artificial Sequence: Synthetic oligonucleotide
  Target: SCN9A; (+) strand; PAM type: YTN; PAM sequence: CTA
ccaccaagaacaggaaggtg

SEQ ID NO: 96595 - DNA, 20 bp, Artificial Sequence
  Description of Artificial Sequence: Synthetic oligonucleotide
  Target: SCN9A; (+) strand; PAM type: YTN; PAM sequence: CTT
cttccctggcttgctcctga

SEQ ID NO: 96596 - DNA, 20 bp, Artificial Sequence
  Description of Artificial Sequence: Synthetic oligonucleotide
  Target: SCN9A; (+) strand; PAM type: YTN; PAM sequence: TTC
ttccctggcttgctcctgac

SEQ ID NO: 96597 - DNA, 20 bp, Artificial Sequence
  Description of Artificial Sequence: Synthetic oligonucleotide
  Target: SCN9A; (+) strand; PAM type: YTN; PAM sequence: CTT
ccctggcttgctcctgacat

SEQ ID NO: 96598 - DNA, 20 bp, Artificial Sequence
  Description of Artificial Sequence: Synthetic oligonucleotide
  Target: SCN9A; (+) strand; PAM type: YTN; PAM sequence: TTC
cctggcttgctcctgacata

SEQ ID NO: 96599 - DNA, 20 bp, Artificial Sequence
  Description of Artificial Sequence: Synthetic oligonucleotide
  Target: SCN9A; (+) strand; PAM type: YTN; PAM sequence: CTG
gcttgctcctgacataattt

SEQ ID NO: 96600 - DNA, 20 bp, Artificial Sequence
  Description of Artificial Sequence: Synthetic oligonucleotide
  Target: SCN9A; (+) strand; PAM type: YTN; PAM sequence: CTT
gctcctgacataatttatgc

SEQ ID NO: 96601 - DNA, 20 bp, Artificial Sequence
  Description of Artificial Sequence: Synthetic oligonucleotide
  Target: SCN9A; (+) strand; PAM type: YTN; PAM sequence: TTG
ctcctgacataatttatgca

SEQ ID NO: 96602 - DNA, 20 bp, Artificial Sequence
  Description of Artificial Sequence: Synthetic oligonucleotide
  Target: SCN9A; (+) strand; PAM type: YTN; PAM sequence: CTC
ctgacataatttatgcagtt

SEQ ID NO: 96603 - DNA, 20 bp, Artificial Sequence
  Description of Artificial Sequence: Synthetic oligonucleotide
  Target: SCN9A; (+) strand; PAM type: YTN; PAM sequence: CTG
acataatttatgcagtttct

SEQ ID NO: 96604 - DNA, 20 bp, Artificial Sequence
  Description of Artificial Sequence: Synthetic oligonucleotide
  Target: SCN9A; (+) strand; PAM type: YTN; PAM sequence: TTT
atgcagtttcttattagagg

SEQ ID NO: 96605 - DNA, 20 bp, Artificial Sequence
  Description of Artificial Sequence: Synthetic oligonucleotide
  Target: SCN9A; (+) strand; PAM type: YTN; PAM sequence: TTA
tgcagtttcttattagagga

SEQ ID NO: 96606 - DNA, 20 bp, Artificial Sequence
  Description of Artificial Sequence: Synthetic oligonucleotide
  Target: SCN9A; (+) strand; PAM type: YTN; PAM sequence: TTT
cttattagaggaaggcttga

SEQ ID NO: 96607 - DNA, 20 bp, Artificial Sequence
  Description of Artificial Sequence: Synthetic oligonucleotide
  Target: SCN9A; (+) strand; PAM type: YTN; PAM sequence: TTC
ttattagaggaaggcttgaa

SEQ ID NO: 96608 - DNA, 20 bp, Artificial Sequence
  Description of Artificial Sequence: Synthetic oligonucleotide
  Target: SCN9A; (+) strand; PAM type: YTN; PAM sequence: CTT
attagaggaaggcttgaact

SEQ ID NO: 96609 - DNA, 20 bp, Artificial Sequence
  Description of Artificial Sequence: Synthetic oligonucleotide
  Target: SCN9A; (+) strand; PAM type: YTN; PAM sequence: TTA
ttagaggaaggcttgaacta

SEQ ID NO: 96610 - DNA, 20 bp, Artificial Sequence
  Description of Artificial Sequence: Synthetic oligonucleotide
  Target: SCN9A; (+) strand; PAM type: YTN; PAM sequence: TTA
gaggaaggcttgaactacac

SEQ ID NO: 96611 - DNA, 20 bp, Artificial Sequence
  Description of Artificial Sequence: Synthetic oligonucleotide
  Target: SCN9A; (+) strand; PAM type: YTN; PAM sequence: CTT
gaactacactttaatccaat

SEQ ID NO: 96612 - DNA, 20 bp, Artificial Sequence
  Description of Artificial Sequence: Synthetic oligonucleotide
  Target: SCN9A; (+) strand; PAM type: YTN; PAM sequence: TTG
aactacactttaatccaata

SEQ ID NO: 96613 - DNA, 20 bp, Artificial Sequence
  Description of Artificial Sequence: Synthetic oligonucleotide
  Target: SCN9A; (+) strand; PAM type: YTN; PAM sequence: CTA
cactttaatccaatagatct

SEQ ID NO: 96614 - DNA, 20 bp, Artificial Sequence
  Description of Artificial Sequence: Synthetic oligonucleotide
  Target: SCN9A; (+) strand; PAM type: YTN; PAM sequence: CTT
taatccaatagatctaacag

SEQ ID NO: 96615 - DNA, 20 bp, Artificial Sequence
  Description of Artificial Sequence: Synthetic oligonucleotide
  Target: SCN9A; (+) strand; PAM type: YTN; PAM sequence: TTT
aatccaatagatctaacaga

SEQ ID NO: 96616 - DNA, 20 bp, Artificial Sequence
  Description of Artificial Sequence: Synthetic oligonucleotide
  Target: SCN9A; (+) strand; PAM type: YTN; PAM sequence: TTA
atccaatagatctaacagat

SEQ ID NO: 96617 - DNA, 20 bp, Artificial Sequence
  Description of Artificial Sequence: Synthetic oligonucleotide
  Target: SCN9A; (+) strand; PAM type: YTN; PAM sequence: CTA
acagatatttatagaacagt

SEQ ID NO: 96618 - DNA, 20 bp, Artificial Sequence
  Description of Artificial Sequence: Synthetic oligonucleotide
  Target: SCN9A; (+) strand; PAM type: YTN; PAM sequence: TTT
atagaacagttcatccaaca

SEQ ID NO: 96619 - DNA, 20 bp, Artificial Sequence
  Description of Artificial Sequence: Synthetic oligonucleotide
  Target: SCN9A; (+) strand; PAM type: YTN; PAM sequence: TTA
tagaacagttcatccaacag

SEQ ID NO: 96620 - DNA, 20 bp, Artificial Sequence
  Description of Artificial Sequence: Synthetic oligonucleotide
  Target: SCN9A; (+) strand; PAM type: YTN; PAM sequence: TTC
atccaacagcaacaaaatac

SEQ ID NO: 96621 - DNA, 20 bp, Artificial Sequence
  Description of Artificial Sequence: Synthetic oligonucleotide
  Target: SCN9A; (+) strand; PAM type: YTN; PAM sequence: TTC
ttctcaaatcacatgaaaca

SEQ ID NO: 96622 - DNA, 20 bp, Artificial Sequence
  Description of Artificial Sequence: Synthetic oligonucleotide
  Target: SCN9A; (+) strand; PAM type: YTN; PAM sequence: CTT
ctcaaatcacatgaaacact

SEQ ID NO: 96623 - DNA, 20 bp, Artificial Sequence
  Description of Artificial Sequence: Synthetic oligonucleotide
  Target: SCN9A; (+) strand; PAM type: YTN; PAM sequence: TTC
tcaaatcacatgaaacactc

SEQ ID NO: 96624 - DNA, 20 bp, Artificial Sequence
  Description of Artificial Sequence: Synthetic oligonucleotide
  Target: SCN9A; (+) strand; PAM type: YTN; PAM sequence: CTC
aaatcacatgaaacactctc

SEQ ID NO: 96625 - DNA, 20 bp, Artificial Sequence
  Description of Artificial Sequence: Synthetic oligonucleotide
  Target: SCN9A; (+) strand; PAM type: YTN; PAM sequence: CTC
tccaggatagatcacatgtt

SEQ ID NO: 96626 - DNA, 20 bp, Artificial Sequence
  Description of Artificial Sequence: Synthetic oligonucleotide
  Target: SCN9A; (+) strand; PAM type: YTN; PAM sequence: CTC
caggatagatcacatgttag

SEQ ID NO: 96627 - DNA, 20 bp, Artificial Sequence
  Description of Artificial Sequence: Synthetic oligonucleotide
  Target: SCN9A; (+) strand; PAM type: YTN; PAM sequence: TTA
ggccaccaaacaagttttaa

SEQ ID NO: 96628 - DNA, 20 bp, Artificial Sequence
  Description of Artificial Sequence: Synthetic oligonucleotide
  Target: SCN9A; (+) strand; PAM type: YTN; PAM sequence: TTT
taacaaatttaagaagatta

SEQ ID NO: 96629 - DNA, 20 bp, Artificial Sequence
  Description of Artificial Sequence: Synthetic oligonucleotide
  Target: SCN9A; (+) strand; PAM type: YTN; PAM sequence: TTT
aacaaatttaagaagattaa

SEQ ID NO: 96630 - DNA, 20 bp, Artificial Sequence
  Description of Artificial Sequence: Synthetic oligonucleotide
  Target: SCN9A; (+) strand; PAM type: YTN; PAM sequence: TTA
acaaatttaagaagattaaa

SEQ ID NO: 96631 - DNA, 20 bp, Artificial Sequence
  Description of Artificial Sequence: Synthetic oligonucleotide
  Target: SCN9A; (+) strand; PAM type: YTN; PAM sequence: TTT
aagaagattaaaatcatatc

SEQ ID NO: 96632 - DNA, 20 bp, Artificial Sequence
  Description of Artificial Sequence: Synthetic oligonucleotide
  Target: SCN9A; (+) strand; PAM type: YTN; PAM sequence: TTA
agaagattaaaatcatatcg

SEQ ID NO: 96633 - DNA, 20 bp, Artificial Sequence
  Description of Artificial Sequence: Synthetic oligonucleotide
  Target: SCN9A; (+) strand; PAM type: YTN; PAM sequence: TTA
aaatcatatcgagtatgttt

SEQ ID NO: 96634 - DNA, 20 bp, Artificial Sequence
  Description of Artificial Sequence: Synthetic oligonucleotide
  Target: SCN9A; (+) strand; PAM type: YTN; PAM sequence: TTT
tctgttcatgatgacatgaa

SEQ ID NO: 96635 - DNA, 20 bp, Artificial Sequence
  Description of Artificial Sequence: Synthetic oligonucleotide
  Target: SCN9A; (+) strand; PAM type: YTN; PAM sequence: TTT
ctgttcatgatgacatgaaa

SEQ ID NO: 96636 - DNA, 20 bp, Artificial Sequence
  Description of Artificial Sequence: Synthetic oligonucleotide
  Target: SCN9A; (+) strand; PAM type: YTN; PAM sequence: TTC
tgttcatgatgacatgaaac

SEQ ID NO: 96637 - DNA, 20 bp, Artificial Sequence
  Description of Artificial Sequence: Synthetic oligonucleotide
  Target: SCN9A; (+) strand; PAM type: YTN; PAM sequence: CTG
ttcatgatgacatgaaacta

SEQ ID NO: 96638 - DNA, 20 bp, Artificial Sequence
  Description of Artificial Sequence: Synthetic oligonucleotide
  Target: SCN9A; (+) strand; PAM type: YTN; PAM sequence: TTC
atgatgacatgaaactagaa

SEQ ID NO: 96639 - DNA, 20 bp, Artificial Sequence
  Description of Artificial Sequence: Synthetic oligonucleotide
  Target: SCN9A; (+) strand; PAM type: YTN; PAM sequence: CTA
gaagtcaataagaataacct

SEQ ID NO: 96640 - DNA, 20 bp, Artificial Sequence
  Description of Artificial Sequence: Synthetic oligonucleotide
  Target: SCN9A; (+) strand; PAM type: YTN; PAM sequence: CTT
gaacaactcataattacgtg

SEQ ID NO: 96641 - DNA, 20 bp, Artificial Sequence
  Description of Artificial Sequence: Synthetic oligonucleotide
  Target: SCN9A; (+) strand; PAM type: YTN; PAM sequence: TTG
aacaactcataattacgtgg

SEQ ID NO: 96642 - DNA, 20 bp, Artificial Sequence
  Description of Artificial Sequence: Synthetic oligonucleotide
  Target: SCN9A; (+) strand; PAM type: YTN; PAM sequence: CTC
ataattacgtggaaattaaa

SEQ ID NO: 96643 - DNA, 20 bp, Artificial Sequence
  Description of Artificial Sequence: Synthetic oligonucleotide
  Target: SCN9A; (+) strand; PAM type: YTN; PAM sequence: TTA
cgtggaaattaaacaacatg

SEQ ID NO: 96644 - DNA, 20 bp, Artificial Sequence
  Description of Artificial Sequence: Synthetic oligonucleotide
  Target: SCN9A; (+) strand; PAM type: YTN; PAM sequence: TTA
aacaacatgctcctgaacag

SEQ ID NO: 96645 - DNA, 20 bp, Artificial Sequence
  Description of Artificial Sequence: Synthetic oligonucleotide
  Target: SCN9A; (+) strand; PAM type: YTN; PAM sequence: CTC
ctgaacaggcaatgggtcaa

SEQ ID NO: 96646 - DNA, 20 bp, Artificial Sequence
  Description of Artificial Sequence: Synthetic oligonucleotide
  Target: SCN9A; (+) strand; PAM type: YTN; PAM sequence: CTG
aacaggcaatgggtcaaaga

SEQ ID NO: 96647 - DNA, 20 bp, Artificial Sequence
  Description of Artificial Sequence: Synthetic oligonucleotide
  Target: SCN9A; (+) strand; PAM type: YTN; PAM sequence: TTA
tacggaaaaacagaaaatat

SEQ ID NO: 96648 - DNA, 20 bp, Artificial Sequence
  Description of Artificial Sequence: Synthetic oligonucleotide
  Target: SCN9A; (+) strand; PAM type: YTN; PAM sequence: TTT
tgggatcaatgacaatggaa

SEQ ID NO: 96649 - DNA, 20 bp, Artificial Sequence
  Description of Artificial Sequence: Synthetic oligonucleotide
  Target: SCN9A; (+) strand; PAM type: YTN; PAM sequence: TTT
gggatcaatgacaatggaaa

SEQ ID NO: 96650 - DNA, 20 bp, Artificial Sequence
  Description of Artificial Sequence: Synthetic oligonucleotide
  Target: SCN9A; (+) strand; PAM type: YTN; PAM sequence: TTG
ggatcaatgacaatggaaac

SEQ ID NO: 96651 - DNA, 20 bp, Artificial Sequence
  Description of Artificial Sequence: Synthetic oligonucleotide
  Target: SCN9A; (+) strand; PAM type: YTN; PAM sequence: CTG
agagaaaaatttatagtaat

SEQ ID NO: 96652 - DNA, 20 bp, Artificial Sequence
  Description of Artificial Sequence: Synthetic oligonucleotide
  Target: SCN9A; (+) strand; PAM type: YTN; PAM sequence: TTT
atagtaataaatgcctacat

SEQ ID NO: 96653 - DNA, 20 bp, Artificial Sequence
  Description of Artificial Sequence: Synthetic oligonucleotide
  Target: SCN9A; (+) strand; PAM type: YTN; PAM sequence: TTA
tagtaataaatgcctacatt

SEQ ID NO: 96654 - DNA, 20 bp, Artificial Sequence
  Description of Artificial Sequence: Synthetic oligonucleotide
  Target: SCN9A; (+) strand; PAM type: YTN; PAM sequence: CTA
cattaaagaaagaaggaaaa

SEQ ID NO: 96655 - DNA, 20 bp, Artificial Sequence
  Description of Artificial Sequence: Synthetic oligonucleotide
  Target: SCN9A; (+) strand; PAM type: YTN; PAM sequence: TTA
aagaaagaaggaaaatctca

SEQ ID NO: 96656 - DNA, 20 bp, Artificial Sequence
  Description of Artificial Sequence: Synthetic oligonucleotide
  Target: SCN9A; (+) strand; PAM type: YTN; PAM sequence: CTC
aaataaacaacctaatatta

SEQ ID NO: 96657 - DNA, 20 bp, Artificial Sequence
  Description of Artificial Sequence: Synthetic oligonucleotide
  Target: SCN9A; (+) strand; PAM type: YTN; PAM sequence: CTA
atattacatcttagagatta

SEQ ID NO: 96658 - DNA, 20 bp, Artificial Sequence
  Description of Artificial Sequence: Synthetic oligonucleotide
  Target: SCN9A; (+) strand; PAM type: YTN; PAM sequence: TTA
catcttagagattagaaaaa

SEQ ID NO: 96659 - DNA, 20 bp, Artificial Sequence
  Description of Artificial Sequence: Synthetic oligonucleotide
  Target: SCN9A; (+) strand; PAM type: YTN; PAM sequence: CTT
agagattagaaaaagaagaa

SEQ ID NO: 96660 - DNA, 20 bp, Artificial Sequence
  Description of Artificial Sequence: Synthetic oligonucleotide
  Target: SCN9A; (+) strand; PAM type: YTN; PAM sequence: TTA
gagattagaaaaagaagaac

SEQ ID NO: 96661 - DNA, 20 bp, Artificial Sequence
  Description of Artificial Sequence: Synthetic oligonucleotide
  Target: SCN9A; (+) strand; PAM type: YTN; PAM sequence: TTA
gaaaaagaagaacagaatat

SEQ ID NO: 96662 - DNA, 20 bp, Artificial Sequence
  Description of Artificial Sequence: Synthetic oligonucleotide
  Target: SCN9A; (+) strand; PAM type: YTN; PAM sequence: CTT
tgcagaaggaagaaaataac

SEQ ID NO: 96663 - DNA, 20 bp, Artificial Sequence
  Description of Artificial Sequence: Synthetic oligonucleotide
  Target: SCN9A; (+) strand; PAM type: YTN; PAM sequence: TTT
gcagaaggaagaaaataaca

SEQ ID NO: 96664 - DNA, 20 bp, Artificial Sequence
  Description of Artificial Sequence: Synthetic oligonucleotide
  Target: SCN9A; (+) strand; PAM type: YTN; PAM sequence: TTG
cagaaggaagaaaataacaa

SEQ ID NO: 96665 - DNA, 20 bp, Artificial Sequence
  Description of Artificial Sequence: Synthetic oligonucleotide
  Target: SCN9A; (+) strand; PAM type: YTN; PAM sequence: CTA
aaaagttgtttttttgaaaa

SEQ ID NO: 96666 - DNA, 20 bp, Artificial Sequence
  Description of Artificial Sequence: Synthetic oligonucleotide
  Target: SCN9A; (+) strand; PAM type: YTN; PAM sequence: TTG
tttttttgaaaagataaaat

SEQ ID NO: 96667 - DNA, 20 bp, Artificial Sequence
  Description of Artificial Sequence: Synthetic oligonucleotide
  Target: SCN9A; (+) strand; PAM type: YTN; PAM sequence: TTT
ttttgaaaagataaaatcga

SEQ ID NO: 96668 - DNA, 20 bp, Artificial Sequence
  Description of Artificial Sequence: Synthetic oligonucleotide
  Target: SCN9A; (+) strand; PAM type: YTN; PAM sequence: TTT
tttgaaaagataaaatcgaa

SEQ ID NO: 96669 - DNA, 20 bp, Artificial Sequence
  Description of Artificial Sequence: Synthetic oligonucleotide
  Target: SCN9A; (+) strand; PAM type: YTN; PAM sequence: TTT
ttgaaaagataaaatcgaaa

SEQ ID NO: 96670 - DNA, 20 bp, Artificial Sequence
  Description of Artificial Sequence: Synthetic oligonucleotide
  Target: SCN9A; (+) strand; PAM type: YTN; PAM sequence: TTT
tgaaaagataaaatcgaaaa

SEQ ID NO: 96671 - DNA, 20 bp, Artificial Sequence
  Description of Artificial Sequence: Synthetic oligonucleotide
  Target: SCN9A; (+) strand; PAM type: YTN; PAM sequence: TTT
gaaaagataaaatcgaaaaa

SEQ ID NO: 96672 - DNA, 20 bp, Artificial Sequence
  Description of Artificial Sequence: Synthetic oligonucleotide
  Target: SCN9A; (+) strand; PAM type: YTN; PAM sequence: TTG
aaaagataaaatcgaaaaac

SEQ ID NO: 96673 - DNA, 20 bp, Artificial Sequence
  Description of Artificial Sequence: Synthetic oligonucleotide
  Target: SCN9A; (+) strand; PAM type: YTN; PAM sequence: CTT
taactagactaaccaaggga

SEQ ID NO: 96674 - DNA, 20 bp, Artificial Sequence
  Description of Artificial Sequence: Synthetic oligonucleotide
  Target: SCN9A; (+) strand; PAM type: YTN; PAM sequence: TTT
aactagactaaccaagggaa

SEQ ID NO: 96675 - DNA, 20 bp, Artificial Sequence
  Description of Artificial Sequence: Synthetic oligonucleotide
  Target: SCN9A; (+) strand; PAM type: YTN; PAM sequence: TTA
actagactaaccaagggaaa

SEQ ID NO: 96676 - DNA, 20 bp, Artificial Sequence
  Description of Artificial Sequence: Synthetic oligonucleotide
  Target: SCN9A; (+) strand; PAM type: YTN; PAM sequence: CTA
gactaaccaagggaaaaaag

SEQ ID NO: 96677 - DNA, 20 bp, Artificial Sequence
  Description of Artificial Sequence: Synthetic oligonucleotide
  Target: SCN9A; (+) strand; PAM type: YTN; PAM sequence: CTA
accaagggaaaaaagacaac

SEQ ID NO: 96678 - DNA, 20 bp, Artificial Sequence
  Description of Artificial Sequence: Synthetic oligonucleotide
  Target: SCN9A; (+) strand; PAM type: YTN; PAM sequence: CTC
aaacaatatctgaaatgaaa

SEQ ID NO: 96679 - DNA, 20 bp, Artificial Sequence
  Description of Artificial Sequence: Synthetic oligonucleotide
  Target: SCN9A; (+) strand; PAM type: YTN; PAM sequence: CTG
aaatgaaagaagggagacta

SEQ ID NO: 96680 - DNA, 20 bp, Artificial Sequence
  Description of Artificial Sequence: Synthetic oligonucleotide
  Target: SCN9A; (+) strand; PAM type: YTN; PAM sequence: CTA
acactgataacacataaata

SEQ ID NO: 96681 - DNA, 20 bp, Artificial Sequence
  Description of Artificial Sequence: Synthetic oligonucleotide
  Target: SCN9A; (+) strand; PAM type: YTN; PAM sequence: CTG
ataacacataaatacaagga

SEQ ID NO: 96682 - DNA, 20 bp, Artificial Sequence
  Description of Artificial Sequence: Synthetic oligonucleotide
  Target: SCN9A; (+) strand; PAM type: YTN; PAM sequence: CTA
ttaatgtgaacaaccataca

SEQ ID NO: 96683 - DNA, 20 bp, Artificial Sequence
  Description of Artificial Sequence: Synthetic oligonucleotide
  Target: SCN9A; (+) strand; PAM type: YTN; PAM sequence: TTA
atgtgaacaaccatacacca

SEQ ID NO: 96684 - DNA, 20 bp, Artificial Sequence
  Description of Artificial Sequence: Synthetic oligonucleotide
  Target: SCN9A; (+) strand; PAM type: YTN; PAM sequence: TTG
aataacctagaaggaatgaa

SEQ ID NO: 96685 - DNA, 20 bp, Artificial Sequence
  Description of Artificial Sequence: Synthetic oligonucleotide
  Target: SCN9A; (+) strand; PAM type: YTN; PAM sequence: CTA
gaaggaatgaactaatcttt

SEQ ID NO: 96686 - DNA, 20 bp, Artificial Sequence
  Description of Artificial Sequence: Synthetic oligonucleotide
  Target: SCN9A; (+) strand; PAM type: YTN; PAM sequence: CTA
atctttagaaacatgcaacc

SEQ ID NO: 96687 - DNA, 20 bp, Artificial Sequence
  Description of Artificial Sequence: Synthetic oligonucleotide
  Target: SCN9A; (+) strand; PAM type: YTN; PAM sequence: CTT
tagaaacatgcaacctacca

SEQ ID NO: 96688 - DNA, 20 bp, Artificial Sequence
  Description of Artificial Sequence: Synthetic oligonucleotide
  Target: SCN9A; (+) strand; PAM type: YTN; PAM sequence: TTT
agaaacatgcaacctaccaa

SEQ ID NO: 96689 - DNA, 20 bp, Artificial Sequence
  Description of Artificial Sequence: Synthetic oligonucleotide
  Target: SCN9A; (+) strand; PAM type: YTN; PAM sequence: TTA
gaaacatgcaacctaccaag

SEQ ID NO: 96690 - DNA, 20 bp, Artificial Sequence
  Description of Artificial Sequence: Synthetic oligonucleotide
  Target: SCN9A; (+) strand; PAM type: YTN; PAM sequence: CTA
ccaagactaaatcaagaaat

SEQ ID NO: 96691 - DNA, 20 bp, Artificial Sequence
  Description of Artificial Sequence: Synthetic oligonucleotide
  Target: SCN9A; (+) strand; PAM type: YTN; PAM sequence: CTA
aatcaagaaatattacatct

SEQ ID NO: 96692 - DNA, 20 bp, Artificial Sequence
  Description of Artificial Sequence: Synthetic oligonucleotide
  Target: SCN9A; (+) strand; PAM type: YTN; PAM sequence: TTA
catctgaacaaaccaatact

SEQ ID NO: 96693 - DNA, 20 bp, Artificial Sequence
  Description of Artificial Sequence: Synthetic oligonucleotide
  Target: SCN9A; (+) strand; PAM type: YTN; PAM sequence: CTG
aacaaaccaatactggataa

SEQ ID NO: 96694 - DNA, 20 bp, Artificial Sequence
  Description of Artificial Sequence: Synthetic oligonucleotide
  Target: SCN9A; (+) strand; PAM type: YTN; PAM sequence: CTG
gataaagaaaatagatcagt

SEQ ID NO: 96695 - DNA, 20 bp, Artificial Sequence
  Description of Artificial Sequence: Synthetic oligonucleotide
  Target: SCN9A; (+) strand; PAM type: YTN; PAM sequence: TTA
agtctcctaaccaaaaaaaa

SEQ ID NO: 96696 - DNA, 20 bp, Artificial Sequence
  Description of Artificial Sequence: Synthetic oligonucleotide
  Target: SCN9A; (+) strand; PAM type: YTN; PAM sequence: CTC
ctaaccaaaaaaaaaaaaaa

SEQ ID NO: 96697 - DNA, 20 bp, Artificial Sequence
  Description of Artificial Sequence: Synthetic oligonucleotide
  Target: SCN9A; (+) strand; PAM type: YTN; PAM sequence: CTA
accaaaaaaaaaaaaaagga

SEQ ID NO: 96698 - DNA, 20 bp, Artificial Sequence
  Description of Artificial Sequence: Synthetic oligonucleotide
  Target: SCN9A; (+) strand; PAM type: YTN; PAM sequence: CTG
gtgaattctatttaaagaag

SEQ ID NO: 96699 - DNA, 20 bp, Artificial Sequence
  Description of Artificial Sequence: Synthetic oligonucleotide
  Target: SCN9A; (+) strand; PAM type: YTN; PAM sequence: TTC
tatttaaagaagtaatatga

SEQ ID NO: 96700 - DNA, 20 bp, Artificial Sequence
  Description of Artificial Sequence: Synthetic oligonucleotide
  Target: SCN9A; (+) strand; PAM type: YTN; PAM sequence: CTA
tttaaagaagtaatatgaat

SEQ ID NO: 96701 - DNA, 20 bp, Artificial Sequence
  Description of Artificial Sequence: Synthetic oligonucleotide
  Target: SCN9A; (+) strand; PAM type: YTN; PAM sequence: TTT
aaagaagtaatatgaattct

SEQ ID NO: 96702 - DNA, 20 bp, Artificial Sequence
  Description of Artificial Sequence: Synthetic oligonucleotide
  Target: SCN9A; (+) strand; PAM type: YTN; PAM sequence: TTA
aagaagtaatatgaattctt

SEQ ID NO: 96703 - DNA, 20 bp, Artificial Sequence
  Description of Artificial Sequence: Synthetic oligonucleotide
  Target: SCN9A; (+) strand; PAM type: YTN; PAM sequence: TTC
ttctcaaattcttccaaaaa

SEQ ID NO: 96704 - DNA, 20 bp, Artificial Sequence
  Description of Artificial Sequence: Synthetic oligonucleotide
  Target: SCN9A; (+) strand; PAM type: YTN; PAM sequence: CTT
ctcaaattcttccaaaaaat

SEQ ID NO: 96705 - DNA, 20 bp, Artificial Sequence
  Description of Artificial Sequence: Synthetic oligonucleotide
  Target: SCN9A; (+) strand; PAM type: YTN; PAM sequence: TTC
tcaaattcttccaaaaaatt

SEQ ID NO: 96706 - DNA, 20 bp, Artificial Sequence
  Description of Artificial Sequence: Synthetic oligonucleotide
  Target: SCN9A; (+) strand; PAM type: YTN; PAM sequence: CTC
aaattcttccaaaaaattga

SEQ ID NO: 96707 - DNA, 20 bp, Artificial Sequence
  Description of Artificial Sequence: Synthetic oligonucleotide
  Target: SCN9A; (+) strand; PAM type: YTN; PAM sequence: TTC
ttccaaaaaattgaaaagga

SEQ ID NO: 96708 - DNA, 20 bp, Artificial Sequence
  Description of Artificial Sequence: Synthetic oligonucleotide
  Target: SCN9A; (+) strand; PAM type: YTN; PAM sequence: CTT
ccaaaaaattgaaaaggagg

SEQ ID NO: 96709 - DNA, 20 bp, Artificial Sequence
  Description of Artificial Sequence: Synthetic oligonucleotide
  Target: SCN9A; (+) strand; PAM type: YTN; PAM sequence: TTC
caaaaaattgaaaaggaggt

SEQ ID NO: 96710 - DNA, 20 bp, Artificial Sequence
  Description of Artificial Sequence: Synthetic oligonucleotide
  Target: SCN9A; (+) strand; PAM type: YTN; PAM sequence: TTG
aaaaggaggtcaaattcatt

SEQ ID NO: 96711 - DNA, 20 bp, Artificial Sequence
  Description of Artificial Sequence: Synthetic oligonucleotide
  Target: SCN9A; (+) strand; PAM type: YTN; PAM sequence: TTC
attttatgaggccagtatta

SEQ ID NO: 96712 - DNA, 20 bp, Artificial Sequence
  Description of Artificial Sequence: Synthetic oligonucleotide
  Target: SCN9A; (+) strand; PAM type: YTN; PAM sequence: TTT
tatgaggccagtattatact

SEQ ID NO: 96713 - DNA, 20 bp, Artificial Sequence
  Description of Artificial Sequence: Synthetic oligonucleotide
  Target: SCN9A; (+) strand; PAM type: YTN; PAM sequence: TTT
atgaggccagtattatactg

SEQ ID NO: 96714 - DNA, 20 bp, Artificial Sequence
  Description of Artificial Sequence: Synthetic oligonucleotide
  Target: SCN9A; (+) strand; PAM type: YTN; PAM sequence: TTA
tgaggccagtattatactga

SEQ ID NO: 96715 - DNA, 20 bp, Artificial Sequence
  Description of Artificial Sequence: Synthetic oligonucleotide
  Target: SCN9A; (+) strand; PAM type: YTN; PAM sequence: TTA
tactgatatgaaaaccctaa

SEQ ID NO: 96716 - DNA, 20 bp, Artificial Sequence
  Description of Artificial Sequence: Synthetic oligonucleotide
  Target: SCN9A; (+) strand; PAM type: YTN; PAM sequence: CTG
atatgaaaaccctaagagta

SEQ ID NO: 96717 - DNA, 20 bp, Artificial Sequence
  Description of Artificial Sequence: Synthetic oligonucleotide
  Target: SCN9A; (+) strand; PAM type: YTN; PAM sequence: CTA
agagtatgctaccagaaaag

SEQ ID NO: 96718 - DNA, 20 bp, Artificial Sequence
  Description of Artificial Sequence: Synthetic oligonucleotide
  Target: SCN9A; (+) strand; PAM type: YTN; PAM sequence: CTA
ccagaaaagaaaactgcagg

SEQ ID NO: 96719 - DNA, 20 bp, Artificial Sequence
  Description of Artificial Sequence: Synthetic oligonucleotide
  Target: SCN9A; (+) strand; PAM type: YTN; PAM sequence: CTG
caggccaatattcttgatga

SEQ ID NO: 96720 - DNA, 20 bp, Artificial Sequence
  Description of Artificial Sequence: Synthetic oligonucleotide
  Target: SCN9A; (+) strand; PAM type: YTN; PAM sequence: TTC
ttgatgaacatagatccaaa

SEQ ID NO: 96721 - DNA, 20 bp, Artificial Sequence
  Description of Artificial Sequence: Synthetic oligonucleotide
  Target: SCN9A; (+) strand; PAM type: YTN; PAM sequence: CTT
gatgaacatagatccaaaaa

SEQ ID NO: 96722 - DNA, 20 bp, Artificial Sequence
  Description of Artificial Sequence: Synthetic oligonucleotide
  Target: SCN9A; (+) strand; PAM type: YTN; PAM sequence: TTG
atgaacatagatccaaaaat

SEQ ID NO: 96723 - DNA, 20 bp, Artificial Sequence
  Description of Artificial Sequence: Synthetic oligonucleotide
  Target: SCN9A; (+) strand; PAM type: YTN; PAM sequence: TTC
acaacaatatattagcaaac

SEQ ID NO: 96724 - DNA, 20 bp, Artificial Sequence
  Description of Artificial Sequence: Synthetic oligonucleotide
  Target: SCN9A; (+) strand; PAM type: YTN; PAM sequence: TTA
gcaaactgaattccctagca

SEQ ID NO: 96725 - DNA, 20 bp, Artificial Sequence
  Description of Artificial Sequence: Synthetic oligonucleotide
  Target: SCN9A; (+) strand; PAM type: YTN; PAM sequence: CTG
aattccctagcacatttaaa

SEQ ID NO: 96726 - DNA, 20 bp, Artificial Sequence
  Description of Artificial Sequence: Synthetic oligonucleotide
  Target: SCN9A; (+) strand; PAM type: YTN; PAM sequence: TTC
cctagcacatttaaaacatc

SEQ ID NO: 96727 - DNA, 20 bp, Artificial Sequence
  Description of Artificial Sequence: Synthetic oligonucleotide
  Target: SCN9A; (+) strand; PAM type: YTN; PAM sequence: CTA
gcacatttaaaacatcattc

SEQ ID NO: 96728 - DNA, 20 bp, Artificial Sequence
  Description of Artificial Sequence: Synthetic oligonucleotide
  Target: SCN9A; (+) strand; PAM type: YTN; PAM sequence: TTT
aaaacatcattcaccatgat

SEQ ID NO: 96729 - DNA, 20 bp, Artificial Sequence
  Description of Artificial Sequence: Synthetic oligonucleotide
  Target: SCN9A; (+) strand; PAM type: YTN; PAM sequence: TTA
aaacatcattcaccatgatt

SEQ ID NO: 96730 - DNA, 20 bp, Artificial Sequence
  Description of Artificial Sequence: Synthetic oligonucleotide
  Target: SCN9A; (+) strand; PAM type: YTN; PAM sequence: TTC
accatgattacttgggattt

SEQ ID NO: 96731 - DNA, 20 bp, Artificial Sequence
  Description of Artificial Sequence: Synthetic oligonucleotide
  Target: SCN9A; (+) strand; PAM type: YTN; PAM sequence: TTA
cttgggatttatctgaggga

SEQ ID NO: 96732 - DNA, 20 bp, Artificial Sequence
  Description of Artificial Sequence: Synthetic oligonucleotide
  Target: SCN9A; (+) strand; PAM type: YTN; PAM sequence: CTT
gggatttatctgagggatgc

SEQ ID NO: 96733 - DNA, 20 bp, Artificial Sequence
  Description of Artificial Sequence: Synthetic oligonucleotide
  Target: SCN9A; (+) strand; PAM type: YTN; PAM sequence: TTG
ggatttatctgagggatgca

SEQ ID NO: 96734 - DNA, 20 bp, Artificial Sequence
  Description of Artificial Sequence: Synthetic oligonucleotide
  Target: SCN9A; (+) strand; PAM type: YTN; PAM sequence: TTT
atctgagggatgcaaaaatg

SEQ ID NO: 96735 - DNA, 20 bp, Artificial Sequence
  Description of Artificial Sequence: Synthetic oligonucleotide
  Target: SCN9A; (+) strand; PAM type: YTN; PAM sequence: TTA
tctgagggatgcaaaaatgg

SEQ ID NO: 96736 - DNA, 20 bp, Artificial Sequence
  Description of Artificial Sequence: Synthetic oligonucleotide
  Target: SCN9A; (+) strand; PAM type: YTN; PAM sequence: CTG
agggatgcaaaaatggttaa

SEQ ID NO: 96737 - DNA, 20 bp, Artificial Sequence
  Description of Artificial Sequence: Synthetic oligonucleotide
  Target: SCN9A; (+) strand; PAM type: YTN; PAM sequence: TTA
aacatacataaatcaataaa

SEQ ID NO: 96738 - DNA, 20 bp, Artificial Sequence
  Description of Artificial Sequence: Synthetic oligonucleotide
  Target: SCN9A; (+) strand; PAM type: YTN; PAM sequence: CTA
cattaacaaaataagaacaa

SEQ ID NO: 96739 - DNA, 20 bp, Artificial Sequence
  Description of Artificial Sequence: Synthetic oligonucleotide
  Target: SCN9A; (+) strand; PAM type: YTN; PAM sequence: TTA
acaaaataagaacaaaaatc

SEQ ID NO: 96740 - DNA, 20 bp, Artificial Sequence
  Description of Artificial Sequence: Synthetic oligonucleotide
  Target: SCN9A; (+) strand; PAM type: YTN; PAM sequence: CTT
actagatgcagacaaagcat

SEQ ID NO: 96741 - DNA, 20 bp, Artificial Sequence
  Description of Artificial Sequence: Synthetic oligonucleotide
  Target: SCN9A; (+) strand; PAM type: YTN; PAM sequence: TTA
ctagatgcagacaaagcatt

SEQ ID NO: 96742 - DNA, 20 bp, Artificial Sequence
  Description of Artificial Sequence: Synthetic oligonucleotide
  Target: SCN9A; (+) strand; PAM type: YTN; PAM sequence: CTA
gatgcagacaaagcatttga

SEQ ID NO: 96743 - DNA, 20 bp, Artificial Sequence
  Description of Artificial Sequence: Synthetic oligonucleotide
  Target: SCN9A; (+) strand; PAM type: YTN; PAM sequence: TTT
gataaaatccagcatatgtt

SEQ ID NO: 96744 - DNA, 20 bp, Artificial Sequence
  Description of Artificial Sequence: Synthetic oligonucleotide
  Target: SCN9A; (+) strand; PAM type: YTN; PAM sequence: TTG
ataaaatccagcatatgttc

SEQ ID NO: 96745 - DNA, 20 bp, Artificial Sequence
  Description of Artificial Sequence: Synthetic oligonucleotide
  Target: SCN9A; (+) strand; PAM type: YTN; PAM sequence: TTC
ataataaaatctcaacaaag

SEQ ID NO: 96746 - DNA, 20 bp, Artificial Sequence
  Description of Artificial Sequence: Synthetic oligonucleotide
  Target: SCN9A; (+) strand; PAM type: YTN; PAM sequence: CTC
aacaaagcagatatggaagg

SEQ ID NO: 96747 - DNA, 20 bp, Artificial Sequence
  Description of Artificial Sequence: Synthetic oligonucleotide
  Target: SCN9A; (+) strand; PAM type: YTN; PAM sequence: CTT
aacaaaataaagccatatat

SEQ ID NO: 96748 - DNA, 20 bp, Artificial Sequence
  Description of Artificial Sequence: Synthetic oligonucleotide
  Target: SCN9A; (+) strand; PAM type: YTN; PAM sequence: TTA
acaaaataaagccatatatg

SEQ ID NO: 96749 - DNA, 20 bp, Artificial Sequence
  Description of Artificial Sequence: Synthetic oligonucleotide
  Target: SCN9A; (+) strand; PAM type: YTN; PAM sequence: CTA
acattatgcaaaaactgaaa

SEQ ID NO: 96750 - DNA, 20 bp, Artificial Sequence
  Description of Artificial Sequence: Synthetic oligonucleotide
  Target: SCN9A; (+) strand; PAM type: YTN; PAM sequence: TTA
tgcaaaaactgaaaagttgg

SEQ ID NO: 96751 - DNA, 20 bp, Artificial Sequence
  Description of Artificial Sequence: Synthetic oligonucleotide
  Target: SCN9A; (+) strand; PAM type: YTN; PAM sequence: CTG
aaaagttgggagcttttctt

SEQ ID NO: 96752 - DNA, 20 bp, Artificial Sequence
  Description of Artificial Sequence: Synthetic oligonucleotide
  Target: SCN9A; (+) strand; PAM type: YTN; PAM sequence: TTG
ggagcttttcttctaagatc

SEQ ID NO: 96753 - DNA, 20 bp, Artificial Sequence
  Description of Artificial Sequence: Synthetic oligonucleotide
  Target: SCN9A; (+) strand; PAM type: YTN; PAM sequence: CTT
ttcttctaagatcaggaaca

SEQ ID NO: 96754 - DNA, 20 bp, Artificial Sequence
  Description of Artificial Sequence: Synthetic oligonucleotide
  Target: SCN9A; (+) strand; PAM type: YTN; PAM sequence: TTT
tcttctaagatcaggaacaa

SEQ ID NO: 96755 - DNA, 20 bp, Artificial Sequence
  Description of Artificial Sequence: Synthetic oligonucleotide
  Target: SCN9A; (+) strand; PAM type: YTN; PAM sequence: TTT
cttctaagatcaggaacaag

SEQ ID NO: 96756 - DNA, 20 bp, Artificial Sequence
  Description of Artificial Sequence: Synthetic oligonucleotide
  Target: SCN9A; (+) strand; PAM type: YTN; PAM sequence: TTC
ttctaagatcaggaacaaga

SEQ ID NO: 96757 - DNA, 20 bp, Artificial Sequence
  Description of Artificial Sequence: Synthetic oligonucleotide
  Target: SCN9A; (+) strand; PAM type: YTN; PAM sequence: CTT
ctaagatcaggaacaagaca

SEQ ID NO: 96758 - DNA, 20 bp, Artificial Sequence
  Description of Artificial Sequence: Synthetic oligonucleotide
  Target: SCN9A; (+) strand; PAM type: YTN; PAM sequence: TTC
taagatcaggaacaagacaa

SEQ ID NO: 96759 - DNA, 20 bp, Artificial Sequence
  Description of Artificial Sequence: Synthetic oligonucleotide
  Target: SCN9A; (+) strand; PAM type: YTN; PAM sequence: CTA
agatcaggaacaagacaagg

SEQ ID NO: 96760 - DNA, 20 bp, Artificial Sequence
  Description of Artificial Sequence: Synthetic oligonucleotide
  Target: SCN9A; (+) strand; PAM type: YTN; PAM sequence: CTA
ttaccacttctttttgacat

SEQ ID NO: 96761 - DNA, 20 bp, Artificial Sequence
  Description of Artificial Sequence: Synthetic oligonucleotide
  Target: SCN9A; (+) strand; PAM type: YTN; PAM sequence: TTA
ccacttctttttgacatagt

SEQ ID NO: 96762 - DNA, 20 bp, Artificial Sequence
  Description of Artificial Sequence: Synthetic oligonucleotide
  Target: SCN9A; (+) strand; PAM type: YTN; PAM sequence: CTT
ctttttgacatagtactaga

SEQ ID NO: 96763 - DNA, 20 bp, Artificial Sequence
  Description of Artificial Sequence: Synthetic oligonucleotide
  Target: SCN9A; (+) strand; PAM type: YTN; PAM sequence: TTC
tttttgacatagtactagaa

SEQ ID NO: 96764 - DNA, 20 bp, Artificial Sequence
  Description of Artificial Sequence: Synthetic oligonucleotide
  Target: SCN9A; (+) strand; PAM type: YTN; PAM sequence: CTT
tttgacatagtactagaaat

SEQ ID NO: 96765 - DNA, 20 bp, Artificial Sequence
  Description of Artificial Sequence: Synthetic oligonucleotide
  Target: SCN9A; (+) strand; PAM type: YTN; PAM sequence: TTT
ttgacatagtactagaaatc

SEQ ID NO: 96766 - DNA, 20 bp, Artificial Sequence
  Description of Artificial Sequence: Synthetic oligonucleotide
  Target: SCN9A; (+) strand; PAM type: YTN; PAM sequence: TTT
tgacatagtactagaaatcc

SEQ ID NO: 96767 - DNA, 20 bp, Artificial Sequence
  Description of Artificial Sequence: Synthetic oligonucleotide
  Target: SCN9A; (+) strand; PAM type: YTN; PAM sequence: TTT
gacatagtactagaaatccc

SEQ ID NO: 96768 - DNA, 20 bp, Artificial Sequence
  Description of Artificial Sequence: Synthetic oligonucleotide
  Target: SCN9A; (+) strand; PAM type: YTN; PAM sequence: TTG
acatagtactagaaatccca

SEQ ID NO: 96769 - DNA, 20 bp, Artificial Sequence
  Description of Artificial Sequence: Synthetic oligonucleotide
  Target: SCN9A; (+) strand; PAM type: YTN; PAM sequence: CTA
gaaatcccatccatagcaat

SEQ ID NO: 96770 - DNA, 20 bp, Artificial Sequence
  Description of Artificial Sequence: Synthetic oligonucleotide
  Target: SCN9A; (+) strand; PAM type: YTN; PAM sequence: TTA
ggcaggaaaaagaaataaaa

SEQ ID NO: 96771 - DNA, 20 bp, Artificial Sequence
  Description of Artificial Sequence: Synthetic oligonucleotide
  Target: SCN9A; (+) strand; PAM type: YTN; PAM sequence: TTA
tctctgtttgctaatgacat

SEQ ID NO: 96772 - DNA, 20 bp, Artificial Sequence
  Description of Artificial Sequence: Synthetic oligonucleotide
  Target: SCN9A; (+) strand; PAM type: YTN; PAM sequence: CTC
tgtttgctaatgacatgatc

SEQ ID NO: 96773 - DNA, 20 bp, Artificial Sequence
  Description of Artificial Sequence: Synthetic oligonucleotide
  Target: SCN9A; (+) strand; PAM type: YTN; PAM sequence: CTG
tttgctaatgacatgatctt

SEQ ID NO: 96774 - DNA, 20 bp, Artificial Sequence
  Description of Artificial Sequence: Synthetic oligonucleotide
  Target: SCN9A; (+) strand; PAM type: YTN; PAM sequence: TTT
gctaatgacatgatctttat

SEQ ID NO: 96775 - DNA, 20 bp, Artificial Sequence
  Description of Artificial Sequence: Synthetic oligonucleotide
  Target: SCN9A; (+) strand; PAM type: YTN; PAM sequence: TTG
ctaatgacatgatctttata

SEQ ID NO: 96776 - DNA, 20 bp, Artificial Sequence
  Description of Artificial Sequence: Synthetic oligonucleotide
  Target: SCN9A; (+) strand; PAM type: YTN; PAM sequence: CTA
atgacatgatctttatatgt

SEQ ID NO: 96777 - DNA, 20 bp, Artificial Sequence
  Description of Artificial Sequence: Synthetic oligonucleotide
  Target: SCN9A; (+) strand; PAM type: YTN; PAM sequence: CTT
tatatgtagaaaaccctgaa

SEQ ID NO: 96778 - DNA, 20 bp, Artificial Sequence
  Description of Artificial Sequence: Synthetic oligonucleotide
  Target: SCN9A; (+) strand; PAM type: YTN; PAM sequence: TTT
atatgtagaaaaccctgaac

SEQ ID NO: 96779 - DNA, 20 bp, Artificial Sequence
  Description of Artificial Sequence: Synthetic oligonucleotide
  Target: SCN9A; (+) strand; PAM type: YTN; PAM sequence: TTA
tatgtagaaaaccctgaaca

SEQ ID NO: 96780 - DNA, 20 bp, Artificial Sequence
  Description of Artificial Sequence: Synthetic oligonucleotide
  Target: SCN9A; (+) strand; PAM type: YTN; PAM sequence: CTG
aacactctactgagaactgt

SEQ ID NO: 96781 - DNA, 20 bp, Artificial Sequence
  Description of Artificial Sequence: Synthetic oligonucleotide
  Target: SCN9A; (+) strand; PAM type: YTN; PAM sequence: CTC
tactgagaactgttaaaact

SEQ ID NO: 96782 - DNA, 20 bp, Artificial Sequence
  Description of Artificial Sequence: Synthetic oligonucleotide
  Target: SCN9A; (+) strand; PAM type: YTN; PAM sequence: CTA
ctgagaactgttaaaactga

SEQ ID NO: 96783 - DNA, 20 bp, Artificial Sequence
  Description of Artificial Sequence: Synthetic oligonucleotide
  Target: SCN9A; (+) strand; PAM type: YTN; PAM sequence: CTG
agaactgttaaaactgatac

SEQ ID NO: 96784 - DNA, 20 bp, Artificial Sequence
  Description of Artificial Sequence: Synthetic oligonucleotide
  Target: SCN9A; (+) strand; PAM type: YTN; PAM sequence: CTG
ttaaaactgatacataaatt

SEQ ID NO: 96785 - DNA, 20 bp, Artificial Sequence
  Description of Artificial Sequence: Synthetic oligonucleotide
  Target: SCN9A; (+) strand; PAM type: YTN; PAM sequence: TTA
aaactgatacataaattcag

SEQ ID NO: 96786 - DNA, 20 bp, Artificial Sequence
  Description of Artificial Sequence: Synthetic oligonucleotide
  Target: SCN9A; (+) strand; PAM type: YTN; PAM sequence: CTG
atacataaattcagtaaagt

SEQ ID NO: 96787 - DNA, 20 bp, Artificial Sequence
  Description of Artificial Sequence: Synthetic oligonucleotide
  Target: SCN9A; (+) strand; PAM type: YTN; PAM sequence: TTC
agtaaagttgcagtttgcaa

SEQ ID NO: 96788 - DNA, 20 bp, Artificial Sequence
  Description of Artificial Sequence: Synthetic oligonucleotide
  Target: SCN9A; (+) strand; PAM type: YTN; PAM sequence: TTG
cagtttgcaaaatcaacata

SEQ ID NO: 96789 - DNA, 20 bp, Artificial Sequence
  Description of Artificial Sequence: Synthetic oligonucleotide
  Target: SCN9A; (+) strand; PAM type: YTN; PAM sequence: TTT
gcaaaatcaacatagaaaaa

SEQ ID NO: 96790 - DNA, 20 bp, Artificial Sequence
  Description of Artificial Sequence: Synthetic oligonucleotide
  Target: SCN9A; (+) strand; PAM type: YTN; PAM sequence: TTG
caaaatcaacatagaaaaat

SEQ ID NO: 96791 - DNA, 20 bp, Artificial Sequence
  Description of Artificial Sequence: Synthetic oligonucleotide
  Target: SCN9A; (+) strand; PAM type: YTN; PAM sequence: TTT
ctatacattaacaatgaggt

SEQ ID NO: 96792 - DNA, 20 bp, Artificial Sequence
  Description of Artificial Sequence: Synthetic oligonucleotide
  Target: SCN9A; (+) strand; PAM type: YTN; PAM sequence: TTC
tatacattaacaatgaggta

SEQ ID NO: 96793 - DNA, 20 bp, Artificial Sequence
  Description of Artificial Sequence: Synthetic oligonucleotide
  Target: SCN9A; (+) strand; PAM type: YTN; PAM sequence: CTA
tacattaacaatgaggtatc

SEQ ID NO: 96794 - DNA, 20 bp, Artificial Sequence
  Description of Artificial Sequence: Synthetic oligonucleotide
  Target: SCN9A; (+) strand; PAM type: YTN; PAM sequence: TTA
acaatgaggtatccaacaaa

SEQ ID NO: 96795 - DNA, 20 bp, Artificial Sequence
  Description of Artificial Sequence: Synthetic oligonucleotide
  Target: SCN9A; (+) strand; PAM type: YTN; PAM sequence: TTA
agaaattaatcctatttaaa

SEQ ID NO: 96796 - DNA, 20 bp, Artificial Sequence
  Description of Artificial Sequence: Synthetic oligonucleotide
  Target: SCN9A; (+) strand; PAM type: YTN; PAM sequence: TTA
atcctatttaaaacagcatc

SEQ ID NO: 96797 - DNA, 20 bp, Artificial Sequence
  Description of Artificial Sequence: Synthetic oligonucleotide
  Target: SCN9A; (+) strand; PAM type: YTN; PAM sequence: CTA
tttaaaacagcatcaaaata

SEQ ID NO: 96798 - DNA, 20 bp, Artificial Sequence
  Description of Artificial Sequence: Synthetic oligonucleotide
  Target: SCN9A; (+) strand; PAM type: YTN; PAM sequence: TTT
aaaacagcatcaaaataaat

SEQ ID NO: 96799 - DNA, 20 bp, Artificial Sequence
  Description of Artificial Sequence: Synthetic oligonucleotide
  Target: SCN9A; (+) strand; PAM type: YTN; PAM sequence: TTA
aaacagcatcaaaataaata

SEQ ID NO: 96800 - DNA, 20 bp, Artificial Sequence
  Description of Artificial Sequence: Synthetic oligonucleotide
  Target: SCN9A; (+) strand; PAM type: YTN; PAM sequence: CTT
tgaagtaaatttaaccagga

SEQ ID NO: 96801 - DNA, 20 bp, Artificial Sequence
  Description of Artificial Sequence: Synthetic oligonucleotide
  Target: SCN9A; (+) strand; PAM type: YTN; PAM sequence: TTT
gaagtaaatttaaccaggaa

SEQ ID NO: 96802 - DNA, 20 bp, Artificial Sequence
  Description of Artificial Sequence: Synthetic oligonucleotide
  Target: SCN9A; (+) strand; PAM type: YTN; PAM sequence: TTG
aagtaaatttaaccaggaaa

SEQ ID NO: 96803 - DNA, 20 bp, Artificial Sequence
  Description of Artificial Sequence: Synthetic oligonucleotide
  Target: SCN9A; (+) strand; PAM type: YTN; PAM sequence: TTT
aaccaggaaagttgaagatc

SEQ ID NO: 96804 - DNA, 20 bp, Artificial Sequence
  Description of Artificial Sequence: Synthetic oligonucleotide
  Target: SCN9A; (+) strand; PAM type: YTN; PAM sequence: TTA
accaggaaagttgaagatct

SEQ ID NO: 96805 - DNA, 20 bp, Artificial Sequence
  Description of Artificial Sequence: Synthetic oligonucleotide
  Target: SCN9A; (+) strand; PAM type: YTN; PAM sequence: TTG
aagatctgtacactgaaaac

SEQ ID NO: 96806 - DNA, 20 bp, Artificial Sequence
  Description of Artificial Sequence: Synthetic oligonucleotide
  Target: SCN9A; (+) strand; PAM type: YTN; PAM sequence: CTG
tacactgaaaactataagtt

SEQ ID NO: 96807 - DNA, 20 bp, Artificial Sequence
  Description of Artificial Sequence: Synthetic oligonucleotide
  Target: SCN9A; (+) strand; PAM type: YTN; PAM sequence: CTG
aaaactataagttgatttaa

SEQ ID NO: 96808 - DNA, 20 bp, Artificial Sequence
  Description of Artificial Sequence: Synthetic oligonucleotide
  Target: SCN9A; (+) strand; PAM type: YTN; PAM sequence: CTA
taagttgatttaaaaaaact

SEQ ID NO: 96809 - DNA, 20 bp, Artificial Sequence
  Description of Artificial Sequence: Synthetic oligonucleotide
  Target: SCN9A; (+) strand; PAM type: YTN; PAM sequence: TTG
atttaaaaaaactgaggaag

SEQ ID NO: 96810 - DNA, 20 bp, Artificial Sequence
  Description of Artificial Sequence: Synthetic oligonucleotide
  Target: SCN9A; (+) strand; PAM type: YTN; PAM sequence: TTT
aaaaaaactgaggaagacac

SEQ ID NO: 96811 - DNA, 20 bp, Artificial Sequence
  Description of Artificial Sequence: Synthetic oligonucleotide
  Target: SCN9A; (+) strand; PAM type: YTN; PAM sequence: TTA
aaaaaactgaggaagacaca

SEQ ID NO: 96812 - DNA, 20 bp, Artificial Sequence
  Description of Artificial Sequence: Synthetic oligonucleotide
  Target: SCN9A; (+) strand; PAM type: YTN; PAM sequence: CTG
aggaagacacaaataaattg

SEQ ID NO: 96813 - DNA, 20 bp, Artificial Sequence
  Description of Artificial Sequence: Synthetic oligonucleotide
  Target: SCN9A; (+) strand; PAM type: YTN; PAM sequence: TTG
taatatatttcatgttcatg

SEQ ID NO: 96814 - DNA, 20 bp, Artificial Sequence
  Description of Artificial Sequence: Synthetic oligonucleotide
  Target: SCN9A; (+) strand; PAM type: YTN; PAM sequence: TTT
catgttcatgtgttggaaga

SEQ ID NO: 96815 - DNA, 20 bp, Artificial Sequence
  Description of Artificial Sequence: Synthetic oligonucleotide
  Target: SCN9A; (+) strand; PAM type: YTN; PAM sequence: TTC
atgttcatgtgttggaagaa

SEQ ID NO: 96816 - DNA, 20 bp, Artificial Sequence
  Description of Artificial Sequence: Synthetic oligonucleotide
  Target: SCN9A; (+) strand; PAM type: YTN; PAM sequence: TTC
atgtgttggaagaattaata

SEQ ID NO: 96817 - DNA, 20 bp, Artificial Sequence
  Description of Artificial Sequence: Synthetic oligonucleotide
  Target: SCN9A; (+) strand; PAM type: YTN; PAM sequence: TTG
gaagaattaatattgttaaa

SEQ ID NO: 96818 - DNA, 20 bp, Artificial Sequence
  Description of Artificial Sequence: Synthetic oligonucleotide
  Target: SCN9A; (+) strand; PAM type: YTN; PAM sequence: TTA
atattgttaaaatgtccata

SEQ ID NO: 96819 - DNA, 20 bp, Artificial Sequence
  Description of Artificial Sequence: Synthetic oligonucleotide
  Target: SCN9A; (+) strand; PAM type: YTN; PAM sequence: TTG
ttaaaatgtccatactaccc

SEQ ID NO: 96820 - DNA, 20 bp, Artificial Sequence
  Description of Artificial Sequence: Synthetic oligonucleotide
  Target: SCN9A; (+) strand; PAM type: YTN; PAM sequence: TTA
aaatgtccatactacccaaa

SEQ ID NO: 96821 - DNA, 20 bp, Artificial Sequence
  Description of Artificial Sequence: Synthetic oligonucleotide
  Target: SCN9A; (+) strand; PAM type: YTN; PAM sequence: CTA
cccaaaataatctacagatt

SEQ ID NO: 96822 - DNA, 20 bp, Artificial Sequence
  Description of Artificial Sequence: Synthetic oligonucleotide
  Target: SCN9A; (+) strand; PAM type: YTN; PAM sequence: CTA
cagattcaatgcaatcccta

SEQ ID NO: 96823 - DNA, 20 bp, Artificial Sequence
  Description of Artificial Sequence: Synthetic oligonucleotide
  Target: SCN9A; (+) strand; PAM type: YTN; PAM sequence: TTC
aatgcaatccctatcaaaat

SEQ ID NO: 96824 - DNA, 20 bp, Artificial Sequence
  Description of Artificial Sequence: Synthetic oligonucleotide
  Target: SCN9A; (+) strand; PAM type: YTN; PAM sequence: CTA
tcaaaattctaatgtcagtt

SEQ ID NO: 96825 - DNA, 20 bp, Artificial Sequence
  Description of Artificial Sequence: Synthetic oligonucleotide
  Target: SCN9A; (+) strand; PAM type: YTN; PAM sequence: TTC
taatgtcagttttcacagaa

SEQ ID NO: 96826 - DNA, 20 bp, Artificial Sequence
  Description of Artificial Sequence: Synthetic oligonucleotide
  Target: SCN9A; (+) strand; PAM type: YTN; PAM sequence: CTA
atgtcagttttcacagaaat

SEQ ID NO: 96827 - DNA, 20 bp, Artificial Sequence
  Description of Artificial Sequence: Synthetic oligonucleotide
  Target: SCN9A; (+) strand; PAM type: YTN; PAM sequence: TTT
tcacagaaatagtaaaaaat

SEQ ID NO: 96828 - DNA, 20 bp, Artificial Sequence
  Description of Artificial Sequence: Synthetic oligonucleotide
  Target: SCN9A; (+) strand; PAM type: YTN; PAM sequence: TTT
cacagaaatagtaaaaaatc

SEQ ID NO: 96829 - DNA, 20 bp, Artificial Sequence
  Description of Artificial Sequence: Synthetic oligonucleotide
  Target: SCN9A; (+) strand; PAM type: YTN; PAM sequence: TTC
acagaaatagtaaaaaatcc

SEQ ID NO: 96830 - DNA, 20 bp, Artificial Sequence
  Description of Artificial Sequence: Synthetic oligonucleotide
  Target: SCN9A; (+) strand; PAM type: YTN; PAM sequence: CTA
acatttgaataaaataaaaa

SEQ ID NO: 96831 - DNA, 20 bp, Artificial Sequence
  Description of Artificial Sequence: Synthetic oligonucleotide
  Target: SCN9A; (+) strand; PAM type: YTN; PAM sequence: TTT
gaataaaataaaaaagatgc

SEQ ID NO: 96832 - DNA, 20 bp, Artificial Sequence
  Description of Artificial Sequence: Synthetic oligonucleotide
  Target: SCN9A; (+) strand; PAM type: YTN; PAM sequence: TTG
aataaaataaaaaagatgct

SEQ ID NO: 96833 - DNA, 20 bp, Artificial Sequence
  Description of Artificial Sequence: Synthetic oligonucleotide
  Target: SCN9A; (+) strand; PAM type: YTN; PAM sequence: CTA
aatggccaaagcaatctgag

SEQ ID NO: 96834 - DNA, 20 bp, Artificial Sequence
  Description of Artificial Sequence: Synthetic oligonucleotide
  Target: SCN9A; (+) strand; PAM type: YTN; PAM sequence: CTG
agcaaaaagaacaaagctag

SEQ ID NO: 96835 - DNA, 20 bp, Artificial Sequence
  Description of Artificial Sequence: Synthetic oligonucleotide
  Target: SCN9A; (+) strand; PAM type: YTN; PAM sequence: CTA
gaggtgcaatactctgtcat

SEQ ID NO: 96836 - DNA, 20 bp, Artificial Sequence
  Description of Artificial Sequence: Synthetic oligonucleotide
  Target: SCN9A; (+) strand; PAM type: YTN; PAM sequence: CTC
tgtcatttcaaaatataaag

SEQ ID NO: 96837 - DNA, 20 bp, Artificial Sequence
  Description of Artificial Sequence: Synthetic oligonucleotide
  Target: SCN9A; (+) strand; PAM type: YTN; PAM sequence: CTG
tcatttcaaaatataaagct

SEQ ID NO: 96838 - DNA, 20 bp, Artificial Sequence
  Description of Artificial Sequence: Synthetic oligonucleotide
  Target: SCN9A; (+) strand; PAM type: YTN; PAM sequence: TTT
caaaatataaagctatgcta

SEQ ID NO: 96839 - DNA, 20 bp, Artificial Sequence
  Description of Artificial Sequence: Synthetic oligonucleotide
  Target: SCN9A; (+) strand; PAM type: YTN; PAM sequence: TTC
aaaatataaagctatgctat

SEQ ID NO: 96840 - DNA, 20 bp, Artificial Sequence
  Description of Artificial Sequence: Synthetic oligonucleotide
  Target: SCN9A; (+) strand; PAM type: YTN; PAM sequence: CTA
tgctattggcataaacacag

SEQ ID NO: 96841 - DNA, 20 bp, Artificial Sequence
  Description of Artificial Sequence: Synthetic oligonucleotide
  Target: SCN9A; (+) strand; PAM type: YTN; PAM sequence: CTA
ttggcataaacacagatata

SEQ ID NO: 96842 - DNA, 20 bp, Artificial Sequence
  Description of Artificial Sequence: Synthetic oligonucleotide
  Target: SCN9A; (+) strand; PAM type: YTN; PAM sequence: TTG
gcataaacacagatatattg

SEQ ID NO: 96843 - DNA, 20 bp, Artificial Sequence
  Description of Artificial Sequence: Synthetic oligonucleotide
  Target: SCN9A; (+) strand; PAM type: YTN; PAM sequence: TTG
gctaatggaaaaggataaaa

SEQ ID NO: 96844 - DNA, 20 bp, Artificial Sequence
  Description of Artificial Sequence: Synthetic oligonucleotide
  Target: SCN9A; (+) strand; PAM type: YTN; PAM sequence: CTA
atggaaaaggataaaaagcc

SEQ ID NO: 96845 - DNA, 20 bp, Artificial Sequence
  Description of Artificial Sequence: Synthetic oligonucleotide
  Target: SCN9A; (+) strand; PAM type: YTN; PAM sequence: TTA
tttatagtcaattgattttc

SEQ ID NO: 96846 - DNA, 20 bp, Artificial Sequence
  Description of Artificial Sequence: Synthetic oligonucleotide
  Target: SCN9A; (+) strand; PAM type: YTN; PAM sequence: TTT
atagtcaattgattttcagc

SEQ ID NO: 96847 - DNA, 20 bp, Artificial Sequence
  Description of Artificial Sequence: Synthetic oligonucleotide
  Target: SCN9A; (+) strand; PAM type: YTN; PAM sequence: TTA
tagtcaattgattttcagca

SEQ ID NO: 96848 - DNA, 20 bp, Artificial Sequence
  Description of Artificial Sequence: Synthetic oligonucleotide
  Target: SCN9A; (+) strand; PAM type: YTN; PAM sequence: TTG
attttcagcaaaggtgcaaa

SEQ ID NO: 96849 - DNA, 20 bp, Artificial Sequence
  Description of Artificial Sequence: Synthetic oligonucleotide
  Target: SCN9A; (+) strand; PAM type: YTN; PAM sequence: TTT
tcagcaaaggtgcaaagaat

SEQ ID NO: 96850 - DNA, 20 bp, Artificial Sequence
  Description of Artificial Sequence: Synthetic oligonucleotide
  Target: SCN9A; (+) strand; PAM type: YTN; PAM sequence: TTT
cagcaaaggtgcaaagaata

SEQ ID NO: 96851 - DNA, 20 bp, Artificial Sequence
  Description of Artificial Sequence: Synthetic oligonucleotide
  Target: SCN9A; (+) strand; PAM type: YTN; PAM sequence: TTC
agcaaaggtgcaaagaataa

SEQ ID NO: 96852 - DNA, 20 bp, Artificial Sequence
  Description of Artificial Sequence: Synthetic oligonucleotide
  Target: SCN9A; (+) strand; PAM type: YTN; PAM sequence: CTC
ttcaataaatggtgttggga

SEQ ID NO: 96853 - DNA, 20 bp, Artificial Sequence
  Description of Artificial Sequence: Synthetic oligonucleotide
  Target: SCN9A; (+) strand; PAM type: YTN; PAM sequence: CTT
caataaatggtgttgggaaa

SEQ ID NO: 96854 - DNA, 20 bp, Artificial Sequence
  Description of Artificial Sequence: Synthetic oligonucleotide
  Target: SCN9A; (+) strand; PAM type: YTN; PAM sequence: TTC
aataaatggtgttgggaaaa

SEQ ID NO: 96855 - DNA, 20 bp, Artificial Sequence
  Description of Artificial Sequence: Synthetic oligonucleotide
  Target: SCN9A; (+) strand; PAM type: YTN; PAM sequence: TTG
ggaaaactgaatattcctta

SEQ ID NO: 96856 - DNA, 20 bp, Artificial Sequence
  Description of Artificial Sequence: Synthetic oligonucleotide
  Target: SCN9A; (+) strand; PAM type: YTN; PAM sequence: CTG
aatattccttatgcaaaaga

SEQ ID NO: 96857 - DNA, 20 bp, Artificial Sequence
  Description of Artificial Sequence: Synthetic oligonucleotide
  Target: SCN9A; (+) strand; PAM type: YTN; PAM sequence: TTC
cttatgcaaaagaatgaaat

SEQ ID NO: 96858 - DNA, 20 bp, Artificial Sequence
  Description of Artificial Sequence: Synthetic oligonucleotide
  Target: SCN9A; (+) strand; PAM type: YTN; PAM sequence: CTT
atgcaaaagaatgaaattgg

SEQ ID NO: 96859 - DNA, 20 bp, Artificial Sequence
  Description of Artificial Sequence: Synthetic oligonucleotide
  Target: SCN9A; (+) strand; PAM type: YTN; PAM sequence: TTA
tgcaaaagaatgaaattggg

SEQ ID NO: 96860 - DNA, 20 bp, Artificial Sequence
  Description of Artificial Sequence: Synthetic oligonucleotide
  Target: SCN9A; (+) strand; PAM type: YTN; PAM sequence: TTG
ggccctttctcataccatat

SEQ ID NO: 96861 - DNA, 20 bp, Artificial Sequence
  Description of Artificial Sequence: Synthetic oligonucleotide
  Target: SCN9A; (+) strand; PAM type: YTN; PAM sequence: CTT
tctcataccatatgtttata

SEQ ID NO: 96862 - DNA, 20 bp, Artificial Sequence
  Description of Artificial Sequence: Synthetic oligonucleotide
  Target: SCN9A; (+) strand; PAM type: YTN; PAM sequence: TTT
ctcataccatatgtttataa

SEQ ID NO: 96863 - DNA, 20 bp, Artificial Sequence
  Description of Artificial Sequence: Synthetic oligonucleotide
  Target: SCN9A; (+) strand; PAM type: YTN; PAM sequence: TTC
tcataccatatgtttataaa

SEQ ID NO: 96864 - DNA, 20 bp, Artificial Sequence
  Description of Artificial Sequence: Synthetic oligonucleotide
  Target: SCN9A; (+) strand; PAM type: YTN; PAM sequence: CTC
ataccatatgtttataaaac

SEQ ID NO: 96865 - DNA, 20 bp, Artificial Sequence
  Description of Artificial Sequence: Synthetic oligonucleotide
  Target: SCN9A; (+) strand; PAM type: YTN; PAM sequence: TTT
ataaaaccaaacaagtaaaa

SEQ ID NO: 96866 - DNA, 20 bp, Artificial Sequence
  Description of Artificial Sequence: Synthetic oligonucleotide
  Target: SCN9A; (+) strand; PAM type: YTN; PAM sequence: TTA
taaaaccaaacaagtaaaag

SEQ ID NO: 96867 - DNA, 20 bp, Artificial Sequence
  Description of Artificial Sequence: Synthetic oligonucleotide
  Target: SCN9A; (+) strand; PAM type: YTN; PAM sequence: CTT
aaatataagaaatgaaacta

SEQ ID NO: 96868 - DNA, 20 bp, Artificial Sequence
  Description of Artificial Sequence: Synthetic oligonucleotide
  Target: SCN9A; (+) strand; PAM type: YTN; PAM sequence: TTA
aatataagaaatgaaactat

SEQ ID NO: 96869 - DNA, 20 bp, Artificial Sequence
  Description of Artificial Sequence: Synthetic oligonucleotide
  Target: SCN9A; (+) strand; PAM type: YTN; PAM sequence: CTA
taaagctactagaagaaaac

SEQ ID NO: 96870 - DNA, 20 bp, Artificial Sequence
  Description of Artificial Sequence: Synthetic oligonucleotide
  Target: SCN9A; (+) strand; PAM type: YTN; PAM sequence: CTA
ctagaagaaaacataaaaga

SEQ ID NO: 96871 - DNA, 20 bp, Artificial Sequence
  Description of Artificial Sequence: Synthetic oligonucleotide
  Target: SCN9A; (+) strand; PAM type: YTN; PAM sequence: CTA
gaagaaaacataaaagaaaa

SEQ ID NO: 96872 - DNA, 20 bp, Artificial Sequence
  Description of Artificial Sequence: Synthetic oligonucleotide
  Target: SCN9A; (+) strand; PAM type: YTN; PAM sequence: CTG
tatgacatttatctgggcaa

SEQ ID NO: 96873 - DNA, 20 bp, Artificial Sequence
  Description of Artificial Sequence: Synthetic oligonucleotide
  Target: SCN9A; (+) strand; PAM type: YTN; PAM sequence: TTT
atctgggcaaggatttcttg

SEQ ID NO: 96874 - DNA, 20 bp, Artificial Sequence
  Description of Artificial Sequence: Synthetic oligonucleotide
  Target: SCN9A; (+) strand; PAM type: YTN; PAM sequence: TTA
tctgggcaaggatttcttgg

SEQ ID NO: 96875 - DNA, 20 bp, Artificial Sequence
  Description of Artificial Sequence: Synthetic oligonucleotide
  Target: SCN9A; (+) strand; PAM type: YTN; PAM sequence: CTG
ggcaaggatttcttggctag

SEQ ID NO: 96876 - DNA, 20 bp, Artificial Sequence
  Description of Artificial Sequence: Synthetic oligonucleotide
  Target: SCN9A; (+) strand; PAM type: YTN; PAM sequence: TTT
cttggctaggactctaaaag

SEQ ID NO: 96877 - DNA, 20 bp, Artificial Sequence
  Description of Artificial Sequence: Synthetic oligonucleotide
  Target: SCN9A; (+) strand; PAM type: YTN; PAM sequence: TTC
ttggctaggactctaaaagc

SEQ ID NO: 96878 - DNA, 20 bp, Artificial Sequence
  Description of Artificial Sequence: Synthetic oligonucleotide
  Target: SCN9A; (+) strand; PAM type: YTN; PAM sequence: CTT
ggctaggactctaaaagcac

SEQ ID NO: 96879 - DNA, 20 bp, Artificial Sequence
  Description of Artificial Sequence: Synthetic oligonucleotide
  Target: SCN9A; (+) strand; PAM type: YTN; PAM sequence: TTG
gctaggactctaaaagcaca

SEQ ID NO: 96880 - DNA, 20 bp, Artificial Sequence
  Description of Artificial Sequence: Synthetic oligonucleotide
  Target: SCN9A; (+) strand; PAM type: YTN; PAM sequence: CTA
ggactctaaaagcacaggta

SEQ ID NO: 96881 - DNA, 20 bp, Artificial Sequence
  Description of Artificial Sequence: Synthetic oligonucleotide
  Target: SCN9A; (+) strand; PAM type: YTN; PAM sequence: CTC
taaaagcacaggtaacaaaa

SEQ ID NO: 96882 - DNA, 20 bp, Artificial Sequence
  Description of Artificial Sequence: Synthetic oligonucleotide
  Target: SCN9A; (+) strand; PAM type: YTN; PAM sequence: CTA
aaagcacaggtaacaaaaga

SEQ ID NO: 96883 - DNA, 20 bp, Artificial Sequence
  Description of Artificial Sequence: Synthetic oligonucleotide
  Target: SCN9A; (+) strand; PAM type: YTN; PAM sequence: TTG
gattagatcaaactaaaaat

SEQ ID NO: 96884 - DNA, 20 bp, Artificial Sequence
  Description of Artificial Sequence: Synthetic oligonucleotide
  Target: SCN9A; (+) strand; PAM type: YTN; PAM sequence: TTA
gatcaaactaaaaatgttct

SEQ ID NO: 96885 - DNA, 20 bp, Artificial Sequence
  Description of Artificial Sequence: Synthetic oligonucleotide
  Target: SCN9A; (+) strand; PAM type: YTN; PAM sequence: CTA
aaaatgttctttacagcaaa

SEQ ID NO: 96886 - DNA, 20 bp, Artificial Sequence
  Description of Artificial Sequence: Synthetic oligonucleotide
  Target: SCN9A; (+) strand; PAM type: YTN; PAM sequence: TTC
tttacagcaaacgaagcaat

SEQ ID NO: 96887 - DNA, 20 bp, Artificial Sequence
  Description of Artificial Sequence: Synthetic oligonucleotide
  Target: SCN9A; (+) strand; PAM type: YTN; PAM sequence: CTT
tacagcaaacgaagcaataa

SEQ ID NO: 96888 - DNA, 20 bp, Artificial Sequence
  Description of Artificial Sequence: Synthetic oligonucleotide
  Target: SCN9A; (+) strand; PAM type: YTN; PAM sequence: TTT
acagcaaacgaagcaataac

SEQ ID NO: 96889 - DNA, 20 bp, Artificial Sequence
  Description of Artificial Sequence: Synthetic oligonucleotide
  Target: SCN9A; (+) strand; PAM type: YTN; PAM sequence: TTA
cagcaaacgaagcaataaca

SEQ ID NO: 96890 - DNA, 20 bp, Artificial Sequence
  Description of Artificial Sequence: Synthetic oligonucleotide
  Target: SCN9A; (+) strand; PAM type: YTN; PAM sequence: TTG
aaataaaatatctgcaaacc

SEQ ID NO: 96891 - DNA, 20 bp, Artificial Sequence
  Description of Artificial Sequence: Synthetic oligonucleotide
  Target: SCN9A; (+) strand; PAM type: YTN; PAM sequence: CTG
caaaccatacatctgataaa

SEQ ID NO: 96892 - DNA, 20 bp, Artificial Sequence
  Description of Artificial Sequence: Synthetic oligonucleotide
  Target: SCN9A; (+) strand; PAM type: YTN; PAM sequence: CTG
ataaagggctaatatccaac

SEQ ID NO: 96893 - DNA, 20 bp, Artificial Sequence
  Description of Artificial Sequence: Synthetic oligonucleotide
  Target: SCN9A; (+) strand; PAM type: YTN; PAM sequence: CTA
atatccaacattatacataa

SEQ ID NO: 96894 - DNA, 20 bp, Artificial Sequence
  Description of Artificial Sequence: Synthetic oligonucleotide
  Target: SCN9A; (+) strand; PAM type: YTN; PAM sequence: TTA
tacataaaaagctcaagcaa

SEQ ID NO: 96895 - DNA, 20 bp, Artificial Sequence
  Description of Artificial Sequence: Synthetic oligonucleotide
  Target: SCN9A; (+) strand; PAM type: YTN; PAM sequence: CTC
aagcaactcaacacctagaa

SEQ ID NO: 96896 - DNA, 20 bp, Artificial Sequence
  Description of Artificial Sequence: Synthetic oligonucleotide
  Target: SCN9A; (+) strand; PAM type: YTN; PAM sequence: CTC
aacacctagaaaatcaataa

SEQ ID NO: 96897 - DNA, 20 bp, Artificial Sequence
  Description of Artificial Sequence: Synthetic oligonucleotide
  Target: SCN9A; (+) strand; PAM type: YTN; PAM sequence: CTA
gaaaatcaataaaccaattg

SEQ ID NO: 96898 - DNA, 20 bp, Artificial Sequence
  Description of Artificial Sequence: Synthetic oligonucleotide
  Target: SCN9A; (+) strand; PAM type: YTN; PAM sequence: TTG
tagaatgggcaaataatctg

SEQ ID NO: 96899 - DNA, 20 bp, Artificial Sequence
  Description of Artificial Sequence: Synthetic oligonucleotide
  Target: SCN9A; (+) strand; PAM type: YTN; PAM sequence: CTG
aacagacatttctcaaaaga

SEQ ID NO: 96900 - DNA, 20 bp, Artificial Sequence
  Description of Artificial Sequence: Synthetic oligonucleotide
  Target: SCN9A; (+) strand; PAM type: YTN; PAM sequence: TTT
ctcaaaagaagagatatgaa

SEQ ID NO: 96901 - DNA, 20 bp, Artificial Sequence
  Description of Artificial Sequence: Synthetic oligonucleotide
  Target: SCN9A; (+) strand; PAM type: YTN; PAM sequence: TTC
tcaaaagaagagatatgaat

SEQ ID NO: 96902 - DNA, 20 bp, Artificial Sequence
  Description of Artificial Sequence: Synthetic oligonucleotide
  Target: SCN9A; (+) strand; PAM type: YTN; PAM sequence: CTC
aaaagaagagatatgaatgg

SEQ ID NO: 96903 - DNA, 20 bp, Artificial Sequence
  Description of Artificial Sequence: Synthetic oligonucleotide
  Target: SCN9A; (+) strand; PAM type: YTN; PAM sequence: TTA
aaaaatgctcaacatctcta

SEQ ID NO: 96904 - DNA, 20 bp, Artificial Sequence
  Description of Artificial Sequence: Synthetic oligonucleotide
  Target: SCN9A; (+) strand; PAM type: YTN; PAM sequence: CTC
aacatctctaatcatcagaa

SEQ ID NO: 96905 - DNA, 20 bp, Artificial Sequence
  Description of Artificial Sequence: Synthetic oligonucleotide
  Target: SCN9A; (+) strand; PAM type: YTN; PAM sequence: CTC
taatcatcagaaaaatgcaa

SEQ ID NO: 96906 - DNA, 20 bp, Artificial Sequence
  Description of Artificial Sequence: Synthetic oligonucleotide
  Target: SCN9A; (+) strand; PAM type: YTN; PAM sequence: CTA
atcatcagaaaaatgcaaat

SEQ ID NO: 96907 - DNA, 20 bp, Artificial Sequence
  Description of Artificial Sequence: Synthetic oligonucleotide
  Target: SCN9A; (+) strand; PAM type: YTN; PAM sequence: TTA
aaatcccaatgaaatattac

SEQ ID NO: 96908 - DNA, 20 bp, Artificial Sequence
  Description of Artificial Sequence: Synthetic oligonucleotide
  Target: SCN9A; (+) strand; PAM type: YTN; PAM sequence: TTA
cctcacacctcctagaatgg

SEQ ID NO: 96909 - DNA, 20 bp, Artificial Sequence
  Description of Artificial Sequence: Synthetic oligonucleotide
  Target: SCN9A; (+) strand; PAM type: YTN; PAM sequence: CTC
acacctcctagaatggctgt

SEQ ID NO: 96910 - DNA, 20 bp, Artificial Sequence
  Description of Artificial Sequence: Synthetic oligonucleotide
  Target: SCN9A; (+) strand; PAM type: YTN; PAM sequence: CTC
ctagaatggctgttatcaaa

SEQ ID NO: 96911 - DNA, 20 bp, Artificial Sequence
  Description of Artificial Sequence: Synthetic oligonucleotide
  Target: SCN9A; (+) strand; PAM type: YTN; PAM sequence: CTA
gaatggctgttatcaaaaag

SEQ ID NO: 96912 - DNA, 20 bp, Artificial Sequence
  Description of Artificial Sequence: Synthetic oligonucleotide
  Target: SCN9A; (+) strand; PAM type: YTN; PAM sequence: CTG
ttatcaaaaagatgaatgat

SEQ ID NO: 96913 - DNA, 20 bp, Artificial Sequence
  Description of Artificial Sequence: Synthetic oligonucleotide
  Target: SCN9A; (+) strand; PAM type: YTN; PAM sequence: TTA
tcaaaaagatgaatgataac

SEQ ID NO: 96914 - DNA, 20 bp, Artificial Sequence
  Description of Artificial Sequence: Synthetic oligonucleotide
  Target: SCN9A; (+) strand; PAM type: YTN; PAM sequence: TTG
atgaggatgtggagaaatag

SEQ ID NO: 96915 - DNA, 20 bp, Artificial Sequence
  Description of Artificial Sequence: Synthetic oligonucleotide
  Target: SCN9A; (+) strand; PAM type: YTN; PAM sequence: CTT
atacattgttagtgaaaatg

SEQ ID NO: 96916 - DNA, 20 bp, Artificial Sequence
  Description of Artificial Sequence: Synthetic oligonucleotide
  Target: SCN9A; (+) strand; PAM type: YTN; PAM sequence: TTA
tacattgttagtgaaaatgt

SEQ ID NO: 96917 - DNA, 20 bp, Artificial Sequence
  Description of Artificial Sequence: Synthetic oligonucleotide
  Target: SCN9A; (+) strand; PAM type: YTN; PAM sequence: TTG
ttagtgaaaatgtaaattag

SEQ ID NO: 96918 - DNA, 20 bp, Artificial Sequence
  Description of Artificial Sequence: Synthetic oligonucleotide
  Target: SCN9A; (+) strand; PAM type: YTN; PAM sequence: TTA
gtgaaaatgtaaattagtac

SEQ ID NO: 96919 - DNA, 20 bp, Artificial Sequence
  Description of Artificial Sequence: Synthetic oligonucleotide
  Target: SCN9A; (+) strand; PAM type: YTN; PAM sequence: TTA
gtacagctgtttgagaaaaa

SEQ ID NO: 96920 - DNA, 20 bp, Artificial Sequence
  Description of Artificial Sequence: Synthetic oligonucleotide
  Target: SCN9A; (+) strand; PAM type: YTN; PAM sequence: CTG
tttgagaaaaatagcatgga

SEQ ID NO: 96921 - DNA, 20 bp, Artificial Sequence
  Description of Artificial Sequence: Synthetic oligonucleotide
  Target: SCN9A; (+) strand; PAM type: YTN; PAM sequence: TTT
gagaaaaatagcatggaagt

SEQ ID NO: 96922 - DNA, 20 bp, Artificial Sequence
  Description of Artificial Sequence: Synthetic oligonucleotide
  Target: SCN9A; (+) strand; PAM type: YTN; PAM sequence: TTG
agaaaaatagcatggaagtt

SEQ ID NO: 96923 - DNA, 20 bp, Artificial Sequence
  Description of Artificial Sequence: Synthetic oligonucleotide
  Target: SCN9A; (+) strand; PAM type: YTN; PAM sequence: TTC
ccaaaacaaatacaattacc

SEQ ID NO: 96924 - DNA, 20 bp, Artificial Sequence
  Description of Artificial Sequence: Synthetic oligonucleotide
  Target: SCN9A; (+) strand; PAM type: YTN; PAM sequence: TTA
ccatataattcagcaattcc

SEQ ID NO: 96925 - DNA, 20 bp, Artificial Sequence
  Description of Artificial Sequence: Synthetic oligonucleotide
  Target: SCN9A; (+) strand; PAM type: YTN; PAM sequence: TTC
agcaattccacttctaggta

SEQ ID NO: 96926 - DNA, 20 bp, Artificial Sequence
  Description of Artificial Sequence: Synthetic oligonucleotide
  Target: SCN9A; (+) strand; PAM type: YTN; PAM sequence: TTC
cacttctaggtatatagtgg

SEQ ID NO: 96927 - DNA, 20 bp, Artificial Sequence
  Description of Artificial Sequence: Synthetic oligonucleotide
  Target: SCN9A; (+) strand; PAM type: YTN; PAM sequence: CTT
ctaggtatatagtggtatat

SEQ ID NO: 96928 - DNA, 20 bp, Artificial Sequence
  Description of Artificial Sequence: Synthetic oligonucleotide
  Target: SCN9A; (+) strand; PAM type: YTN; PAM sequence: TTC
taggtatatagtggtatata

SEQ ID NO: 96929 - DNA, 20 bp, Artificial Sequence
  Description of Artificial Sequence: Synthetic oligonucleotide
  Target: SCN9A; (+) strand; PAM type: YTN; PAM sequence: CTA
ggtatatagtggtatatatt

SEQ ID NO: 96930 - DNA, 20 bp, Artificial Sequence
  Description of Artificial Sequence: Synthetic oligonucleotide
  Target: SCN9A; (+) strand; PAM type: YTN; PAM sequence: TTT
aattcctttagaggaattaa

SEQ ID NO: 96931 - DNA, 20 bp, Artificial Sequence
  Description of Artificial Sequence: Synthetic oligonucleotide
  Target: SCN9A; (+) strand; PAM type: YTN; PAM sequence: TTA
attcctttagaggaattaaa

SEQ ID NO: 96932 - DNA, 20 bp, Artificial Sequence
  Description of Artificial Sequence: Synthetic oligonucleotide
  Target: SCN9A; (+) strand; PAM type: YTN; PAM sequence: TTC
ctttagaggaattaaaatcg

SEQ ID NO: 96933 - DNA, 20 bp, Artificial Sequence
  Description of Artificial Sequence: Synthetic oligonucleotide
  Target: SCN9A; (+) strand; PAM type: YTN; PAM sequence: CTT
tagaggaattaaaatcgttc

SEQ ID NO: 96934 - DNA, 20 bp, Artificial Sequence
  Description of Artificial Sequence: Synthetic oligonucleotide
  Target: SCN9A; (+) strand; PAM type: YTN; PAM sequence: TTT
agaggaattaaaatcgttct

SEQ ID NO: 96935 - DNA, 20 bp, Artificial Sequence
  Description of Artificial Sequence: Synthetic oligonucleotide
  Target: SCN9A; (+) strand; PAM type: YTN; PAM sequence: TTA
gaggaattaaaatcgttctg

SEQ ID NO: 96936 - DNA, 20 bp, Artificial Sequence
  Description of Artificial Sequence: Synthetic oligonucleotide
  Target: SCN9A; (+) strand; PAM type: YTN; PAM sequence: TTA
aaatcgttctgtcaaaggta

SEQ ID NO: 96937 - DNA, 20 bp, Artificial Sequence
  Description of Artificial Sequence: Synthetic oligonucleotide
  Target: SCN9A; (+) strand; PAM type: YTN; PAM sequence: TTC
tgtcaaaggtatacctgcac

SEQ ID NO: 96938 - DNA, 20 bp, Artificial Sequence
  Description of Artificial Sequence: Synthetic oligonucleotide
  Target: SCN9A; (+) strand; PAM type: YTN; PAM sequence: CTG
tcaaaggtatacctgcactc

SEQ ID NO: 96939 - DNA, 20 bp, Artificial Sequence
  Description of Artificial Sequence: Synthetic oligonucleotide
  Target: SCN9A; (+) strand; PAM type: YTN; PAM sequence: CTG
cactcccatgttcatttcag

SEQ ID NO: 96940 - DNA, 20 bp, Artificial Sequence
  Description of Artificial Sequence: Synthetic oligonucleotide
  Target: SCN9A; (+) strand; PAM type: YTN; PAM sequence: CTC
ccatgttcatttcagcatta

SEQ ID NO: 96941 - DNA, 20 bp, Artificial Sequence
  Description of Artificial Sequence: Synthetic oligonucleotide
  Target: SCN9A; (+) strand; PAM type: YTN; PAM sequence: TTC
atttcagcattatttacaag

SEQ ID NO: 96942 - DNA, 20 bp, Artificial Sequence
  Description of Artificial Sequence: Synthetic oligonucleotide
  Target: SCN9A; (+) strand; PAM type: YTN; PAM sequence: TTT
cagcattatttacaagaacc

SEQ ID NO: 96943 - DNA, 20 bp, Artificial Sequence
  Description of Artificial Sequence: Synthetic oligonucleotide
  Target: SCN9A; (+) strand; PAM type: YTN; PAM sequence: TTC
agcattatttacaagaacca

SEQ ID NO: 96944 - DNA, 20 bp, Artificial Sequence
  Description of Artificial Sequence: Synthetic oligonucleotide
  Target: SCN9A; (+) strand; PAM type: YTN; PAM sequence: TTA
tttacaagaaccaagacata

SEQ ID NO: 96945 - DNA, 20 bp, Artificial Sequence
  Description of Artificial Sequence: Synthetic oligonucleotide
  Target: SCN9A; (+) strand; PAM type: YTN; PAM sequence: TTT
acaagaaccaagacatatta

SEQ ID NO: 96946 - DNA, 20 bp, Artificial Sequence
  Description of Artificial Sequence: Synthetic oligonucleotide
  Target: SCN9A; (+) strand; PAM type: YTN; PAM sequence: TTA
caagaaccaagacatattag

SEQ ID NO: 96947 - DNA, 20 bp, Artificial Sequence
  Description of Artificial Sequence: Synthetic oligonucleotide
  Target: SCN9A; (+) strand; PAM type: YTN; PAM sequence: TTA
ggttggtgcaaatgtaattg

SEQ ID NO: 96948 - DNA, 20 bp, Artificial Sequence
  Description of Artificial Sequence: Synthetic oligonucleotide
  Target: SCN9A; (+) strand; PAM type: YTN; PAM sequence: TTG
gtgcaaatgtaattgcagtt

SEQ ID NO: 96949 - DNA, 20 bp, Artificial Sequence
  Description of Artificial Sequence: Synthetic oligonucleotide
  Target: SCN9A; (+) strand; PAM type: YTN; PAM sequence: TTG
cagtttttaccattactttt

SEQ ID NO: 96950 - DNA, 20 bp, Artificial Sequence
  Description of Artificial Sequence: Synthetic oligonucleotide
  Target: SCN9A; (+) strand; PAM type: YTN; PAM sequence: TTT
ttaccattacttttgctgca

SEQ ID NO: 96951 - DNA, 20 bp, Artificial Sequence
  Description of Artificial Sequence: Synthetic oligonucleotide
  Target: SCN9A; (+) strand; PAM type: YTN; PAM sequence: TTT
taccattacttttgctgcaa

SEQ ID NO: 96952 - DNA, 20 bp, Artificial Sequence
  Description of Artificial Sequence: Synthetic oligonucleotide
  Target: SCN9A; (+) strand; PAM type: YTN; PAM sequence: TTT
accattacttttgctgcaat

SEQ ID NO: 96953 - DNA, 20 bp, Artificial Sequence
  Description of Artificial Sequence: Synthetic oligonucleotide
  Target: SCN9A; (+) strand; PAM type: YTN; PAM sequence: TTA
ccattacttttgctgcaatt

SEQ ID NO: 96954 - DNA, 20 bp, Artificial Sequence
  Description of Artificial Sequence: Synthetic oligonucleotide
  Target: SCN9A; (+) strand; PAM type: YTN; PAM sequence: TTA
cttttgctgcaattaaaagt

SEQ ID NO: 96955 - DNA, 20 bp, Artificial Sequence
  Description of Artificial Sequence: Synthetic oligonucleotide
  Target: SCN9A; (+) strand; PAM type: YTN; PAM sequence: CTT
ttgctgcaattaaaagtaat

SEQ ID NO: 96956 - DNA, 20 bp, Artificial Sequence
  Description of Artificial Sequence: Synthetic oligonucleotide
  Target: SCN9A; (+) strand; PAM type: YTN; PAM sequence: TTT
tgctgcaattaaaagtaatg

SEQ ID NO: 96957 - DNA, 20 bp, Artificial Sequence
  Description of Artificial Sequence: Synthetic oligonucleotide
  Target: SCN9A; (+) strand; PAM type: YTN; PAM sequence: TTT
gctgcaattaaaagtaatgg

SEQ ID NO: 96958 - DNA, 20 bp, Artificial Sequence
  Description of Artificial Sequence: Synthetic oligonucleotide
  Target: SCN9A; (+) strand; PAM type: YTN; PAM sequence: TTG
ctgcaattaaaagtaatggc

SEQ ID NO: 96959 - DNA, 20 bp, Artificial Sequence
  Description of Artificial Sequence: Synthetic oligonucleotide
  Target: SCN9A; (+) strand; PAM type: YTN; PAM sequence: CTG
caattaaaagtaatggccaa

SEQ ID NO: 96960 - DNA, 20 bp, Artificial Sequence
  Description of Artificial Sequence: Synthetic oligonucleotide
  Target: SCN9A; (+) strand; PAM type: YTN; PAM sequence: TTA
aaagtaatggccaaaaccgc

SEQ ID NO: 96961 - DNA, 20 bp, Artificial Sequence
  Description of Artificial Sequence: Synthetic oligonucleotide
  Target: SCN9A; (+) strand; PAM type: YTN; PAM sequence: TTA
cttttgcactaacccataca

SEQ ID NO: 96962 - DNA, 20 bp, Artificial Sequence
  Description of Artificial Sequence: Synthetic oligonucleotide
  Target: SCN9A; (+) strand; PAM type: YTN; PAM sequence: CTT
ttgcactaacccatacatgc

SEQ ID NO: 96963 - DNA, 20 bp, Artificial Sequence
  Description of Artificial Sequence: Synthetic oligonucleotide
  Target: SCN9A; (+) strand; PAM type: YTN; PAM sequence: TTT
tgcactaacccatacatgca

SEQ ID NO: 96964 - DNA, 20 bp, Artificial Sequence
  Description of Artificial Sequence: Synthetic oligonucleotide
  Target: SCN9A; (+) strand; PAM type: YTN; PAM sequence: TTT
gcactaacccatacatgcaa

SEQ ID NO: 96965 - DNA, 20 bp, Artificial Sequence
  Description of Artificial Sequence: Synthetic oligonucleotide
  Target: SCN9A; (+) strand; PAM type: YTN; PAM sequence: TTG
cactaacccatacatgcaac

SEQ ID NO: 96966 - DNA, 20 bp, Artificial Sequence
  Description of Artificial Sequence: Synthetic oligonucleotide
  Target: SCN9A; (+) strand; PAM type: YTN; PAM sequence: CTA
acccatacatgcaacctgta

SEQ ID NO: 96967 - DNA, 20 bp, Artificial Sequence
  Description of Artificial Sequence: Synthetic oligonucleotide
  Target: SCN9A; (+) strand; PAM type: YTN; PAM sequence: CTG
tacccatcaacaggtgaatg

SEQ ID NO: 96968 - DNA, 20 bp, Artificial Sequence
  Description of Artificial Sequence: Synthetic oligonucleotide
  Target: SCN9A; (+) strand; PAM type: YTN; PAM sequence: CTA
ctatacaaaactttaaaaga

SEQ ID NO: 96969 - DNA, 20 bp, Artificial Sequence
  Description of Artificial Sequence: Synthetic oligonucleotide
  Target: SCN9A; (+) strand; PAM type: YTN; PAM sequence: CTA
tacaaaactttaaaagaaca

SEQ ID NO: 96970 - DNA, 20 bp, Artificial Sequence
  Description of Artificial Sequence: Synthetic oligonucleotide
  Target: SCN9A; (+) strand; PAM type: YTN; PAM sequence: CTT
taaaagaacaaattttgtca

SEQ ID NO: 96971 - DNA, 20 bp, Artificial Sequence
  Description of Artificial Sequence: Synthetic oligonucleotide
  Target: SCN9A; (+) strand; PAM type: YTN; PAM sequence: TTT
aaaagaacaaattttgtcat

SEQ ID NO: 96972 - DNA, 20 bp, Artificial Sequence
  Description of Artificial Sequence: Synthetic oligonucleotide
  Target: SCN9A; (+) strand; PAM type: YTN; PAM sequence: TTA
aaagaacaaattttgtcatt

SEQ ID NO: 96973 - DNA, 20 bp, Artificial Sequence
  Description of Artificial Sequence: Synthetic oligonucleotide
  Target: SCN9A; (+) strand; PAM type: YTN; PAM sequence: TTT
tgtcattcatcccaacatga

SEQ ID NO: 96974 - DNA, 20 bp, Artificial Sequence
  Description of Artificial Sequence: Synthetic oligonucleotide
  Target: SCN9A; (+) strand; PAM type: YTN; PAM sequence: TTT
gtcattcatcccaacatgaa

SEQ ID NO: 96975 - DNA, 20 bp, Artificial Sequence
  Description of Artificial Sequence: Synthetic oligonucleotide
  Target: SCN9A; (+) strand; PAM type: YTN; PAM sequence: TTG
tcattcatcccaacatgaat

SEQ ID NO: 96976 - DNA, 20 bp, Artificial Sequence
  Description of Artificial Sequence: Synthetic oligonucleotide
  Target: SCN9A; (+) strand; PAM type: YTN; PAM sequence: TTC
atcccaacatgaatgaaact

SEQ ID NO: 96977 - DNA, 20 bp, Artificial Sequence
  Description of Artificial Sequence: Synthetic oligonucleotide
  Target: SCN9A; (+) strand; PAM type: YTN; PAM sequence: CTA
aaggacgttatgctaagcaa

SEQ ID NO: 96978 - DNA, 20 bp, Artificial Sequence
  Description of Artificial Sequence: Synthetic oligonucleotide
  Target: SCN9A; (+) strand; PAM type: YTN; PAM sequence: TTA
tgctaagcaaaattagccag

SEQ ID NO: 96979 - DNA, 20 bp, Artificial Sequence
  Description of Artificial Sequence: Synthetic oligonucleotide
  Target: SCN9A; (+) strand; PAM type: YTN; PAM sequence: CTA
agcaaaattagccaggtaca

SEQ ID NO: 96980 - DNA, 20 bp, Artificial Sequence
  Description of Artificial Sequence: Synthetic oligonucleotide
  Target: SCN9A; (+) strand; PAM type: YTN; PAM sequence: TTA
gccaggtacagaaagacaaa

SEQ ID NO: 96981 - DNA, 20 bp, Artificial Sequence
  Description of Artificial Sequence: Synthetic oligonucleotide
  Target: SCN9A; (+) strand; PAM type: YTN; PAM sequence: CTC
acttacatgtaaaatggggt

SEQ ID NO: 96982 - DNA, 20 bp, Artificial Sequence
  Description of Artificial Sequence: Synthetic oligonucleotide
  Target: SCN9A; (+) strand; PAM type: YTN; PAM sequence: CTT
acatgtaaaatggggtgggg

SEQ ID NO: 96983 - DNA, 20 bp, Artificial Sequence
  Description of Artificial Sequence: Synthetic oligonucleotide
  Target: SCN9A; (+) strand; PAM type: YTN; PAM sequence: TTA
catgtaaaatggggtggggg

SEQ ID NO: 96984 - DNA, 20 bp, Artificial Sequence
  Description of Artificial Sequence: Synthetic oligonucleotide
  Target: SCN9A; (+) strand; PAM type: YTN; PAM sequence: TTA
ggagatatacctaatgtaaa

SEQ ID NO: 96985 - DNA, 20 bp, Artificial Sequence
  Description of Artificial Sequence: Synthetic oligonucleotide
  Target: SCN9A; (+) strand; PAM type: YTN; PAM sequence: CTA
atgtaaatgacgagttaatg

SEQ ID NO: 96986 - DNA, 20 bp, Artificial Sequence
  Description of Artificial Sequence: Synthetic oligonucleotide
  Target: SCN9A; (+) strand; PAM type: YTN; PAM sequence: TTA
atgggtgccgcacaccaaca

SEQ ID NO: 96987 - DNA, 20 bp, Artificial Sequence
  Description of Artificial Sequence: Synthetic oligonucleotide
  Target: SCN9A; (+) strand; PAM type: YTN; PAM sequence: CTG
cacgttgtgcacatgtaccc

SEQ ID NO: 96988 - DNA, 20 bp, Artificial Sequence
  Description of Artificial Sequence: Synthetic oligonucleotide
  Target: SCN9A; (+) strand; PAM type: YTN; PAM sequence: TTG
tgcacatgtaccctagaact

SEQ ID NO: 96989 - DNA, 20 bp, Artificial Sequence
  Description of Artificial Sequence: Synthetic oligonucleotide
  Target: SCN9A; (+) strand; PAM type: YTN; PAM sequence: CTA
gaacttaaagtaaaataaaa

SEQ ID NO: 96990 - DNA, 20 bp, Artificial Sequence
  Description of Artificial Sequence: Synthetic oligonucleotide
  Target: SCN9A; (+) strand; PAM type: YTN; PAM sequence: CTT
aaagtaaaataaaaaaataa

SEQ ID NO: 96991 - DNA, 20 bp, Artificial Sequence
  Description of Artificial Sequence: Synthetic oligonucleotide
  Target: SCN9A; (+) strand; PAM type: YTN; PAM sequence: TTA
aagtaaaataaaaaaataaa

SEQ ID NO: 96992 - DNA, 20 bp, Artificial Sequence
  Description of Artificial Sequence: Synthetic oligonucleotide
  Target: SCN9A; (+) strand; PAM type: YTN; PAM sequence: TTA
cagaaacagcatataaaggt

SEQ ID NO: 96993 - DNA, 20 bp, Artificial Sequence
  Description of Artificial Sequence: Synthetic oligonucleotide
  Target: SCN9A; (+) strand; PAM type: YTN; PAM sequence: TTG
ccataggactgggggaagac

SEQ ID NO: 96994 - DNA, 20 bp, Artificial Sequence
  Description of Artificial Sequence: Synthetic oligonucleotide
  Target: SCN9A; (+) strand; PAM type: YTN; PAM sequence: CTG
ggggaagacgatgtggagaa

SEQ ID NO: 96995 - DNA, 20 bp, Artificial Sequence
  Description of Artificial Sequence: Synthetic oligonucleotide
  Target: SCN9A; (+) strand; PAM type: YTN; PAM sequence: CTT
gatcaaaggatgtacatttt

SEQ ID NO: 96996 - DNA, 20 bp, Artificial Sequence
  Description of Artificial Sequence: Synthetic oligonucleotide
  Target: SCN9A; (+) strand; PAM type: YTN; PAM sequence: TTG
atcaaaggatgtacattttt

SEQ ID NO: 96997 - DNA, 20 bp, Artificial Sequence
  Description of Artificial Sequence: Synthetic oligonucleotide
  Target: SCN9A; (+) strand; PAM type: YTN; PAM sequence: TTT
ttcatttagagtagaggaat

SEQ ID NO: 96998 - DNA, 20 bp, Artificial Sequence
  Description of Artificial Sequence: Synthetic oligonucleotide
  Target: SCN9A; (+) strand; PAM type: YTN; PAM sequence: TTT
tcatttagagtagaggaata

SEQ ID NO: 96999 - DNA, 20 bp, Artificial Sequence
  Description of Artificial Sequence: Synthetic oligonucleotide
  Target: SCN9A; (+) strand; PAM type: YTN; PAM sequence: TTT
catttagagtagaggaataa

SEQ ID NO: 97000 - DNA, 20 bp, Artificial Sequence
  Description of Artificial Sequence: Synthetic oligonucleotide
  Target: SCN9A; (+) strand; PAM type: YTN; PAM sequence: TTC
atttagagtagaggaataaa

SEQ ID NO: 97001 - DNA, 20 bp, Artificial Sequence
  Description of Artificial Sequence: Synthetic oligonucleotide
  Target: SCN9A; (+) strand; PAM type: YTN; PAM sequence: TTT
agagtagaggaataaatctt

SEQ ID NO: 97002 - DNA, 20 bp, Artificial Sequence
  Description of Artificial Sequence: Synthetic oligonucleotide
  Target: SCN9A; (+) strand; PAM type: YTN; PAM sequence: TTA
gagtagaggaataaatctta

SEQ ID NO: 97003 - DNA, 20 bp, Artificial Sequence
  Description of Artificial Sequence: Synthetic oligonucleotide
  Target: SCN9A; (+) strand; PAM type: YTN; PAM sequence: CTT
aagatggattaaagacttaa

SEQ ID NO: 97004 - DNA, 20 bp, Artificial Sequence
  Description of Artificial Sequence: Synthetic oligonucleotide
  Target: SCN9A; (+) strand; PAM type: YTN; PAM sequence: TTA
agatggattaaagacttaaa

SEQ ID NO: 97005 - DNA, 20 bp, Artificial Sequence
  Description of Artificial Sequence: Synthetic oligonucleotide
  Target: SCN9A; (+) strand; PAM type: YTN; PAM sequence: TTA
aagacttaaatgtaaaatct

SEQ ID NO: 97006 - DNA, 20 bp, Artificial Sequence
  Description of Artificial Sequence: Synthetic oligonucleotide
  Target: SCN9A; (+) strand; PAM type: YTN; PAM sequence: CTT
aaatgtaaaatctaaaacta

SEQ ID NO: 97007 - DNA, 20 bp, Artificial Sequence
  Description of Artificial Sequence: Synthetic oligonucleotide
  Target: SCN9A; (+) strand; PAM type: YTN; PAM sequence: TTA
aatgtaaaatctaaaactat

SEQ ID NO: 97008 - DNA, 20 bp, Artificial Sequence
  Description of Artificial Sequence: Synthetic oligonucleotide
  Target: SCN9A; (+) strand; PAM type: YTN; PAM sequence: CTA
aaactataaaaaccctggaa

SEQ ID NO: 97009 - DNA, 20 bp, Artificial Sequence
  Description of Artificial Sequence: Synthetic oligonucleotide
  Target: SCN9A; (+) strand; PAM type: YTN; PAM sequence: CTA
taaaaaccctggaagacagc

SEQ ID NO: 97010 - DNA, 20 bp, Artificial Sequence
  Description of Artificial Sequence: Synthetic oligonucleotide
  Target: SCN9A; (+) strand; PAM type: YTN; PAM sequence: CTG
gaagacagcctaggcaatac

SEQ ID NO: 97011 - DNA, 20 bp, Artificial Sequence
  Description of Artificial Sequence: Synthetic oligonucleotide
  Target: SCN9A; (+) strand; PAM type: YTN; PAM sequence: CTA
ggcaataccattcaggacat

SEQ ID NO: 97012 - DNA, 20 bp, Artificial Sequence
  Description of Artificial Sequence: Synthetic oligonucleotide
  Target: SCN9A; (+) strand; PAM type: YTN; PAM sequence: TTC
aggacataggcatgggcaaa

SEQ ID NO: 97013 - DNA, 20 bp, Artificial Sequence
  Description of Artificial Sequence: Synthetic oligonucleotide
  Target: SCN9A; (+) strand; PAM type: YTN; PAM sequence: TTT
catgatgaagacaccaaaag

SEQ ID NO: 97014 - DNA, 20 bp, Artificial Sequence
  Description of Artificial Sequence: Synthetic oligonucleotide
  Target: SCN9A; (+) strand; PAM type: YTN; PAM sequence: TTC
atgatgaagacaccaaaagc

SEQ ID NO: 97015 - DNA, 20 bp, Artificial Sequence
  Description of Artificial Sequence: Synthetic oligonucleotide
  Target: SCN9A; (+) strand; PAM type: YTN; PAM sequence: CTG
caacaaaaacaaaaattaac

SEQ ID NO: 97016 - DNA, 20 bp, Artificial Sequence
  Description of Artificial Sequence: Synthetic oligonucleotide
  Target: SCN9A; (+) strand; PAM type: YTN; PAM sequence: TTA
acaaatgggatctaattaaa

SEQ ID NO: 97017 - DNA, 20 bp, Artificial Sequence
  Description of Artificial Sequence: Synthetic oligonucleotide
  Target: SCN9A; (+) strand; PAM type: YTN; PAM sequence: CTA
attaaactaaagagcttctg

SEQ ID NO: 97018 - DNA, 20 bp, Artificial Sequence
  Description of Artificial Sequence: Synthetic oligonucleotide
  Target: SCN9A; (+) strand; PAM type: YTN; PAM sequence: TTA
aactaaagagcttctgcaca

SEQ ID NO: 97019 - DNA, 20 bp, Artificial Sequence
  Description of Artificial Sequence: Synthetic oligonucleotide
  Target: SCN9A; (+) strand; PAM type: YTN; PAM sequence: CTA
aagagcttctgcacagcaaa

SEQ ID NO: 97020 - DNA, 20 bp, Artificial Sequence
  Description of Artificial Sequence: Synthetic oligonucleotide
  Target: SCN9A; (+) strand; PAM type: YTN; PAM sequence: CTT
ctgcacagcaaaagaaacta

SEQ ID NO: 97021 - DNA, 20 bp, Artificial Sequence
  Description of Artificial Sequence: Synthetic oligonucleotide
  Target: SCN9A; (+) strand; PAM type: YTN; PAM sequence: TTC
tgcacagcaaaagaaactat

SEQ ID NO: 97022 - DNA, 20 bp, Artificial Sequence
  Description of Artificial Sequence: Synthetic oligonucleotide
  Target: SCN9A; (+) strand; PAM type: YTN; PAM sequence: CTG
cacagcaaaagaaactatca

SEQ ID NO: 97023 - DNA, 20 bp, Artificial Sequence
  Description of Artificial Sequence: Synthetic oligonucleotide
  Target: SCN9A; (+) strand; PAM type: YTN; PAM sequence: CTA
tcaacagagtaagcagacag

SEQ ID NO: 97024 - DNA, 20 bp, Artificial Sequence
  Description of Artificial Sequence: Synthetic oligonucleotide
  Target: SCN9A; (+) strand; PAM type: YTN; PAM sequence: CTA
cagaatgggagaaaattttt

SEQ ID NO: 97025 - DNA, 20 bp, Artificial Sequence
  Description of Artificial Sequence: Synthetic oligonucleotide
  Target: SCN9A; (+) strand; PAM type: YTN; PAM sequence: TTT
ttgcagactatgcatctgac

SEQ ID NO: 97026 - DNA, 20 bp, Artificial Sequence
  Description of Artificial Sequence: Synthetic oligonucleotide
  Target: SCN9A; (+) strand; PAM type: YTN; PAM sequence: TTT
tgcagactatgcatctgaca

SEQ ID NO: 97027 - DNA, 20 bp, Artificial Sequence
  Description of Artificial Sequence: Synthetic oligonucleotide
  Target: SCN9A; (+) strand; PAM type: YTN; PAM sequence: TTT
gcagactatgcatctgacaa

SEQ ID NO: 97028 - DNA, 20 bp, Artificial Sequence
  Description of Artificial Sequence: Synthetic oligonucleotide
  Target: SCN9A; (+) strand; PAM type: YTN; PAM sequence: TTG
cagactatgcatctgacaaa

SEQ ID NO: 97029 - DNA, 20 bp, Artificial Sequence
  Description of Artificial Sequence: Synthetic oligonucleotide
  Target: SCN9A; (+) strand; PAM type: YTN; PAM sequence: CTA
tgcatctgacaaaggtctaa

SEQ ID NO: 97030 - DNA, 20 bp, Artificial Sequence
  Description of Artificial Sequence: Synthetic oligonucleotide
  Target: SCN9A; (+) strand; PAM type: YTN; PAM sequence: CTG
acaaaggtctaatatccaga

SEQ ID NO: 97031 - DNA, 20 bp, Artificial Sequence
  Description of Artificial Sequence: Synthetic oligonucleotide
  Target: SCN9A; (+) strand; PAM type: YTN; PAM sequence: CTA
atatccagaatctataagga

SEQ ID NO: 97032 - DNA, 20 bp, Artificial Sequence
  Description of Artificial Sequence: Synthetic oligonucleotide
  Target: SCN9A; (+) strand; PAM type: YTN; PAM sequence: CTA
taaggaacttaaatgagttt

SEQ ID NO: 97033 - DNA, 20 bp, Artificial Sequence
  Description of Artificial Sequence: Synthetic oligonucleotide
  Target: SCN9A; (+) strand; PAM type: YTN; PAM sequence: CTT
aaatgagtttacaagaaata

SEQ ID NO: 97034 - DNA, 20 bp, Artificial Sequence
  Description of Artificial Sequence: Synthetic oligonucleotide
  Target: SCN9A; (+) strand; PAM type: YTN; PAM sequence: TTA
aatgagtttacaagaaataa

SEQ ID NO: 97035 - DNA, 20 bp, Artificial Sequence
  Description of Artificial Sequence: Synthetic oligonucleotide
  Target: SCN9A; (+) strand; PAM type: YTN; PAM sequence: TTT
acaagaaataaacaacccca

SEQ ID NO: 97036 - DNA, 20 bp, Artificial Sequence
  Description of Artificial Sequence: Synthetic oligonucleotide
  Target: SCN9A; (+) strand; PAM type: YTN; PAM sequence: TTA
caagaaataaacaaccccat

SEQ ID NO: 97037 - DNA, 20 bp, Artificial Sequence
  Description of Artificial Sequence: Synthetic oligonucleotide
  Target: SCN9A; (+) strand; PAM type: YTN; PAM sequence: TTA
aaaagtgggcaaaggatatg

SEQ ID NO: 97038 - DNA, 20 bp, Artificial Sequence
  Description of Artificial Sequence: Synthetic oligonucleotide
  Target: SCN9A; (+) strand; PAM type: YTN; PAM sequence: CTT
ctgaaaagaagacacacatg

SEQ ID NO: 97039 - DNA, 20 bp, Artificial Sequence
  Description of Artificial Sequence: Synthetic oligonucleotide
  Target: SCN9A; (+) strand; PAM type: YTN; PAM sequence: TTC
tgaaaagaagacacacatgc

SEQ ID NO: 97040 - DNA, 20 bp, Artificial Sequence
  Description of Artificial Sequence: Synthetic oligonucleotide
  Target: SCN9A; (+) strand; PAM type: YTN; PAM sequence: CTG
aaaagaagacacacatgcaa

SEQ ID NO: 97041 - DNA, 20 bp, Artificial Sequence
  Description of Artificial Sequence: Synthetic oligonucleotide
  Target: SCN9A; (+) strand; PAM type: YTN; PAM sequence: CTC
aatgtcactgaccattagag

SEQ ID NO: 97042 - DNA, 20 bp, Artificial Sequence
  Description of Artificial Sequence: Synthetic oligonucleotide
  Target: SCN9A; (+) strand; PAM type: YTN; PAM sequence: CTG
accattagagaaatgcaaat

SEQ ID NO: 97043 - DNA, 20 bp, Artificial Sequence
  Description of Artificial Sequence: Synthetic oligonucleotide
  Target: SCN9A; (+) strand; PAM type: YTN; PAM sequence: TTA
gagaaatgcaaatcaaaacc

SEQ ID NO: 97044 - DNA, 20 bp, Artificial Sequence
  Description of Artificial Sequence: Synthetic oligonucleotide
  Target: SCN9A; (+) strand; PAM type: YTN; PAM sequence: CTC
acaccagtcagaatggctat

SEQ ID NO: 97045 - DNA, 20 bp, Artificial Sequence
  Description of Artificial Sequence: Synthetic oligonucleotide
  Target: SCN9A; (+) strand; PAM type: YTN; PAM sequence: CTA
ttatgaaaaagtcaaaaaat

SEQ ID NO: 97046 - DNA, 20 bp, Artificial Sequence
  Description of Artificial Sequence: Synthetic oligonucleotide
  Target: SCN9A; (+) strand; PAM type: YTN; PAM sequence: TTA
tgaaaaagtcaaaaaataac

SEQ ID NO: 97047 - DNA, 20 bp, Artificial Sequence
  Description of Artificial Sequence: Synthetic oligonucleotide
  Target: SCN9A; (+) strand; PAM type: YTN; PAM sequence: CTG
gcgagggtgtggagaaaaaa

SEQ ID NO: 97048 - DNA, 20 bp, Artificial Sequence
  Description of Artificial Sequence: Synthetic oligonucleotide
  Target: SCN9A; (+) strand; PAM type: YTN; PAM sequence: CTA
cacactgttgatgggagtgt

SEQ ID NO: 97049 - DNA, 20 bp, Artificial Sequence
  Description of Artificial Sequence: Synthetic oligonucleotide
  Target: SCN9A; (+) strand; PAM type: YTN; PAM sequence: CTG
ttgatgggagtgtaaattaa

SEQ ID NO: 97050 - DNA, 20 bp, Artificial Sequence
  Description of Artificial Sequence: Synthetic oligonucleotide
  Target: SCN9A; (+) strand; PAM type: YTN; PAM sequence: TTG
atgggagtgtaaattaattc

SEQ ID NO: 97051 - DNA, 20 bp, Artificial Sequence
  Description of Artificial Sequence: Synthetic oligonucleotide
  Target: SCN9A; (+) strand; PAM type: YTN; PAM sequence: TTA
attcaaccataatggaagac

SEQ ID NO: 97052 - DNA, 20 bp, Artificial Sequence
  Description of Artificial Sequence: Synthetic oligonucleotide
  Target: SCN9A; (+) strand; PAM type: YTN; PAM sequence: TTC
aaccataatggaagactgtg

SEQ ID NO: 97053 - DNA, 20 bp, Artificial Sequence
  Description of Artificial Sequence: Synthetic oligonucleotide
  Target: SCN9A; (+) strand; PAM type: YTN; PAM sequence: CTG
tgtggcaattcctcaaagac

SEQ ID NO: 97054 - DNA, 20 bp, Artificial Sequence
  Description of Artificial Sequence: Synthetic oligonucleotide
  Target: SCN9A; (+) strand; PAM type: YTN; PAM sequence: TTC
ctcaaagacctaaagacaga

SEQ ID NO: 97055 - DNA, 20 bp, Artificial Sequence
  Description of Artificial Sequence: Synthetic oligonucleotide
  Target: SCN9A; (+) strand; PAM type: YTN; PAM sequence: CTC
aaagacctaaagacagaaat

SEQ ID NO: 97056 - DNA, 20 bp, Artificial Sequence
  Description of Artificial Sequence: Synthetic oligonucleotide
  Target: SCN9A; (+) strand; PAM type: YTN; PAM sequence: CTA
aagacagaaatgccattcaa

SEQ ID NO: 97057 - DNA, 20 bp, Artificial Sequence
  Description of Artificial Sequence: Synthetic oligonucleotide
  Target: SCN9A; (+) strand; PAM type: YTN; PAM sequence: TTC
aacccagcaatcccattact

SEQ ID NO: 97058 - DNA, 20 bp, Artificial Sequence
  Description of Artificial Sequence: Synthetic oligonucleotide
  Target: SCN9A; (+) strand; PAM type: YTN; PAM sequence: TTA
ctgggtatatacctaaaggg

SEQ ID NO: 97059 - DNA, 20 bp, Artificial Sequence
  Description of Artificial Sequence: Synthetic oligonucleotide
  Target: SCN9A; (+) strand; PAM type: YTN; PAM sequence: CTG
ggtatatacctaaagggaaa

SEQ ID NO: 97060 - DNA, 20 bp, Artificial Sequence
  Description of Artificial Sequence: Synthetic oligonucleotide
  Target: SCN9A; (+) strand; PAM type: YTN; PAM sequence: CTA
aagggaaatacatttttcta

SEQ ID NO: 97061 - DNA, 20 bp, Artificial Sequence
  Description of Artificial Sequence: Synthetic oligonucleotide
  Target: SCN9A; (+) strand; PAM type: YTN; PAM sequence: TTT
ttctattataaagacacatg

SEQ ID NO: 97062 - DNA, 20 bp, Artificial Sequence
  Description of Artificial Sequence: Synthetic oligonucleotide
  Target: SCN9A; (+) strand; PAM type: YTN; PAM sequence: TTT
tctattataaagacacatgc

SEQ ID NO: 97063 - DNA, 20 bp, Artificial Sequence
  Description of Artificial Sequence: Synthetic oligonucleotide
  Target: SCN9A; (+) strand; PAM type: YTN; PAM sequence: TTT
ctattataaagacacatgca

SEQ ID NO: 97064 - DNA, 20 bp, Artificial Sequence
  Description of Artificial Sequence: Synthetic oligonucleotide
  Target: SCN9A; (+) strand; PAM type: YTN; PAM sequence: TTC
tattataaagacacatgcac

SEQ ID NO: 97065 - DNA, 20 bp, Artificial Sequence
  Description of Artificial Sequence: Synthetic oligonucleotide
  Target: SCN9A; (+) strand; PAM type: YTN; PAM sequence: CTA
ttataaagacacatgcacac

SEQ ID NO: 97066 - DNA, 20 bp, Artificial Sequence
  Description of Artificial Sequence: Synthetic oligonucleotide
  Target: SCN9A; (+) strand; PAM type: YTN; PAM sequence: TTA
taaagacacatgcacacata

SEQ ID NO: 97067 - DNA, 20 bp, Artificial Sequence
  Description of Artificial Sequence: Synthetic oligonucleotide
  Target: SCN9A; (+) strand; PAM type: YTN; PAM sequence: TTT
attggagcactattcacaat

SEQ ID NO: 97068 - DNA, 20 bp, Artificial Sequence
  Description of Artificial Sequence: Synthetic oligonucleotide
  Target: SCN9A; (+) strand; PAM type: YTN; PAM sequence: TTA
ttggagcactattcacaatg

SEQ ID NO: 97069 - DNA, 20 bp, Artificial Sequence
  Description of Artificial Sequence: Synthetic oligonucleotide
  Target: SCN9A; (+) strand; PAM type: YTN; PAM sequence: TTG
gagcactattcacaatggca

SEQ ID NO: 97070 - DNA, 20 bp, Artificial Sequence
  Description of Artificial Sequence: Synthetic oligonucleotide
  Target: SCN9A; (+) strand; PAM type: YTN; PAM sequence: CTA
ttcacaatggcaaagacata

SEQ ID NO: 97071 - DNA, 20 bp, Artificial Sequence
  Description of Artificial Sequence: Synthetic oligonucleotide
  Target: SCN9A; (+) strand; PAM type: YTN; PAM sequence: TTC
acaatggcaaagacatagaa

SEQ ID NO: 97072 - DNA, 20 bp, Artificial Sequence
  Description of Artificial Sequence: Synthetic oligonucleotide
  Target: SCN9A; (+) strand; PAM type: YTN; PAM sequence: CTC
aaatgaccatcagtgataga

SEQ ID NO: 97073 - DNA, 20 bp, Artificial Sequence
  Description of Artificial Sequence: Synthetic oligonucleotide
  Target: SCN9A; (+) strand; PAM type: YTN; PAM sequence: CTG
gataaagataatgtggtaaa

SEQ ID NO: 97074 - DNA, 20 bp, Artificial Sequence
  Description of Artificial Sequence: Synthetic oligonucleotide
  Target: SCN9A; (+) strand; PAM type: YTN; PAM sequence: CTA
tgcagccattcaaaaaaaaa

SEQ ID NO: 97075 - DNA, 20 bp, Artificial Sequence
  Description of Artificial Sequence: Synthetic oligonucleotide
  Target: SCN9A; (+) strand; PAM type: YTN; PAM sequence: TTC
aaaaaaaaacgagatcatat

SEQ ID NO: 97076 - DNA, 20 bp, Artificial Sequence
  Description of Artificial Sequence: Synthetic oligonucleotide
  Target: SCN9A; (+) strand; PAM type: YTN; PAM sequence: CTT
tgcagggacatgaatggagc

SEQ ID NO: 97077 - DNA, 20 bp, Artificial Sequence
  Description of Artificial Sequence: Synthetic oligonucleotide
  Target: SCN9A; (+) strand; PAM type: YTN; PAM sequence: TTT
gcagggacatgaatggagct

SEQ ID NO: 97078 - DNA, 20 bp, Artificial Sequence
  Description of Artificial Sequence: Synthetic oligonucleotide
  Target: SCN9A; (+) strand; PAM type: YTN; PAM sequence: TTG
cagggacatgaatggagctg

SEQ ID NO: 97079 - DNA, 20 bp, Artificial Sequence
  Description of Artificial Sequence: Synthetic oligonucleotide
  Target: SCN9A; (+) strand; PAM type: YTN; PAM sequence: CTG
gaggccattttcattagtaa

SEQ ID NO: 97080 - DNA, 20 bp, Artificial Sequence
  Description of Artificial Sequence: Synthetic oligonucleotide
  Target: SCN9A; (+) strand; PAM type: YTN; PAM sequence: TTT
tcattagtaaactaaggcag

SEQ ID NO: 97081 - DNA, 20 bp, Artificial Sequence
  Description of Artificial Sequence: Synthetic oligonucleotide
  Target: SCN9A; (+) strand; PAM type: YTN; PAM sequence: TTT
cattagtaaactaaggcagg

SEQ ID NO: 97082 - DNA, 20 bp, Artificial Sequence
  Description of Artificial Sequence: Synthetic oligonucleotide
  Target: SCN9A; (+) strand; PAM type: YTN; PAM sequence: TTC
attagtaaactaaggcagga

SEQ ID NO: 97083 - DNA, 20 bp, Artificial Sequence
  Description of Artificial Sequence: Synthetic oligonucleotide
  Target: SCN9A; (+) strand; PAM type: YTN; PAM sequence: TTA
gtaaactaaggcaggaacag

SEQ ID NO: 97084 - DNA, 20 bp, Artificial Sequence
  Description of Artificial Sequence: Synthetic oligonucleotide
  Target: SCN9A; (+) strand; PAM type: YTN; PAM sequence: CTA
aggcaggaacagaaaaccaa

SEQ ID NO: 97085 - DNA, 20 bp, Artificial Sequence
  Description of Artificial Sequence: Synthetic oligonucleotide
  Target: SCN9A; (+) strand; PAM type: YTN; PAM sequence: TTC
tcacttataagtgggagcta

SEQ ID NO: 97086 - DNA, 20 bp, Artificial Sequence
  Description of Artificial Sequence: Synthetic oligonucleotide
  Target: SCN9A; (+) strand; PAM type: YTN; PAM sequence: CTC
acttataagtgggagctaaa

SEQ ID NO: 97087 - DNA, 20 bp, Artificial Sequence
  Description of Artificial Sequence: Synthetic oligonucleotide
  Target: SCN9A; (+) strand; PAM type: YTN; PAM sequence: CTT
ataagtgggagctaaatgat

SEQ ID NO: 97088 - DNA, 20 bp, Artificial Sequence
  Description of Artificial Sequence: Synthetic oligonucleotide
  Target: SCN9A; (+) strand; PAM type: YTN; PAM sequence: TTA
taagtgggagctaaatgatg

SEQ ID NO: 97089 - DNA, 20 bp, Artificial Sequence
  Description of Artificial Sequence: Synthetic oligonucleotide
  Target: SCN9A; (+) strand; PAM type: YTN; PAM sequence: CTA
aatgatgagaacacatggac

SEQ ID NO: 97090 - DNA, 20 bp, Artificial Sequence
  Description of Artificial Sequence: Synthetic oligonucleotide
  Target: SCN9A; (+) strand; PAM type: YTN; PAM sequence: CTG
gggcctatgggagggtgaag

SEQ ID NO: 97091 - DNA, 20 bp, Artificial Sequence
  Description of Artificial Sequence: Synthetic oligonucleotide
  Target: SCN9A; (+) strand; PAM type: YTN; PAM sequence: CTA
tgggagggtgaagggtggga

SEQ ID NO: 97092 - DNA, 20 bp, Artificial Sequence
  Description of Artificial Sequence: Synthetic oligonucleotide
  Target: SCN9A; (+) strand; PAM type: YTN; PAM sequence: CTG
ggattaatacctcagggatg

SEQ ID NO: 97093 - DNA, 20 bp, Artificial Sequence
  Description of Artificial Sequence: Synthetic oligonucleotide
  Target: SCN9A; (+) strand; PAM type: YTN; PAM sequence: TTA
atacctcagggatgaaataa

SEQ ID NO: 97094 - DNA, 20 bp, Artificial Sequence
  Description of Artificial Sequence: Synthetic oligonucleotide
  Target: SCN9A; (+) strand; PAM type: YTN; PAM sequence: CTC
agggatgaaataatctgtac

SEQ ID NO: 97095 - DNA, 20 bp, Artificial Sequence
  Description of Artificial Sequence: Synthetic oligonucleotide
  Target: SCN9A; (+) strand; PAM type: YTN; PAM sequence: CTG
tacaacaaacccctatgaca

SEQ ID NO: 97096 - DNA, 20 bp, Artificial Sequence
  Description of Artificial Sequence: Synthetic oligonucleotide
  Target: SCN9A; (+) strand; PAM type: YTN; PAM sequence: CTA
tgacatgtttacctatgtaa

SEQ ID NO: 97097 - DNA, 20 bp, Artificial Sequence
  Description of Artificial Sequence: Synthetic oligonucleotide
  Target: SCN9A; (+) strand; PAM type: YTN; PAM sequence: TTT
acctatgtaacaagactgca

SEQ ID NO: 97098 - DNA, 20 bp, Artificial Sequence
  Description of Artificial Sequence: Synthetic oligonucleotide
  Target: SCN9A; (+) strand; PAM type: YTN; PAM sequence: TTA
cctatgtaacaagactgcac

SEQ ID NO: 97099 - DNA, 20 bp, Artificial Sequence
  Description of Artificial Sequence: Synthetic oligonucleotide
  Target: SCN9A; (+) strand; PAM type: YTN; PAM sequence: CTA
tgtaacaagactgcacatcc

SEQ ID NO: 97100 - DNA, 20 bp, Artificial Sequence
  Description of Artificial Sequence: Synthetic oligonucleotide
  Target: SCN9A; (+) strand; PAM type: YTN; PAM sequence: CTG
cacatcctgtacatgtaccc

SEQ ID NO: 97101 - DNA, 20 bp, Artificial Sequence
  Description of Artificial Sequence: Synthetic oligonucleotide
  Target: SCN9A; (+) strand; PAM type: YTN; PAM sequence: CTG
tacatgtacccctgaactta

SEQ ID NO: 97102 - DNA, 20 bp, Artificial Sequence
  Description of Artificial Sequence: Synthetic oligonucleotide
  Target: SCN9A; (+) strand; PAM type: YTN; PAM sequence: CTG
aacttaaaataaaagtcaaa

SEQ ID NO: 97103 - DNA, 20 bp, Artificial Sequence
  Description of Artificial Sequence: Synthetic oligonucleotide
  Target: SCN9A; (+) strand; PAM type: YTN; PAM sequence: CTT
aaaataaaagtcaaaaaagt

SEQ ID NO: 97104 - DNA, 20 bp, Artificial Sequence
  Description of Artificial Sequence: Synthetic oligonucleotide
  Target: SCN9A; (+) strand; PAM type: YTN; PAM sequence: TTA
aaataaaagtcaaaaaagtc

SEQ ID NO: 97105 - DNA, 20 bp, Artificial Sequence
  Description of Artificial Sequence: Synthetic oligonucleotide
  Target: SCN9A; (+) strand; PAM type: YTN; PAM sequence: TTT
caaaattgctaaaagaatag

SEQ ID NO: 97106 - DNA, 20 bp, Artificial Sequence
  Description of Artificial Sequence: Synthetic oligonucleotide
  Target: SCN9A; (+) strand; PAM type: YTN; PAM sequence: TTC
aaaattgctaaaagaatagc

SEQ ID NO: 97107 - DNA, 20 bp, Artificial Sequence
  Description of Artificial Sequence: Synthetic oligonucleotide
  Target: SCN9A; (+) strand; PAM type: YTN; PAM sequence: TTG
ctaaaagaatagctttttaa

SEQ ID NO: 97108 - DNA, 20 bp, Artificial Sequence
  Description of Artificial Sequence: Synthetic oligonucleotide
  Target: SCN9A; (+) strand; PAM type: YTN; PAM sequence: CTA
aaagaatagctttttaactt

SEQ ID NO: 97109 - DNA, 20 bp, Artificial Sequence
  Description of Artificial Sequence: Synthetic oligonucleotide
  Target: SCN9A; (+) strand; PAM type: YTN; PAM sequence: CTT
tttaactttcttaccacaaa

SEQ ID NO: 97110 - DNA, 20 bp, Artificial Sequence
  Description of Artificial Sequence: Synthetic oligonucleotide
  Target: SCN9A; (+) strand; PAM type: YTN; PAM sequence: TTT
ttaactttcttaccacaaaa

SEQ ID NO: 97111 - DNA, 20 bp, Artificial Sequence
  Description of Artificial Sequence: Synthetic oligonucleotide
  Target: SCN9A; (+) strand; PAM type: YTN; PAM sequence: TTT
taactttcttaccacaaaaa

SEQ ID NO: 97112 - DNA, 20 bp, Artificial Sequence
  Description of Artificial Sequence: Synthetic oligonucleotide
  Target: SCN9A; (+) strand; PAM type: YTN; PAM sequence: TTT
aactttcttaccacaaaaaa

SEQ ID NO: 97113 - DNA, 20 bp, Artificial Sequence
  Description of Artificial Sequence: Synthetic oligonucleotide
  Target: SCN9A; (+) strand; PAM type: YTN; PAM sequence: TTA
actttcttaccacaaaaaaa

SEQ ID NO: 97114 - DNA, 20 bp, Artificial Sequence
  Description of Artificial Sequence: Synthetic oligonucleotide
  Target: SCN9A; (+) strand; PAM type: YTN; PAM sequence: CTT
tcttaccacaaaaaaatgat

SEQ ID NO: 97115 - DNA, 20 bp, Artificial Sequence
  Description of Artificial Sequence: Synthetic oligonucleotide
  Target: SCN9A; (+) strand; PAM type: YTN; PAM sequence: TTT
cttaccacaaaaaaatgata

SEQ ID NO: 97116 - DNA, 20 bp, Artificial Sequence
  Description of Artificial Sequence: Synthetic oligonucleotide
  Target: SCN9A; (+) strand; PAM type: YTN; PAM sequence: TTC
ttaccacaaaaaaatgataa

SEQ ID NO: 97117 - DNA, 20 bp, Artificial Sequence
  Description of Artificial Sequence: Synthetic oligonucleotide
  Target: SCN9A; (+) strand; PAM type: YTN; PAM sequence: CTT
accacaaaaaaatgataagt

SEQ ID NO: 97118 - DNA, 20 bp, Artificial Sequence
  Description of Artificial Sequence: Synthetic oligonucleotide
  Target: SCN9A; (+) strand; PAM type: YTN; PAM sequence: TTA
ccacaaaaaaatgataagtg

SEQ ID NO: 97119 - DNA, 20 bp, Artificial Sequence
  Description of Artificial Sequence: Synthetic oligonucleotide
  Target: SCN9A; (+) strand; PAM type: YTN; PAM sequence: TTA
tgttaattagcgtgactgaa

SEQ ID NO: 97120 - DNA, 20 bp, Artificial Sequence
  Description of Artificial Sequence: Synthetic oligonucleotide
  Target: SCN9A; (+) strand; PAM type: YTN; PAM sequence: TTA
attagcgtgactgaaaattt

SEQ ID NO: 97121 - DNA, 20 bp, Artificial Sequence
  Description of Artificial Sequence: Synthetic oligonucleotide
  Target: SCN9A; (+) strand; PAM type: YTN; PAM sequence: TTA
gcgtgactgaaaatttctac

SEQ ID NO: 97122 - DNA, 20 bp, Artificial Sequence
  Description of Artificial Sequence: Synthetic oligonucleotide
  Target: SCN9A; (+) strand; PAM type: YTN; PAM sequence: CTG
aaaatttctacaatgtttat

SEQ ID NO: 97123 - DNA, 20 bp, Artificial Sequence
  Description of Artificial Sequence: Synthetic oligonucleotide
  Target: SCN9A; (+) strand; PAM type: YTN; PAM sequence: TTT
ctacaatgtttatgtagatc

SEQ ID NO: 97124 - DNA, 20 bp, Artificial Sequence
  Description of Artificial Sequence: Synthetic oligonucleotide
  Target: SCN9A; (+) strand; PAM type: YTN; PAM sequence: TTC
tacaatgtttatgtagatca

SEQ ID NO: 97125 - DNA, 20 bp, Artificial Sequence
  Description of Artificial Sequence: Synthetic oligonucleotide
  Target: SCN9A; (+) strand; PAM type: YTN; PAM sequence: CTA
caatgtttatgtagatcaaa

SEQ ID NO: 97126 - DNA, 20 bp, Artificial Sequence
  Description of Artificial Sequence: Synthetic oligonucleotide
  Target: SCN9A; (+) strand; PAM type: YTN; PAM sequence: TTT
atgtagatcaaaacattgtt

SEQ ID NO: 97127 - DNA, 20 bp, Artificial Sequence
  Description of Artificial Sequence: Synthetic oligonucleotide
  Target: SCN9A; (+) strand; PAM type: YTN; PAM sequence: TTA
tgtagatcaaaacattgttt

SEQ ID NO: 97128 - DNA, 20 bp, Artificial Sequence
  Description of Artificial Sequence: Synthetic oligonucleotide
  Target: SCN9A; (+) strand; PAM type: YTN; PAM sequence: TTG
ttttgtaccccataaataag

SEQ ID NO: 97129 - DNA, 20 bp, Artificial Sequence
  Description of Artificial Sequence: Synthetic oligonucleotide
  Target: SCN9A; (+) strand; PAM type: YTN; PAM sequence: TTT
tgtaccccataaataagcac

SEQ ID NO: 97130 - DNA, 20 bp, Artificial Sequence
  Description of Artificial Sequence: Synthetic oligonucleotide
  Target: SCN9A; (+) strand; PAM type: YTN; PAM sequence: TTT
gtaccccataaataagcaca

SEQ ID NO: 97131 - DNA, 20 bp, Artificial Sequence
  Description of Artificial Sequence: Synthetic oligonucleotide
  Target: SCN9A; (+) strand; PAM type: YTN; PAM sequence: TTG
taccccataaataagcacaa

SEQ ID NO: 97132 - DNA, 20 bp, Artificial Sequence
  Description of Artificial Sequence: Synthetic oligonucleotide
  Target: SCN9A; (+) strand; PAM type: YTN; PAM sequence: TTT
ttgtcaattaaaaatgaaca

SEQ ID NO: 97133 - DNA, 20 bp, Artificial Sequence
  Description of Artificial Sequence: Synthetic oligonucleotide
  Target: SCN9A; (+) strand; PAM type: YTN; PAM sequence: TTT
tgtcaattaaaaatgaacaa

SEQ ID NO: 97134 - DNA, 20 bp, Artificial Sequence
  Description of Artificial Sequence: Synthetic oligonucleotide
  Target: SCN9A; (+) strand; PAM type: YTN; PAM sequence: TTT
gtcaattaaaaatgaacaaa

SEQ ID NO: 97135 - DNA, 20 bp, Artificial Sequence
  Description of Artificial Sequence: Synthetic oligonucleotide
  Target: SCN9A; (+) strand; PAM type: YTN; PAM sequence: TTG
tcaattaaaaatgaacaaat

SEQ ID NO: 97136 - DNA, 20 bp, Artificial Sequence
  Description of Artificial Sequence: Synthetic oligonucleotide
  Target: SCN9A; (+) strand; PAM type: YTN; PAM sequence: TTA
aaaatgaacaaatatttaaa

SEQ ID NO: 97137 - DNA, 20 bp, Artificial Sequence
  Description of Artificial Sequence: Synthetic oligonucleotide
  Target: SCN9A; (+) strand; PAM type: YTN; PAM sequence: TTT
aaacagaaaaaaacatacta

SEQ ID NO: 97138 - DNA, 20 bp, Artificial Sequence
  Description of Artificial Sequence: Synthetic oligonucleotide
  Target: SCN9A; (+) strand; PAM type: YTN; PAM sequence: TTA
aacagaaaaaaacatactac

SEQ ID NO: 97139 - DNA, 20 bp, Artificial Sequence
  Description of Artificial Sequence: Synthetic oligonucleotide
  Target: SCN9A; (+) strand; PAM type: YTN; PAM sequence: CTA
cagaacaagatccctgatga

SEQ ID NO: 97140 - DNA, 20 bp, Artificial Sequence
  Description of Artificial Sequence: Synthetic oligonucleotide
  Target: SCN9A; (+) strand; PAM type: YTN; PAM sequence: CTG
atgaacatagatgcaaataa

SEQ ID NO: 97141 - DNA, 20 bp, Artificial Sequence
  Description of Artificial Sequence: Synthetic oligonucleotide
  Target: SCN9A; (+) strand; PAM type: YTN; PAM sequence: CTT
catcaaaatattagcaaact

SEQ ID NO: 97142 - DNA, 20 bp, Artificial Sequence
  Description of Artificial Sequence: Synthetic oligonucleotide
  Target: SCN9A; (+) strand; PAM type: YTN; PAM sequence: TTC
atcaaaatattagcaaactg

SEQ ID NO: 97143 - DNA, 20 bp, Artificial Sequence
  Description of Artificial Sequence: Synthetic oligonucleotide
  Target: SCN9A; (+) strand; PAM type: YTN; PAM sequence: TTA
gcaaactgaatgcaacagcc

SEQ ID NO: 97144 - DNA, 20 bp, Artificial Sequence
  Description of Artificial Sequence: Synthetic oligonucleotide
  Target: SCN9A; (+) strand; PAM type: YTN; PAM sequence: CTG
aatgcaacagcccattaaat

SEQ ID NO: 97145 - DNA, 20 bp, Artificial Sequence
  Description of Artificial Sequence: Synthetic oligonucleotide
  Target: SCN9A; (+) strand; PAM type: YTN; PAM sequence: TTA
aatgatcatgtactacgacc

SEQ ID NO: 97146 - DNA, 20 bp, Artificial Sequence
  Description of Artificial Sequence: Synthetic oligonucleotide
  Target: SCN9A; (+) strand; PAM type: YTN; PAM sequence: CTA
cgaccaagtgggagttgtcc

SEQ ID NO: 97147 - DNA, 20 bp, Artificial Sequence
  Description of Artificial Sequence: Synthetic oligonucleotide
  Target: SCN9A; (+) strand; PAM type: YTN; PAM sequence: TTG
tccctaggatgcaaggatgg

SEQ ID NO: 97148 - DNA, 20 bp, Artificial Sequence
  Description of Artificial Sequence: Synthetic oligonucleotide
  Target: SCN9A; (+) strand; PAM type: YTN; PAM sequence: CTA
ggatgcaaggatggttcaac

SEQ ID NO: 97149 - DNA, 20 bp, Artificial Sequence
  Description of Artificial Sequence: Synthetic oligonucleotide
  Target: SCN9A; (+) strand; PAM type: YTN; PAM sequence: TTC
aacatatgcagaccaataat

SEQ ID NO: 97150 - DNA, 20 bp, Artificial Sequence
  Description of Artificial Sequence: Synthetic oligonucleotide
  Target: SCN9A; (+) strand; PAM type: YTN; PAM sequence: CTG
agaaggataaaaatcacatg

SEQ ID NO: 97151 - DNA, 20 bp, Artificial Sequence
  Description of Artificial Sequence: Synthetic oligonucleotide
  Target: SCN9A; (+) strand; PAM type: YTN; PAM sequence: TTC
agaagaagcatttgacaaat

SEQ ID NO: 97152 - DNA, 20 bp, Artificial Sequence
  Description of Artificial Sequence: Synthetic oligonucleotide
  Target: SCN9A; (+) strand; PAM type: YTN; PAM sequence: TTT
gacaaatttcaacaaccttt

SEQ ID NO: 97153 - DNA, 20 bp, Artificial Sequence
  Description of Artificial Sequence: Synthetic oligonucleotide
  Target: SCN9A; (+) strand; PAM type: YTN; PAM sequence: TTG
acaaatttcaacaacctttc

SEQ ID NO: 97154 - DNA, 20 bp, Artificial Sequence
  Description of Artificial Sequence: Synthetic oligonucleotide
  Target: SCN9A; (+) strand; PAM type: YTN; PAM sequence: TTT
caacaacctttcatggtaaa

SEQ ID NO: 97155 - DNA, 20 bp, Artificial Sequence
  Description of Artificial Sequence: Synthetic oligonucleotide
  Target: SCN9A; (+) strand; PAM type: YTN; PAM sequence: TTC
aacaacctttcatggtaaaa

SEQ ID NO: 97156 - DNA, 20 bp, Artificial Sequence
  Description of Artificial Sequence: Synthetic oligonucleotide
  Target: SCN9A; (+) strand; PAM type: YTN; PAM sequence: CTT
tcatggtaaaaactaaaaaa

SEQ ID NO: 97157 - DNA, 20 bp, Artificial Sequence
  Description of Artificial Sequence: Synthetic oligonucleotide
  Target: SCN9A; (+) strand; PAM type: YTN; PAM sequence: TTT
catggtaaaaactaaaaaaa

SEQ ID NO: 97158 - DNA, 20 bp, Artificial Sequence
  Description of Artificial Sequence: Synthetic oligonucleotide
  Target: SCN9A; (+) strand; PAM type: YTN; PAM sequence: TTC
atggtaaaaactaaaaaaag

SEQ ID NO: 97159 - DNA, 20 bp, Artificial Sequence
  Description of Artificial Sequence: Synthetic oligonucleotide
  Target: SCN9A; (+) strand; PAM type: YTN; PAM sequence: CTA
aaaaaagaaaacaaaagcta

SEQ ID NO: 97160 - DNA, 20 bp, Artificial Sequence
  Description of Artificial Sequence: Synthetic oligonucleotide
  Target: SCN9A; (+) strand; PAM type: YTN; PAM sequence: CTA
ggtatagaagttgctataac

SEQ ID NO: 97161 - DNA, 20 bp, Artificial Sequence
  Description of Artificial Sequence: Synthetic oligonucleotide
  Target: SCN9A; (+) strand; PAM type: YTN; PAM sequence: TTG
ctataacttgaaggtttgtc

SEQ ID NO: 97162 - DNA, 20 bp, Artificial Sequence
  Description of Artificial Sequence: Synthetic oligonucleotide
  Target: SCN9A; (+) strand; PAM type: YTN; PAM sequence: CTA
taacttgaaggtttgtcccc

SEQ ID NO: 97163 - DNA, 20 bp, Artificial Sequence
  Description of Artificial Sequence: Synthetic oligonucleotide
  Target: SCN9A; (+) strand; PAM type: YTN; PAM sequence: CTT
gaaggtttgtcccctccaaa

SEQ ID NO: 97164 - DNA, 20 bp, Artificial Sequence
  Description of Artificial Sequence: Synthetic oligonucleotide
  Target: SCN9A; (+) strand; PAM type: YTN; PAM sequence: TTG
aaggtttgtcccctccaaag

SEQ ID NO: 97165 - DNA, 20 bp, Artificial Sequence
  Description of Artificial Sequence: Synthetic oligonucleotide
  Target: SCN9A; (+) strand; PAM type: YTN; PAM sequence: TTT
gtcccctccaaagctcatgt

SEQ ID NO: 97166 - DNA, 20 bp, Artificial Sequence
  Description of Artificial Sequence: Synthetic oligonucleotide
  Target: SCN9A; (+) strand; PAM type: YTN; PAM sequence: TTG
tcccctccaaagctcatgtt

SEQ ID NO: 97167 - DNA, 20 bp, Artificial Sequence
  Description of Artificial Sequence: Synthetic oligonucleotide
  Target: SCN9A; (+) strand; PAM type: YTN; PAM sequence: CTC
caaagctcatgttgcaattt

SEQ ID NO: 97168 - DNA, 20 bp, Artificial Sequence
  Description of Artificial Sequence: Synthetic oligonucleotide
  Target: SCN9A; (+) strand; PAM type: YTN; PAM sequence: CTC
atgttgcaatttaattgcaa

SEQ ID NO: 97169 - DNA, 20 bp, Artificial Sequence
  Description of Artificial Sequence: Synthetic oligonucleotide
  Target: SCN9A; (+) strand; PAM type: YTN; PAM sequence: TTG
caatttaattgcaattgtga

SEQ ID NO: 97170 - DNA, 20 bp, Artificial Sequence
  Description of Artificial Sequence: Synthetic oligonucleotide
  Target: SCN9A; (+) strand; PAM type: YTN; PAM sequence: TTT
aattgcaattgtgacagaat

SEQ ID NO: 97171 - DNA, 20 bp, Artificial Sequence
  Description of Artificial Sequence: Synthetic oligonucleotide
  Target: SCN9A; (+) strand; PAM type: YTN; PAM sequence: TTA
attgcaattgtgacagaatt

SEQ ID NO: 97172 - DNA, 20 bp, Artificial Sequence
  Description of Artificial Sequence: Synthetic oligonucleotide
  Target: SCN9A; (+) strand; PAM type: YTN; PAM sequence: TTG
caattgtgacagaattggga

SEQ ID NO: 97173 - DNA, 20 bp, Artificial Sequence
  Description of Artificial Sequence: Synthetic oligonucleotide
  Target: SCN9A; (+) strand; PAM type: YTN; PAM sequence: TTG
tgacagaattgggaggtgag

SEQ ID NO: 97174 - DNA, 20 bp, Artificial Sequence
  Description of Artificial Sequence: Synthetic oligonucleotide
  Target: SCN9A; (+) strand; PAM type: YTN; PAM sequence: TTG
ggaggtgagacctttaagag

SEQ ID NO: 97175 - DNA, 20 bp, Artificial Sequence
  Description of Artificial Sequence: Synthetic oligonucleotide
  Target: SCN9A; (+) strand; PAM type: YTN; PAM sequence: CTT
taagaggtgtttaagttatg

SEQ ID NO: 97176 - DNA, 20 bp, Artificial Sequence
  Description of Artificial Sequence: Synthetic oligonucleotide
  Target: SCN9A; (+) strand; PAM type: YTN; PAM sequence: TTT
aagaggtgtttaagttatga

SEQ ID NO: 97177 - DNA, 20 bp, Artificial Sequence
  Description of Artificial Sequence: Synthetic oligonucleotide
  Target: SCN9A; (+) strand; PAM type: YTN; PAM sequence: TTA
agaggtgtttaagttatgag

SEQ ID NO: 97178 - DNA, 20 bp, Artificial Sequence
  Description of Artificial Sequence: Synthetic oligonucleotide
  Target: SCN9A; (+) strand; PAM type: YTN; PAM sequence: TTT
aagttatgagaattttaccc

SEQ ID NO: 97179 - DNA, 20 bp, Artificial Sequence
  Description of Artificial Sequence: Synthetic oligonucleotide
  Target: SCN9A; (+) strand; PAM type: YTN; PAM sequence: TTA
agttatgagaattttaccct

SEQ ID NO: 97180 - DNA, 20 bp, Artificial Sequence
  Description of Artificial Sequence: Synthetic oligonucleotide
  Target: SCN9A; (+) strand; PAM type: YTN; PAM sequence: TTA
tgagaattttacccttttaa

SEQ ID NO: 97181 - DNA, 20 bp, Artificial Sequence
  Description of Artificial Sequence: Synthetic oligonucleotide
  Target: SCN9A; (+) strand; PAM type: YTN; PAM sequence: TTT
tacccttttaaatgcattaa

SEQ ID NO: 97182 - DNA, 20 bp, Artificial Sequence
  Description of Artificial Sequence: Synthetic oligonucleotide
  Target: SCN9A; (+) strand; PAM type: YTN; PAM sequence: TTT
acccttttaaatgcattaat

SEQ ID NO: 97183 - DNA, 20 bp, Artificial Sequence
  Description of Artificial Sequence: Synthetic oligonucleotide
  Target: SCN9A; (+) strand; PAM type: YTN; PAM sequence: TTA
cccttttaaatgcattaatg

SEQ ID NO: 97184 - DNA, 20 bp, Artificial Sequence
  Description of Artificial Sequence: Synthetic oligonucleotide
  Target: SCN9A; (+) strand; PAM type: YTN; PAM sequence: CTT
ttaaatgcattaatgctgtt

SEQ ID NO: 97185 - DNA, 20 bp, Artificial Sequence
  Description of Artificial Sequence: Synthetic oligonucleotide
  Target: SCN9A; (+) strand; PAM type: YTN; PAM sequence: TTT
taaatgcattaatgctgtta

SEQ ID NO: 97186 - DNA, 20 bp, Artificial Sequence
  Description of Artificial Sequence: Synthetic oligonucleotide
  Target: SCN9A; (+) strand; PAM type: YTN; PAM sequence: TTT
aaatgcattaatgctgttat

SEQ ID NO: 97187 - DNA, 20 bp, Artificial Sequence
  Description of Artificial Sequence: Synthetic oligonucleotide
  Target: SCN9A; (+) strand; PAM type: YTN; PAM sequence: TTA
aatgcattaatgctgttatc

SEQ ID NO: 97188 - DNA, 20 bp, Artificial Sequence
  Description of Artificial Sequence: Synthetic oligonucleotide
  Target: SCN9A; (+) strand; PAM type: YTN; PAM sequence: TTA
atgctgttatctcaggattg

SEQ ID NO: 97189 - DNA, 20 bp, Artificial Sequence
  Description of Artificial Sequence: Synthetic oligonucleotide
  Target: SCN9A; (+) strand; PAM type: YTN; PAM sequence: CTG
ttatctcaggattgagttca

SEQ ID NO: 97190 - DNA, 20 bp, Artificial Sequence
  Description of Artificial Sequence: Synthetic oligonucleotide
  Target: SCN9A; (+) strand; PAM type: YTN; PAM sequence: TTA
tctcaggattgagttcatta

SEQ ID NO: 97191 - DNA, 20 bp, Artificial Sequence
  Description of Artificial Sequence: Synthetic oligonucleotide
  Target: SCN9A; (+) strand; PAM type: YTN; PAM sequence: CTC
aggattgagttcattataaa

SEQ ID NO: 97192 - DNA, 20 bp, Artificial Sequence
  Description of Artificial Sequence: Synthetic oligonucleotide
  Target: SCN9A; (+) strand; PAM type: YTN; PAM sequence: TTG
agttcattataaacaggcag

SEQ ID NO: 97193 - DNA, 20 bp, Artificial Sequence
  Description of Artificial Sequence: Synthetic oligonucleotide
  Target: SCN9A; (+) strand; PAM type: YTN; PAM sequence: TTC
attataaacaggcaggttct

SEQ ID NO: 97194 - DNA, 20 bp, Artificial Sequence
  Description of Artificial Sequence: Synthetic oligonucleotide
  Target: SCN9A; (+) strand; PAM type: YTN; PAM sequence: TTA
taaacaggcaggttctgcct

SEQ ID NO: 97195 - DNA, 20 bp, Artificial Sequence
  Description of Artificial Sequence: Synthetic oligonucleotide
  Target: SCN9A; (+) strand; PAM type: YTN; PAM sequence: TTC
tgcctccttttctcacttat

SEQ ID NO: 97196 - DNA, 20 bp, Artificial Sequence
  Description of Artificial Sequence: Synthetic oligonucleotide
  Target: SCN9A; (+) strand; PAM type: YTN; PAM sequence: CTG
cctccttttctcacttattc

SEQ ID NO: 97197 - DNA, 20 bp, Artificial Sequence
  Description of Artificial Sequence: Synthetic oligonucleotide
  Target: SCN9A; (+) strand; PAM type: YTN; PAM sequence: CTC
cttttctcacttattctctc

SEQ ID NO: 97198 - DNA, 20 bp, Artificial Sequence
  Description of Artificial Sequence: Synthetic oligonucleotide
  Target: SCN9A; (+) strand; PAM type: YTN; PAM sequence: CTT
ttctcacttattctctcttt

SEQ ID NO: 97199 - DNA, 20 bp, Artificial Sequence
  Description of Artificial Sequence: Synthetic oligonucleotide
  Target: SCN9A; (+) strand; PAM type: YTN; PAM sequence: TTT
tctcacttattctctctttg

SEQ ID NO: 97200 - DNA, 20 bp, Artificial Sequence
  Description of Artificial Sequence: Synthetic oligonucleotide
  Target: SCN9A; (+) strand; PAM type: YTN; PAM sequence: TTT
ctcacttattctctctttgt

SEQ ID NO: 97201 - DNA, 20 bp, Artificial Sequence
  Description of Artificial Sequence: Synthetic oligonucleotide
  Target: SCN9A; (+) strand; PAM type: YTN; PAM sequence: TTC
tcacttattctctctttgtg

SEQ ID NO: 97202 - DNA, 20 bp, Artificial Sequence
  Description of Artificial Sequence: Synthetic oligonucleotide
  Target: SCN9A; (+) strand; PAM type: YTN; PAM sequence: CTC
acttattctctctttgtgcc

SEQ ID NO: 97203 - DNA, 20 bp, Artificial Sequence
  Description of Artificial Sequence: Synthetic oligonucleotide
  Target: SCN9A; (+) strand; PAM type: YTN; PAM sequence: CTT
attctctctttgtgccatgt

SEQ ID NO: 97204 - DNA, 20 bp, Artificial Sequence
  Description of Artificial Sequence: Synthetic oligonucleotide
  Target: SCN9A; (+) strand; PAM type: YTN; PAM sequence: TTA
ttctctctttgtgccatgtg

SEQ ID NO: 97205 - DNA, 20 bp, Artificial Sequence
  Description of Artificial Sequence: Synthetic oligonucleotide
  Target: SCN9A; (+) strand; PAM type: YTN; PAM sequence: TTC
tctctttgtgccatgtgtat

SEQ ID NO: 97206 - DNA, 20 bp, Artificial Sequence
  Description of Artificial Sequence: Synthetic oligonucleotide
  Target: SCN9A; (+) strand; PAM type: YTN; PAM sequence: CTC
tctttgtgccatgtgtatca

SEQ ID NO: 97207 - DNA, 20 bp, Artificial Sequence
  Description of Artificial Sequence: Synthetic oligonucleotide
  Target: SCN9A; (+) strand; PAM type: YTN; PAM sequence: CTC
tttgtgccatgtgtatcata

SEQ ID NO: 97208 - DNA, 20 bp, Artificial Sequence
  Description of Artificial Sequence: Synthetic oligonucleotide
  Target: SCN9A; (+) strand; PAM type: YTN; PAM sequence: CTT
tgtgccatgtgtatcataac

SEQ ID NO: 97209 - DNA, 20 bp, Artificial Sequence
  Description of Artificial Sequence: Synthetic oligonucleotide
  Target: SCN9A; (+) strand; PAM type: YTN; PAM sequence: TTT
gtgccatgtgtatcataaca

SEQ ID NO: 97210 - DNA, 20 bp, Artificial Sequence
  Description of Artificial Sequence: Synthetic oligonucleotide
  Target: SCN9A; (+) strand; PAM type: YTN; PAM sequence: TTG
tgccatgtgtatcataacat

SEQ ID NO: 97211 - DNA, 20 bp, Artificial Sequence
  Description of Artificial Sequence: Synthetic oligonucleotide
  Target: SCN9A; (+) strand; PAM type: YTN; PAM sequence: CTT
acagcatgttatgacacaac

SEQ ID NO: 97212 - DNA, 20 bp, Artificial Sequence
  Description of Artificial Sequence: Synthetic oligonucleotide
  Target: SCN9A; (+) strand; PAM type: YTN; PAM sequence: TTA
cagcatgttatgacacaaca

SEQ ID NO: 97213 - DNA, 20 bp, Artificial Sequence
  Description of Artificial Sequence: Synthetic oligonucleotide
  Target: SCN9A; (+) strand; PAM type: YTN; PAM sequence: TTA
tgacacaacaaataagacct

SEQ ID NO: 97214 - DNA, 20 bp, Artificial Sequence
  Description of Artificial Sequence: Synthetic oligonucleotide
  Target: SCN9A; (+) strand; PAM type: YTN; PAM sequence: CTC
accagacagcccctcagtca

SEQ ID NO: 97215 - DNA, 20 bp, Artificial Sequence
  Description of Artificial Sequence: Synthetic oligonucleotide
  Target: SCN9A; (+) strand; PAM type: YTN; PAM sequence: CTC
agtcatgaactttccatcct

SEQ ID NO: 97216 - DNA, 20 bp, Artificial Sequence
  Description of Artificial Sequence: Synthetic oligonucleotide
  Target: SCN9A; (+) strand; PAM type: YTN; PAM sequence: CTT
tccatcctccagtactgtga

SEQ ID NO: 97217 - DNA, 20 bp, Artificial Sequence
  Description of Artificial Sequence: Synthetic oligonucleotide
  Target: SCN9A; (+) strand; PAM type: YTN; PAM sequence: TTT
ccatcctccagtactgtgat

SEQ ID NO: 97218 - DNA, 20 bp, Artificial Sequence
  Description of Artificial Sequence: Synthetic oligonucleotide
  Target: SCN9A; (+) strand; PAM type: YTN; PAM sequence: TTC
catcctccagtactgtgatc

SEQ ID NO: 97219 - DNA, 20 bp, Artificial Sequence
  Description of Artificial Sequence: Synthetic oligonucleotide
  Target: SCN9A; (+) strand; PAM type: YTN; PAM sequence: CTC
cagtactgtgatcccataag

SEQ ID NO: 97220 - DNA, 20 bp, Artificial Sequence
  Description of Artificial Sequence: Synthetic oligonucleotide
  Target: SCN9A; (+) strand; PAM type: YTN; PAM sequence: CTG
tgatcccataaggtttatgt

SEQ ID NO: 97221 - DNA, 20 bp, Artificial Sequence
  Description of Artificial Sequence: Synthetic oligonucleotide
  Target: SCN9A; (+) strand; PAM type: YTN; PAM sequence: TTT
atgttcattataaattaccc

SEQ ID NO: 97222 - DNA, 20 bp, Artificial Sequence
  Description of Artificial Sequence: Synthetic oligonucleotide
  Target: SCN9A; (+) strand; PAM type: YTN; PAM sequence: TTA
tgttcattataaattaccca

SEQ ID NO: 97223 - DNA, 20 bp, Artificial Sequence
  Description of Artificial Sequence: Synthetic oligonucleotide
  Target: SCN9A; (+) strand; PAM type: YTN; PAM sequence: TTC
attataaattacccagtctg

SEQ ID NO: 97224 - DNA, 20 bp, Artificial Sequence
  Description of Artificial Sequence: Synthetic oligonucleotide
  Target: SCN9A; (+) strand; PAM type: YTN; PAM sequence: TTA
taaattacccagtctgtggt

SEQ ID NO: 97225 - DNA, 20 bp, Artificial Sequence
  Description of Artificial Sequence: Synthetic oligonucleotide
  Target: SCN9A; (+) strand; PAM type: YTN; PAM sequence: TTA
cccagtctgtggtattctgt

SEQ ID NO: 97226 - DNA, 20 bp, Artificial Sequence
  Description of Artificial Sequence: Synthetic oligonucleotide
  Target: SCN9A; (+) strand; PAM type: YTN; PAM sequence: CTG
tggtattctgttatagtagc

SEQ ID NO: 97227 - DNA, 20 bp, Artificial Sequence
  Description of Artificial Sequence: Synthetic oligonucleotide
  Target: SCN9A; (+) strand; PAM type: YTN; PAM sequence: TTC
tgttatagtagcacaaatgg

SEQ ID NO: 97228 - DNA, 20 bp, Artificial Sequence
  Description of Artificial Sequence: Synthetic oligonucleotide
  Target: SCN9A; (+) strand; PAM type: YTN; PAM sequence: CTG
ttatagtagcacaaatggat

SEQ ID NO: 97229 - DNA, 20 bp, Artificial Sequence
  Description of Artificial Sequence: Synthetic oligonucleotide
  Target: SCN9A; (+) strand; PAM type: YTN; PAM sequence: TTA
tagtagcacaaatggatgag

SEQ ID NO: 97230 - DNA, 20 bp, Artificial Sequence
  Description of Artificial Sequence: Synthetic oligonucleotide
  Target: SCN9A; (+) strand; PAM type: YTN; PAM sequence: CTT
catgataacaaagactactt

SEQ ID NO: 97231 - DNA, 20 bp, Artificial Sequence
  Description of Artificial Sequence: Synthetic oligonucleotide
  Target: SCN9A; (+) strand; PAM type: YTN; PAM sequence: TTC
atgataacaaagactacttg

SEQ ID NO: 97232 - DNA, 20 bp, Artificial Sequence
  Description of Artificial Sequence: Synthetic oligonucleotide
  Target: SCN9A; (+) strand; PAM type: YTN; PAM sequence: CTA
cttgaaaatcccacagctaa

SEQ ID NO: 97233 - DNA, 20 bp, Artificial Sequence
  Description of Artificial Sequence: Synthetic oligonucleotide
  Target: SCN9A; (+) strand; PAM type: YTN; PAM sequence: CTT
gaaaatcccacagctaacat

SEQ ID NO: 97234 - DNA, 20 bp, Artificial Sequence
  Description of Artificial Sequence: Synthetic oligonucleotide
  Target: SCN9A; (+) strand; PAM type: YTN; PAM sequence: TTG
aaaatcccacagctaacatc

SEQ ID NO: 97235 - DNA, 20 bp, Artificial Sequence
  Description of Artificial Sequence: Synthetic oligonucleotide
  Target: SCN9A; (+) strand; PAM type: YTN; PAM sequence: CTA
acatcgtattcaatggtgaa

SEQ ID NO: 97236 - DNA, 20 bp, Artificial Sequence
  Description of Artificial Sequence: Synthetic oligonucleotide
  Target: SCN9A; (+) strand; PAM type: YTN; PAM sequence: TTC
aatggtgaaaaactgaaaaa

SEQ ID NO: 97237 - DNA, 20 bp, Artificial Sequence
  Description of Artificial Sequence: Synthetic oligonucleotide
  Target: SCN9A; (+) strand; PAM type: YTN; PAM sequence: CTG
aaaaactttcctgtaagatc

SEQ ID NO: 97238 - DNA, 20 bp, Artificial Sequence
  Description of Artificial Sequence: Synthetic oligonucleotide
  Target: SCN9A; (+) strand; PAM type: YTN; PAM sequence: CTT
tcctgtaagatcaggaataa

SEQ ID NO: 97239 - DNA, 20 bp, Artificial Sequence
  Description of Artificial Sequence: Synthetic oligonucleotide
  Target: SCN9A; (+) strand; PAM type: YTN; PAM sequence: TTT
cctgtaagatcaggaataag

SEQ ID NO: 97240 - DNA, 20 bp, Artificial Sequence
  Description of Artificial Sequence: Synthetic oligonucleotide
  Target: SCN9A; (+) strand; PAM type: YTN; PAM sequence: TTC
ctgtaagatcaggaataaga

SEQ ID NO: 97241 - DNA, 20 bp, Artificial Sequence
  Description of Artificial Sequence: Synthetic oligonucleotide
  Target: SCN9A; (+) strand; PAM type: YTN; PAM sequence: CTG
taagatcaggaataagacaa

SEQ ID NO: 97242 - DNA, 20 bp, Artificial Sequence
  Description of Artificial Sequence: Synthetic oligonucleotide
  Target: SCN9A; (+) strand; PAM type: YTN; PAM sequence: CTA
ctcttgccacttgtatttaa

SEQ ID NO: 97243 - DNA, 20 bp, Artificial Sequence
  Description of Artificial Sequence: Synthetic oligonucleotide
  Target: SCN9A; (+) strand; PAM type: YTN; PAM sequence: CTC
ttgccacttgtatttaacac

SEQ ID NO: 97244 - DNA, 20 bp, Artificial Sequence
  Description of Artificial Sequence: Synthetic oligonucleotide
  Target: SCN9A; (+) strand; PAM type: YTN; PAM sequence: CTT
gccacttgtatttaacacag

SEQ ID NO: 97245 - DNA, 20 bp, Artificial Sequence
  Description of Artificial Sequence: Synthetic oligonucleotide
  Target: SCN9A; (+) strand; PAM type: YTN; PAM sequence: TTG
ccacttgtatttaacacagc

SEQ ID NO: 97246 - DNA, 20 bp, Artificial Sequence
  Description of Artificial Sequence: Synthetic oligonucleotide
  Target: SCN9A; (+) strand; PAM type: YTN; PAM sequence: CTT
gtatttaacacagcactaga

SEQ ID NO: 97247 - DNA, 20 bp, Artificial Sequence
  Description of Artificial Sequence: Synthetic oligonucleotide
  Target: SCN9A; (+) strand; PAM type: YTN; PAM sequence: TTG
tatttaacacagcactagaa

SEQ ID NO: 97248 - DNA, 20 bp, Artificial Sequence
  Description of Artificial Sequence: Synthetic oligonucleotide
  Target: SCN9A; (+) strand; PAM type: YTN; PAM sequence: TTT
aacacagcactagaagtcct

SEQ ID NO: 97249 - DNA, 20 bp, Artificial Sequence
  Description of Artificial Sequence: Synthetic oligonucleotide
  Target: SCN9A; (+) strand; PAM type: YTN; PAM sequence: TTA
acacagcactagaagtccta

SEQ ID NO: 97250 - DNA, 20 bp, Artificial Sequence
  Description of Artificial Sequence: Synthetic oligonucleotide
  Target: SCN9A; (+) strand; PAM type: YTN; PAM sequence: CTA
gaagtcctagccagagaaat

SEQ ID NO: 97251 - DNA, 20 bp, Artificial Sequence
  Description of Artificial Sequence: Synthetic oligonucleotide
  Target: SCN9A; (+) strand; PAM type: YTN; PAM sequence: CTA
gccagagaaattaggcaaga

SEQ ID NO: 97252 - DNA, 20 bp, Artificial Sequence
  Description of Artificial Sequence: Synthetic oligonucleotide
  Target: SCN9A; (+) strand; PAM type: YTN; PAM sequence: TTA
ggcaagaaaaacaagtaaaa

SEQ ID NO: 97253 - DNA, 20 bp, Artificial Sequence
  Description of Artificial Sequence: Synthetic oligonucleotide
  Target: SCN9A; (+) strand; PAM type: YTN; PAM sequence: CTG
aaagaaaaaagtgtttacag

SEQ ID NO: 97254 - DNA, 20 bp, Artificial Sequence
  Description of Artificial Sequence: Synthetic oligonucleotide
  Target: SCN9A; (+) strand; PAM type: YTN; PAM sequence: TTT
acagatgacattattttata

SEQ ID NO: 97255 - DNA, 20 bp, Artificial Sequence
  Description of Artificial Sequence: Synthetic oligonucleotide
  Target: SCN9A; (+) strand; PAM type: YTN; PAM sequence: TTA
cagatgacattattttatat

SEQ ID NO: 97256 - DNA, 20 bp, Artificial Sequence
  Description of Artificial Sequence: Synthetic oligonucleotide
  Target: SCN9A; (+) strand; PAM type: YTN; PAM sequence: TTA
ttttatatggagagtaccct

SEQ ID NO: 97257 - DNA, 20 bp, Artificial Sequence
  Description of Artificial Sequence: Synthetic oligonucleotide
  Target: SCN9A; (+) strand; PAM type: YTN; PAM sequence: TTT
tatatggagagtaccctaaa

SEQ ID NO: 97258 - DNA, 20 bp, Artificial Sequence
  Description of Artificial Sequence: Synthetic oligonucleotide
  Target: SCN9A; (+) strand; PAM type: YTN; PAM sequence: TTT
atatggagagtaccctaaag

SEQ ID NO: 97259 - DNA, 20 bp, Artificial Sequence
  Description of Artificial Sequence: Synthetic oligonucleotide
  Target: SCN9A; (+) strand; PAM type: YTN; PAM sequence: TTA
tatggagagtaccctaaaga

SEQ ID NO: 97260 - DNA, 20 bp, Artificial Sequence
  Description of Artificial Sequence: Synthetic oligonucleotide
  Target: SCN9A; (+) strand; PAM type: YTN; PAM sequence: CTA
aagactccacacatcaggaa

SEQ ID NO: 97261 - DNA, 20 bp, Artificial Sequence
  Description of Artificial Sequence: Synthetic oligonucleotide
  Target: SCN9A; (+) strand; PAM type: YTN; PAM sequence: CTC
cacacatcaggaaaatctgt

SEQ ID NO: 97262 - DNA, 20 bp, Artificial Sequence
  Description of Artificial Sequence: Synthetic oligonucleotide
  Target: SCN9A; (+) strand; PAM type: YTN; PAM sequence: CTG
ttagaactaataaacaaatt

SEQ ID NO: 97263 - DNA, 20 bp, Artificial Sequence
  Description of Artificial Sequence: Synthetic oligonucleotide
  Target: SCN9A; (+) strand; PAM type: YTN; PAM sequence: TTA
gaactaataaacaaatttac

SEQ ID NO: 97264 - DNA, 20 bp, Artificial Sequence
  Description of Artificial Sequence: Synthetic oligonucleotide
  Target: SCN9A; (+) strand; PAM type: YTN; PAM sequence: CTA
ataaacaaatttactagatg

SEQ ID NO: 97265 - DNA, 20 bp, Artificial Sequence
  Description of Artificial Sequence: Synthetic oligonucleotide
  Target: SCN9A; (+) strand; PAM type: YTN; PAM sequence: TTT
actagatgttgaaggatata

SEQ ID NO: 97266 - DNA, 20 bp, Artificial Sequence
  Description of Artificial Sequence: Synthetic oligonucleotide
  Target: SCN9A; (+) strand; PAM type: YTN; PAM sequence: TTA
ctagatgttgaaggatataa

SEQ ID NO: 97267 - DNA, 20 bp, Artificial Sequence
  Description of Artificial Sequence: Synthetic oligonucleotide
  Target: SCN9A; (+) strand; PAM type: YTN; PAM sequence: CTA
gatgttgaaggatataaaat

SEQ ID NO: 97268 - DNA, 20 bp, Artificial Sequence
  Description of Artificial Sequence: Synthetic oligonucleotide
  Target: SCN9A; (+) strand; PAM type: YTN; PAM sequence: TTG
aaggatataaaatcaacata

SEQ ID NO: 97269 - DNA, 20 bp, Artificial Sequence
  Description of Artificial Sequence: Synthetic oligonucleotide
  Target: SCN9A; (+) strand; PAM type: YTN; PAM sequence: CTG
cgtttctatacactaacaat

SEQ ID NO: 97270 - DNA, 20 bp, Artificial Sequence
  Description of Artificial Sequence: Synthetic oligonucleotide
  Target: SCN9A; (+) strand; PAM type: YTN; PAM sequence: TTT
ctatacactaacaataaaca

SEQ ID NO: 97271 - DNA, 20 bp, Artificial Sequence
  Description of Artificial Sequence: Synthetic oligonucleotide
  Target: SCN9A; (+) strand; PAM type: YTN; PAM sequence: TTC
tatacactaacaataaacaa

SEQ ID NO: 97272 - DNA, 20 bp, Artificial Sequence
  Description of Artificial Sequence: Synthetic oligonucleotide
  Target: SCN9A; (+) strand; PAM type: YTN; PAM sequence: CTA
tacactaacaataaacaatc

SEQ ID NO: 97273 - DNA, 20 bp, Artificial Sequence
  Description of Artificial Sequence: Synthetic oligonucleotide
  Target: SCN9A; (+) strand; PAM type: YTN; PAM sequence: CTA
acaataaacaatctgaagag

SEQ ID NO: 97274 - DNA, 20 bp, Artificial Sequence
  Description of Artificial Sequence: Synthetic oligonucleotide
  Target: SCN9A; (+) strand; PAM type: YTN; PAM sequence: CTG
aagagaaaattaggaaagaa

SEQ ID NO: 97275 - DNA, 20 bp, Artificial Sequence
  Description of Artificial Sequence: Synthetic oligonucleotide
  Target: SCN9A; (+) strand; PAM type: YTN; PAM sequence: TTA
ggaaagaaatcccatttatg

SEQ ID NO: 97276 - DNA, 20 bp, Artificial Sequence
  Description of Artificial Sequence: Synthetic oligonucleotide
  Target: SCN9A; (+) strand; PAM type: YTN; PAM sequence: TTT
atgataacatcaaaagaaat

SEQ ID NO: 97277 - DNA, 20 bp, Artificial Sequence
  Description of Artificial Sequence: Synthetic oligonucleotide
  Target: SCN9A; (+) strand; PAM type: YTN; PAM sequence: TTA
tgataacatcaaaagaaata

SEQ ID NO: 97278 - DNA, 20 bp, Artificial Sequence
  Description of Artificial Sequence: Synthetic oligonucleotide
  Target: SCN9A; (+) strand; PAM type: YTN; PAM sequence: CTT
aggatatgcttaaccaaggc

SEQ ID NO: 97279 - DNA, 20 bp, Artificial Sequence
  Description of Artificial Sequence: Synthetic oligonucleotide
  Target: SCN9A; (+) strand; PAM type: YTN; PAM sequence: TTA
ggatatgcttaaccaaggca

SEQ ID NO: 97280 - DNA, 20 bp, Artificial Sequence
  Description of Artificial Sequence: Synthetic oligonucleotide
  Target: SCN9A; (+) strand; PAM type: YTN; PAM sequence: CTT
aaccaaggcattgaaaatgt

SEQ ID NO: 97281 - DNA, 20 bp, Artificial Sequence
  Description of Artificial Sequence: Synthetic oligonucleotide
  Target: SCN9A; (+) strand; PAM type: YTN; PAM sequence: TTA
accaaggcattgaaaatgta

SEQ ID NO: 97282 - DNA, 20 bp, Artificial Sequence
  Description of Artificial Sequence: Synthetic oligonucleotide
  Target: SCN9A; (+) strand; PAM type: YTN; PAM sequence: TTG
aaaatgtatgcactgaaaac

SEQ ID NO: 97283 - DNA, 20 bp, Artificial Sequence
  Description of Artificial Sequence: Synthetic oligonucleotide
  Target: SCN9A; (+) strand; PAM type: YTN; PAM sequence: CTG
aaaactacaaaatgttcatg

SEQ ID NO: 97284 - DNA, 20 bp, Artificial Sequence
  Description of Artificial Sequence: Synthetic oligonucleotide
  Target: SCN9A; (+) strand; PAM type: YTN; PAM sequence: CTA
caaaatgttcatgaaggaaa

SEQ ID NO: 97285 - DNA, 20 bp, Artificial Sequence
  Description of Artificial Sequence: Synthetic oligonucleotide
  Target: SCN9A; (+) strand; PAM type: YTN; PAM sequence: TTC
atgaaggaaattaaagaaga

SEQ ID NO: 97286 - DNA, 20 bp, Artificial Sequence
  Description of Artificial Sequence: Synthetic oligonucleotide
  Target: SCN9A; (+) strand; PAM type: YTN; PAM sequence: TTA
aagaagacacaaataaatgg

SEQ ID NO: 97287 - DNA, 20 bp, Artificial Sequence
  Description of Artificial Sequence: Synthetic oligonucleotide
  Target: SCN9A; (+) strand; PAM type: YTN; PAM sequence: TTC
acgaattaaatgacttaata

SEQ ID NO: 97288 - DNA, 20 bp, Artificial Sequence
  Description of Artificial Sequence: Synthetic oligonucleotide
  Target: SCN9A; (+) strand; PAM type: YTN; PAM sequence: TTA
aatgacttaatattgttaaa

SEQ ID NO: 97289 - DNA, 20 bp, Artificial Sequence
  Description of Artificial Sequence: Synthetic oligonucleotide
  Target: SCN9A; (+) strand; PAM type: YTN; PAM sequence: CTT
aatattgttaaaatgcccat

SEQ ID NO: 97290 - DNA, 20 bp, Artificial Sequence
  Description of Artificial Sequence: Synthetic oligonucleotide
  Target: SCN9A; (+) strand; PAM type: YTN; PAM sequence: TTA
atattgttaaaatgcccata

SEQ ID NO: 97291 - DNA, 20 bp, Artificial Sequence
  Description of Artificial Sequence: Synthetic oligonucleotide
  Target: SCN9A; (+) strand; PAM type: YTN; PAM sequence: TTG
ttaaaatgcccatactaccc

SEQ ID NO: 97292 - DNA, 20 bp, Artificial Sequence
  Description of Artificial Sequence: Synthetic oligonucleotide
  Target: SCN9A; (+) strand; PAM type: YTN; PAM sequence: TTA
aaatgcccatactaccctaa

SEQ ID NO: 97293 - DNA, 20 bp, Artificial Sequence
  Description of Artificial Sequence: Synthetic oligonucleotide
  Target: SCN9A; (+) strand; PAM type: YTN; PAM sequence: CTA
ccctaagtgatctgtgaatt

SEQ ID NO: 97294 - DNA, 20 bp, Artificial Sequence
  Description of Artificial Sequence: Synthetic oligonucleotide
  Target: SCN9A; (+) strand; PAM type: YTN; PAM sequence: CTA
agtgatctgtgaattcaata

SEQ ID NO: 97295 - DNA, 20 bp, Artificial Sequence
  Description of Artificial Sequence: Synthetic oligonucleotide
  Target: SCN9A; (+) strand; PAM type: YTN; PAM sequence: CTG
tgaattcaatacagtacata

SEQ ID NO: 97296 - DNA, 20 bp, Artificial Sequence
  Description of Artificial Sequence: Synthetic oligonucleotide
  Target: SCN9A; (+) strand; PAM type: YTN; PAM sequence: TTC
aatacagtacatatcaaaat

SEQ ID NO: 97297 - DNA, 20 bp, Artificial Sequence
  Description of Artificial Sequence: Synthetic oligonucleotide
  Target: SCN9A; (+) strand; PAM type: YTN; PAM sequence: TTA
tttactaaaataaaaaaaga

SEQ ID NO: 97298 - DNA, 20 bp, Artificial Sequence
  Description of Artificial Sequence: Synthetic oligonucleotide
  Target: SCN9A; (+) strand; PAM type: YTN; PAM sequence: TTT
actaaaataaaaaaagatcc

SEQ ID NO: 97299 - DNA, 20 bp, Artificial Sequence
  Description of Artificial Sequence: Synthetic oligonucleotide
  Target: SCN9A; (+) strand; PAM type: YTN; PAM sequence: TTA
ctaaaataaaaaaagatcct

SEQ ID NO: 97300 - DNA, 20 bp, Artificial Sequence
  Description of Artificial Sequence: Synthetic oligonucleotide
  Target: SCN9A; (+) strand; PAM type: YTN; PAM sequence: CTA
aaataaaaaaagatcctaaa

SEQ ID NO: 97301 - DNA, 20 bp, Artificial Sequence
  Description of Artificial Sequence: Synthetic oligonucleotide
  Target: SCN9A; (+) strand; PAM type: YTN; PAM sequence: CTA
aaattcatatggaaccacaa

SEQ ID NO: 97302 - DNA, 20 bp, Artificial Sequence
  Description of Artificial Sequence: Synthetic oligonucleotide
  Target: SCN9A; (+) strand; PAM type: YTN; PAM sequence: TTC
atatggaaccacaaaagact

SEQ ID NO: 97303 - DNA, 20 bp, Artificial Sequence
  Description of Artificial Sequence: Synthetic oligonucleotide
  Target: SCN9A; (+) strand; PAM type: YTN; PAM sequence: CTC
tgaatagccaaagcaatctt

SEQ ID NO: 97304 - DNA, 20 bp, Artificial Sequence
  Description of Artificial Sequence: Synthetic oligonucleotide
  Target: SCN9A; (+) strand; PAM type: YTN; PAM sequence: CTG
aatagccaaagcaatcttaa

SEQ ID NO: 97305 - DNA, 20 bp, Artificial Sequence
  Description of Artificial Sequence: Synthetic oligonucleotide
  Target: SCN9A; (+) strand; PAM type: YTN; PAM sequence: CTT
aagaaaaaagaacaaaatgg

SEQ ID NO: 97306 - DNA, 20 bp, Artificial Sequence
  Description of Artificial Sequence: Synthetic oligonucleotide
  Target: SCN9A; (+) strand; PAM type: YTN; PAM sequence: TTA
agaaaaaagaacaaaatgga

SEQ ID NO: 97307 - DNA, 20 bp, Artificial Sequence
  Description of Artificial Sequence: Synthetic oligonucleotide
  Target: SCN9A; (+) strand; PAM type: YTN; PAM sequence: TTT
tctcatttcttatttattta

SEQ ID NO: 97308 - DNA, 20 bp, Artificial Sequence
  Description of Artificial Sequence: Synthetic oligonucleotide
  Target: SCN9A; (+) strand; PAM type: YTN; PAM sequence: TTT
ctcatttcttatttatttat

SEQ ID NO: 97309 - DNA, 20 bp, Artificial Sequence
  Description of Artificial Sequence: Synthetic oligonucleotide
  Target: SCN9A; (+) strand; PAM type: YTN; PAM sequence: TTC
tcatttcttatttatttatt

SEQ ID NO: 97310 - DNA, 20 bp, Artificial Sequence
  Description of Artificial Sequence: Synthetic oligonucleotide
  Target: SCN9A; (+) strand; PAM type: YTN; PAM sequence: CTC
atttcttatttatttattta

SEQ ID NO: 97311 - DNA, 20 bp, Artificial Sequence
  Description of Artificial Sequence: Synthetic oligonucleotide
  Target: SCN9A; (+) strand; PAM type: YTN; PAM sequence: TTT
cttatttatttatttattga

SEQ ID NO: 97312 - DNA, 20 bp, Artificial Sequence
  Description of Artificial Sequence: Synthetic oligonucleotide
  Target: SCN9A; (+) strand; PAM type: YTN; PAM sequence: TTC
ttatttatttatttattgag

SEQ ID NO: 97313 - DNA, 20 bp, Artificial Sequence
  Description of Artificial Sequence: Synthetic oligonucleotide
  Target: SCN9A; (+) strand; PAM type: YTN; PAM sequence: CTT
atttatttatttattgagag

SEQ ID NO: 97314 - DNA, 20 bp, Artificial Sequence
  Description of Artificial Sequence: Synthetic oligonucleotide
  Target: SCN9A; (+) strand; PAM type: YTN; PAM sequence: TTA
tttatttatttattgagaga

SEQ ID NO: 97315 - DNA, 20 bp, Artificial Sequence
  Description of Artificial Sequence: Synthetic oligonucleotide
  Target: SCN9A; (+) strand; PAM type: YTN; PAM sequence: TTT
atttatttattgagagagaa

SEQ ID NO: 97316 - DNA, 20 bp, Artificial Sequence
  Description of Artificial Sequence: Synthetic oligonucleotide
  Target: SCN9A; (+) strand; PAM type: YTN; PAM sequence: TTA
tttatttattgagagagaag

SEQ ID NO: 97317 - DNA, 20 bp, Artificial Sequence
  Description of Artificial Sequence: Synthetic oligonucleotide
  Target: SCN9A; (+) strand; PAM type: YTN; PAM sequence: TTT
atttattgagagagaagatc

SEQ ID NO: 97318 - DNA, 20 bp, Artificial Sequence
  Description of Artificial Sequence: Synthetic oligonucleotide
  Target: SCN9A; (+) strand; PAM type: YTN; PAM sequence: TTA
tttattgagagagaagatct

SEQ ID NO: 97319 - DNA, 20 bp, Artificial Sequence
  Description of Artificial Sequence: Synthetic oligonucleotide
  Target: SCN9A; (+) strand; PAM type: YTN; PAM sequence: TTT
attgagagagaagatctcac

SEQ ID NO: 97320 - DNA, 20 bp, Artificial Sequence
  Description of Artificial Sequence: Synthetic oligonucleotide
  Target: SCN9A; (+) strand; PAM type: YTN; PAM sequence: TTA
ttgagagagaagatctcacc

SEQ ID NO: 97321 - DNA, 20 bp, Artificial Sequence
  Description of Artificial Sequence: Synthetic oligonucleotide
  Target: SCN9A; (+) strand; PAM type: YTN; PAM sequence: TTG
agagagaagatctcaccctg

SEQ ID NO: 97322 - DNA, 20 bp, Artificial Sequence
  Description of Artificial Sequence: Synthetic oligonucleotide
  Target: SCN9A; (+) strand; PAM type: YTN; PAM sequence: CTC
accctgttgcccaggccaga

SEQ ID NO: 97323 - DNA, 20 bp, Artificial Sequence
  Description of Artificial Sequence: Synthetic oligonucleotide
  Target: SCN9A; (+) strand; PAM type: YTN; PAM sequence: CTG
ttgcccaggccagagtgcag

SEQ ID NO: 97324 - DNA, 20 bp, Artificial Sequence
  Description of Artificial Sequence: Synthetic oligonucleotide
  Target: SCN9A; (+) strand; PAM type: YTN; PAM sequence: TTG
cccaggccagagtgcagtgg

SEQ ID NO: 97325 - DNA, 20 bp, Artificial Sequence
  Description of Artificial Sequence: Synthetic oligonucleotide
  Target: SCN9A; (+) strand; PAM type: YTN; PAM sequence: CTC
actgcagcctcatactcttg

SEQ ID NO: 97326 - DNA, 20 bp, Artificial Sequence
  Description of Artificial Sequence: Synthetic oligonucleotide
  Target: SCN9A; (+) strand; PAM type: YTN; PAM sequence: CTG
cagcctcatactcttgggct

SEQ ID NO: 97327 - DNA, 20 bp, Artificial Sequence
  Description of Artificial Sequence: Synthetic oligonucleotide
  Target: SCN9A; (+) strand; PAM type: YTN; PAM sequence: CTC
atactcttgggcttcagtga

SEQ ID NO: 97328 - DNA, 20 bp, Artificial Sequence
  Description of Artificial Sequence: Synthetic oligonucleotide
  Target: SCN9A; (+) strand; PAM type: YTN; PAM sequence: CTC
ttgggcttcagtgatcctcc

SEQ ID NO: 97329 - DNA, 20 bp, Artificial Sequence
  Description of Artificial Sequence: Synthetic oligonucleotide
  Target: SCN9A; (+) strand; PAM type: YTN; PAM sequence: CTT
gggcttcagtgatcctccca

SEQ ID NO: 97330 - DNA, 20 bp, Artificial Sequence
  Description of Artificial Sequence: Synthetic oligonucleotide
  Target: SCN9A; (+) strand; PAM type: YTN; PAM sequence: TTG
ggcttcagtgatcctcccac

SEQ ID NO: 97331 - DNA, 20 bp, Artificial Sequence
  Description of Artificial Sequence: Synthetic oligonucleotide
  Target: SCN9A; (+) strand; PAM type: YTN; PAM sequence: CTT
cagtgatcctcccacctcag

SEQ ID NO: 97332 - DNA, 20 bp, Artificial Sequence
  Description of Artificial Sequence: Synthetic oligonucleotide
  Target: SCN9A; (+) strand; PAM type: YTN; PAM sequence: TTC
agtgatcctcccacctcagg

SEQ ID NO: 97333 - DNA, 20 bp, Artificial Sequence
  Description of Artificial Sequence: Synthetic oligonucleotide
  Target: SCN9A; (+) strand; PAM type: YTN; PAM sequence: CTC
ccacctcaggctcctaagta

SEQ ID NO: 97334 - DNA, 20 bp, Artificial Sequence
  Description of Artificial Sequence: Synthetic oligonucleotide
  Target: SCN9A; (+) strand; PAM type: YTN; PAM sequence: CTC
aggctcctaagtagctagga

SEQ ID NO: 97335 - DNA, 20 bp, Artificial Sequence
  Description of Artificial Sequence: Synthetic oligonucleotide
  Target: SCN9A; (+) strand; PAM type: YTN; PAM sequence: CTC
ctaagtagctaggactatag

SEQ ID NO: 97336 - DNA, 20 bp, Artificial Sequence
  Description of Artificial Sequence: Synthetic oligonucleotide
  Target: SCN9A; (+) strand; PAM type: YTN; PAM sequence: CTA
agtagctaggactataggtg

SEQ ID NO: 97337 - DNA, 20 bp, Artificial Sequence
  Description of Artificial Sequence: Synthetic oligonucleotide
  Target: SCN9A; (+) strand; PAM type: YTN; PAM sequence: CTA
ggactataggtgtgtgccat

SEQ ID NO: 97338 - DNA, 20 bp, Artificial Sequence
  Description of Artificial Sequence: Synthetic oligonucleotide
  Target: SCN9A; (+) strand; PAM type: YTN; PAM sequence: CTA
taggtgtgtgccatcatgct

SEQ ID NO: 97339 - DNA, 20 bp, Artificial Sequence
  Description of Artificial Sequence: Synthetic oligonucleotide
  Target: SCN9A; (+) strand; PAM type: YTN; PAM sequence: CTT
ggctacttttcaaatatctt

SEQ ID NO: 97340 - DNA, 20 bp, Artificial Sequence
  Description of Artificial Sequence: Synthetic oligonucleotide
  Target: SCN9A; (+) strand; PAM type: YTN; PAM sequence: TTG
gctacttttcaaatatcttc

SEQ ID NO: 97341 - DNA, 20 bp, Artificial Sequence
  Description of Artificial Sequence: Synthetic oligonucleotide
  Target: SCN9A; (+) strand; PAM type: YTN; PAM sequence: CTA
cttttcaaatatcttcgtaa

SEQ ID NO: 97342 - DNA, 20 bp, Artificial Sequence
  Description of Artificial Sequence: Synthetic oligonucleotide
  Target: SCN9A; (+) strand; PAM type: YTN; PAM sequence: CTT
ttcaaatatcttcgtaaaga

SEQ ID NO: 97343 - DNA, 20 bp, Artificial Sequence
  Description of Artificial Sequence: Synthetic oligonucleotide
  Target: SCN9A; (+) strand; PAM type: YTN; PAM sequence: TTT
tcaaatatcttcgtaaagaa

SEQ ID NO: 97344 - DNA, 20 bp, Artificial Sequence
  Description of Artificial Sequence: Synthetic oligonucleotide
  Target: SCN9A; (+) strand; PAM type: YTN; PAM sequence: TTT
caaatatcttcgtaaagaag

SEQ ID NO: 97345 - DNA, 20 bp, Artificial Sequence
  Description of Artificial Sequence: Synthetic oligonucleotide
  Target: SCN9A; (+) strand; PAM type: YTN; PAM sequence: TTC
aaatatcttcgtaaagaagg

SEQ ID NO: 97346 - DNA, 20 bp, Artificial Sequence
  Description of Artificial Sequence: Synthetic oligonucleotide
  Target: SCN9A; (+) strand; PAM type: YTN; PAM sequence: CTT
cgtaaagaaggagtctatct

SEQ ID NO: 97347 - DNA, 20 bp, Artificial Sequence
  Description of Artificial Sequence: Synthetic oligonucleotide
  Target: SCN9A; (+) strand; PAM type: YTN; PAM sequence: TTC
gtaaagaaggagtctatctt

SEQ ID NO: 97348 - DNA, 20 bp, Artificial Sequence
  Description of Artificial Sequence: Synthetic oligonucleotide
  Target: SCN9A; (+) strand; PAM type: YTN; PAM sequence: CTA
tcttgcccaggctggtctca

SEQ ID NO: 97349 - DNA, 20 bp, Artificial Sequence
  Description of Artificial Sequence: Synthetic oligonucleotide
  Target: SCN9A; (+) strand; PAM type: YTN; PAM sequence: CTT
gcccaggctggtctcaaact

SEQ ID NO: 97350 - DNA, 20 bp, Artificial Sequence
  Description of Artificial Sequence: Synthetic oligonucleotide
  Target: SCN9A; (+) strand; PAM type: YTN; PAM sequence: TTG
cccaggctggtctcaaactc

SEQ ID NO: 97351 - DNA, 20 bp, Artificial Sequence
  Description of Artificial Sequence: Synthetic oligonucleotide
  Target: SCN9A; (+) strand; PAM type: YTN; PAM sequence: CTG
gtctcaaactcttggccaca

SEQ ID NO: 97352 - DNA, 20 bp, Artificial Sequence
  Description of Artificial Sequence: Synthetic oligonucleotide
  Target: SCN9A; (+) strand; PAM type: YTN; PAM sequence: CTC
aaactcttggccacaagtga

SEQ ID NO: 97353 - DNA, 20 bp, Artificial Sequence
  Description of Artificial Sequence: Synthetic oligonucleotide
  Target: SCN9A; (+) strand; PAM type: YTN; PAM sequence: CTC
ttggccacaagtgatcctcc

SEQ ID NO: 97354 - DNA, 20 bp, Artificial Sequence
  Description of Artificial Sequence: Synthetic oligonucleotide
  Target: SCN9A; (+) strand; PAM type: YTN; PAM sequence: CTT
ggccacaagtgatcctccag

SEQ ID NO: 97355 - DNA, 20 bp, Artificial Sequence
  Description of Artificial Sequence: Synthetic oligonucleotide
  Target: SCN9A; (+) strand; PAM type: YTN; PAM sequence: TTG
gccacaagtgatcctccagc

SEQ ID NO: 97356 - DNA, 20 bp, Artificial Sequence
  Description of Artificial Sequence: Synthetic oligonucleotide
  Target: SCN9A; (+) strand; PAM type: YTN; PAM sequence: CTC
cagccttagcctcccgagtt

SEQ ID NO: 97357 - DNA, 20 bp, Artificial Sequence
  Description of Artificial Sequence: Synthetic oligonucleotide
  Target: SCN9A; (+) strand; PAM type: YTN; PAM sequence: CTT
agcctcccgagttgctggga

SEQ ID NO: 97358 - DNA, 20 bp, Artificial Sequence
  Description of Artificial Sequence: Synthetic oligonucleotide
  Target: SCN9A; (+) strand; PAM type: YTN; PAM sequence: TTA
gcctcccgagttgctgggat

SEQ ID NO: 97359 - DNA, 20 bp, Artificial Sequence
  Description of Artificial Sequence: Synthetic oligonucleotide
  Target: SCN9A; (+) strand; PAM type: YTN; PAM sequence: CTC
ccgagttgctgggattataa

SEQ ID NO: 97360 - DNA, 20 bp, Artificial Sequence
  Description of Artificial Sequence: Synthetic oligonucleotide
  Target: SCN9A; (+) strand; PAM type: YTN; PAM sequence: TTG
ctgggattataagcatgagc

SEQ ID NO: 97361 - DNA, 20 bp, Artificial Sequence
  Description of Artificial Sequence: Synthetic oligonucleotide
  Target: SCN9A; (+) strand; PAM type: YTN; PAM sequence: CTG
ggattataagcatgagccat

SEQ ID NO: 97362 - DNA, 20 bp, Artificial Sequence
  Description of Artificial Sequence: Synthetic oligonucleotide
  Target: SCN9A; (+) strand; PAM type: YTN; PAM sequence: TTA
taagcatgagccattgcacc

SEQ ID NO: 97363 - DNA, 20 bp, Artificial Sequence
  Description of Artificial Sequence: Synthetic oligonucleotide
  Target: SCN9A; (+) strand; PAM type: YTN; PAM sequence: TTG
cacccagtccccacaggtcc

SEQ ID NO: 97364 - DNA, 20 bp, Artificial Sequence
  Description of Artificial Sequence: Synthetic oligonucleotide
  Target: SCN9A; (+) strand; PAM type: YTN; PAM sequence: CTC
atttcaaaatgtataacaaa

SEQ ID NO: 97365 - DNA, 20 bp, Artificial Sequence
  Description of Artificial Sequence: Synthetic oligonucleotide
  Target: SCN9A; (+) strand; PAM type: YTN; PAM sequence: TTT
caaaatgtataacaaagcta

SEQ ID NO: 97366 - DNA, 20 bp, Artificial Sequence
  Description of Artificial Sequence: Synthetic oligonucleotide
  Target: SCN9A; (+) strand; PAM type: YTN; PAM sequence: TTC
aaaatgtataacaaagctac

SEQ ID NO: 97367 - DNA, 20 bp, Artificial Sequence
  Description of Artificial Sequence: Synthetic oligonucleotide
  Target: SCN9A; (+) strand; PAM type: YTN; PAM sequence: CTA
caacaattaaaatagtatgg

SEQ ID NO: 97368 - DNA, 20 bp, Artificial Sequence
  Description of Artificial Sequence: Synthetic oligonucleotide
  Target: SCN9A; (+) strand; PAM type: YTN; PAM sequence: TTA
aaatagtatggtcctggcat

SEQ ID NO: 97369 - DNA, 20 bp, Artificial Sequence
  Description of Artificial Sequence: Synthetic oligonucleotide
  Target: SCN9A; (+) strand; PAM type: YTN; PAM sequence: CTG
gcataaaacaaatatatagg

SEQ ID NO: 97370 - DNA, 20 bp, Artificial Sequence
  Description of Artificial Sequence: Synthetic oligonucleotide
  Target: SCN9A; (+) strand; PAM type: YTN; PAM sequence: TTA
actcatattcaacaggggtg

SEQ ID NO: 97371 - DNA, 20 bp, Artificial Sequence
  Description of Artificial Sequence: Synthetic oligonucleotide
  Target: SCN9A; (+) strand; PAM type: YTN; PAM sequence: CTC
atattcaacaggggtgccaa

SEQ ID NO: 97372 - DNA, 20 bp, Artificial Sequence
  Description of Artificial Sequence: Synthetic oligonucleotide
  Target: SCN9A; (+) strand; PAM type: YTN; PAM sequence: TTC
aacaggggtgccaagaatac

SEQ ID NO: 97373 - DNA, 20 bp, Artificial Sequence
  Description of Artificial Sequence: Synthetic oligonucleotide
  Target: SCN9A; (+) strand; PAM type: YTN; PAM sequence: CTC
aacaaataatgttgggaaaa

SEQ ID NO: 97374 - DNA, 20 bp, Artificial Sequence
  Description of Artificial Sequence: Synthetic oligonucleotide
  Target: SCN9A; (+) strand; PAM type: YTN; PAM sequence: TTG
ggaaaactggatattcacat

SEQ ID NO: 97375 - DNA, 20 bp, Artificial Sequence
  Description of Artificial Sequence: Synthetic oligonucleotide
  Target: SCN9A; (+) strand; PAM type: YTN; PAM sequence: CTG
gatattcacatataaaaaaa

SEQ ID NO: 97376 - DNA, 20 bp, Artificial Sequence
  Description of Artificial Sequence: Synthetic oligonucleotide
  Target: SCN9A; (+) strand; PAM type: YTN; PAM sequence: TTC
acatataaaaaaataaaatt

SEQ ID NO: 97377 - DNA, 20 bp, Artificial Sequence
  Description of Artificial Sequence: Synthetic oligonucleotide
  Target: SCN9A; (+) strand; PAM type: YTN; PAM sequence: TTG
aattcttatattataccata

SEQ ID NO: 97378 - DNA, 20 bp, Artificial Sequence
  Description of Artificial Sequence: Synthetic oligonucleotide
  Target: SCN9A; (+) strand; PAM type: YTN; PAM sequence: TTC
ttatattataccatacacaa

SEQ ID NO: 97379 - DNA, 20 bp, Artificial Sequence
  Description of Artificial Sequence: Synthetic oligonucleotide
  Target: SCN9A; (+) strand; PAM type: YTN; PAM sequence: CTT
atattataccatacacaaaa

SEQ ID NO: 97380 - DNA, 20 bp, Artificial Sequence
  Description of Artificial Sequence: Synthetic oligonucleotide
  Target: SCN9A; (+) strand; PAM type: YTN; PAM sequence: TTA
tattataccatacacaaaaa

SEQ ID NO: 97381 - DNA, 20 bp, Artificial Sequence
  Description of Artificial Sequence: Synthetic oligonucleotide
  Target: SCN9A; (+) strand; PAM type: YTN; PAM sequence: TTA
taccatacacaaaaataaac

SEQ ID NO: 97382 - DNA, 20 bp, Artificial Sequence
  Description of Artificial Sequence: Synthetic oligonucleotide
  Target: SCN9A; (+) strand; PAM type: YTN; PAM sequence: CTC
aaaatagattaaacatttaa

SEQ ID NO: 97383 - DNA, 20 bp, Artificial Sequence
  Description of Artificial Sequence: Synthetic oligonucleotide
  Target: SCN9A; (+) strand; PAM type: YTN; PAM sequence: TTA
aacatttaaacctaagacct

SEQ ID NO: 97384 - DNA, 20 bp, Artificial Sequence
  Description of Artificial Sequence: Synthetic oligonucleotide
  Target: SCN9A; (+) strand; PAM type: YTN; PAM sequence: TTT
aaacctaagacctgaaaact

SEQ ID NO: 97385 - DNA, 20 bp, Artificial Sequence
  Description of Artificial Sequence: Synthetic oligonucleotide
  Target: SCN9A; (+) strand; PAM type: YTN; PAM sequence: TTA
aacctaagacctgaaaactg

SEQ ID NO: 97386 - DNA, 20 bp, Artificial Sequence
  Description of Artificial Sequence: Synthetic oligonucleotide
  Target: SCN9A; (+) strand; PAM type: YTN; PAM sequence: CTA
agacctgaaaactgtaaaac

SEQ ID NO: 97387 - DNA, 20 bp, Artificial Sequence
  Description of Artificial Sequence: Synthetic oligonucleotide
  Target: SCN9A; (+) strand; PAM type: YTN; PAM sequence: CTG
aaaactgtaaaacttgtaga

SEQ ID NO: 97388 - DNA, 20 bp, Artificial Sequence
  Description of Artificial Sequence: Synthetic oligonucleotide
  Target: SCN9A; (+) strand; PAM type: YTN; PAM sequence: CTG
taaaacttgtagaagaaaac

SEQ ID NO: 97389 - DNA, 20 bp, Artificial Sequence
  Description of Artificial Sequence: Synthetic oligonucleotide
  Target: SCN9A; (+) strand; PAM type: YTN; PAM sequence: CTT
gtagaagaaaacatagcagg

SEQ ID NO: 97390 - DNA, 20 bp, Artificial Sequence
  Description of Artificial Sequence: Synthetic oligonucleotide
  Target: SCN9A; (+) strand; PAM type: YTN; PAM sequence: TTG
tagaagaaaacatagcagga

SEQ ID NO: 97391 - DNA, 20 bp, Artificial Sequence
  Description of Artificial Sequence: Synthetic oligonucleotide
  Target: SCN9A; (+) strand; PAM type: YTN; PAM sequence: CTT
catgatactgttcttgacaa

SEQ ID NO: 97392 - DNA, 20 bp, Artificial Sequence
  Description of Artificial Sequence: Synthetic oligonucleotide
  Target: SCN9A; (+) strand; PAM type: YTN; PAM sequence: TTC
atgatactgttcttgacaat

SEQ ID NO: 97393 - DNA, 20 bp, Artificial Sequence
  Description of Artificial Sequence: Synthetic oligonucleotide
  Target: SCN9A; (+) strand; PAM type: YTN; PAM sequence: CTG
ttcttgacaatgatttcttg

SEQ ID NO: 97394 - DNA, 20 bp, Artificial Sequence
  Description of Artificial Sequence: Synthetic oligonucleotide
  Target: SCN9A; (+) strand; PAM type: YTN; PAM sequence: TTC
ttgacaatgatttcttggca

SEQ ID NO: 97395 - DNA, 20 bp, Artificial Sequence
  Description of Artificial Sequence: Synthetic oligonucleotide
  Target: SCN9A; (+) strand; PAM type: YTN; PAM sequence: CTT
gacaatgatttcttggcaat

SEQ ID NO: 97396 - DNA, 20 bp, Artificial Sequence
  Description of Artificial Sequence: Synthetic oligonucleotide
  Target: SCN9A; (+) strand; PAM type: YTN; PAM sequence: TTG
acaatgatttcttggcaatg

SEQ ID NO: 97397 - DNA, 20 bp, Artificial Sequence
  Description of Artificial Sequence: Synthetic oligonucleotide
  Target: SCN9A; (+) strand; PAM type: YTN; PAM sequence: TTT
cttggcaatgactccaaaat

SEQ ID NO: 97398 - DNA, 20 bp, Artificial Sequence
  Description of Artificial Sequence: Synthetic oligonucleotide
  Target: SCN9A; (+) strand; PAM type: YTN; PAM sequence: TTC
ttggcaatgactccaaaatt

SEQ ID NO: 97399 - DNA, 20 bp, Artificial Sequence
  Description of Artificial Sequence: Synthetic oligonucleotide
  Target: SCN9A; (+) strand; PAM type: YTN; PAM sequence: CTT
ggcaatgactccaaaattca

SEQ ID NO: 97400 - DNA, 20 bp, Artificial Sequence
  Description of Artificial Sequence: Synthetic oligonucleotide
  Target: SCN9A; (+) strand; PAM type: YTN; PAM sequence: TTG
gcaatgactccaaaattcaa

SEQ ID NO: 97401 - DNA, 20 bp, Artificial Sequence
  Description of Artificial Sequence: Synthetic oligonucleotide
  Target: SCN9A; (+) strand; PAM type: YTN; PAM sequence: CTC
caaaattcaaacaagagcaa

SEQ ID NO: 97402 - DNA, 20 bp, Artificial Sequence
  Description of Artificial Sequence: Synthetic oligonucleotide
  Target: SCN9A; (+) strand; PAM type: YTN; PAM sequence: TTC
aaacaagagcaaaaatagac

SEQ ID NO: 97403 - DNA, 20 bp, Artificial Sequence
  Description of Artificial Sequence: Synthetic oligonucleotide
  Target: SCN9A; (+) strand; PAM type: YTN; PAM sequence: TTG
agaccatatcaaactaaaaa

SEQ ID NO: 97404 - DNA, 20 bp, Artificial Sequence
  Description of Artificial Sequence: Synthetic oligonucleotide
  Target: SCN9A; (+) strand; PAM type: YTN; PAM sequence: CTA
aaaagctttgggaaaaaaag

SEQ ID NO: 97405 - DNA, 20 bp, Artificial Sequence
  Description of Artificial Sequence: Synthetic oligonucleotide
  Target: SCN9A; (+) strand; PAM type: YTN; PAM sequence: CTT
tgggaaaaaaaggaagcatt

SEQ ID NO: 97406 - DNA, 20 bp, Artificial Sequence
  Description of Artificial Sequence: Synthetic oligonucleotide
  Target: SCN9A; (+) strand; PAM type: YTN; PAM sequence: TTT
gggaaaaaaaggaagcattc

SEQ ID NO: 97407 - DNA, 20 bp, Artificial Sequence
  Description of Artificial Sequence: Synthetic oligonucleotide
  Target: SCN9A; (+) strand; PAM type: YTN; PAM sequence: TTG
ggaaaaaaaggaagcattca

SEQ ID NO: 97408 - DNA, 20 bp, Artificial Sequence
  Description of Artificial Sequence: Synthetic oligonucleotide
  Target: SCN9A; (+) strand; PAM type: YTN; PAM sequence: TTC
aagagggtgaaaaagcaacc

SEQ ID NO: 97409 - DNA, 20 bp, Artificial Sequence
  Description of Artificial Sequence: Synthetic oligonucleotide
  Target: SCN9A; (+) strand; PAM type: YTN; PAM sequence: CTA
tagaatgggagaaaatattt

SEQ ID NO: 97410 - DNA, 20 bp, Artificial Sequence
  Description of Artificial Sequence: Synthetic oligonucleotide
  Target: SCN9A; (+) strand; PAM type: YTN; PAM sequence: TTT
ccaactatatatctaataaa

SEQ ID NO: 97411 - DNA, 20 bp, Artificial Sequence
  Description of Artificial Sequence: Synthetic oligonucleotide
  Target: SCN9A; (+) strand; PAM type: YTN; PAM sequence: TTC
caactatatatctaataaat

SEQ ID NO: 97412 - DNA, 20 bp, Artificial Sequence
  Description of Artificial Sequence: Synthetic oligonucleotide
  Target: SCN9A; (+) strand; PAM type: YTN; PAM sequence: CTA
tatatctaataaatggttaa

SEQ ID NO: 97413 - DNA, 20 bp, Artificial Sequence
  Description of Artificial Sequence: Synthetic oligonucleotide
  Target: SCN9A; (+) strand; PAM type: YTN; PAM sequence: CTA
ataaatggttaatatccaaa

SEQ ID NO: 97414 - DNA, 20 bp, Artificial Sequence
  Description of Artificial Sequence: Synthetic oligonucleotide
  Target: SCN9A; (+) strand; PAM type: YTN; PAM sequence: TTA
atatccaaaatatataggga

SEQ ID NO: 97415 - DNA, 20 bp, Artificial Sequence
  Description of Artificial Sequence: Synthetic oligonucleotide
  Target: SCN9A; (+) strand; PAM type: YTN; PAM sequence: CTC
ctgcaacttaagaaggcatg

SEQ ID NO: 97416 - DNA, 20 bp, Artificial Sequence
  Description of Artificial Sequence: Synthetic oligonucleotide
  Target: SCN9A; (+) strand; PAM type: YTN; PAM sequence: CTG
caacttaagaaggcatgcaa

SEQ ID NO: 97417 - DNA, 20 bp, Artificial Sequence
  Description of Artificial Sequence: Synthetic oligonucleotide
  Target: SCN9A; (+) strand; PAM type: YTN; PAM sequence: CTT
aagaaggcatgcaaatgacc

SEQ ID NO: 97418 - DNA, 20 bp, Artificial Sequence
  Description of Artificial Sequence: Synthetic oligonucleotide
  Target: SCN9A; (+) strand; PAM type: YTN; PAM sequence: TTA
agaaggcatgcaaatgacca

SEQ ID NO: 97419 - DNA, 20 bp, Artificial Sequence
  Description of Artificial Sequence: Synthetic oligonucleotide
  Target: SCN9A; (+) strand; PAM type: YTN; PAM sequence: TTA
aaagatgctcagtatcacta

SEQ ID NO: 97420 - DNA, 20 bp, Artificial Sequence
  Description of Artificial Sequence: Synthetic oligonucleotide
  Target: SCN9A; (+) strand; PAM type: YTN; PAM sequence: CTC
agtatcactaatcatcagaa

SEQ ID NO: 97421 - DNA, 20 bp, Artificial Sequence
  Description of Artificial Sequence: Synthetic oligonucleotide
  Target: SCN9A; (+) strand; PAM type: YTN; PAM sequence: CTA
atcatcagaaaattcaaata

SEQ ID NO: 97422 - DNA, 20 bp, Artificial Sequence
  Description of Artificial Sequence: Synthetic oligonucleotide
  Target: SCN9A; (+) strand; PAM type: YTN; PAM sequence: TTC
aaataaaaactgtaatgagg

SEQ ID NO: 97423 - DNA, 20 bp, Artificial Sequence
  Description of Artificial Sequence: Synthetic oligonucleotide
  Target: SCN9A; (+) strand; PAM type: YTN; PAM sequence: CTG
taatgagggccaggtgcagt

SEQ ID NO: 97424 - DNA, 20 bp, Artificial Sequence
  Description of Artificial Sequence: Synthetic oligonucleotide
  Target: SCN9A; (+) strand; PAM type: YTN; PAM sequence: CTC
atgcctgttatcccagcact

SEQ ID NO: 97425 - DNA, 20 bp, Artificial Sequence
  Description of Artificial Sequence: Synthetic oligonucleotide
  Target: SCN9A; (+) strand; PAM type: YTN; PAM sequence: CTG
ttatcccagcactttgggag

SEQ ID NO: 97426 - DNA, 20 bp, Artificial Sequence
  Description of Artificial Sequence: Synthetic oligonucleotide
  Target: SCN9A; (+) strand; PAM type: YTN; PAM sequence: TTA
tcccagcactttgggaggcc

SEQ ID NO: 97427 - DNA, 20 bp, Artificial Sequence
  Description of Artificial Sequence: Synthetic oligonucleotide
  Target: SCN9A; (+) strand; PAM type: YTN; PAM sequence: CTT
tgggaggccaaggtgggtgg

SEQ ID NO: 97428 - DNA, 20 bp, Artificial Sequence
  Description of Artificial Sequence: Synthetic oligonucleotide
  Target: SCN9A; (+) strand; PAM type: YTN; PAM sequence: TTT
gggaggccaaggtgggtgga

SEQ ID NO: 97429 - DNA, 20 bp, Artificial Sequence
  Description of Artificial Sequence: Synthetic oligonucleotide
  Target: SCN9A; (+) strand; PAM type: YTN; PAM sequence: TTG
ggaggccaaggtgggtggat

SEQ ID NO: 97430 - DNA, 20 bp, Artificial Sequence
  Description of Artificial Sequence: Synthetic oligonucleotide
  Target: SCN9A; (+) strand; PAM type: YTN; PAM sequence: CTG
gccaaaatggtgaaactcca

SEQ ID NO: 97431 - DNA, 20 bp, Artificial Sequence
  Description of Artificial Sequence: Synthetic oligonucleotide
  Target: SCN9A; (+) strand; PAM type: YTN; PAM sequence: CTC
catctctactgaaaatacaa

SEQ ID NO: 97432 - DNA, 20 bp, Artificial Sequence
  Description of Artificial Sequence: Synthetic oligonucleotide
  Target: SCN9A; (+) strand; PAM type: YTN; PAM sequence: CTC
tactgaaaatacaaaaatta

SEQ ID NO: 97433 - DNA, 20 bp, Artificial Sequence
  Description of Artificial Sequence: Synthetic oligonucleotide
  Target: SCN9A; (+) strand; PAM type: YTN; PAM sequence: CTA
ctgaaaatacaaaaattagc

SEQ ID NO: 97434 - DNA, 20 bp, Artificial Sequence
  Description of Artificial Sequence: Synthetic oligonucleotide
  Target: SCN9A; (+) strand; PAM type: YTN; PAM sequence: CTG
aaaatacaaaaattagctgg

SEQ ID NO: 97435 - DNA, 20 bp, Artificial Sequence
  Description of Artificial Sequence: Synthetic oligonucleotide
  Target: SCN9A; (+) strand; PAM type: YTN; PAM sequence: TTA
gctgggcatggtggcacatg

SEQ ID NO: 97436 - DNA, 20 bp, Artificial Sequence
  Description of Artificial Sequence: Synthetic oligonucleotide
  Target: SCN9A; (+) strand; PAM type: YTN; PAM sequence: CTG
ggcatggtggcacatgcctg

SEQ ID NO: 97437 - DNA, 20 bp, Artificial Sequence
  Description of Artificial Sequence: Synthetic oligonucleotide
  Target: SCN9A; (+) strand; PAM type: YTN; PAM sequence: CTG
taatcccagctacttgggaa

SEQ ID NO: 97438 - DNA, 20 bp, Artificial Sequence
  Description of Artificial Sequence: Synthetic oligonucleotide
  Target: SCN9A; (+) strand; PAM type: YTN; PAM sequence: CTA
cttgggaagctgaggcagga

SEQ ID NO: 97439 - DNA, 20 bp, Artificial Sequence
  Description of Artificial Sequence: Synthetic oligonucleotide
  Target: SCN9A; (+) strand; PAM type: YTN; PAM sequence: CTT
gggaagctgaggcaggagaa

SEQ ID NO: 97440 - DNA, 20 bp, Artificial Sequence
  Description of Artificial Sequence: Synthetic oligonucleotide
  Target: SCN9A; (+) strand; PAM type: YTN; PAM sequence: TTG
ggaagctgaggcaggagaat

SEQ ID NO: 97441 - DNA, 20 bp, Artificial Sequence
  Description of Artificial Sequence: Synthetic oligonucleotide
  Target: SCN9A; (+) strand; PAM type: YTN; PAM sequence: CTG
aggcaggagaatcacttgaa

SEQ ID NO: 97442 - DNA, 20 bp, Artificial Sequence
  Description of Artificial Sequence: Synthetic oligonucleotide
  Target: SCN9A; (+) strand; PAM type: YTN; PAM sequence: CTT
gaaccagggagtcggaggtt

SEQ ID NO: 97443 - DNA, 20 bp, Artificial Sequence
  Description of Artificial Sequence: Synthetic oligonucleotide
  Target: SCN9A; (+) strand; PAM type: YTN; PAM sequence: TTG
aaccagggagtcggaggttg

SEQ ID NO: 97444 - DNA, 20 bp, Artificial Sequence
  Description of Artificial Sequence: Synthetic oligonucleotide
  Target: SCN9A; (+) strand; PAM type: YTN; PAM sequence: TTG
cagtgagctgagatcgcgcc

SEQ ID NO: 97445 - DNA, 20 bp, Artificial Sequence
  Description of Artificial Sequence: Synthetic oligonucleotide
  Target: SCN9A; (+) strand; PAM type: YTN; PAM sequence: CTG
agatcgcgccactgcactcc

SEQ ID NO: 97446 - DNA, 20 bp, Artificial Sequence
  Description of Artificial Sequence: Synthetic oligonucleotide
  Target: SCN9A; (+) strand; PAM type: YTN; PAM sequence: CTG
cactccagcctggtgacaga

SEQ ID NO: 97447 - DNA, 20 bp, Artificial Sequence
  Description of Artificial Sequence: Synthetic oligonucleotide
  Target: SCN9A; (+) strand; PAM type: YTN; PAM sequence: CTC
cagcctggtgacagagtgag

SEQ ID NO: 97448 - DNA, 20 bp, Artificial Sequence
  Description of Artificial Sequence: Synthetic oligonucleotide
  Target: SCN9A; (+) strand; PAM type: YTN; PAM sequence: CTG
gtgacagagtgagactcctt

SEQ ID NO: 97449 - DNA, 20 bp, Artificial Sequence
  Description of Artificial Sequence: Synthetic oligonucleotide
  Target: SCN9A; (+) strand; PAM type: YTN; PAM sequence: CTC
cttcaaaaacaaacaaacaa

SEQ ID NO: 97450 - DNA, 20 bp, Artificial Sequence
  Description of Artificial Sequence: Synthetic oligonucleotide
  Target: SCN9A; (+) strand; PAM type: YTN; PAM sequence: CTT
caaaaacaaacaaacaaaca

SEQ ID NO: 97451 - DNA, 20 bp, Artificial Sequence
  Description of Artificial Sequence: Synthetic oligonucleotide
  Target: SCN9A; (+) strand; PAM type: YTN; PAM sequence: TTC
aaaaacaaacaaacaaacag

SEQ ID NO: 97452 - DNA, 20 bp, Artificial Sequence
  Description of Artificial Sequence: Synthetic oligonucleotide
  Target: SCN9A; (+) strand; PAM type: YTN; PAM sequence: CTC
acgcctgtaatcccagcact

SEQ ID NO: 97453 - DNA, 20 bp, Artificial Sequence
  Description of Artificial Sequence: Synthetic oligonucleotide
  Target: SCN9A; (+) strand; PAM type: YTN; PAM sequence: CTG
taatcccagcactttgggag

SEQ ID NO: 97454 - DNA, 20 bp, Artificial Sequence
  Description of Artificial Sequence: Synthetic oligonucleotide
  Target: SCN9A; (+) strand; PAM type: YTN; PAM sequence: CTT
tgggaggccgagacgggcgg

SEQ ID NO: 97455 - DNA, 20 bp, Artificial Sequence
  Description of Artificial Sequence: Synthetic oligonucleotide
  Target: SCN9A; (+) strand; PAM type: YTN; PAM sequence: TTT
gggaggccgagacgggcgga

SEQ ID NO: 97456 - DNA, 20 bp, Artificial Sequence
  Description of Artificial Sequence: Synthetic oligonucleotide
  Target: SCN9A; (+) strand; PAM type: YTN; PAM sequence: TTG
ggaggccgagacgggcggat

SEQ ID NO: 97457 - DNA, 20 bp, Artificial Sequence
  Description of Artificial Sequence: Synthetic oligonucleotide
  Target: SCN9A; (+) strand; PAM type: YTN; PAM sequence: CTG
gctaacagggtgaaaccccg

SEQ ID NO: 97458 - DNA, 20 bp, Artificial Sequence
  Description of Artificial Sequence: Synthetic oligonucleotide
  Target: SCN9A; (+) strand; PAM type: YTN; PAM sequence: CTA
acagggtgaaaccccgtctc

SEQ ID NO: 97459 - DNA, 20 bp, Artificial Sequence
  Description of Artificial Sequence: Synthetic oligonucleotide
  Target: SCN9A; (+) strand; PAM type: YTN; PAM sequence: CTC
tactaaaaatacaaaaatta

SEQ ID NO: 97460 - DNA, 20 bp, Artificial Sequence
  Description of Artificial Sequence: Synthetic oligonucleotide
  Target: SCN9A; (+) strand; PAM type: YTN; PAM sequence: CTA
ctaaaaatacaaaaattagc

SEQ ID NO: 97461 - DNA, 20 bp, Artificial Sequence
  Description of Artificial Sequence: Synthetic oligonucleotide
  Target: SCN9A; (+) strand; PAM type: YTN; PAM sequence: CTA
aaaatacaaaaattagccgg

SEQ ID NO: 97462 - DNA, 20 bp, Artificial Sequence
  Description of Artificial Sequence: Synthetic oligonucleotide
  Target: SCN9A; (+) strand; PAM type: YTN; PAM sequence: TTA
gccgggcatggtggcgcacg

SEQ ID NO: 97463 - DNA, 20 bp, Artificial Sequence
  Description of Artificial Sequence: Synthetic oligonucleotide
  Target: SCN9A; (+) strand; PAM type: YTN; PAM sequence: CTG
tagtcccagctacacgggag

SEQ ID NO: 97464 - DNA, 20 bp, Artificial Sequence
  Description of Artificial Sequence: Synthetic oligonucleotide
  Target: SCN9A; (+) strand; PAM type: YTN; PAM sequence: CTA
cacgggaggctgaggcagga

SEQ ID NO: 97465 - DNA, 20 bp, Artificial Sequence
  Description of Artificial Sequence: Synthetic oligonucleotide
  Target: SCN9A; (+) strand; PAM type: YTN; PAM sequence: CTG
aggcaggagaatggcgtgaa

SEQ ID NO: 97466 - DNA, 20 bp, Artificial Sequence
  Description of Artificial Sequence: Synthetic oligonucleotide
  Target: SCN9A; (+) strand; PAM type: YTN; PAM sequence: CTT
gcagtgagtcgagatcgcgc

SEQ ID NO: 97467 - DNA, 20 bp, Artificial Sequence
  Description of Artificial Sequence: Synthetic oligonucleotide
  Target: SCN9A; (+) strand; PAM type: YTN; PAM sequence: TTG
cagtgagtcgagatcgcgcc

SEQ ID NO: 97468 - DNA, 20 bp, Artificial Sequence
  Description of Artificial Sequence: Synthetic oligonucleotide
  Target: SCN9A; (+) strand; PAM type: YTN; PAM sequence: CTG
cactccagcctgggcgacag

SEQ ID NO: 97469 - DNA, 20 bp, Artificial Sequence
  Description of Artificial Sequence: Synthetic oligonucleotide
  Target: SCN9A; (+) strand; PAM type: YTN; PAM sequence: CTC
cagcctgggcgacagagcga

SEQ ID NO: 97470 - DNA, 20 bp, Artificial Sequence
  Description of Artificial Sequence: Synthetic oligonucleotide
  Target: SCN9A; (+) strand; PAM type: YTN; PAM sequence: CTG
ggcgacagagcgaaactccg

SEQ ID NO: 97471 - DNA, 20 bp, Artificial Sequence
  Description of Artificial Sequence: Synthetic oligonucleotide
  Target: SCN9A; (+) strand; PAM type: YTN; PAM sequence: CTC
cgtctcaaaaaaaaaaacaa

SEQ ID NO: 97472 - DNA, 20 bp, Artificial Sequence
  Description of Artificial Sequence: Synthetic oligonucleotide
  Target: SCN9A; (+) strand; PAM type: YTN; PAM sequence: CTC
aaaaaaaaaaacaacaaaaa

SEQ ID NO: 97473 - DNA, 20 bp, Artificial Sequence
  Description of Artificial Sequence: Synthetic oligonucleotide
  Target: SCN9A; (+) strand; PAM type: YTN; PAM sequence: TTT
catacctgctaggatggcta

SEQ ID NO: 97474 - DNA, 20 bp, Artificial Sequence
  Description of Artificial Sequence: Synthetic oligonucleotide
  Target: SCN9A; (+) strand; PAM type: YTN; PAM sequence: TTC
atacctgctaggatggctat

SEQ ID NO: 97475 - DNA, 20 bp, Artificial Sequence
  Description of Artificial Sequence: Synthetic oligonucleotide
  Target: SCN9A; (+) strand; PAM type: YTN; PAM sequence: CTG
ctaggatggctattaccaaa

SEQ ID NO: 97476 - DNA, 20 bp, Artificial Sequence
  Description of Artificial Sequence: Synthetic oligonucleotide
  Target: SCN9A; (+) strand; PAM type: YTN; PAM sequence: CTA
ggatggctattaccaaaaca

SEQ ID NO: 97477 - DNA, 20 bp, Artificial Sequence
  Description of Artificial Sequence: Synthetic oligonucleotide
  Target: SCN9A; (+) strand; PAM type: YTN; PAM sequence: CTA
ttaccaaaacaaaaacaaaa

SEQ ID NO: 97478 - DNA, 20 bp, Artificial Sequence
  Description of Artificial Sequence: Synthetic oligonucleotide
  Target: SCN9A; (+) strand; PAM type: YTN; PAM sequence: TTA
ccaaaacaaaaacaaaaacc

SEQ ID NO: 97479 - DNA, 20 bp, Artificial Sequence
  Description of Artificial Sequence: Synthetic oligonucleotide
  Target: SCN9A; (+) strand; PAM type: YTN; PAM sequence: TTG
gcaaggatatggagaaatta

SEQ ID NO: 97480 - DNA, 20 bp, Artificial Sequence
  Description of Artificial Sequence: Synthetic oligonucleotide
  Target: SCN9A; (+) strand; PAM type: YTN; PAM sequence: TTA
gaacctttgtacattgttgg

SEQ ID NO: 97481 - DNA, 20 bp, Artificial Sequence
  Description of Artificial Sequence: Synthetic oligonucleotide
  Target: SCN9A; (+) strand; PAM type: YTN; PAM sequence: CTT
tgtacattgttggaatgtaa

SEQ ID NO: 97482 - DNA, 20 bp, Artificial Sequence
  Description of Artificial Sequence: Synthetic oligonucleotide
  Target: SCN9A; (+) strand; PAM type: YTN; PAM sequence: TTT
gtacattgttggaatgtaaa

SEQ ID NO: 97483 - DNA, 20 bp, Artificial Sequence
  Description of Artificial Sequence: Synthetic oligonucleotide
  Target: SCN9A; (+) strand; PAM type: YTN; PAM sequence: TTG
tacattgttggaatgtaaaa

SEQ ID NO: 97484 - DNA, 20 bp, Artificial Sequence
  Description of Artificial Sequence: Synthetic oligonucleotide
  Target: SCN9A; (+) strand; PAM type: YTN; PAM sequence: TTG
ttggaatgtaaaatgatgta

SEQ ID NO: 97485 - DNA, 20 bp, Artificial Sequence
  Description of Artificial Sequence: Synthetic oligonucleotide
  Target: SCN9A; (+) strand; PAM type: YTN; PAM sequence: TTG
gaatgtaaaatgatgtagct

SEQ ID NO: 97486 - DNA, 20 bp, Artificial Sequence
  Description of Artificial Sequence: Synthetic oligonucleotide
  Target: SCN9A; (+) strand; PAM type: YTN; PAM sequence: CTG
ccatagaaaacagtatgaaa

SEQ ID NO: 97487 - DNA, 20 bp, Artificial Sequence
  Description of Artificial Sequence: Synthetic oligonucleotide
  Target: SCN9A; (+) strand; PAM type: YTN; PAM sequence: TTC
ctgaaaaaattaaaaatata

SEQ ID NO: 97488 - DNA, 20 bp, Artificial Sequence
  Description of Artificial Sequence: Synthetic oligonucleotide
  Target: SCN9A; (+) strand; PAM type: YTN; PAM sequence: CTG
aaaaaattaaaaatataact

SEQ ID NO: 97489 - DNA, 20 bp, Artificial Sequence
  Description of Artificial Sequence: Synthetic oligonucleotide
  Target: SCN9A; (+) strand; PAM type: YTN; PAM sequence: TTA
aaaatataactaccatttga

SEQ ID NO: 97490 - DNA, 20 bp, Artificial Sequence
  Description of Artificial Sequence: Synthetic oligonucleotide
  Target: SCN9A; (+) strand; PAM type: YTN; PAM sequence: CTA
ccatttgatctagcaatgcc

SEQ ID NO: 97491 - DNA, 20 bp, Artificial Sequence
  Description of Artificial Sequence: Synthetic oligonucleotide
  Target: SCN9A; (+) strand; PAM type: YTN; PAM sequence: TTT
gatctagcaatgccacatct

SEQ ID NO: 97492 - DNA, 20 bp, Artificial Sequence
  Description of Artificial Sequence: Synthetic oligonucleotide
  Target: SCN9A; (+) strand; PAM type: YTN; PAM sequence: TTG
atctagcaatgccacatctg

SEQ ID NO: 97493 - DNA, 20 bp, Artificial Sequence
  Description of Artificial Sequence: Synthetic oligonucleotide
  Target: SCN9A; (+) strand; PAM type: YTN; PAM sequence: CTA
gcaatgccacatctgagcat

SEQ ID NO: 97494 - DNA, 20 bp, Artificial Sequence
  Description of Artificial Sequence: Synthetic oligonucleotide
  Target: SCN9A; (+) strand; PAM type: YTN; PAM sequence: CTG
agcatattttaaaaatttga

SEQ ID NO: 97495 - DNA, 20 bp, Artificial Sequence
  Description of Artificial Sequence: Synthetic oligonucleotide
  Target: SCN9A; (+) strand; PAM type: YTN; PAM sequence: TTT
taaaaatttgaactcaggat

SEQ ID NO: 97496 - DNA, 20 bp, Artificial Sequence
  Description of Artificial Sequence: Synthetic oligonucleotide
  Target: SCN9A; (+) strand; PAM type: YTN; PAM sequence: TTT
aaaaatttgaactcaggatc

SEQ ID NO: 97497 - DNA, 20 bp, Artificial Sequence
  Description of Artificial Sequence: Synthetic oligonucleotide
  Target: SCN9A; (+) strand; PAM type: YTN; PAM sequence: TTA
aaaatttgaactcaggatct

SEQ ID NO: 97498 - DNA, 20 bp, Artificial Sequence
  Description of Artificial Sequence: Synthetic oligonucleotide
  Target: SCN9A; (+) strand; PAM type: YTN; PAM sequence: TTT
gaactcaggatctcagagtc

SEQ ID NO: 97499 - DNA, 20 bp, Artificial Sequence
  Description of Artificial Sequence: Synthetic oligonucleotide
  Target: SCN9A; (+) strand; PAM type: YTN; PAM sequence: TTG
aactcaggatctcagagtcc

SEQ ID NO: 97500 - DNA, 20 bp, Artificial Sequence
  Description of Artificial Sequence: Synthetic oligonucleotide
  Target: SCN9A; (+) strand; PAM type: YTN; PAM sequence: CTC
aggatctcagagtccttact

SEQ ID NO: 97501 - DNA, 20 bp, Artificial Sequence
  Description of Artificial Sequence: Synthetic oligonucleotide
  Target: SCN9A; (+) strand; PAM type: YTN; PAM sequence: CTC
agagtccttacttccatgtt

SEQ ID NO: 97502 - DNA, 20 bp, Artificial Sequence
  Description of Artificial Sequence: Synthetic oligonucleotide
  Target: SCN9A; (+) strand; PAM type: YTN; PAM sequence: CTT
acttccatgttcacttcagc

SEQ ID NO: 97503 - DNA, 20 bp, Artificial Sequence
  Description of Artificial Sequence: Synthetic oligonucleotide
  Target: SCN9A; (+) strand; PAM type: YTN; PAM sequence: TTA
cttccatgttcacttcagca

SEQ ID NO: 97504 - DNA, 20 bp, Artificial Sequence
  Description of Artificial Sequence: Synthetic oligonucleotide
  Target: SCN9A; (+) strand; PAM type: YTN; PAM sequence: CTT
ccatgttcacttcagcacta

SEQ ID NO: 97505 - DNA, 20 bp, Artificial Sequence
  Description of Artificial Sequence: Synthetic oligonucleotide
  Target: SCN9A; (+) strand; PAM type: YTN; PAM sequence: TTC
catgttcacttcagcactat

SEQ ID NO: 97506 - DNA, 20 bp, Artificial Sequence
  Description of Artificial Sequence: Synthetic oligonucleotide
  Target: SCN9A; (+) strand; PAM type: YTN; PAM sequence: TTC
acttcagcactatttactgt

SEQ ID NO: 97507 - DNA, 20 bp, Artificial Sequence
  Description of Artificial Sequence: Synthetic oligonucleotide
  Target: SCN9A; (+) strand; PAM type: YTN; PAM sequence: CTT
cagcactatttactgtatcc

SEQ ID NO: 97508 - DNA, 20 bp, Artificial Sequence
  Description of Artificial Sequence: Synthetic oligonucleotide
  Target: SCN9A; (+) strand; PAM type: YTN; PAM sequence: TTC
agcactatttactgtatcca

SEQ ID NO: 97509 - DNA, 20 bp, Artificial Sequence
  Description of Artificial Sequence: Synthetic oligonucleotide
  Target: SCN9A; (+) strand; PAM type: YTN; PAM sequence: CTA
tttactgtatccaaatatga

SEQ ID NO: 97510 - DNA, 20 bp, Artificial Sequence
  Description of Artificial Sequence: Synthetic oligonucleotide
  Target: SCN9A; (+) strand; PAM type: YTN; PAM sequence: TTT
actgtatccaaatatgaaaa

SEQ ID NO: 97511 - DNA, 20 bp, Artificial Sequence
  Description of Artificial Sequence: Synthetic oligonucleotide
  Target: SCN9A; (+) strand; PAM type: YTN; PAM sequence: TTA
ctgtatccaaatatgaaaac

SEQ ID NO: 97512 - DNA, 20 bp, Artificial Sequence
  Description of Artificial Sequence: Synthetic oligonucleotide
  Target: SCN9A; (+) strand; PAM type: YTN; PAM sequence: CTG
tatccaaatatgaaaacaac

SEQ ID NO: 97513 - DNA, 20 bp, Artificial Sequence
  Description of Artificial Sequence: Synthetic oligonucleotide
  Target: SCN9A; (+) strand; PAM type: YTN; PAM sequence: CTA
aatgtctattgatgaatgat

SEQ ID NO: 97514 - DNA, 20 bp, Artificial Sequence
  Description of Artificial Sequence: Synthetic oligonucleotide
  Target: SCN9A; (+) strand; PAM type: YTN; PAM sequence: CTA
ttgatgaatgatgggataga

SEQ ID NO: 97515 - DNA, 20 bp, Artificial Sequence
  Description of Artificial Sequence: Synthetic oligonucleotide
  Target: SCN9A; (+) strand; PAM type: YTN; PAM sequence: TTG
atgaatgatgggatagaaaa

SEQ ID NO: 97516 - DNA, 20 bp, Artificial Sequence
  Description of Artificial Sequence: Synthetic oligonucleotide
  Target: SCN9A; (+) strand; PAM type: YTN; PAM sequence: TTT
gtatacctgcatgtgcgtgt

SEQ ID NO: 97517 - DNA, 20 bp, Artificial Sequence
  Description of Artificial Sequence: Synthetic oligonucleotide
  Target: SCN9A; (+) strand; PAM type: YTN; PAM sequence: TTG
tatacctgcatgtgcgtgtg

SEQ ID NO: 97518 - DNA, 20 bp, Artificial Sequence
  Description of Artificial Sequence: Synthetic oligonucleotide
  Target: SCN9A; (+) strand; PAM type: YTN; PAM sequence: CTG
catgtgcgtgtgcacgtaca

SEQ ID NO: 97519 - DNA, 20 bp, Artificial Sequence
  Description of Artificial Sequence: Synthetic oligonucleotide
  Target: SCN9A; (+) strand; PAM type: YTN; PAM sequence: CTA
ttcagccttataaagaagga

SEQ ID NO: 97520 - DNA, 20 bp, Artificial Sequence
  Description of Artificial Sequence: Synthetic oligonucleotide
  Target: SCN9A; (+) strand; PAM type: YTN; PAM sequence: TTC
agccttataaagaaggaaat

SEQ ID NO: 97521 - DNA, 20 bp, Artificial Sequence
  Description of Artificial Sequence: Synthetic oligonucleotide
  Target: SCN9A; (+) strand; PAM type: YTN; PAM sequence: CTT
ataaagaaggaaatcctgcc

SEQ ID NO: 97522 - DNA, 20 bp, Artificial Sequence
  Description of Artificial Sequence: Synthetic oligonucleotide
  Target: SCN9A; (+) strand; PAM type: YTN; PAM sequence: TTA
taaagaaggaaatcctgcca

SEQ ID NO: 97523 - DNA, 20 bp, Artificial Sequence
  Description of Artificial Sequence: Synthetic oligonucleotide
  Target: SCN9A; (+) strand; PAM type: YTN; PAM sequence: CTG
ccatatgcagcaacttgaat

SEQ ID NO: 97524 - DNA, 20 bp, Artificial Sequence
  Description of Artificial Sequence: Synthetic oligonucleotide
  Target: SCN9A; (+) strand; PAM type: YTN; PAM sequence: CTT
gaatgaacctggataaattt

SEQ ID NO: 97525 - DNA, 20 bp, Artificial Sequence
  Description of Artificial Sequence: Synthetic oligonucleotide
  Target: SCN9A; (+) strand; PAM type: YTN; PAM sequence: TTG
aatgaacctggataaattta

SEQ ID NO: 97526 - DNA, 20 bp, Artificial Sequence
  Description of Artificial Sequence: Synthetic oligonucleotide
  Target: SCN9A; (+) strand; PAM type: YTN; PAM sequence: CTG
gataaatttatgctgagtga

SEQ ID NO: 97527 - DNA, 20 bp, Artificial Sequence
  Description of Artificial Sequence: Synthetic oligonucleotide
  Target: SCN9A; (+) strand; PAM type: YTN; PAM sequence: TTT
atgctgagtgaagtaacaga

SEQ ID NO: 97528 - DNA, 20 bp, Artificial Sequence
  Description of Artificial Sequence: Synthetic oligonucleotide
  Target: SCN9A; (+) strand; PAM type: YTN; PAM sequence: TTA
tgctgagtgaagtaacagaa

SEQ ID NO: 97529 - DNA, 20 bp, Artificial Sequence
  Description of Artificial Sequence: Synthetic oligonucleotide
  Target: SCN9A; (+) strand; PAM type: YTN; PAM sequence: CTG
agtgaagtaacagaaaaaat

SEQ ID NO: 97530 - DNA, 20 bp, Artificial Sequence
  Description of Artificial Sequence: Synthetic oligonucleotide
  Target: SCN9A; (+) strand; PAM type: YTN; PAM sequence: TTG
cataattccacttcggtgaa

SEQ ID NO: 97531 - DNA, 20 bp, Artificial Sequence
  Description of Artificial Sequence: Synthetic oligonucleotide
  Target: SCN9A; (+) strand; PAM type: YTN; PAM sequence: TTC
cacttcggtgaagtaactaa

SEQ ID NO: 97532 - DNA, 20 bp, Artificial Sequence
  Description of Artificial Sequence: Synthetic oligonucleotide
  Target: SCN9A; (+) strand; PAM type: YTN; PAM sequence: CTT
cggtgaagtaactaaaatgg

SEQ ID NO: 97533 - DNA, 20 bp, Artificial Sequence
  Description of Artificial Sequence: Synthetic oligonucleotide
  Target: SCN9A; (+) strand; PAM type: YTN; PAM sequence: TTC
ggtgaagtaactaaaatggt

SEQ ID NO: 97534 - DNA, 20 bp, Artificial Sequence
  Description of Artificial Sequence: Synthetic oligonucleotide
  Target: SCN9A; (+) strand; PAM type: YTN; PAM sequence: CTA
aaatggtcaaactcatggaa

SEQ ID NO: 97535 - DNA, 20 bp, Artificial Sequence
  Description of Artificial Sequence: Synthetic oligonucleotide
  Target: SCN9A; (+) strand; PAM type: YTN; PAM sequence: CTC
atggaaacagagagaagaat

SEQ ID NO: 97536 - DNA, 20 bp, Artificial Sequence
  Description of Artificial Sequence: Synthetic oligonucleotide
  Target: SCN9A; (+) strand; PAM type: YTN; PAM sequence: TTG
ccagggcatgaaaggatggg

SEQ ID NO: 97537 - DNA, 20 bp, Artificial Sequence
  Description of Artificial Sequence: Synthetic oligonucleotide
  Target: SCN9A; (+) strand; PAM type: YTN; PAM sequence: TTG
ctattcaatgggaataaagt

SEQ ID NO: 97538 - DNA, 20 bp, Artificial Sequence
  Description of Artificial Sequence: Synthetic oligonucleotide
  Target: SCN9A; (+) strand; PAM type: YTN; PAM sequence: CTA
ttcaatgggaataaagtttc

SEQ ID NO: 97539 - DNA, 20 bp, Artificial Sequence
  Description of Artificial Sequence: Synthetic oligonucleotide
  Target: SCN9A; (+) strand; PAM type: YTN; PAM sequence: TTC
aatgggaataaagtttcaat

SEQ ID NO: 97540 - DNA, 20 bp, Artificial Sequence
  Description of Artificial Sequence: Synthetic oligonucleotide
  Target: SCN9A; (+) strand; PAM type: YTN; PAM sequence: TTT
caattatgcaagatgaataa

SEQ ID NO: 97541 - DNA, 20 bp, Artificial Sequence
  Description of Artificial Sequence: Synthetic oligonucleotide
  Target: SCN9A; (+) strand; PAM type: YTN; PAM sequence: TTC
aattatgcaagatgaataag

SEQ ID NO: 97542 - DNA, 20 bp, Artificial Sequence
  Description of Artificial Sequence: Synthetic oligonucleotide
  Target: SCN9A; (+) strand; PAM type: YTN; PAM sequence: TTA
tgcaagatgaataagttcta

SEQ ID NO: 97543 - DNA, 20 bp, Artificial Sequence
  Description of Artificial Sequence: Synthetic oligonucleotide
  Target: SCN9A; (+) strand; PAM type: YTN; PAM sequence: TTC
tagggacttcctgtagtact

SEQ ID NO: 97544 - DNA, 20 bp, Artificial Sequence
  Description of Artificial Sequence: Synthetic oligonucleotide
  Target: SCN9A; (+) strand; PAM type: YTN; PAM sequence: CTA
gggacttcctgtagtacttc

SEQ ID NO: 97545 - DNA, 20 bp, Artificial Sequence
  Description of Artificial Sequence: Synthetic oligonucleotide
  Target: SCN9A; (+) strand; PAM type: YTN; PAM sequence: CTT
cctgtagtacttcgtaacta

SEQ ID NO: 97546 - DNA, 20 bp, Artificial Sequence
  Description of Artificial Sequence: Synthetic oligonucleotide
  Target: SCN9A; (+) strand; PAM type: YTN; PAM sequence: TTC
ctgtagtacttcgtaactat

SEQ ID NO: 97547 - DNA, 20 bp, Artificial Sequence
  Description of Artificial Sequence: Synthetic oligonucleotide
  Target: SCN9A; (+) strand; PAM type: YTN; PAM sequence: CTG
tagtacttcgtaactatagt

SEQ ID NO: 97548 - DNA, 20 bp, Artificial Sequence
  Description of Artificial Sequence: Synthetic oligonucleotide
  Target: SCN9A; (+) strand; PAM type: YTN; PAM sequence: CTT
cgtaactatagttaacaata

SEQ ID NO: 97549 - DNA, 20 bp, Artificial Sequence
  Description of Artificial Sequence: Synthetic oligonucleotide
  Target: SCN9A; (+) strand; PAM type: YTN; PAM sequence: TTC
gtaactatagttaacaatat

SEQ ID NO: 97550 - DNA, 20 bp, Artificial Sequence
  Description of Artificial Sequence: Synthetic oligonucleotide
  Target: SCN9A; (+) strand; PAM type: YTN; PAM sequence: CTA
tagttaacaatatatatagt

SEQ ID NO: 97551 - DNA, 20 bp, Artificial Sequence
  Description of Artificial Sequence: Synthetic oligonucleotide
  Target: SCN9A; (+) strand; PAM type: YTN; PAM sequence: TTA
acaatatatatagtatactt

SEQ ID NO: 97552 - DNA, 20 bp, Artificial Sequence
  Description of Artificial Sequence: Synthetic oligonucleotide
  Target: SCN9A; (+) strand; PAM type: YTN; PAM sequence: CTT
aaaaattttgttaagcaggt

SEQ ID NO: 97553 - DNA, 20 bp, Artificial Sequence
  Description of Artificial Sequence: Synthetic oligonucleotide
  Target: SCN9A; (+) strand; PAM type: YTN; PAM sequence: TTA
aaaattttgttaagcaggta

SEQ ID NO: 97554 - DNA, 20 bp, Artificial Sequence
  Description of Artificial Sequence: Synthetic oligonucleotide
  Target: SCN9A; (+) strand; PAM type: YTN; PAM sequence: TTT
tgttaagcaggtagatctca

SEQ ID NO: 97555 - DNA, 20 bp, Artificial Sequence
  Description of Artificial Sequence: Synthetic oligonucleotide
  Target: SCN9A; (+) strand; PAM type: YTN; PAM sequence: TTT
gttaagcaggtagatctcat

SEQ ID NO: 97556 - DNA, 20 bp, Artificial Sequence
  Description of Artificial Sequence: Synthetic oligonucleotide
  Target: SCN9A; (+) strand; PAM type: YTN; PAM sequence: TTG
ttaagcaggtagatctcata

SEQ ID NO: 97557 - DNA, 20 bp, Artificial Sequence
  Description of Artificial Sequence: Synthetic oligonucleotide
  Target: SCN9A; (+) strand; PAM type: YTN; PAM sequence: TTA
agcaggtagatctcatatta

SEQ ID NO: 97558 - DNA, 20 bp, Artificial Sequence
  Description of Artificial Sequence: Synthetic oligonucleotide
  Target: SCN9A; (+) strand; PAM type: YTN; PAM sequence: CTC
atattaagtttccttaccac

SEQ ID NO: 97559 - DNA, 20 bp, Artificial Sequence
  Description of Artificial Sequence: Synthetic oligonucleotide
  Target: SCN9A; (+) strand; PAM type: YTN; PAM sequence: TTA
agtttccttaccacaataat

SEQ ID NO: 97560 - DNA, 20 bp, Artificial Sequence
  Description of Artificial Sequence: Synthetic oligonucleotide
  Target: SCN9A; (+) strand; PAM type: YTN; PAM sequence: TTT
ccttaccacaataattaaaa

SEQ ID NO: 97561 - DNA, 20 bp, Artificial Sequence
  Description of Artificial Sequence: Synthetic oligonucleotide
  Target: SCN9A; (+) strand; PAM type: YTN; PAM sequence: TTC
cttaccacaataattaaaat

SEQ ID NO: 97562 - DNA, 20 bp, Artificial Sequence
  Description of Artificial Sequence: Synthetic oligonucleotide
  Target: SCN9A; (+) strand; PAM type: YTN; PAM sequence: CTT
accacaataattaaaattag

SEQ ID NO: 97563 - DNA, 20 bp, Artificial Sequence
  Description of Artificial Sequence: Synthetic oligonucleotide
  Target: SCN9A; (+) strand; PAM type: YTN; PAM sequence: TTA
ccacaataattaaaattagg

SEQ ID NO: 97564 - DNA, 20 bp, Artificial Sequence
  Description of Artificial Sequence: Synthetic oligonucleotide
  Target: SCN9A; (+) strand; PAM type: YTN; PAM sequence: TTA
aaattaggaaaggcaaagaa

SEQ ID NO: 97565 - DNA, 20 bp, Artificial Sequence
  Description of Artificial Sequence: Synthetic oligonucleotide
  Target: SCN9A; (+) strand; PAM type: YTN; PAM sequence: TTA
ggaaaggcaaagaaaaggat

SEQ ID NO: 97566 - DNA, 20 bp, Artificial Sequence
  Description of Artificial Sequence: Synthetic oligonucleotide
  Target: SCN9A; (+) strand; PAM type: YTN; PAM sequence: CTT
tcatttgttttttttctttg

SEQ ID NO: 97567 - DNA, 20 bp, Artificial Sequence
  Description of Artificial Sequence: Synthetic oligonucleotide
  Target: SCN9A; (+) strand; PAM type: YTN; PAM sequence: TTT
catttgttttttttctttgg

SEQ ID NO: 97568 - DNA, 20 bp, Artificial Sequence
  Description of Artificial Sequence: Synthetic oligonucleotide
  Target: SCN9A; (+) strand; PAM type: YTN; PAM sequence: TTC
atttgttttttttctttgga

SEQ ID NO: 97569 - DNA, 20 bp, Artificial Sequence
  Description of Artificial Sequence: Synthetic oligonucleotide
  Target: SCN9A; (+) strand; PAM type: YTN; PAM sequence: TTT
gttttttttctttggaataa

SEQ ID NO: 97570 - DNA, 20 bp, Artificial Sequence
  Description of Artificial Sequence: Synthetic oligonucleotide
  Target: SCN9A; (+) strand; PAM type: YTN; PAM sequence: TTG
ttttttttctttggaataaa

SEQ ID NO: 97571 - DNA, 20 bp, Artificial Sequence
  Description of Artificial Sequence: Synthetic oligonucleotide
  Target: SCN9A; (+) strand; PAM type: YTN; PAM sequence: TTT
tttttctttggaataaatga

SEQ ID NO: 97572 - DNA, 20 bp, Artificial Sequence
  Description of Artificial Sequence: Synthetic oligonucleotide
  Target: SCN9A; (+) strand; PAM type: YTN; PAM sequence: TTT
ttttctttggaataaatgag

SEQ ID NO: 97573 - DNA, 20 bp, Artificial Sequence
  Description of Artificial Sequence: Synthetic oligonucleotide
  Target: SCN9A; (+) strand; PAM type: YTN; PAM sequence: TTT
tttctttggaataaatgagt

SEQ ID NO: 97574 - DNA, 20 bp, Artificial Sequence
  Description of Artificial Sequence: Synthetic oligonucleotide
  Target: SCN9A; (+) strand; PAM type: YTN; PAM sequence: TTT
ttctttggaataaatgagtt

SEQ ID NO: 97575 - DNA, 20 bp, Artificial Sequence
  Description of Artificial Sequence: Synthetic oligonucleotide
  Target: SCN9A; (+) strand; PAM type: YTN; PAM sequence: TTT
tctttggaataaatgagttc

SEQ ID NO: 97576 - DNA, 20 bp, Artificial Sequence
  Description of Artificial Sequence: Synthetic oligonucleotide
  Target: SCN9A; (+) strand; PAM type: YTN; PAM sequence: TTT
ctttggaataaatgagttca

SEQ ID NO: 97577 - DNA, 20 bp, Artificial Sequence
  Description of Artificial Sequence: Synthetic oligonucleotide
  Target: SCN9A; (+) strand; PAM type: YTN; PAM sequence: TTC
tttggaataaatgagttcat

SEQ ID NO: 97578 - DNA, 20 bp, Artificial Sequence
  Description of Artificial Sequence: Synthetic oligonucleotide
  Target: SCN9A; (+) strand; PAM type: YTN; PAM sequence: CTT
tggaataaatgagttcatca

SEQ ID NO: 97579 - DNA, 20 bp, Artificial Sequence
  Description of Artificial Sequence: Synthetic oligonucleotide
  Target: SCN9A; (+) strand; PAM type: YTN; PAM sequence: TTT
ggaataaatgagttcatcac

SEQ ID NO: 97580 - DNA, 20 bp, Artificial Sequence
  Description of Artificial Sequence: Synthetic oligonucleotide
  Target: SCN9A; (+) strand; PAM type: YTN; PAM sequence: TTG
gaataaatgagttcatcaca

SEQ ID NO: 97581 - DNA, 20 bp, Artificial Sequence
  Description of Artificial Sequence: Synthetic oligonucleotide
  Target: SCN9A; (+) strand; PAM type: YTN; PAM sequence: TTC
atcacaaagcatctactacg

SEQ ID NO: 97582 - DNA, 20 bp, Artificial Sequence
  Description of Artificial Sequence: Synthetic oligonucleotide
  Target: SCN9A; (+) strand; PAM type: YTN; PAM sequence: CTA
ctacgtacttctacatagca

SEQ ID NO: 97583 - DNA, 20 bp, Artificial Sequence
  Description of Artificial Sequence: Synthetic oligonucleotide
  Target: SCN9A; (+) strand; PAM type: YTN; PAM sequence: CTA
cgtacttctacatagcatgt

SEQ ID NO: 97584 - DNA, 20 bp, Artificial Sequence
  Description of Artificial Sequence: Synthetic oligonucleotide
  Target: SCN9A; (+) strand; PAM type: YTN; PAM sequence: CTT
ctacatagcatgtgttaact

SEQ ID NO: 97585 - DNA, 20 bp, Artificial Sequence
  Description of Artificial Sequence: Synthetic oligonucleotide
  Target: SCN9A; (+) strand; PAM type: YTN; PAM sequence: TTC
tacatagcatgtgttaacta

SEQ ID NO: 97586 - DNA, 20 bp, Artificial Sequence
  Description of Artificial Sequence: Synthetic oligonucleotide
  Target: SCN9A; (+) strand; PAM type: YTN; PAM sequence: CTA
catagcatgtgttaactaat

SEQ ID NO: 97587 - DNA, 20 bp, Artificial Sequence
  Description of Artificial Sequence: Synthetic oligonucleotide
  Target: SCN9A; (+) strand; PAM type: YTN; PAM sequence: TTA
actaattgaagtgttggtca

SEQ ID NO: 97588 - DNA, 20 bp, Artificial Sequence
  Description of Artificial Sequence: Synthetic oligonucleotide
  Target: SCN9A; (+) strand; PAM type: YTN; PAM sequence: CTA
attgaagtgttggtcatgtt

SEQ ID NO: 97589 - DNA, 20 bp, Artificial Sequence
  Description of Artificial Sequence: Synthetic oligonucleotide
  Target: SCN9A; (+) strand; PAM type: YTN; PAM sequence: TTG
aagtgttggtcatgtttttt

SEQ ID NO: 97590 - DNA, 20 bp, Artificial Sequence
  Description of Artificial Sequence: Synthetic oligonucleotide
  Target: SCN9A; (+) strand; PAM type: YTN; PAM sequence: TTG
gtcatgttttttcagggaag

SEQ ID NO: 97591 - DNA, 20 bp, Artificial Sequence
  Description of Artificial Sequence: Synthetic oligonucleotide
  Target: SCN9A; (+) strand; PAM type: YTN; PAM sequence: TTT
tttcagggaagagtggaaag

SEQ ID NO: 97592 - DNA, 20 bp, Artificial Sequence
  Description of Artificial Sequence: Synthetic oligonucleotide
  Target: SCN9A; (+) strand; PAM type: YTN; PAM sequence: TTT
ttcagggaagagtggaaaga

SEQ ID NO: 97593 - DNA, 20 bp, Artificial Sequence
  Description of Artificial Sequence: Synthetic oligonucleotide
  Target: SCN9A; (+) strand; PAM type: YTN; PAM sequence: TTT
tcagggaagagtggaaagaa

SEQ ID NO: 97594 - DNA, 20 bp, Artificial Sequence
  Description of Artificial Sequence: Synthetic oligonucleotide
  Target: SCN9A; (+) strand; PAM type: YTN; PAM sequence: TTT
cagggaagagtggaaagaaa

SEQ ID NO: 97595 - DNA, 20 bp, Artificial Sequence
  Description of Artificial Sequence: Synthetic oligonucleotide
  Target: SCN9A; (+) strand; PAM type: YTN; PAM sequence: TTC
agggaagagtggaaagaaat

SEQ ID NO: 97596 - DNA, 20 bp, Artificial Sequence
  Description of Artificial Sequence: Synthetic oligonucleotide
  Target: SCN9A; (+) strand; PAM type: YTN; PAM sequence: TTC
taaatcattcagaaaaggtc

SEQ ID NO: 97597 - DNA, 20 bp, Artificial Sequence
  Description of Artificial Sequence: Synthetic oligonucleotide
  Target: SCN9A; (+) strand; PAM type: YTN; PAM sequence: CTA
aatcattcagaaaaggtcag

SEQ ID NO: 97598 - DNA, 20 bp, Artificial Sequence
  Description of Artificial Sequence: Synthetic oligonucleotide
  Target: SCN9A; (+) strand; PAM type: YTN; PAM sequence: TTC
agaaaaggtcagaaaataaa

SEQ ID NO: 97599 - DNA, 20 bp, Artificial Sequence
  Description of Artificial Sequence: Synthetic oligonucleotide
  Target: SCN9A; (+) strand; PAM type: YTN; PAM sequence: CTA
tacttagattgcaagatgaa

SEQ ID NO: 97600 - DNA, 20 bp, Artificial Sequence
  Description of Artificial Sequence: Synthetic oligonucleotide
  Target: SCN9A; (+) strand; PAM type: YTN; PAM sequence: CTT
agattgcaagatgaaatact

SEQ ID NO: 97601 - DNA, 20 bp, Artificial Sequence
  Description of Artificial Sequence: Synthetic oligonucleotide
  Target: SCN9A; (+) strand; PAM type: YTN; PAM sequence: TTA
gattgcaagatgaaatactg

SEQ ID NO: 97602 - DNA, 20 bp, Artificial Sequence
  Description of Artificial Sequence: Synthetic oligonucleotide
  Target: SCN9A; (+) strand; PAM type: YTN; PAM sequence: TTG
caagatgaaatactggaaga

SEQ ID NO: 97603 - DNA, 20 bp, Artificial Sequence
  Description of Artificial Sequence: Synthetic oligonucleotide
  Target: SCN9A; (+) strand; PAM type: YTN; PAM sequence: CTG
gaagaatgataggggatatg

SEQ ID NO: 97604 - DNA, 20 bp, Artificial Sequence
  Description of Artificial Sequence: Synthetic oligonucleotide
  Target: SCN9A; (+) strand; PAM type: YTN; PAM sequence: TTT
ttgatgcttctaaatcagta

SEQ ID NO: 97605 - DNA, 20 bp, Artificial Sequence
  Description of Artificial Sequence: Synthetic oligonucleotide
  Target: SCN9A; (+) strand; PAM type: YTN; PAM sequence: TTT
tgatgcttctaaatcagtaa

SEQ ID NO: 97606 - DNA, 20 bp, Artificial Sequence
  Description of Artificial Sequence: Synthetic oligonucleotide
  Target: SCN9A; (+) strand; PAM type: YTN; PAM sequence: TTT
gatgcttctaaatcagtaac

SEQ ID NO: 97607 - DNA, 20 bp, Artificial Sequence
  Description of Artificial Sequence: Synthetic oligonucleotide
  Target: SCN9A; (+) strand; PAM type: YTN; PAM sequence: TTG
atgcttctaaatcagtaact

SEQ ID NO: 97608 - DNA, 20 bp, Artificial Sequence
  Description of Artificial Sequence: Synthetic oligonucleotide
  Target: SCN9A; (+) strand; PAM type: YTN; PAM sequence: CTT
ctaaatcagtaactgtttcc

SEQ ID NO: 97609 - DNA, 20 bp, Artificial Sequence
  Description of Artificial Sequence: Synthetic oligonucleotide
  Target: SCN9A; (+) strand; PAM type: YTN; PAM sequence: TTC
taaatcagtaactgtttcct

SEQ ID NO: 97610 - DNA, 20 bp, Artificial Sequence
  Description of Artificial Sequence: Synthetic oligonucleotide
  Target: SCN9A; (+) strand; PAM type: YTN; PAM sequence: CTA
aatcagtaactgtttcctga

SEQ ID NO: 97611 - DNA, 20 bp, Artificial Sequence
  Description of Artificial Sequence: Synthetic oligonucleotide
  Target: SCN9A; (+) strand; PAM type: YTN; PAM sequence: CTG
tttcctgactttggtggtga

SEQ ID NO: 97612 - DNA, 20 bp, Artificial Sequence
  Description of Artificial Sequence: Synthetic oligonucleotide
  Target: SCN9A; (+) strand; PAM type: YTN; PAM sequence: TTT
cctgactttggtggtgatag

SEQ ID NO: 97613 - DNA, 20 bp, Artificial Sequence
  Description of Artificial Sequence: Synthetic oligonucleotide
  Target: SCN9A; (+) strand; PAM type: YTN; PAM sequence: TTC
ctgactttggtggtgatagt

SEQ ID NO: 97614 - DNA, 20 bp, Artificial Sequence
  Description of Artificial Sequence: Synthetic oligonucleotide
  Target: SCN9A; (+) strand; PAM type: YTN; PAM sequence: CTG
actttggtggtgatagtatc

SEQ ID NO: 97615 - DNA, 20 bp, Artificial Sequence
  Description of Artificial Sequence: Synthetic oligonucleotide
  Target: SCN9A; (+) strand; PAM type: YTN; PAM sequence: CTT
tggtggtgatagtatcaacc

SEQ ID NO: 97616 - DNA, 20 bp, Artificial Sequence
  Description of Artificial Sequence: Synthetic oligonucleotide
  Target: SCN9A; (+) strand; PAM type: YTN; PAM sequence: TTT
ggtggtgatagtatcaaccc

SEQ ID NO: 97617 - DNA, 20 bp, Artificial Sequence
  Description of Artificial Sequence: Synthetic oligonucleotide
  Target: SCN9A; (+) strand; PAM type: YTN; PAM sequence: TTG
gtggtgatagtatcaaccca

SEQ ID NO: 97618 - DNA, 20 bp, Artificial Sequence
  Description of Artificial Sequence: Synthetic oligonucleotide
  Target: SCN9A; (+) strand; PAM type: YTN; PAM sequence: CTA
ttttacttcctgcagtagaa

SEQ ID NO: 97619 - DNA, 20 bp, Artificial Sequence
  Description of Artificial Sequence: Synthetic oligonucleotide
  Target: SCN9A; (+) strand; PAM type: YTN; PAM sequence: TTT
tacttcctgcagtagaaatg

SEQ ID NO: 97620 - DNA, 20 bp, Artificial Sequence
  Description of Artificial Sequence: Synthetic oligonucleotide
  Target: SCN9A; (+) strand; PAM type: YTN; PAM sequence: TTT
acttcctgcagtagaaatgt

SEQ ID NO: 97621 - DNA, 20 bp, Artificial Sequence
  Description of Artificial Sequence: Synthetic oligonucleotide
  Target: SCN9A; (+) strand; PAM type: YTN; PAM sequence: TTA
cttcctgcagtagaaatgtt

SEQ ID NO: 97622 - DNA, 20 bp, Artificial Sequence
  Description of Artificial Sequence: Synthetic oligonucleotide
  Target: SCN9A; (+) strand; PAM type: YTN; PAM sequence: CTT
cctgcagtagaaatgttgta

SEQ ID NO: 97623 - DNA, 20 bp, Artificial Sequence
  Description of Artificial Sequence: Synthetic oligonucleotide
  Target: SCN9A; (+) strand; PAM type: YTN; PAM sequence: TTC
ctgcagtagaaatgttgtaa

SEQ ID NO: 97624 - DNA, 20 bp, Artificial Sequence
  Description of Artificial Sequence: Synthetic oligonucleotide
  Target: SCN9A; (+) strand; PAM type: YTN; PAM sequence: CTG
cagtagaaatgttgtaagaa

SEQ ID NO: 97625 - DNA, 20 bp, Artificial Sequence
  Description of Artificial Sequence: Synthetic oligonucleotide
  Target: SCN9A; (+) strand; PAM type: YTN; PAM sequence: TTG
taagaataacattaacaagc

SEQ ID NO: 97626 - DNA, 20 bp, Artificial Sequence
  Description of Artificial Sequence: Synthetic oligonucleotide
  Target: SCN9A; (+) strand; PAM type: YTN; PAM sequence: TTA
acaagcaggaagattaaagt

SEQ ID NO: 97627 - DNA, 20 bp, Artificial Sequence
  Description of Artificial Sequence: Synthetic oligonucleotide
  Target: SCN9A; (+) strand; PAM type: YTN; PAM sequence: TTA
aagtcaattggatgttggct

SEQ ID NO: 97628 - DNA, 20 bp, Artificial Sequence
  Description of Artificial Sequence: Synthetic oligonucleotide
  Target: SCN9A; (+) strand; PAM type: YTN; PAM sequence: TTG
gatgttggctgttttattta

SEQ ID NO: 97629 - DNA, 20 bp, Artificial Sequence
  Description of Artificial Sequence: Synthetic oligonucleotide
  Target: SCN9A; (+) strand; PAM type: YTN; PAM sequence: TTG
gctgttttatttatgctcat

SEQ ID NO: 97630 - DNA, 20 bp, Artificial Sequence
  Description of Artificial Sequence: Synthetic oligonucleotide
  Target: SCN9A; (+) strand; PAM type: YTN; PAM sequence: CTG
ttttatttatgctcatactg

SEQ ID NO: 97631 - DNA, 20 bp, Artificial Sequence
  Description of Artificial Sequence: Synthetic oligonucleotide
  Target: SCN9A; (+) strand; PAM type: YTN; PAM sequence: TTT
tatttatgctcatactgctc

SEQ ID NO: 97632 - DNA, 20 bp, Artificial Sequence
  Description of Artificial Sequence: Synthetic oligonucleotide
  Target: SCN9A; (+) strand; PAM type: YTN; PAM sequence: TTT
atttatgctcatactgctct

SEQ ID NO: 97633 - DNA, 20 bp, Artificial Sequence
  Description of Artificial Sequence: Synthetic oligonucleotide
  Target: SCN9A; (+) strand; PAM type: YTN; PAM sequence: TTA
tttatgctcatactgctctt

SEQ ID NO: 97634 - DNA, 20 bp, Artificial Sequence
  Description of Artificial Sequence: Synthetic oligonucleotide
  Target: SCN9A; (+) strand; PAM type: YTN; PAM sequence: TTT
atgctcatactgctctttct

SEQ ID NO: 97635 - DNA, 20 bp, Artificial Sequence
  Description of Artificial Sequence: Synthetic oligonucleotide
  Target: SCN9A; (+) strand; PAM type: YTN; PAM sequence: TTA
tgctcatactgctctttcta

SEQ ID NO: 97636 - DNA, 20 bp, Artificial Sequence
  Description of Artificial Sequence: Synthetic oligonucleotide
  Target: SCN9A; (+) strand; PAM type: YTN; PAM sequence: CTC
atactgctctttctagacac

SEQ ID NO: 97637 - DNA, 20 bp, Artificial Sequence
  Description of Artificial Sequence: Synthetic oligonucleotide
  Target: SCN9A; (+) strand; PAM type: YTN; PAM sequence: CTG
ctctttctagacacgcttaa

SEQ ID NO: 97638 - DNA, 20 bp, Artificial Sequence
  Description of Artificial Sequence: Synthetic oligonucleotide
  Target: SCN9A; (+) strand; PAM type: YTN; PAM sequence: CTC
tttctagacacgcttaattt

SEQ ID NO: 97639 - DNA, 20 bp, Artificial Sequence
  Description of Artificial Sequence: Synthetic oligonucleotide
  Target: SCN9A; (+) strand; PAM type: YTN; PAM sequence: CTT
tctagacacgcttaatttat

SEQ ID NO: 97640 - DNA, 20 bp, Artificial Sequence
  Description of Artificial Sequence: Synthetic oligonucleotide
  Target: SCN9A; (+) strand; PAM type: YTN; PAM sequence: TTT
ctagacacgcttaatttatc

SEQ ID NO: 97641 - DNA, 20 bp, Artificial Sequence
  Description of Artificial Sequence: Synthetic oligonucleotide
  Target: SCN9A; (+) strand; PAM type: YTN; PAM sequence: TTC
tagacacgcttaatttatcc

SEQ ID NO: 97642 - DNA, 20 bp, Artificial Sequence
  Description of Artificial Sequence: Synthetic oligonucleotide
  Target: SCN9A; (+) strand; PAM type: YTN; PAM sequence: CTA
gacacgcttaatttatccta

SEQ ID NO: 97643 - DNA, 20 bp, Artificial Sequence
  Description of Artificial Sequence: Synthetic oligonucleotide
  Target: SCN9A; (+) strand; PAM type: YTN; PAM sequence: CTT
aatttatcctatgcagggaa

SEQ ID NO: 97644 - DNA, 20 bp, Artificial Sequence
  Description of Artificial Sequence: Synthetic oligonucleotide
  Target: SCN9A; (+) strand; PAM type: YTN; PAM sequence: TTA
atttatcctatgcagggaag

SEQ ID NO: 97645 - DNA, 20 bp, Artificial Sequence
  Description of Artificial Sequence: Synthetic oligonucleotide
  Target: SCN9A; (+) strand; PAM type: YTN; PAM sequence: TTT
atcctatgcagggaagactg

SEQ ID NO: 97646 - DNA, 20 bp, Artificial Sequence
  Description of Artificial Sequence: Synthetic oligonucleotide
  Target: SCN9A; (+) strand; PAM type: YTN; PAM sequence: TTA
tcctatgcagggaagactga

SEQ ID NO: 97647 - DNA, 20 bp, Artificial Sequence
  Description of Artificial Sequence: Synthetic oligonucleotide
  Target: SCN9A; (+) strand; PAM type: YTN; PAM sequence: CTA
tgcagggaagactgaggaat

SEQ ID NO: 97648 - DNA, 20 bp, Artificial Sequence
  Description of Artificial Sequence: Synthetic oligonucleotide
  Target: SCN9A; (+) strand; PAM type: YTN; PAM sequence: CTG
aggaattacttgtgtgtgct

SEQ ID NO: 97649 - DNA, 20 bp, Artificial Sequence
  Description of Artificial Sequence: Synthetic oligonucleotide
  Target: SCN9A; (+) strand; PAM type: YTN; PAM sequence: TTA
cttgtgtgtgcttatatatt

SEQ ID NO: 97650 - DNA, 20 bp, Artificial Sequence
  Description of Artificial Sequence: Synthetic oligonucleotide
  Target: SCN9A; (+) strand; PAM type: YTN; PAM sequence: CTT
gtgtgtgcttatatattaca

SEQ ID NO: 97651 - DNA, 20 bp, Artificial Sequence
  Description of Artificial Sequence: Synthetic oligonucleotide
  Target: SCN9A; (+) strand; PAM type: YTN; PAM sequence: TTG
tgtgtgcttatatattacat

SEQ ID NO: 97652 - DNA, 20 bp, Artificial Sequence
  Description of Artificial Sequence: Synthetic oligonucleotide
  Target: SCN9A; (+) strand; PAM type: YTN; PAM sequence: CTT
atatattacatgtatgtata

SEQ ID NO: 97653 - DNA, 20 bp, Artificial Sequence
  Description of Artificial Sequence: Synthetic oligonucleotide
  Target: SCN9A; (+) strand; PAM type: YTN; PAM sequence: TTA
tatattacatgtatgtatat

SEQ ID NO: 97654 - DNA, 20 bp, Artificial Sequence
  Description of Artificial Sequence: Synthetic oligonucleotide
  Target: SCN9A; (+) strand; PAM type: YTN; PAM sequence: TTA
catgtatgtatatataatgc

SEQ ID NO: 97655 - DNA, 20 bp, Artificial Sequence
  Description of Artificial Sequence: Synthetic oligonucleotide
  Target: SCN9A; (+) strand; PAM type: YTN; PAM sequence: CTT
aagttgagaaaaataaattg

SEQ ID NO: 97656 - DNA, 20 bp, Artificial Sequence
  Description of Artificial Sequence: Synthetic oligonucleotide
  Target: SCN9A; (+) strand; PAM type: YTN; PAM sequence: TTA
agttgagaaaaataaattga

SEQ ID NO: 97657 - DNA, 20 bp, Artificial Sequence
  Description of Artificial Sequence: Synthetic oligonucleotide
  Target: SCN9A; (+) strand; PAM type: YTN; PAM sequence: TTG
agaaaaataaattgaaaatc

SEQ ID NO: 97658 - DNA, 20 bp, Artificial Sequence
  Description of Artificial Sequence: Synthetic oligonucleotide
  Target: SCN9A; (+) strand; PAM type: YTN; PAM sequence: TTG
aaaatcagtgtacactttat

SEQ ID NO: 97659 - DNA, 20 bp, Artificial Sequence
  Description of Artificial Sequence: Synthetic oligonucleotide
  Target: SCN9A; (+) strand; PAM type: YTN; PAM sequence: CTT
tataaatgtaaaatggaaca

SEQ ID NO: 97660 - DNA, 20 bp, Artificial Sequence
  Description of Artificial Sequence: Synthetic oligonucleotide
  Target: SCN9A; (+) strand; PAM type: YTN; PAM sequence: TTT
ataaatgtaaaatggaacat

SEQ ID NO: 97661 - DNA, 20 bp, Artificial Sequence
  Description of Artificial Sequence: Synthetic oligonucleotide
  Target: SCN9A; (+) strand; PAM type: YTN; PAM sequence: TTA
taaatgtaaaatggaacatg

SEQ ID NO: 97662 - DNA, 20 bp, Artificial Sequence
  Description of Artificial Sequence: Synthetic oligonucleotide
  Target: SCN9A; (+) strand; PAM type: YTN; PAM sequence: TTT
aaaaatctttaaaaataaac

SEQ ID NO: 97663 - DNA, 20 bp, Artificial Sequence
  Description of Artificial Sequence: Synthetic oligonucleotide
  Target: SCN9A; (+) strand; PAM type: YTN; PAM sequence: TTA
aaaatctttaaaaataaaca

SEQ ID NO: 97664 - DNA, 20 bp, Artificial Sequence
  Description of Artificial Sequence: Synthetic oligonucleotide
  Target: SCN9A; (+) strand; PAM type: YTN; PAM sequence: CTT
taaaaataaacatctgtatt

SEQ ID NO: 97665 - DNA, 20 bp, Artificial Sequence
  Description of Artificial Sequence: Synthetic oligonucleotide
  Target: SCN9A; (+) strand; PAM type: YTN; PAM sequence: TTT
aaaaataaacatctgtattt

SEQ ID NO: 97666 - DNA, 20 bp, Artificial Sequence
  Description of Artificial Sequence: Synthetic oligonucleotide
  Target: SCN9A; (+) strand; PAM type: YTN; PAM sequence: TTA
aaaataaacatctgtatttg

SEQ ID NO: 97667 - DNA, 20 bp, Artificial Sequence
  Description of Artificial Sequence: Synthetic oligonucleotide
  Target: SCN9A; (+) strand; PAM type: YTN; PAM sequence: CTG
tatttgtaaatgtcaggata

SEQ ID NO: 97668 - DNA, 20 bp, Artificial Sequence
  Description of Artificial Sequence: Synthetic oligonucleotide
  Target: SCN9A; (+) strand; PAM type: YTN; PAM sequence: TTT
gtaaatgtcaggataaataa

SEQ ID NO: 97669 - DNA, 20 bp, Artificial Sequence
  Description of Artificial Sequence: Synthetic oligonucleotide
  Target: SCN9A; (+) strand; PAM type: YTN; PAM sequence: TTG
taaatgtcaggataaataat

SEQ ID NO: 97670 - DNA, 20 bp, Artificial Sequence
  Description of Artificial Sequence: Synthetic oligonucleotide
  Target: SCN9A; (+) strand; PAM type: YTN; PAM sequence: TTT
actaaatttttgtctacttg

SEQ ID NO: 97671 - DNA, 20 bp, Artificial Sequence
  Description of Artificial Sequence: Synthetic oligonucleotide
  Target: SCN9A; (+) strand; PAM type: YTN; PAM sequence: TTA
ctaaatttttgtctacttgc

SEQ ID NO: 97672 - DNA, 20 bp, Artificial Sequence
  Description of Artificial Sequence: Synthetic oligonucleotide
  Target: SCN9A; (+) strand; PAM type: YTN; PAM sequence: CTA
aatttttgtctacttgcaaa

SEQ ID NO: 97673 - DNA, 20 bp, Artificial Sequence
  Description of Artificial Sequence: Synthetic oligonucleotide
  Target: SCN9A; (+) strand; PAM type: YTN; PAM sequence: TTT
ttgtctacttgcaaatagtc

SEQ ID NO: 97674 - DNA, 20 bp, Artificial Sequence
  Description of Artificial Sequence: Synthetic oligonucleotide
  Target: SCN9A; (+) strand; PAM type: YTN; PAM sequence: TTT
tgtctacttgcaaatagtca

SEQ ID NO: 97675 - DNA, 20 bp, Artificial Sequence
  Description of Artificial Sequence: Synthetic oligonucleotide
  Target: SCN9A; (+) strand; PAM type: YTN; PAM sequence: TTT
gtctacttgcaaatagtcaa

SEQ ID NO: 97676 - DNA, 20 bp, Artificial Sequence
  Description of Artificial Sequence: Synthetic oligonucleotide
  Target: SCN9A; (+) strand; PAM type: YTN; PAM sequence: TTG
tctacttgcaaatagtcaat

SEQ ID NO: 97677 - DNA, 20 bp, Artificial Sequence
  Description of Artificial Sequence: Synthetic oligonucleotide
  Target: SCN9A; (+) strand; PAM type: YTN; PAM sequence: CTA
cttgcaaatagtcaatcatg

SEQ ID NO: 97678 - DNA, 20 bp, Artificial Sequence
  Description of Artificial Sequence: Synthetic oligonucleotide
  Target: SCN9A; (+) strand; PAM type: YTN; PAM sequence: CTT
gcaaatagtcaatcatgcac

SEQ ID NO: 97679 - DNA, 20 bp, Artificial Sequence
  Description of Artificial Sequence: Synthetic oligonucleotide
  Target: SCN9A; (+) strand; PAM type: YTN; PAM sequence: TTG
caaatagtcaatcatgcaca

SEQ ID NO: 97680 - DNA, 20 bp, Artificial Sequence
  Description of Artificial Sequence: Synthetic oligonucleotide
  Target: SCN9A; (+) strand; PAM type: YTN; PAM sequence: CTA
atgacattttggtacatgta

SEQ ID NO: 97681 - DNA, 20 bp, Artificial Sequence
  Description of Artificial Sequence: Synthetic oligonucleotide
  Target: SCN9A; (+) strand; PAM type: YTN; PAM sequence: TTT
tggtacatgtacatctgtct

SEQ ID NO: 97682 - DNA, 20 bp, Artificial Sequence
  Description of Artificial Sequence: Synthetic oligonucleotide
  Target: SCN9A; (+) strand; PAM type: YTN; PAM sequence: TTT
ggtacatgtacatctgtctt

SEQ ID NO: 97683 - DNA, 20 bp, Artificial Sequence
  Description of Artificial Sequence: Synthetic oligonucleotide
  Target: SCN9A; (+) strand; PAM type: YTN; PAM sequence: TTG
gtacatgtacatctgtcttc

SEQ ID NO: 97684 - DNA, 20 bp, Artificial Sequence
  Description of Artificial Sequence: Synthetic oligonucleotide
  Target: SCN9A; (+) strand; PAM type: YTN; PAM sequence: CTG
tcttcttagatgctaagcca

SEQ ID NO: 97685 - DNA, 20 bp, Artificial Sequence
  Description of Artificial Sequence: Synthetic oligonucleotide
  Target: SCN9A; (+) strand; PAM type: YTN; PAM sequence: CTT
cttagatgctaagccagtac

SEQ ID NO: 97686 - DNA, 20 bp, Artificial Sequence
  Description of Artificial Sequence: Synthetic oligonucleotide
  Target: SCN9A; (+) strand; PAM type: YTN; PAM sequence: TTC
ttagatgctaagccagtacc

SEQ ID NO: 97687 - DNA, 20 bp, Artificial Sequence
  Description of Artificial Sequence: Synthetic oligonucleotide
  Target: SCN9A; (+) strand; PAM type: YTN; PAM sequence: CTT
agatgctaagccagtaccca

SEQ ID NO: 97688 - DNA, 20 bp, Artificial Sequence
  Description of Artificial Sequence: Synthetic oligonucleotide
  Target: SCN9A; (+) strand; PAM type: YTN; PAM sequence: TTA
gatgctaagccagtacccaa

SEQ ID NO: 97689 - DNA, 20 bp, Artificial Sequence
  Description of Artificial Sequence: Synthetic oligonucleotide
  Target: SCN9A; (+) strand; PAM type: YTN; PAM sequence: CTA
agccagtacccaaaattatt

SEQ ID NO: 97690 - DNA, 20 bp, Artificial Sequence
  Description of Artificial Sequence: Synthetic oligonucleotide
  Target: SCN9A; (+) strand; PAM type: YTN; PAM sequence: TTA
ttattctcttttgtaattct

SEQ ID NO: 97691 - DNA, 20 bp, Artificial Sequence
  Description of Artificial Sequence: Synthetic oligonucleotide
  Target: SCN9A; (+) strand; PAM type: YTN; PAM sequence: TTA
ttctcttttgtaattctacc

SEQ ID NO: 97692 - DNA, 20 bp, Artificial Sequence
  Description of Artificial Sequence: Synthetic oligonucleotide
  Target: SCN9A; (+) strand; PAM type: YTN; PAM sequence: TTC
tcttttgtaattctaccatt

SEQ ID NO: 97693 - DNA, 20 bp, Artificial Sequence
  Description of Artificial Sequence: Synthetic oligonucleotide
  Target: SCN9A; (+) strand; PAM type: YTN; PAM sequence: CTC
ttttgtaattctaccattta

SEQ ID NO: 97694 - DNA, 20 bp, Artificial Sequence
  Description of Artificial Sequence: Synthetic oligonucleotide
  Target: SCN9A; (+) strand; PAM type: YTN; PAM sequence: CTT
ttgtaattctaccatttagt

SEQ ID NO: 97695 - DNA, 20 bp, Artificial Sequence
  Description of Artificial Sequence: Synthetic oligonucleotide
  Target: SCN9A; (+) strand; PAM type: YTN; PAM sequence: TTT
tgtaattctaccatttagtc

SEQ ID NO: 97696 - DNA, 20 bp, Artificial Sequence
  Description of Artificial Sequence: Synthetic oligonucleotide
  Target: SCN9A; (+) strand; PAM type: YTN; PAM sequence: TTT
gtaattctaccatttagtct

SEQ ID NO: 97697 - DNA, 20 bp, Artificial Sequence
  Description of Artificial Sequence: Synthetic oligonucleotide
  Target: SCN9A; (+) strand; PAM type: YTN; PAM sequence: TTG
taattctaccatttagtctc

SEQ ID NO: 97698 - DNA, 20 bp, Artificial Sequence
  Description of Artificial Sequence: Synthetic oligonucleotide
  Target: SCN9A; (+) strand; PAM type: YTN; PAM sequence: TTC
taccatttagtctccaaaga

SEQ ID NO: 97699 - DNA, 20 bp, Artificial Sequence
  Description of Artificial Sequence: Synthetic oligonucleotide
  Target: SCN9A; (+) strand; PAM type: YTN; PAM sequence: CTA
ccatttagtctccaaagatc

SEQ ID NO: 97700 - DNA, 20 bp, Artificial Sequence
  Description of Artificial Sequence: Synthetic oligonucleotide
  Target: SCN9A; (+) strand; PAM type: YTN; PAM sequence: TTT
agtctccaaagatctctttt

SEQ ID NO: 97701 - DNA, 20 bp, Artificial Sequence
  Description of Artificial Sequence: Synthetic oligonucleotide
  Target: SCN9A; (+) strand; PAM type: YTN; PAM sequence: TTA
gtctccaaagatctcttttt

SEQ ID NO: 97702 - DNA, 20 bp, Artificial Sequence
  Description of Artificial Sequence: Synthetic oligonucleotide
  Target: SCN9A; (+) strand; PAM type: YTN; PAM sequence: CTC
caaagatctctttttgtata

SEQ ID NO: 97703 - DNA, 20 bp, Artificial Sequence
  Description of Artificial Sequence: Synthetic oligonucleotide
  Target: SCN9A; (+) strand; PAM type: YTN; PAM sequence: CTC
tttttgtataggtggtacca

SEQ ID NO: 97704 - DNA, 20 bp, Artificial Sequence
  Description of Artificial Sequence: Synthetic oligonucleotide
  Target: SCN9A; (+) strand; PAM type: YTN; PAM sequence: CTT
tttgtataggtggtaccaca

SEQ ID NO: 97705 - DNA, 20 bp, Artificial Sequence
  Description of Artificial Sequence: Synthetic oligonucleotide
  Target: SCN9A; (+) strand; PAM type: YTN; PAM sequence: TTT
ttgtataggtggtaccacaa

SEQ ID NO: 97706 - DNA, 20 bp, Artificial Sequence
  Description of Artificial Sequence: Synthetic oligonucleotide
  Target: SCN9A; (+) strand; PAM type: YTN; PAM sequence: TTT
tgtataggtggtaccacaac

SEQ ID NO: 97707 - DNA, 20 bp, Artificial Sequence
  Description of Artificial Sequence: Synthetic oligonucleotide
  Target: SCN9A; (+) strand; PAM type: YTN; PAM sequence: TTT
gtataggtggtaccacaacc

SEQ ID NO: 97708 - DNA, 20 bp, Artificial Sequence
  Description of Artificial Sequence: Synthetic oligonucleotide
  Target: SCN9A; (+) strand; PAM type: YTN; PAM sequence: TTG
tataggtggtaccacaacca

SEQ ID NO: 97709 - DNA, 20 bp, Artificial Sequence
  Description of Artificial Sequence: Synthetic oligonucleotide
  Target: SCN9A; (+) strand; PAM type: YTN; PAM sequence: CTC
agttagttgacaagaaactc

SEQ ID NO: 97710 - DNA, 20 bp, Artificial Sequence
  Description of Artificial Sequence: Synthetic oligonucleotide
  Target: SCN9A; (+) strand; PAM type: YTN; PAM sequence: TTA
gttgacaagaaactccagaa

SEQ ID NO: 97711 - DNA, 20 bp, Artificial Sequence
  Description of Artificial Sequence: Synthetic oligonucleotide
  Target: SCN9A; (+) strand; PAM type: YTN; PAM sequence: TTG
acaagaaactccagaattag

SEQ ID NO: 97712 - DNA, 20 bp, Artificial Sequence
  Description of Artificial Sequence: Synthetic oligonucleotide
  Target: SCN9A; (+) strand; PAM type: YTN; PAM sequence: CTC
cagaattagactcctttatc

SEQ ID NO: 97713 - DNA, 20 bp, Artificial Sequence
  Description of Artificial Sequence: Synthetic oligonucleotide
  Target: SCN9A; (+) strand; PAM type: YTN; PAM sequence: TTA
gactcctttatctcttgcaa

SEQ ID NO: 97714 - DNA, 20 bp, Artificial Sequence
  Description of Artificial Sequence: Synthetic oligonucleotide
  Target: SCN9A; (+) strand; PAM type: YTN; PAM sequence: CTC
ctttatctcttgcaaatcac

SEQ ID NO: 97715 - DNA, 20 bp, Artificial Sequence
  Description of Artificial Sequence: Synthetic oligonucleotide
  Target: SCN9A; (+) strand; PAM type: YTN; PAM sequence: CTT
tatctcttgcaaatcacaag

SEQ ID NO: 97716 - DNA, 20 bp, Artificial Sequence
  Description of Artificial Sequence: Synthetic oligonucleotide
  Target: SCN9A; (+) strand; PAM type: YTN; PAM sequence: TTT
atctcttgcaaatcacaagc

SEQ ID NO: 97717 - DNA, 20 bp, Artificial Sequence
  Description of Artificial Sequence: Synthetic oligonucleotide
  Target: SCN9A; (+) strand; PAM type: YTN; PAM sequence: TTA
tctcttgcaaatcacaagca

SEQ ID NO: 97718 - DNA, 20 bp, Artificial Sequence
  Description of Artificial Sequence: Synthetic oligonucleotide
  Target: SCN9A; (+) strand; PAM type: YTN; PAM sequence: CTC
ttgcaaatcacaagcaatac

SEQ ID NO: 97719 - DNA, 20 bp, Artificial Sequence
  Description of Artificial Sequence: Synthetic oligonucleotide
  Target: SCN9A; (+) strand; PAM type: YTN; PAM sequence: CTT
gcaaatcacaagcaatactg

SEQ ID NO: 97720 - DNA, 20 bp, Artificial Sequence
  Description of Artificial Sequence: Synthetic oligonucleotide
  Target: SCN9A; (+) strand; PAM type: YTN; PAM sequence: TTG
caaatcacaagcaatactgt

SEQ ID NO: 97721 - DNA, 20 bp, Artificial Sequence
  Description of Artificial Sequence: Synthetic oligonucleotide
  Target: SCN9A; (+) strand; PAM type: YTN; PAM sequence: CTG
tagattctaccctctaaaat

SEQ ID NO: 97722 - DNA, 20 bp, Artificial Sequence
  Description of Artificial Sequence: Synthetic oligonucleotide
  Target: SCN9A; (+) strand; PAM type: YTN; PAM sequence: TTC
taccctctaaaatgttttaa

SEQ ID NO: 97723 - DNA, 20 bp, Artificial Sequence
  Description of Artificial Sequence: Synthetic oligonucleotide
  Target: SCN9A; (+) strand; PAM type: YTN; PAM sequence: CTA
ccctctaaaatgttttaatg

SEQ ID NO: 97724 - DNA, 20 bp, Artificial Sequence
  Description of Artificial Sequence: Synthetic oligonucleotide
  Target: SCN9A; (+) strand; PAM type: YTN; PAM sequence: CTC
taaaatgttttaatggaaca

SEQ ID NO: 97725 - DNA, 20 bp, Artificial Sequence
  Description of Artificial Sequence: Synthetic oligonucleotide
  Target: SCN9A; (+) strand; PAM type: YTN; PAM sequence: CTA
aaatgttttaatggaacata

SEQ ID NO: 97726 - DNA, 20 bp, Artificial Sequence
  Description of Artificial Sequence: Synthetic oligonucleotide
  Target: SCN9A; (+) strand; PAM type: YTN; PAM sequence: TTT
taatggaacatatttcctat

SEQ ID NO: 97727 - DNA, 20 bp, Artificial Sequence
  Description of Artificial Sequence: Synthetic oligonucleotide
  Target: SCN9A; (+) strand; PAM type: YTN; PAM sequence: TTT
aatggaacatatttcctatt

SEQ ID NO: 97728 - DNA, 20 bp, Artificial Sequence
  Description of Artificial Sequence: Synthetic oligonucleotide
  Target: SCN9A; (+) strand; PAM type: YTN; PAM sequence: TTA
atggaacatatttcctattc

SEQ ID NO: 97729 - DNA, 20 bp, Artificial Sequence
  Description of Artificial Sequence: Synthetic oligonucleotide
  Target: SCN9A; (+) strand; PAM type: YTN; PAM sequence: TTT
cctattctccattgacacac

SEQ ID NO: 97730 - DNA, 20 bp, Artificial Sequence
  Description of Artificial Sequence: Synthetic oligonucleotide
  Target: SCN9A; (+) strand; PAM type: YTN; PAM sequence: TTC
ctattctccattgacacaca

SEQ ID NO: 97731 - DNA, 20 bp, Artificial Sequence
  Description of Artificial Sequence: Synthetic oligonucleotide
  Target: SCN9A; (+) strand; PAM type: YTN; PAM sequence: CTA
ttctccattgacacacagga

SEQ ID NO: 97732 - DNA, 20 bp, Artificial Sequence
  Description of Artificial Sequence: Synthetic oligonucleotide
  Target: SCN9A; (+) strand; PAM type: YTN; PAM sequence: TTC
tccattgacacacaggacta

SEQ ID NO: 97733 - DNA, 20 bp, Artificial Sequence
  Description of Artificial Sequence: Synthetic oligonucleotide
  Target: SCN9A; (+) strand; PAM type: YTN; PAM sequence: CTC
cattgacacacaggactaat

SEQ ID NO: 97734 - DNA, 20 bp, Artificial Sequence
  Description of Artificial Sequence: Synthetic oligonucleotide
  Target: SCN9A; (+) strand; PAM type: YTN; PAM sequence: TTG
acacacaggactaatttgga

SEQ ID NO: 97735 - DNA, 20 bp, Artificial Sequence
  Description of Artificial Sequence: Synthetic oligonucleotide
  Target: SCN9A; (+) strand; PAM type: YTN; PAM sequence: CTA
atttggagacttagtgtggt

SEQ ID NO: 97736 - DNA, 20 bp, Artificial Sequence
  Description of Artificial Sequence: Synthetic oligonucleotide
  Target: SCN9A; (+) strand; PAM type: YTN; PAM sequence: TTT
ggagacttagtgtggtccag

SEQ ID NO: 97737 - DNA, 20 bp, Artificial Sequence
  Description of Artificial Sequence: Synthetic oligonucleotide
  Target: SCN9A; (+) strand; PAM type: YTN; PAM sequence: TTG
gagacttagtgtggtccagg

SEQ ID NO: 97738 - DNA, 20 bp, Artificial Sequence
  Description of Artificial Sequence: Synthetic oligonucleotide
  Target: SCN9A; (+) strand; PAM type: YTN; PAM sequence: CTT
agtgtggtccaggtggcagg

SEQ ID NO: 97739 - DNA, 20 bp, Artificial Sequence
  Description of Artificial Sequence: Synthetic oligonucleotide
  Target: SCN9A; (+) strand; PAM type: YTN; PAM sequence: TTA
gtgtggtccaggtggcaggt

SEQ ID NO: 97740 - DNA, 20 bp, Artificial Sequence
  Description of Artificial Sequence: Synthetic oligonucleotide
  Target: SCN9A; (+) strand; PAM type: YTN; PAM sequence: CTG
aaatagtctttggtccttcc

SEQ ID NO: 97741 - DNA, 20 bp, Artificial Sequence
  Description of Artificial Sequence: Synthetic oligonucleotide
  Target: SCN9A; (+) strand; PAM type: YTN; PAM sequence: CTT
tggtccttccctagtcattt

SEQ ID NO: 97742 - DNA, 20 bp, Artificial Sequence
  Description of Artificial Sequence: Synthetic oligonucleotide
  Target: SCN9A; (+) strand; PAM type: YTN; PAM sequence: TTT
ggtccttccctagtcatttt

SEQ ID NO: 97743 - DNA, 20 bp, Artificial Sequence
  Description of Artificial Sequence: Synthetic oligonucleotide
  Target: SCN9A; (+) strand; PAM type: YTN; PAM sequence: TTG
gtccttccctagtcattttg

SEQ ID NO: 97744 - DNA, 20 bp, Artificial Sequence
  Description of Artificial Sequence: Synthetic oligonucleotide
  Target: SCN9A; (+) strand; PAM type: YTN; PAM sequence: CTT
ccctagtcattttgtgcatc

SEQ ID NO: 97745 - DNA, 20 bp, Artificial Sequence
  Description of Artificial Sequence: Synthetic oligonucleotide
  Target: SCN9A; (+) strand; PAM type: YTN; PAM sequence: TTC
cctagtcattttgtgcatca

SEQ ID NO: 97746 - DNA, 20 bp, Artificial Sequence
  Description of Artificial Sequence: Synthetic oligonucleotide
  Target: SCN9A; (+) strand; PAM type: YTN; PAM sequence: CTA
gtcattttgtgcatcactgc

SEQ ID NO: 97747 - DNA, 20 bp, Artificial Sequence
  Description of Artificial Sequence: Synthetic oligonucleotide
  Target: SCN9A; (+) strand; PAM type: YTN; PAM sequence: TTT
tgtgcatcactgctagatta

SEQ ID NO: 97748 - DNA, 20 bp, Artificial Sequence
  Description of Artificial Sequence: Synthetic oligonucleotide
  Target: SCN9A; (+) strand; PAM type: YTN; PAM sequence: TTT
gtgcatcactgctagattaa

SEQ ID NO: 97749 - DNA, 20 bp, Artificial Sequence
  Description of Artificial Sequence: Synthetic oligonucleotide
  Target: SCN9A; (+) strand; PAM type: YTN; PAM sequence: TTG
tgcatcactgctagattaat

SEQ ID NO: 97750 - DNA, 20 bp, Artificial Sequence
  Description of Artificial Sequence: Synthetic oligonucleotide
  Target: SCN9A; (+) strand; PAM type: YTN; PAM sequence: CTG
ctagattaattttttgtaaa

SEQ ID NO: 97751 - DNA, 20 bp, Artificial Sequence
  Description of Artificial Sequence: Synthetic oligonucleotide
  Target: SCN9A; (+) strand; PAM type: YTN; PAM sequence: CTA
gattaattttttgtaaagct

SEQ ID NO: 97752 - DNA, 20 bp, Artificial Sequence
  Description of Artificial Sequence: Synthetic oligonucleotide
  Target: SCN9A; (+) strand; PAM type: YTN; PAM sequence: TTA
attttttgtaaagctcagtc

SEQ ID NO: 97753 - DNA, 20 bp, Artificial Sequence
  Description of Artificial Sequence: Synthetic oligonucleotide
  Target: SCN9A; (+) strand; PAM type: YTN; PAM sequence: TTT
tttgtaaagctcagtctcta

SEQ ID NO: 97754 - DNA, 20 bp, Artificial Sequence
  Description of Artificial Sequence: Synthetic oligonucleotide
  Target: SCN9A; (+) strand; PAM type: YTN; PAM sequence: TTT
ttgtaaagctcagtctctag

SEQ ID NO: 97755 - DNA, 20 bp, Artificial Sequence
  Description of Artificial Sequence: Synthetic oligonucleotide
  Target: SCN9A; (+) strand; PAM type: YTN; PAM sequence: TTT
tgtaaagctcagtctctaga

SEQ ID NO: 97756 - DNA, 20 bp, Artificial Sequence
  Description of Artificial Sequence: Synthetic oligonucleotide
  Target: SCN9A; (+) strand; PAM type: YTN; PAM sequence: TTT
gtaaagctcagtctctagaa

SEQ ID NO: 97757 - DNA, 20 bp, Artificial Sequence
  Description of Artificial Sequence: Synthetic oligonucleotide
  Target: SCN9A; (+) strand; PAM type: YTN; PAM sequence: TTG
taaagctcagtctctagaaa

SEQ ID NO: 97758 - DNA, 20 bp, Artificial Sequence
  Description of Artificial Sequence: Synthetic oligonucleotide
  Target: SCN9A; (+) strand; PAM type: YTN; PAM sequence: CTC
agtctctagaaaaagcaatt

SEQ ID NO: 97759 - DNA, 20 bp, Artificial Sequence
  Description of Artificial Sequence: Synthetic oligonucleotide
  Target: SCN9A; (+) strand; PAM type: YTN; PAM sequence: CTC
tagaaaaagcaattctggag

SEQ ID NO: 97760 - DNA, 20 bp, Artificial Sequence
  Description of Artificial Sequence: Synthetic oligonucleotide
  Target: SCN9A; (+) strand; PAM type: YTN; PAM sequence: CTA
gaaaaagcaattctggagct

SEQ ID NO: 97761 - DNA, 20 bp, Artificial Sequence
  Description of Artificial Sequence: Synthetic oligonucleotide
  Target: SCN9A; (+) strand; PAM type: YTN; PAM sequence: TTC
tggagctagatccataatga

SEQ ID NO: 97762 - DNA, 20 bp, Artificial Sequence
  Description of Artificial Sequence: Synthetic oligonucleotide
  Target: SCN9A; (+) strand; PAM type: YTN; PAM sequence: CTG
gagctagatccataatgaaa

SEQ ID NO: 97763 - DNA, 20 bp, Artificial Sequence
  Description of Artificial Sequence: Synthetic oligonucleotide
  Target: SCN9A; (+) strand; PAM type: YTN; PAM sequence: CTA
gatccataatgaaactactt

SEQ ID NO: 97764 - DNA, 20 bp, Artificial Sequence
  Description of Artificial Sequence: Synthetic oligonucleotide
  Target: SCN9A; (+) strand; PAM type: YTN; PAM sequence: CTA
ctttttagctgtcaggccat

SEQ ID NO: 97765 - DNA, 20 bp, Artificial Sequence
  Description of Artificial Sequence: Synthetic oligonucleotide
  Target: SCN9A; (+) strand; PAM type: YTN; PAM sequence: CTT
tttagctgtcaggccatgtg

SEQ ID NO: 97766 - DNA, 20 bp, Artificial Sequence
  Description of Artificial Sequence: Synthetic oligonucleotide
  Target: SCN9A; (+) strand; PAM type: YTN; PAM sequence: TTT
ttagctgtcaggccatgtgc

SEQ ID NO: 97767 - DNA, 20 bp, Artificial Sequence
  Description of Artificial Sequence: Synthetic oligonucleotide
  Target: SCN9A; (+) strand; PAM type: YTN; PAM sequence: TTT
tagctgtcaggccatgtgca

SEQ ID NO: 97768 - DNA, 20 bp, Artificial Sequence
  Description of Artificial Sequence: Synthetic oligonucleotide
  Target: SCN9A; (+) strand; PAM type: YTN; PAM sequence: TTT
agctgtcaggccatgtgcaa

SEQ ID NO: 97769 - DNA, 20 bp, Artificial Sequence
  Description of Artificial Sequence: Synthetic oligonucleotide
  Target: SCN9A; (+) strand; PAM type: YTN; PAM sequence: TTA
gctgtcaggccatgtgcaaa

SEQ ID NO: 97770 - DNA, 20 bp, Artificial Sequence
  Description of Artificial Sequence: Synthetic oligonucleotide
  Target: SCN9A; (+) strand; PAM type: YTN; PAM sequence: CTG
tcaggccatgtgcaaataag

SEQ ID NO: 97771 - DNA, 20 bp, Artificial Sequence
  Description of Artificial Sequence: Synthetic oligonucleotide
  Target: SCN9A; (+) strand; PAM type: YTN; PAM sequence: TTT
ttctgagaggttaaatgagg

SEQ ID NO: 97772 - DNA, 20 bp, Artificial Sequence
  Description of Artificial Sequence: Synthetic oligonucleotide
  Target: SCN9A; (+) strand; PAM type: YTN; PAM sequence: TTT
tctgagaggttaaatgagga

SEQ ID NO: 97773 - DNA, 20 bp, Artificial Sequence
  Description of Artificial Sequence: Synthetic oligonucleotide
  Target: SCN9A; (+) strand; PAM type: YTN; PAM sequence: TTT
ctgagaggttaaatgaggat

SEQ ID NO: 97774 - DNA, 20 bp, Artificial Sequence
  Description of Artificial Sequence: Synthetic oligonucleotide
  Target: SCN9A; (+) strand; PAM type: YTN; PAM sequence: TTC
tgagaggttaaatgaggata

SEQ ID NO: 97775 - DNA, 20 bp, Artificial Sequence
  Description of Artificial Sequence: Synthetic oligonucleotide
  Target: SCN9A; (+) strand; PAM type: YTN; PAM sequence: CTG
agaggttaaatgaggatact

SEQ ID NO: 97776 - DNA, 20 bp, Artificial Sequence
  Description of Artificial Sequence: Synthetic oligonucleotide
  Target: SCN9A; (+) strand; PAM type: YTN; PAM sequence: TTA
aatgaggatactatgtcttt

SEQ ID NO: 97777 - DNA, 20 bp, Artificial Sequence
  Description of Artificial Sequence: Synthetic oligonucleotide
  Target: SCN9A; (+) strand; PAM type: YTN; PAM sequence: CTA
tgtcttttagatttgttgta

SEQ ID NO: 97778 - DNA, 20 bp, Artificial Sequence
  Description of Artificial Sequence: Synthetic oligonucleotide
  Target: SCN9A; (+) strand; PAM type: YTN; PAM sequence: CTT
ttagatttgttgtaaaattt

SEQ ID NO: 97779 - DNA, 20 bp, Artificial Sequence
  Description of Artificial Sequence: Synthetic oligonucleotide
  Target: SCN9A; (+) strand; PAM type: YTN; PAM sequence: TTT
tagatttgttgtaaaatttg

SEQ ID NO: 97780 - DNA, 20 bp, Artificial Sequence
  Description of Artificial Sequence: Synthetic oligonucleotide
  Target: SCN9A; (+) strand; PAM type: YTN; PAM sequence: TTT
agatttgttgtaaaatttga

SEQ ID NO: 97781 - DNA, 20 bp, Artificial Sequence
  Description of Artificial Sequence: Synthetic oligonucleotide
  Target: SCN9A; (+) strand; PAM type: YTN; PAM sequence: TTA
gatttgttgtaaaatttgac

SEQ ID NO: 97782 - DNA, 20 bp, Artificial Sequence
  Description of Artificial Sequence: Synthetic oligonucleotide
  Target: SCN9A; (+) strand; PAM type: YTN; PAM sequence: TTT
gttgtaaaatttgactacaa

SEQ ID NO: 97783 - DNA, 20 bp, Artificial Sequence
  Description of Artificial Sequence: Synthetic oligonucleotide
  Target: SCN9A; (+) strand; PAM type: YTN; PAM sequence: TTG
ttgtaaaatttgactacaat

SEQ ID NO: 97784 - DNA, 20 bp, Artificial Sequence
  Description of Artificial Sequence: Synthetic oligonucleotide
  Target: SCN9A; (+) strand; PAM type: YTN; PAM sequence: TTG
taaaatttgactacaattat

SEQ ID NO: 97785 - DNA, 20 bp, Artificial Sequence
  Description of Artificial Sequence: Synthetic oligonucleotide
  Target: SCN9A; (+) strand; PAM type: YTN; PAM sequence: TTT
gactacaattatgttagaag

SEQ ID NO: 97786 - DNA, 20 bp, Artificial Sequence
  Description of Artificial Sequence: Synthetic oligonucleotide
  Target: SCN9A; (+) strand; PAM type: YTN; PAM sequence: TTG
actacaattatgttagaagt

SEQ ID NO: 97787 - DNA, 20 bp, Artificial Sequence
  Description of Artificial Sequence: Synthetic oligonucleotide
  Target: SCN9A; (+) strand; PAM type: YTN; PAM sequence: CTA
caattatgttagaagtattt

SEQ ID NO: 97788 - DNA, 20 bp, Artificial Sequence
  Description of Artificial Sequence: Synthetic oligonucleotide
  Target: SCN9A; (+) strand; PAM type: YTN; PAM sequence: TTA
tgttagaagtattttacaca

SEQ ID NO: 97789 - DNA, 20 bp, Artificial Sequence
  Description of Artificial Sequence: Synthetic oligonucleotide
  Target: SCN9A; (+) strand; PAM type: YTN; PAM sequence: TTA
gaagtattttacacaggatc

SEQ ID NO: 97790 - DNA, 20 bp, Artificial Sequence
  Description of Artificial Sequence: Synthetic oligonucleotide
  Target: SCN9A; (+) strand; PAM type: YTN; PAM sequence: TTT
tacacaggatctgacatatc

SEQ ID NO: 97791 - DNA, 20 bp, Artificial Sequence
  Description of Artificial Sequence: Synthetic oligonucleotide
  Target: SCN9A; (+) strand; PAM type: YTN; PAM sequence: TTT
acacaggatctgacatatca

SEQ ID NO: 97792 - DNA, 20 bp, Artificial Sequence
  Description of Artificial Sequence: Synthetic oligonucleotide
  Target: SCN9A; (+) strand; PAM type: YTN; PAM sequence: TTA
cacaggatctgacatatcat

SEQ ID NO: 97793 - DNA, 20 bp, Artificial Sequence
  Description of Artificial Sequence: Synthetic oligonucleotide
  Target: SCN9A; (+) strand; PAM type: YTN; PAM sequence: CTG
acatatcatggagtcttaat

SEQ ID NO: 97794 - DNA, 20 bp, Artificial Sequence
  Description of Artificial Sequence: Synthetic oligonucleotide
  Target: SCN9A; (+) strand; PAM type: YTN; PAM sequence: CTT
aataaacatcaatctcctgc

SEQ ID NO: 97795 - DNA, 20 bp, Artificial Sequence
  Description of Artificial Sequence: Synthetic oligonucleotide
  Target: SCN9A; (+) strand; PAM type: YTN; PAM sequence: TTA
ataaacatcaatctcctgct

SEQ ID NO: 97796 - DNA, 20 bp, Artificial Sequence
  Description of Artificial Sequence: Synthetic oligonucleotide
  Target: SCN9A; (+) strand; PAM type: YTN; PAM sequence: CTC
ctgcttccatattcttccct

SEQ ID NO: 97797 - DNA, 20 bp, Artificial Sequence
  Description of Artificial Sequence: Synthetic oligonucleotide
  Target: SCN9A; (+) strand; PAM type: YTN; PAM sequence: CTG
cttccatattcttccctact

SEQ ID NO: 97798 - DNA, 20 bp, Artificial Sequence
  Description of Artificial Sequence: Synthetic oligonucleotide
  Target: SCN9A; (+) strand; PAM type: YTN; PAM sequence: CTT
ccatattcttccctactcaa

SEQ ID NO: 97799 - DNA, 20 bp, Artificial Sequence
  Description of Artificial Sequence: Synthetic oligonucleotide
  Target: SCN9A; (+) strand; PAM type: YTN; PAM sequence: TTC
catattcttccctactcaac

SEQ ID NO: 97800 - DNA, 20 bp, Artificial Sequence
  Description of Artificial Sequence: Synthetic oligonucleotide
  Target: SCN9A; (+) strand; PAM type: YTN; PAM sequence: TTC
ttccctactcaacatatatg

SEQ ID NO: 97801 - DNA, 20 bp, Artificial Sequence
  Description of Artificial Sequence: Synthetic oligonucleotide
  Target: SCN9A; (+) strand; PAM type: YTN; PAM sequence: CTT
ccctactcaacatatatgaa

SEQ ID NO: 97802 - DNA, 20 bp, Artificial Sequence
  Description of Artificial Sequence: Synthetic oligonucleotide
  Target: SCN9A; (+) strand; PAM type: YTN; PAM sequence: TTC
cctactcaacatatatgaat

SEQ ID NO: 97803 - DNA, 20 bp, Artificial Sequence
  Description of Artificial Sequence: Synthetic oligonucleotide
  Target: SCN9A; (+) strand; PAM type: YTN; PAM sequence: CTA
ctcaacatatatgaatgaaa

SEQ ID NO: 97804 - DNA, 20 bp, Artificial Sequence
  Description of Artificial Sequence: Synthetic oligonucleotide
  Target: SCN9A; (+) strand; PAM type: YTN; PAM sequence: CTC
aacatatatgaatgaaacac

SEQ ID NO: 97805 - DNA, 20 bp, Artificial Sequence
  Description of Artificial Sequence: Synthetic oligonucleotide
  Target: SCN9A; (+) strand; PAM type: YTN; PAM sequence: CTG
ctattaaaaaaggtctaata

SEQ ID NO: 97806 - DNA, 20 bp, Artificial Sequence
  Description of Artificial Sequence: Synthetic oligonucleotide
  Target: SCN9A; (+) strand; PAM type: YTN; PAM sequence: CTA
ttaaaaaaggtctaatacgg

SEQ ID NO: 97807 - DNA, 20 bp, Artificial Sequence
  Description of Artificial Sequence: Synthetic oligonucleotide
  Target: SCN9A; (+) strand; PAM type: YTN; PAM sequence: TTA
aaaaaggtctaatacggctt

SEQ ID NO: 97808 - DNA, 20 bp, Artificial Sequence
  Description of Artificial Sequence: Synthetic oligonucleotide
  Target: SCN9A; (+) strand; PAM type: YTN; PAM sequence: CTA
atacggctttttatatctac

SEQ ID NO: 97809 - DNA, 20 bp, Artificial Sequence
  Description of Artificial Sequence: Synthetic oligonucleotide
  Target: SCN9A; (+) strand; PAM type: YTN; PAM sequence: CTT
tttatatctactctcaggca

SEQ ID NO: 97810 - DNA, 20 bp, Artificial Sequence
  Description of Artificial Sequence: Synthetic oligonucleotide
  Target: SCN9A; (+) strand; PAM type: YTN; PAM sequence: TTT
ttatatctactctcaggcag

SEQ ID NO: 97811 - DNA, 20 bp, Artificial Sequence
  Description of Artificial Sequence: Synthetic oligonucleotide
  Target: SCN9A; (+) strand; PAM type: YTN; PAM sequence: TTT
tatatctactctcaggcagg

SEQ ID NO: 97812 - DNA, 20 bp, Artificial Sequence
  Description of Artificial Sequence: Synthetic oligonucleotide
  Target: SCN9A; (+) strand; PAM type: YTN; PAM sequence: TTT
atatctactctcaggcaggt

SEQ ID NO: 97813 - DNA, 20 bp, Artificial Sequence
  Description of Artificial Sequence: Synthetic oligonucleotide
  Target: SCN9A; (+) strand; PAM type: YTN; PAM sequence: TTA
tatctactctcaggcaggtt

SEQ ID NO: 97814 - DNA, 20 bp, Artificial Sequence
  Description of Artificial Sequence: Synthetic oligonucleotide
  Target: SCN9A; (+) strand; PAM type: YTN; PAM sequence: CTA
ctctcaggcaggttaaaacc

SEQ ID NO: 97815 - DNA, 20 bp, Artificial Sequence
  Description of Artificial Sequence: Synthetic oligonucleotide
  Target: SCN9A; (+) strand; PAM type: YTN; PAM sequence: CTC
tcaggcaggttaaaacctca

SEQ ID NO: 97816 - DNA, 20 bp, Artificial Sequence
  Description of Artificial Sequence: Synthetic oligonucleotide
  Target: SCN9A; (+) strand; PAM type: YTN; PAM sequence: CTC
aggcaggttaaaacctcatc

SEQ ID NO: 97817 - DNA, 20 bp, Artificial Sequence
  Description of Artificial Sequence: Synthetic oligonucleotide
  Target: SCN9A; (+) strand; PAM type: YTN; PAM sequence: TTA
aaacctcatcttttactatt

SEQ ID NO: 97818 - DNA, 20 bp, Artificial Sequence
  Description of Artificial Sequence: Synthetic oligonucleotide
  Target: SCN9A; (+) strand; PAM type: YTN; PAM sequence: CTC
atcttttactatttctccaa

SEQ ID NO: 97819 - DNA, 20 bp, Artificial Sequence
  Description of Artificial Sequence: Synthetic oligonucleotide
  Target: SCN9A; (+) strand; PAM type: YTN; PAM sequence: CTT
ttactatttctccaaatctt

SEQ ID NO: 97820 - DNA, 20 bp, Artificial Sequence
  Description of Artificial Sequence: Synthetic oligonucleotide
  Target: SCN9A; (+) strand; PAM type: YTN; PAM sequence: TTT
tactatttctccaaatctta

SEQ ID NO: 97821 - DNA, 20 bp, Artificial Sequence
  Description of Artificial Sequence: Synthetic oligonucleotide
  Target: SCN9A; (+) strand; PAM type: YTN; PAM sequence: TTT
actatttctccaaatcttaa

SEQ ID NO: 97822 - DNA, 20 bp, Artificial Sequence
  Description of Artificial Sequence: Synthetic oligonucleotide
  Target: SCN9A; (+) strand; PAM type: YTN; PAM sequence: TTA
ctatttctccaaatcttaaa

SEQ ID NO: 97823 - DNA, 20 bp, Artificial Sequence
  Description of Artificial Sequence: Synthetic oligonucleotide
  Target: SCN9A; (+) strand; PAM type: YTN; PAM sequence: CTA
tttctccaaatcttaaattt

SEQ ID NO: 97824 - DNA, 20 bp, Artificial Sequence
  Description of Artificial Sequence: Synthetic oligonucleotide
  Target: SCN9A; (+) strand; PAM type: YTN; PAM sequence: TTT
ctccaaatcttaaatttctt

SEQ ID NO: 97825 - DNA, 20 bp, Artificial Sequence
  Description of Artificial Sequence: Synthetic oligonucleotide
  Target: SCN9A; (+) strand; PAM type: YTN; PAM sequence: TTC
tccaaatcttaaatttcttc

SEQ ID NO: 97826 - DNA, 20 bp, Artificial Sequence
  Description of Artificial Sequence: Synthetic oligonucleotide
  Target: SCN9A; (+) strand; PAM type: YTN; PAM sequence: CTC
caaatcttaaatttcttcaa

SEQ ID NO: 97827 - DNA, 20 bp, Artificial Sequence
  Description of Artificial Sequence: Synthetic oligonucleotide
  Target: SCN9A; (+) strand; PAM type: YTN; PAM sequence: CTT
aaatttcttcaaaaccgaaa

SEQ ID NO: 97828 - DNA, 20 bp, Artificial Sequence
  Description of Artificial Sequence: Synthetic oligonucleotide
  Target: SCN9A; (+) strand; PAM type: YTN; PAM sequence: TTA
aatttcttcaaaaccgaaag

SEQ ID NO: 97829 - DNA, 20 bp, Artificial Sequence
  Description of Artificial Sequence: Synthetic oligonucleotide
  Target: SCN9A; (+) strand; PAM type: YTN; PAM sequence: TTT
cttcaaaaccgaaagcattg

SEQ ID NO: 97830 - DNA, 20 bp, Artificial Sequence
  Description of Artificial Sequence: Synthetic oligonucleotide
  Target: SCN9A; (+) strand; PAM type: YTN; PAM sequence: TTC
ttcaaaaccgaaagcattgc

SEQ ID NO: 97831 - DNA, 20 bp, Artificial Sequence
  Description of Artificial Sequence: Synthetic oligonucleotide
  Target: SCN9A; (+) strand; PAM type: YTN; PAM sequence: CTT
caaaaccgaaagcattgcta

SEQ ID NO: 97832 - DNA, 20 bp, Artificial Sequence
  Description of Artificial Sequence: Synthetic oligonucleotide
  Target: SCN9A; (+) strand; PAM type: YTN; PAM sequence: TTC
aaaaccgaaagcattgctat

SEQ ID NO: 97833 - DNA, 20 bp, Artificial Sequence
  Description of Artificial Sequence: Synthetic oligonucleotide
  Target: SCN9A; (+) strand; PAM type: YTN; PAM sequence: TTG
ctatcccccctgaattgctg

SEQ ID NO: 97834 - DNA, 20 bp, Artificial Sequence
  Description of Artificial Sequence: Synthetic oligonucleotide
  Target: SCN9A; (+) strand; PAM type: YTN; PAM sequence: CTA
tcccccctgaattgctgcct

SEQ ID NO: 97835 - DNA, 20 bp, Artificial Sequence
  Description of Artificial Sequence: Synthetic oligonucleotide
  Target: SCN9A; (+) strand; PAM type: YTN; PAM sequence: CTG
aattgctgcctcttttatca

SEQ ID NO: 97836 - DNA, 20 bp, Artificial Sequence
  Description of Artificial Sequence: Synthetic oligonucleotide
  Target: SCN9A; (+) strand; PAM type: YTN; PAM sequence: TTG
ctgcctcttttatcaacaca

SEQ ID NO: 97837 - DNA, 20 bp, Artificial Sequence
  Description of Artificial Sequence: Synthetic oligonucleotide
  Target: SCN9A; (+) strand; PAM type: YTN; PAM sequence: CTG
cctcttttatcaacacaatt

SEQ ID NO: 97838 - DNA, 20 bp, Artificial Sequence
  Description of Artificial Sequence: Synthetic oligonucleotide
  Target: SCN9A; (+) strand; PAM type: YTN; PAM sequence: CTC
ttttatcaacacaattcatt

SEQ ID NO: 97839 - DNA, 20 bp, Artificial Sequence
  Description of Artificial Sequence: Synthetic oligonucleotide
  Target: SCN9A; (+) strand; PAM type: YTN; PAM sequence: CTT
ttatcaacacaattcatttg

SEQ ID NO: 97840 - DNA, 20 bp, Artificial Sequence
  Description of Artificial Sequence: Synthetic oligonucleotide
  Target: SCN9A; (+) strand; PAM type: YTN; PAM sequence: TTT
tatcaacacaattcatttgc

SEQ ID NO: 97841 - DNA, 20 bp, Artificial Sequence
  Description of Artificial Sequence: Synthetic oligonucleotide
  Target: SCN9A; (+) strand; PAM type: YTN; PAM sequence: TTT
atcaacacaattcatttgct

SEQ ID NO: 97842 - DNA, 20 bp, Artificial Sequence
  Description of Artificial Sequence: Synthetic oligonucleotide
  Target: SCN9A; (+) strand; PAM type: YTN; PAM sequence: TTA
tcaacacaattcatttgctc

SEQ ID NO: 97843 - DNA, 20 bp, Artificial Sequence
  Description of Artificial Sequence: Synthetic oligonucleotide
  Target: SCN9A; (+) strand; PAM type: YTN; PAM sequence: TTC
atttgctcattcatttctgt

SEQ ID NO: 97844 - DNA, 20 bp, Artificial Sequence
  Description of Artificial Sequence: Synthetic oligonucleotide
  Target: SCN9A; (+) strand; PAM type: YTN; PAM sequence: TTT
gctcattcatttctgtttca

SEQ ID NO: 97845 - DNA, 20 bp, Artificial Sequence
  Description of Artificial Sequence: Synthetic oligonucleotide
  Target: SCN9A; (+) strand; PAM type: YTN; PAM sequence: TTG
ctcattcatttctgtttcac

SEQ ID NO: 97846 - DNA, 20 bp, Artificial Sequence
  Description of Artificial Sequence: Synthetic oligonucleotide
  Target: SCN9A; (+) strand; PAM type: YTN; PAM sequence: CTC
attcatttctgtttcactcc

SEQ ID NO: 97847 - DNA, 20 bp, Artificial Sequence
  Description of Artificial Sequence: Synthetic oligonucleotide
  Target: SCN9A; (+) strand; PAM type: YTN; PAM sequence: TTC
atttctgtttcactccatgt

SEQ ID NO: 97848 - DNA, 20 bp, Artificial Sequence
  Description of Artificial Sequence: Synthetic oligonucleotide
  Target: SCN9A; (+) strand; PAM type: YTN; PAM sequence: TTT
ctgtttcactccatgtgggt

SEQ ID NO: 97849 - DNA, 20 bp, Artificial Sequence
  Description of Artificial Sequence: Synthetic oligonucleotide
  Target: SCN9A; (+) strand; PAM type: YTN; PAM sequence: TTC
tgtttcactccatgtgggtt

SEQ ID NO: 97850 - DNA, 20 bp, Artificial Sequence
  Description of Artificial Sequence: Synthetic oligonucleotide
  Target: SCN9A; (+) strand; PAM type: YTN; PAM sequence: CTG
tttcactccatgtgggttag

SEQ ID NO: 97851 - DNA, 20 bp, Artificial Sequence
  Description of Artificial Sequence: Synthetic oligonucleotide
  Target: SCN9A; (+) strand; PAM type: YTN; PAM sequence: TTT
cactccatgtgggttagcca

SEQ ID NO: 97852 - DNA, 20 bp, Artificial Sequence
  Description of Artificial Sequence: Synthetic oligonucleotide
  Target: SCN9A; (+) strand; PAM type: YTN; PAM sequence: TTC
actccatgtgggttagccat

SEQ ID NO: 97853 - DNA, 20 bp, Artificial Sequence
  Description of Artificial Sequence: Synthetic oligonucleotide
  Target: SCN9A; (+) strand; PAM type: YTN; PAM sequence: CTC
catgtgggttagccattctt

SEQ ID NO: 97854 - DNA, 20 bp, Artificial Sequence
  Description of Artificial Sequence: Synthetic oligonucleotide
  Target: SCN9A; (+) strand; PAM type: YTN; PAM sequence: TTA
gccattcttttgcctctccg

SEQ ID NO: 97855 - DNA, 20 bp, Artificial Sequence
  Description of Artificial Sequence: Synthetic oligonucleotide
  Target: SCN9A; (+) strand; PAM type: YTN; PAM sequence: TTC
ttttgcctctccgttgctac

SEQ ID NO: 97856 - DNA, 20 bp, Artificial Sequence
  Description of Artificial Sequence: Synthetic oligonucleotide
  Target: SCN9A; (+) strand; PAM type: YTN; PAM sequence: CTT
ttgcctctccgttgctacat

SEQ ID NO: 97857 - DNA, 20 bp, Artificial Sequence
  Description of Artificial Sequence: Synthetic oligonucleotide
  Target: SCN9A; (+) strand; PAM type: YTN; PAM sequence: TTT
tgcctctccgttgctacatg

SEQ ID NO: 97858 - DNA, 20 bp, Artificial Sequence
  Description of Artificial Sequence: Synthetic oligonucleotide
  Target: SCN9A; (+) strand; PAM type: YTN; PAM sequence: TTT
gcctctccgttgctacatgt

SEQ ID NO: 97859 - DNA, 20 bp, Artificial Sequence
  Description of Artificial Sequence: Synthetic oligonucleotide
  Target: SCN9A; (+) strand; PAM type: YTN; PAM sequence: TTG
cctctccgttgctacatgtc

SEQ ID NO: 97860 - DNA, 20 bp, Artificial Sequence
  Description of Artificial Sequence: Synthetic oligonucleotide
  Target: SCN9A; (+) strand; PAM type: YTN; PAM sequence: CTC
tccgttgctacatgtcttct

SEQ ID NO: 97861 - DNA, 20 bp, Artificial Sequence
  Description of Artificial Sequence: Synthetic oligonucleotide
  Target: SCN9A; (+) strand; PAM type: YTN; PAM sequence: CTC
cgttgctacatgtcttcttt

SEQ ID NO: 97862 - DNA, 20 bp, Artificial Sequence
  Description of Artificial Sequence: Synthetic oligonucleotide
  Target: SCN9A; (+) strand; PAM type: YTN; PAM sequence: TTG
ctacatgtcttctttcccac

SEQ ID NO: 97863 - DNA, 20 bp, Artificial Sequence
  Description of Artificial Sequence: Synthetic oligonucleotide
  Target: SCN9A; (+) strand; PAM type: YTN; PAM sequence: CTA
catgtcttctttcccacctt

SEQ ID NO: 97864 - DNA, 20 bp, Artificial Sequence
  Description of Artificial Sequence: Synthetic oligonucleotide
  Target: SCN9A; (+) strand; PAM type: YTN; PAM sequence: CTT
ctttcccaccttccaaagcc

SEQ ID NO: 97865 - DNA, 20 bp, Artificial Sequence
  Description of Artificial Sequence: Synthetic oligonucleotide
  Target: SCN9A; (+) strand; PAM type: YTN; PAM sequence: TTC
tttcccaccttccaaagcct

SEQ ID NO: 97866 - DNA, 20 bp, Artificial Sequence
  Description of Artificial Sequence: Synthetic oligonucleotide
  Target: SCN9A; (+) strand; PAM type: YTN; PAM sequence: CTT
tcccaccttccaaagccttc

SEQ ID NO: 97867 - DNA, 20 bp, Artificial Sequence
  Description of Artificial Sequence: Synthetic oligonucleotide
  Target: SCN9A; (+) strand; PAM type: YTN; PAM sequence: TTT
cccaccttccaaagccttct

SEQ ID NO: 97868 - DNA, 20 bp, Artificial Sequence
  Description of Artificial Sequence: Synthetic oligonucleotide
  Target: SCN9A; (+) strand; PAM type: YTN; PAM sequence: TTC
ccaccttccaaagccttctc

SEQ ID NO: 97869 - DNA, 20 bp, Artificial Sequence
  Description of Artificial Sequence: Synthetic oligonucleotide
  Target: SCN9A; (+) strand; PAM type: YTN; PAM sequence: CTT
ccaaagccttctcaattgtc

SEQ ID NO: 97870 - DNA, 20 bp, Artificial Sequence
  Description of Artificial Sequence: Synthetic oligonucleotide
  Target: SCN9A; (+) strand; PAM type: YTN; PAM sequence: TTC
caaagccttctcaattgtca

SEQ ID NO: 97871 - DNA, 20 bp, Artificial Sequence
  Description of Artificial Sequence: Synthetic oligonucleotide
  Target: SCN9A; (+) strand; PAM type: YTN; PAM sequence: CTT
ctcaattgtcacgtatttca

SEQ ID NO: 97872 - DNA, 20 bp, Artificial Sequence
  Description of Artificial Sequence: Synthetic oligonucleotide
  Target: SCN9A; (+) strand; PAM type: YTN; PAM sequence: TTC
tcaattgtcacgtatttcat

SEQ ID NO: 97873 - DNA, 20 bp, Artificial Sequence
  Description of Artificial Sequence: Synthetic oligonucleotide
  Target: SCN9A; (+) strand; PAM type: YTN; PAM sequence: CTC
aattgtcacgtatttcataa

SEQ ID NO: 97874 - DNA, 20 bp, Artificial Sequence
  Description of Artificial Sequence: Synthetic oligonucleotide
  Target: SCN9A; (+) strand; PAM type: YTN; PAM sequence: TTG
tcacgtatttcataaaccat

SEQ ID NO: 97875 - DNA, 20 bp, Artificial Sequence
  Description of Artificial Sequence: Synthetic oligonucleotide
  Target: SCN9A; (+) strand; PAM type: YTN; PAM sequence: TTT
cataaaccattctatagcag

SEQ ID NO: 97876 - DNA, 20 bp, Artificial Sequence
  Description of Artificial Sequence: Synthetic oligonucleotide
  Target: SCN9A; (+) strand; PAM type: YTN; PAM sequence: TTC
ataaaccattctatagcagc

SEQ ID NO: 97877 - DNA, 20 bp, Artificial Sequence
  Description of Artificial Sequence: Synthetic oligonucleotide
  Target: SCN9A; (+) strand; PAM type: YTN; PAM sequence: TTC
tatagcagcatctattttta

SEQ ID NO: 97878 - DNA, 20 bp, Artificial Sequence
  Description of Artificial Sequence: Synthetic oligonucleotide
  Target: SCN9A; (+) strand; PAM type: YTN; PAM sequence: CTA
tagcagcatctatttttact

SEQ ID NO: 97879 - DNA, 20 bp, Artificial Sequence
  Description of Artificial Sequence: Synthetic oligonucleotide
  Target: SCN9A; (+) strand; PAM type: YTN; PAM sequence: CTA
tttttactctgactgtcatg

SEQ ID NO: 97880 - DNA, 20 bp, Artificial Sequence
  Description of Artificial Sequence: Synthetic oligonucleotide
  Target: SCN9A; (+) strand; PAM type: YTN; PAM sequence: TTT
ttactctgactgtcatgtat

SEQ ID NO: 97881 - DNA, 20 bp, Artificial Sequence
  Description of Artificial Sequence: Synthetic oligonucleotide
  Target: SCN9A; (+) strand; PAM type: YTN; PAM sequence: TTT
tactctgactgtcatgtata

SEQ ID NO: 97882 - DNA, 20 bp, Artificial Sequence
  Description of Artificial Sequence: Synthetic oligonucleotide
  Target: SCN9A; (+) strand; PAM type: YTN; PAM sequence: TTT
actctgactgtcatgtatat

SEQ ID NO: 97883 - DNA, 20 bp, Artificial Sequence
  Description of Artificial Sequence: Synthetic oligonucleotide
  Target: SCN9A; (+) strand; PAM type: YTN; PAM sequence: TTA
ctctgactgtcatgtatatt

SEQ ID NO: 97884 - DNA, 20 bp, Artificial Sequence
  Description of Artificial Sequence: Synthetic oligonucleotide
  Target: SCN9A; (+) strand; PAM type: YTN; PAM sequence: CTC
tgactgtcatgtatattttt

SEQ ID NO: 97885 - DNA, 20 bp, Artificial Sequence
  Description of Artificial Sequence: Synthetic oligonucleotide
  Target: SCN9A; (+) strand; PAM type: YTN; PAM sequence: CTG
actgtcatgtatattttttg

SEQ ID NO: 97886 - DNA, 20 bp, Artificial Sequence
  Description of Artificial Sequence: Synthetic oligonucleotide
  Target: SCN9A; (+) strand; PAM type: YTN; PAM sequence: CTG
tcatgtatattttttgtgct

SEQ ID NO: 97887 - DNA, 20 bp, Artificial Sequence
  Description of Artificial Sequence: Synthetic oligonucleotide
  Target: SCN9A; (+) strand; PAM type: YTN; PAM sequence: TTT
tttgtgcttgttaatttttc

SEQ ID NO: 97888 - DNA, 20 bp, Artificial Sequence
  Description of Artificial Sequence: Synthetic oligonucleotide
  Target: SCN9A; (+) strand; PAM type: YTN; PAM sequence: TTT
ttgtgcttgttaatttttct

SEQ ID NO: 97889 - DNA, 20 bp, Artificial Sequence
  Description of Artificial Sequence: Synthetic oligonucleotide
  Target: SCN9A; (+) strand; PAM type: YTN; PAM sequence: TTT
tgtgcttgttaatttttctt

SEQ ID NO: 97890 - DNA, 20 bp, Artificial Sequence
  Description of Artificial Sequence: Synthetic oligonucleotide
  Target: SCN9A; (+) strand; PAM type: YTN; PAM sequence: TTT
gtgcttgttaatttttctta

SEQ ID NO: 97891 - DNA, 20 bp, Artificial Sequence
  Description of Artificial Sequence: Synthetic oligonucleotide
  Target: SCN9A; (+) strand; PAM type: YTN; PAM sequence: TTG
tgcttgttaatttttcttat

SEQ ID NO: 97892 - DNA, 20 bp, Artificial Sequence
  Description of Artificial Sequence: Synthetic oligonucleotide
  Target: SCN9A; (+) strand; PAM type: YTN; PAM sequence: CTT
gttaatttttcttattgtat

SEQ ID NO: 97893 - DNA, 20 bp, Artificial Sequence
  Description of Artificial Sequence: Synthetic oligonucleotide
  Target: SCN9A; (+) strand; PAM type: YTN; PAM sequence: TTG
ttaatttttcttattgtatt

SEQ ID NO: 97894 - DNA, 20 bp, Artificial Sequence
  Description of Artificial Sequence: Synthetic oligonucleotide
  Target: SCN9A; (+) strand; PAM type: YTN; PAM sequence: TTA
atttttcttattgtatttat

SEQ ID NO: 97895 - DNA, 20 bp, Artificial Sequence
  Description of Artificial Sequence: Synthetic oligonucleotide
  Target: SCN9A; (+) strand; PAM type: YTN; PAM sequence: TTT
ttcttattgtatttatcatg

SEQ ID NO: 97896 - DNA, 20 bp, Artificial Sequence
  Description of Artificial Sequence: Synthetic oligonucleotide
  Target: SCN9A; (+) strand; PAM type: YTN; PAM sequence: TTT
tcttattgtatttatcatga

SEQ ID NO: 97897 - DNA, 20 bp, Artificial Sequence
  Description of Artificial Sequence: Synthetic oligonucleotide
  Target: SCN9A; (+) strand; PAM type: YTN; PAM sequence: TTT
cttattgtatttatcatgat

SEQ ID NO: 97898 - DNA, 20 bp, Artificial Sequence
  Description of Artificial Sequence: Synthetic oligonucleotide
  Target: SCN9A; (+) strand; PAM type: YTN; PAM sequence: TTC
ttattgtatttatcatgatt

SEQ ID NO: 97899 - DNA, 20 bp, Artificial Sequence
  Description of Artificial Sequence: Synthetic oligonucleotide
  Target: SCN9A; (+) strand; PAM type: YTN; PAM sequence: CTT
attgtatttatcatgattat

SEQ ID NO: 97900 - DNA, 20 bp, Artificial Sequence
  Description of Artificial Sequence: Synthetic oligonucleotide
  Target: SCN9A; (+) strand; PAM type: YTN; PAM sequence: TTA
ttgtatttatcatgattata

SEQ ID NO: 97901 - DNA, 20 bp, Artificial Sequence
  Description of Artificial Sequence: Synthetic oligonucleotide
  Target: SCN9A; (+) strand; PAM type: YTN; PAM sequence: TTG
tatttatcatgattatagta

SEQ ID NO: 97902 - DNA, 20 bp, Artificial Sequence
  Description of Artificial Sequence: Synthetic oligonucleotide
  Target: SCN9A; (+) strand; PAM type: YTN; PAM sequence: TTT
atcatgattatagtatttgg

SEQ ID NO: 97903 - DNA, 20 bp, Artificial Sequence
  Description of Artificial Sequence: Synthetic oligonucleotide
  Target: SCN9A; (+) strand; PAM type: YTN; PAM sequence: TTA
tcatgattatagtatttggg

SEQ ID NO: 97904 - DNA, 20 bp, Artificial Sequence
  Description of Artificial Sequence: Synthetic oligonucleotide
  Target: SCN9A; (+) strand; PAM type: YTN; PAM sequence: TTA
tagtatttggggatagagca

SEQ ID NO: 97905 - DNA, 20 bp, Artificial Sequence
  Description of Artificial Sequence: Synthetic oligonucleotide
  Target: SCN9A; (+) strand; PAM type: YTN; PAM sequence: TTT
ggggatagagcatagtagag

SEQ ID NO: 97906 - DNA, 20 bp, Artificial Sequence
  Description of Artificial Sequence: Synthetic oligonucleotide
  Target: SCN9A; (+) strand; PAM type: YTN; PAM sequence: TTG
gggatagagcatagtagaga

SEQ ID NO: 97907 - DNA, 20 bp, Artificial Sequence
  Description of Artificial Sequence: Synthetic oligonucleotide
  Target: SCN9A; (+) strand; PAM type: YTN; PAM sequence: TTT
aatagagtacaagatacatc

SEQ ID NO: 97908 - DNA, 20 bp, Artificial Sequence
  Description of Artificial Sequence: Synthetic oligonucleotide
  Target: SCN9A; (+) strand; PAM type: YTN; PAM sequence: TTA
atagagtacaagatacatcg

SEQ ID NO: 97909 - DNA, 20 bp, Artificial Sequence
  Description of Artificial Sequence: Synthetic oligonucleotide
  Target: SCN9A; (+) strand; PAM type: YTN; PAM sequence: TTT
actactgactctatctaacc

SEQ ID NO: 97910 - DNA, 20 bp, Artificial Sequence
  Description of Artificial Sequence: Synthetic oligonucleotide
  Target: SCN9A; (+) strand; PAM type: YTN; PAM sequence: TTA
ctactgactctatctaacct

SEQ ID NO: 97911 - DNA, 20 bp, Artificial Sequence
  Description of Artificial Sequence: Synthetic oligonucleotide
  Target: SCN9A; (+) strand; PAM type: YTN; PAM sequence: CTA
ctgactctatctaaccttca

SEQ ID NO: 97912 - DNA, 20 bp, Artificial Sequence
  Description of Artificial Sequence: Synthetic oligonucleotide
  Target: SCN9A; (+) strand; PAM type: YTN; PAM sequence: CTG
actctatctaaccttcatca

SEQ ID NO: 97913 - DNA, 20 bp, Artificial Sequence
  Description of Artificial Sequence: Synthetic oligonucleotide
  Target: SCN9A; (+) strand; PAM type: YTN; PAM sequence: CTC
tatctaaccttcatcacata

SEQ ID NO: 97914 - DNA, 20 bp, Artificial Sequence
  Description of Artificial Sequence: Synthetic oligonucleotide
  Target: SCN9A; (+) strand; PAM type: YTN; PAM sequence: CTA
tctaaccttcatcacatact

SEQ ID NO: 97915 - DNA, 20 bp, Artificial Sequence
  Description of Artificial Sequence: Synthetic oligonucleotide
  Target: SCN9A; (+) strand; PAM type: YTN; PAM sequence: CTA
accttcatcacatactcgat

SEQ ID NO: 97916 - DNA, 20 bp, Artificial Sequence
  Description of Artificial Sequence: Synthetic oligonucleotide
  Target: SCN9A; (+) strand; PAM type: YTN; PAM sequence: CTT
catcacatactcgatatatg

SEQ ID NO: 97917 - DNA, 20 bp, Artificial Sequence
  Description of Artificial Sequence: Synthetic oligonucleotide
  Target: SCN9A; (+) strand; PAM type: YTN; PAM sequence: TTC
atcacatactcgatatatga

SEQ ID NO: 97918 - DNA, 20 bp, Artificial Sequence
  Description of Artificial Sequence: Synthetic oligonucleotide
  Target: SCN9A; (+) strand; PAM type: YTN; PAM sequence: CTC
gatatatgaccttgggtaag

SEQ ID NO: 97919 - DNA, 20 bp, Artificial Sequence
  Description of Artificial Sequence: Synthetic oligonucleotide
  Target: SCN9A; (+) strand; PAM type: YTN; PAM sequence: CTT
gggtaagtcacttaacctct

SEQ ID NO: 97920 - DNA, 20 bp, Artificial Sequence
  Description of Artificial Sequence: Synthetic oligonucleotide
  Target: SCN9A; (+) strand; PAM type: YTN; PAM sequence: TTG
ggtaagtcacttaacctctg

SEQ ID NO: 97921 - DNA, 20 bp, Artificial Sequence
  Description of Artificial Sequence: Synthetic oligonucleotide
  Target: SCN9A; (+) strand; PAM type: YTN; PAM sequence: CTT
aacctctgtgtgcctttcct

SEQ ID NO: 97922 - DNA, 20 bp, Artificial Sequence
  Description of Artificial Sequence: Synthetic oligonucleotide
  Target: SCN9A; (+) strand; PAM type: YTN; PAM sequence: TTA
acctctgtgtgcctttcctc

SEQ ID NO: 97923 - DNA, 20 bp, Artificial Sequence
  Description of Artificial Sequence: Synthetic oligonucleotide
  Target: SCN9A; (+) strand; PAM type: YTN; PAM sequence: CTC
tgtgtgcctttcctcatttg

SEQ ID NO: 97924 - DNA, 20 bp, Artificial Sequence
  Description of Artificial Sequence: Synthetic oligonucleotide
  Target: SCN9A; (+) strand; PAM type: YTN; PAM sequence: CTG
tgtgcctttcctcatttgtg

SEQ ID NO: 97925 - DNA, 20 bp, Artificial Sequence
  Description of Artificial Sequence: Synthetic oligonucleotide
  Target: SCN9A; (+) strand; PAM type: YTN; PAM sequence: CTT
tcctcatttgtgaaagagac

SEQ ID NO: 97926 - DNA, 20 bp, Artificial Sequence
  Description of Artificial Sequence: Synthetic oligonucleotide
  Target: SCN9A; (+) strand; PAM type: YTN; PAM sequence: TTT
cctcatttgtgaaagagact

SEQ ID NO: 97927 - DNA, 20 bp, Artificial Sequence
  Description of Artificial Sequence: Synthetic oligonucleotide
  Target: SCN9A; (+) strand; PAM type: YTN; PAM sequence: TTC
ctcatttgtgaaagagactc

SEQ ID NO: 97928 - DNA, 20 bp, Artificial Sequence
  Description of Artificial Sequence: Synthetic oligonucleotide
  Target: SCN9A; (+) strand; PAM type: YTN; PAM sequence: CTC
atttgtgaaagagactctgt

SEQ ID NO: 97929 - DNA, 20 bp, Artificial Sequence
  Description of Artificial Sequence: Synthetic oligonucleotide
  Target: SCN9A; (+) strand; PAM type: YTN; PAM sequence: TTT
gtgaaagagactctgtaata

SEQ ID NO: 97930 - DNA, 20 bp, Artificial Sequence
  Description of Artificial Sequence: Synthetic oligonucleotide
  Target: SCN9A; (+) strand; PAM type: YTN; PAM sequence: TTG
tgaaagagactctgtaataa

SEQ ID NO: 97931 - DNA, 20 bp, Artificial Sequence
  Description of Artificial Sequence: Synthetic oligonucleotide
  Target: SCN9A; (+) strand; PAM type: YTN; PAM sequence: CTC
tgtaataatacttttgtgat

SEQ ID NO: 97932 - DNA, 20 bp, Artificial Sequence
  Description of Artificial Sequence: Synthetic oligonucleotide
  Target: SCN9A; (+) strand; PAM type: YTN; PAM sequence: CTG
taataatacttttgtgattg

SEQ ID NO: 97933 - DNA, 20 bp, Artificial Sequence
  Description of Artificial Sequence: Synthetic oligonucleotide
  Target: SCN9A; (+) strand; PAM type: YTN; PAM sequence: CTT
ttgtgattgatgttatgggt

SEQ ID NO: 97934 - DNA, 20 bp, Artificial Sequence
  Description of Artificial Sequence: Synthetic oligonucleotide
  Target: SCN9A; (+) strand; PAM type: YTN; PAM sequence: TTT
tgtgattgatgttatgggtt

SEQ ID NO: 97935 - DNA, 20 bp, Artificial Sequence
  Description of Artificial Sequence: Synthetic oligonucleotide
  Target: SCN9A; (+) strand; PAM type: YTN; PAM sequence: TTT
gtgattgatgttatgggttg

SEQ ID NO: 97936 - DNA, 20 bp, Artificial Sequence
  Description of Artificial Sequence: Synthetic oligonucleotide
  Target: SCN9A; (+) strand; PAM type: YTN; PAM sequence: TTG
tgattgatgttatgggttgg

SEQ ID NO: 97937 - DNA, 20 bp, Artificial Sequence
  Description of Artificial Sequence: Synthetic oligonucleotide
  Target: SCN9A; (+) strand; PAM type: YTN; PAM sequence: TTG
atgttatgggttggattgtg

SEQ ID NO: 97938 - DNA, 20 bp, Artificial Sequence
  Description of Artificial Sequence: Synthetic oligonucleotide
  Target: SCN9A; (+) strand; PAM type: YTN; PAM sequence: TTA
tgggttggattgtgtgccct

SEQ ID NO: 97939 - DNA, 20 bp, Artificial Sequence
  Description of Artificial Sequence: Synthetic oligonucleotide
  Target: SCN9A; (+) strand; PAM type: YTN; PAM sequence: TTG
gattgtgtgccctaagaagg

SEQ ID NO: 97940 - DNA, 20 bp, Artificial Sequence
  Description of Artificial Sequence: Synthetic oligonucleotide
  Target: SCN9A; (+) strand; PAM type: YTN; PAM sequence: TTG
tgtgccctaagaaggtacat

SEQ ID NO: 97941 - DNA, 20 bp, Artificial Sequence
  Description of Artificial Sequence: Synthetic oligonucleotide
  Target: SCN9A; (+) strand; PAM type: YTN; PAM sequence: CTA
agaaggtacatataagtcct

SEQ ID NO: 97942 - DNA, 20 bp, Artificial Sequence
  Description of Artificial Sequence: Synthetic oligonucleotide
  Target: SCN9A; (+) strand; PAM type: YTN; PAM sequence: CTA
acccttagcacttcagaatg

SEQ ID NO: 97943 - DNA, 20 bp, Artificial Sequence
  Description of Artificial Sequence: Synthetic oligonucleotide
  Target: SCN9A; (+) strand; PAM type: YTN; PAM sequence: CTT
agcacttcagaatgtgacct

SEQ ID NO: 97944 - DNA, 20 bp, Artificial Sequence
  Description of Artificial Sequence: Synthetic oligonucleotide
  Target: SCN9A; (+) strand; PAM type: YTN; PAM sequence: TTA
gcacttcagaatgtgacctt

SEQ ID NO: 97945 - DNA, 20 bp, Artificial Sequence
  Description of Artificial Sequence: Synthetic oligonucleotide
  Target: SCN9A; (+) strand; PAM type: YTN; PAM sequence: CTT
cagaatgtgaccttatttga

SEQ ID NO: 97946 - DNA, 20 bp, Artificial Sequence
  Description of Artificial Sequence: Synthetic oligonucleotide
  Target: SCN9A; (+) strand; PAM type: YTN; PAM sequence: TTC
agaatgtgaccttatttgaa

SEQ ID NO: 97947 - DNA, 20 bp, Artificial Sequence
  Description of Artificial Sequence: Synthetic oligonucleotide
  Target: SCN9A; (+) strand; PAM type: YTN; PAM sequence: CTT
atttgaaaataatgtcattg

SEQ ID NO: 97948 - DNA, 20 bp, Artificial Sequence
  Description of Artificial Sequence: Synthetic oligonucleotide
  Target: SCN9A; (+) strand; PAM type: YTN; PAM sequence: TTA
tttgaaaataatgtcattgc

SEQ ID NO: 97949 - DNA, 20 bp, Artificial Sequence
  Description of Artificial Sequence: Synthetic oligonucleotide
  Target: SCN9A; (+) strand; PAM type: YTN; PAM sequence: TTT
gaaaataatgtcattgcaga

SEQ ID NO: 97950 - DNA, 20 bp, Artificial Sequence
  Description of Artificial Sequence: Synthetic oligonucleotide
  Target: SCN9A; (+) strand; PAM type: YTN; PAM sequence: TTG
aaaataatgtcattgcagat

SEQ ID NO: 97951 - DNA, 20 bp, Artificial Sequence
  Description of Artificial Sequence: Synthetic oligonucleotide
  Target: SCN9A; (+) strand; PAM type: YTN; PAM sequence: TTG
cagatgtaattaagatgaag

SEQ ID NO: 97952 - DNA, 20 bp, Artificial Sequence
  Description of Artificial Sequence: Synthetic oligonucleotide
  Target: SCN9A; (+) strand; PAM type: YTN; PAM sequence: TTA
agatgaagtcatactggagt

SEQ ID NO: 97953 - DNA, 20 bp, Artificial Sequence
  Description of Artificial Sequence: Synthetic oligonucleotide
  Target: SCN9A; (+) strand; PAM type: YTN; PAM sequence: CTG
gagtggagtgggctcttaat

SEQ ID NO: 97954 - DNA, 20 bp, Artificial Sequence
  Description of Artificial Sequence: Synthetic oligonucleotide
  Target: SCN9A; (+) strand; PAM type: YTN; PAM sequence: CTC
ttaatccagtgtgactggca

SEQ ID NO: 97955 - DNA, 20 bp, Artificial Sequence
  Description of Artificial Sequence: Synthetic oligonucleotide
  Target: SCN9A; (+) strand; PAM type: YTN; PAM sequence: CTT
aatccagtgtgactggcatc

SEQ ID NO: 97956 - DNA, 20 bp, Artificial Sequence
  Description of Artificial Sequence: Synthetic oligonucleotide
  Target: SCN9A; (+) strand; PAM type: YTN; PAM sequence: TTA
atccagtgtgactggcatcc

SEQ ID NO: 97957 - DNA, 20 bp, Artificial Sequence
  Description of Artificial Sequence: Synthetic oligonucleotide
  Target: SCN9A; (+) strand; PAM type: YTN; PAM sequence: CTG
gcatccttactagtagagga

SEQ ID NO: 97958 - DNA, 20 bp, Artificial Sequence
  Description of Artificial Sequence: Synthetic oligonucleotide
  Target: SCN9A; (+) strand; PAM type: YTN; PAM sequence: CTT
actagtagaggagaaagaca

SEQ ID NO: 97959 - DNA, 20 bp, Artificial Sequence
  Description of Artificial Sequence: Synthetic oligonucleotide
  Target: SCN9A; (+) strand; PAM type: YTN; PAM sequence: TTA
ctagtagaggagaaagacac

SEQ ID NO: 97960 - DNA, 20 bp, Artificial Sequence
  Description of Artificial Sequence: Synthetic oligonucleotide
  Target: SCN9A; (+) strand; PAM type: YTN; PAM sequence: CTA
gtagaggagaaagacacaca

SEQ ID NO: 97961 - DNA, 20 bp, Artificial Sequence
  Description of Artificial Sequence: Synthetic oligonucleotide
  Target: SCN9A; (+) strand; PAM type: YTN; PAM sequence: CTA
taatgggagagattggagtt

SEQ ID NO: 97962 - DNA, 20 bp, Artificial Sequence
  Description of Artificial Sequence: Synthetic oligonucleotide
  Target: SCN9A; (+) strand; PAM type: YTN; PAM sequence: TTG
gagttctgttgccataaacc

SEQ ID NO: 97963 - DNA, 20 bp, Artificial Sequence
  Description of Artificial Sequence: Synthetic oligonucleotide
  Target: SCN9A; (+) strand; PAM type: YTN; PAM sequence: TTC
tgttgccataaaccaagaaa

SEQ ID NO: 97964 - DNA, 20 bp, Artificial Sequence
  Description of Artificial Sequence: Synthetic oligonucleotide
  Target: SCN9A; (+) strand; PAM type: YTN; PAM sequence: CTG
ttgccataaaccaagaaaca

SEQ ID NO: 97965 - DNA, 20 bp, Artificial Sequence
  Description of Artificial Sequence: Synthetic oligonucleotide
  Target: SCN9A; (+) strand; PAM type: YTN; PAM sequence: TTG
ccataaaccaagaaacacct

SEQ ID NO: 97966 - DNA, 20 bp, Artificial Sequence
  Description of Artificial Sequence: Synthetic oligonucleotide
  Target: SCN9A; (+) strand; PAM type: YTN; PAM sequence: CTG
ggctaccagaagctggaaga

SEQ ID NO: 97967 - DNA, 20 bp, Artificial Sequence
  Description of Artificial Sequence: Synthetic oligonucleotide
  Target: SCN9A; (+) strand; PAM type: YTN; PAM sequence: CTA
ccagaagctggaagaggcaa

SEQ ID NO: 97968 - DNA, 20 bp, Artificial Sequence
  Description of Artificial Sequence: Synthetic oligonucleotide
  Target: SCN9A; (+) strand; PAM type: YTN; PAM sequence: CTG
gaagaggcaataaaatatat

SEQ ID NO: 97969 - DNA, 20 bp, Artificial Sequence
  Description of Artificial Sequence: Synthetic oligonucleotide
  Target: SCN9A; (+) strand; PAM type: YTN; PAM sequence: TTT
tcttagaggctttaaagaga

SEQ ID NO: 97970 - DNA, 20 bp, Artificial Sequence
  Description of Artificial Sequence: Synthetic oligonucleotide
  Target: SCN9A; (+) strand; PAM type: YTN; PAM sequence: TTT
cttagaggctttaaagagaa

SEQ ID NO: 97971 - DNA, 20 bp, Artificial Sequence
  Description of Artificial Sequence: Synthetic oligonucleotide
  Target: SCN9A; (+) strand; PAM type: YTN; PAM sequence: TTC
ttagaggctttaaagagaac

SEQ ID NO: 97972 - DNA, 20 bp, Artificial Sequence
  Description of Artificial Sequence: Synthetic oligonucleotide
  Target: SCN9A; (+) strand; PAM type: YTN; PAM sequence: CTT
agaggctttaaagagaacat

SEQ ID NO: 97973 - DNA, 20 bp, Artificial Sequence
  Description of Artificial Sequence: Synthetic oligonucleotide
  Target: SCN9A; (+) strand; PAM type: YTN; PAM sequence: TTA
gaggctttaaagagaacatg

SEQ ID NO: 97974 - DNA, 20 bp, Artificial Sequence
  Description of Artificial Sequence: Synthetic oligonucleotide
  Target: SCN9A; (+) strand; PAM type: YTN; PAM sequence: CTT
taaagagaacatggacctgc

SEQ ID NO: 97975 - DNA, 20 bp, Artificial Sequence
  Description of Artificial Sequence: Synthetic oligonucleotide
  Target: SCN9A; (+) strand; PAM type: YTN; PAM sequence: TTT
aaagagaacatggacctgct

SEQ ID NO: 97976 - DNA, 20 bp, Artificial Sequence
  Description of Artificial Sequence: Synthetic oligonucleotide
  Target: SCN9A; (+) strand; PAM type: YTN; PAM sequence: TTA
aagagaacatggacctgctg

SEQ ID NO: 97977 - DNA, 20 bp, Artificial Sequence
  Description of Artificial Sequence: Synthetic oligonucleotide
  Target: SCN9A; (+) strand; PAM type: YTN; PAM sequence: CTG
ctgacactttgaatttggac

SEQ ID NO: 97978 - DNA, 20 bp, Artificial Sequence
  Description of Artificial Sequence: Synthetic oligonucleotide
  Target: SCN9A; (+) strand; PAM type: YTN; PAM sequence: CTG
acactttgaatttggacttc

SEQ ID NO: 97979 - DNA, 20 bp, Artificial Sequence
  Description of Artificial Sequence: Synthetic oligonucleotide
  Target: SCN9A; (+) strand; PAM type: YTN; PAM sequence: CTT
tgaatttggacttctaacct

SEQ ID NO: 97980 - DNA, 20 bp, Artificial Sequence
  Description of Artificial Sequence: Synthetic oligonucleotide
  Target: SCN9A; (+) strand; PAM type: YTN; PAM sequence: TTT
gaatttggacttctaacctc

SEQ ID NO: 97981 - DNA, 20 bp, Artificial Sequence
  Description of Artificial Sequence: Synthetic oligonucleotide
  Target: SCN9A; (+) strand; PAM type: YTN; PAM sequence: TTG
aatttggacttctaacctcc

SEQ ID NO: 97982 - DNA, 20 bp, Artificial Sequence
  Description of Artificial Sequence: Synthetic oligonucleotide
  Target: SCN9A; (+) strand; PAM type: YTN; PAM sequence: TTT
ggacttctaacctccaaaag

SEQ ID NO: 97983 - DNA, 20 bp, Artificial Sequence
  Description of Artificial Sequence: Synthetic oligonucleotide
  Target: SCN9A; (+) strand; PAM type: YTN; PAM sequence: TTG
gacttctaacctccaaaagt

SEQ ID NO: 97984 - DNA, 20 bp, Artificial Sequence
  Description of Artificial Sequence: Synthetic oligonucleotide
  Target: SCN9A; (+) strand; PAM type: YTN; PAM sequence: CTT
ctaacctccaaaagtgtgag

SEQ ID NO: 97985 - DNA, 20 bp, Artificial Sequence
  Description of Artificial Sequence: Synthetic oligonucleotide
  Target: SCN9A; (+) strand; PAM type: YTN; PAM sequence: TTC
taacctccaaaagtgtgaga

SEQ ID NO: 97986 - DNA, 20 bp, Artificial Sequence
  Description of Artificial Sequence: Synthetic oligonucleotide
  Target: SCN9A; (+) strand; PAM type: YTN; PAM sequence: CTA
acctccaaaagtgtgagaga

SEQ ID NO: 97987 - DNA, 20 bp, Artificial Sequence
  Description of Artificial Sequence: Synthetic oligonucleotide
  Target: SCN9A; (+) strand; PAM type: YTN; PAM sequence: CTC
caaaagtgtgagagaatata

SEQ ID NO: 97988 - DNA, 20 bp, Artificial Sequence
  Description of Artificial Sequence: Synthetic oligonucleotide
  Target: SCN9A; (+) strand; PAM type: YTN; PAM sequence: TTT
ctcttgttttaagccctcag

SEQ ID NO: 97989 - DNA, 20 bp, Artificial Sequence
  Description of Artificial Sequence: Synthetic oligonucleotide
  Target: SCN9A; (+) strand; PAM type: YTN; PAM sequence: TTC
tcttgttttaagccctcagg

SEQ ID NO: 97990 - DNA, 20 bp, Artificial Sequence
  Description of Artificial Sequence: Synthetic oligonucleotide
  Target: SCN9A; (+) strand; PAM type: YTN; PAM sequence: CTC
ttgttttaagccctcaggtt

SEQ ID NO: 97991 - DNA, 20 bp, Artificial Sequence
  Description of Artificial Sequence: Synthetic oligonucleotide
  Target: SCN9A; (+) strand; PAM type: YTN; PAM sequence: CTT
gttttaagccctcaggtttg

SEQ ID NO: 97992 - DNA, 20 bp, Artificial Sequence
  Description of Artificial Sequence: Synthetic oligonucleotide
  Target: SCN9A; (+) strand; PAM type: YTN; PAM sequence: TTG
ttttaagccctcaggtttgt

SEQ ID NO: 97993 - DNA, 20 bp, Artificial Sequence
  Description of Artificial Sequence: Synthetic oligonucleotide
  Target: SCN9A; (+) strand; PAM type: YTN; PAM sequence: TTT
taagccctcaggtttgtatt

SEQ ID NO: 97994 - DNA, 20 bp, Artificial Sequence
  Description of Artificial Sequence: Synthetic oligonucleotide
  Target: SCN9A; (+) strand; PAM type: YTN; PAM sequence: TTT
aagccctcaggtttgtatta

SEQ ID NO: 97995 - DNA, 20 bp, Artificial Sequence
  Description of Artificial Sequence: Synthetic oligonucleotide
  Target: SCN9A; (+) strand; PAM type: YTN; PAM sequence: TTA
agccctcaggtttgtattat

SEQ ID NO: 97996 - DNA, 20 bp, Artificial Sequence
  Description of Artificial Sequence: Synthetic oligonucleotide
  Target: SCN9A; (+) strand; PAM type: YTN; PAM sequence: CTC
aggtttgtattatcctgttc

SEQ ID NO: 97997 - DNA, 20 bp, Artificial Sequence
  Description of Artificial Sequence: Synthetic oligonucleotide
  Target: SCN9A; (+) strand; PAM type: YTN; PAM sequence: TTT
gtattatcctgttctcgtag

SEQ ID NO: 97998 - DNA, 20 bp, Artificial Sequence
  Description of Artificial Sequence: Synthetic oligonucleotide
  Target: SCN9A; (+) strand; PAM type: YTN; PAM sequence: TTG
tattatcctgttctcgtagg

SEQ ID NO: 97999 - DNA, 20 bp, Artificial Sequence
  Description of Artificial Sequence: Synthetic oligonucleotide
  Target: SCN9A; (+) strand; PAM type: YTN; PAM sequence: TTA
tcctgttctcgtaggtcaaa

SEQ ID NO: 98000 - DNA, 20 bp, Artificial Sequence
  Description of Artificial Sequence: Synthetic oligonucleotide
  Target: SCN9A; (+) strand; PAM type: YTN; PAM sequence: CTG
ttctcgtaggtcaaagaaac

SEQ ID NO: 98001 - DNA, 20 bp, Artificial Sequence
  Description of Artificial Sequence: Synthetic oligonucleotide
  Target: SCN9A; (+) strand; PAM type: YTN; PAM sequence: TTC
tcgtaggtcaaagaaactaa

SEQ ID NO: 98002 - DNA, 20 bp, Artificial Sequence
  Description of Artificial Sequence: Synthetic oligonucleotide
  Target: SCN9A; (+) strand; PAM type: YTN; PAM sequence: CTC
gtaggtcaaagaaactaata

SEQ ID NO: 98003 - DNA, 20 bp, Artificial Sequence
  Description of Artificial Sequence: Synthetic oligonucleotide
  Target: SCN9A; (+) strand; PAM type: YTN; PAM sequence: CTA
atacagttgatgtgaagatt

SEQ ID NO: 98004 - DNA, 20 bp, Artificial Sequence
  Description of Artificial Sequence: Synthetic oligonucleotide
  Target: SCN9A; (+) strand; PAM type: YTN; PAM sequence: TTG
atgtgaagattaattaatta

SEQ ID NO: 98005 - DNA, 20 bp, Artificial Sequence
  Description of Artificial Sequence: Synthetic oligonucleotide
  Target: SCN9A; (+) strand; PAM type: YTN; PAM sequence: TTA
attaattaaaaatttcagaa

SEQ ID NO: 98006 - DNA, 20 bp, Artificial Sequence
  Description of Artificial Sequence: Synthetic oligonucleotide
  Target: SCN9A; (+) strand; PAM type: YTN; PAM sequence: TTA
attaaaaatttcagaagatt

SEQ ID NO: 98007 - DNA, 20 bp, Artificial Sequence
  Description of Artificial Sequence: Synthetic oligonucleotide
  Target: SCN9A; (+) strand; PAM type: YTN; PAM sequence: TTA
aaaatttcagaagattgctc

SEQ ID NO: 98008 - DNA, 20 bp, Artificial Sequence
  Description of Artificial Sequence: Synthetic oligonucleotide
  Target: SCN9A; (+) strand; PAM type: YTN; PAM sequence: TTT
cagaagattgctcaaattac

SEQ ID NO: 98009 - DNA, 20 bp, Artificial Sequence
  Description of Artificial Sequence: Synthetic oligonucleotide
  Target: SCN9A; (+) strand; PAM type: YTN; PAM sequence: TTC
agaagattgctcaaattaca

SEQ ID NO: 98010 - DNA, 20 bp, Artificial Sequence
  Description of Artificial Sequence: Synthetic oligonucleotide
  Target: SCN9A; (+) strand; PAM type: YTN; PAM sequence: TTG
ctcaaattacagtattcaac

SEQ ID NO: 98011 - DNA, 20 bp, Artificial Sequence
  Description of Artificial Sequence: Synthetic oligonucleotide
  Target: SCN9A; (+) strand; PAM type: YTN; PAM sequence: CTC
aaattacagtattcaacaag

SEQ ID NO: 98012 - DNA, 20 bp, Artificial Sequence
  Description of Artificial Sequence: Synthetic oligonucleotide
  Target: SCN9A; (+) strand; PAM type: YTN; PAM sequence: TTA
cagtattcaacaagtcttaa

SEQ ID NO: 98013 - DNA, 20 bp, Artificial Sequence
  Description of Artificial Sequence: Synthetic oligonucleotide
  Target: SCN9A; (+) strand; PAM type: YTN; PAM sequence: TTC
aacaagtcttaattttcatt

SEQ ID NO: 98014 - DNA, 20 bp, Artificial Sequence
  Description of Artificial Sequence: Synthetic oligonucleotide
  Target: SCN9A; (+) strand; PAM type: YTN; PAM sequence: CTT
aattttcattacctgtgtta

SEQ ID NO: 98015 - DNA, 20 bp, Artificial Sequence
  Description of Artificial Sequence: Synthetic oligonucleotide
  Target: SCN9A; (+) strand; PAM type: YTN; PAM sequence: TTA
attttcattacctgtgttat

SEQ ID NO: 98016 - DNA, 20 bp, Artificial Sequence
  Description of Artificial Sequence: Synthetic oligonucleotide
  Target: SCN9A; (+) strand; PAM type: YTN; PAM sequence: TTT
tcattacctgtgttatttat

SEQ ID NO: 98017 - DNA, 20 bp, Artificial Sequence
  Description of Artificial Sequence: Synthetic oligonucleotide
  Target: SCN9A; (+) strand; PAM type: YTN; PAM sequence: TTT
cattacctgtgttatttatt

SEQ ID NO: 98018 - DNA, 20 bp, Artificial Sequence
  Description of Artificial Sequence: Synthetic oligonucleotide
  Target: SCN9A; (+) strand; PAM type: YTN; PAM sequence: TTC
attacctgtgttatttattc

SEQ ID NO: 98019 - DNA, 20 bp, Artificial Sequence
  Description of Artificial Sequence: Synthetic oligonucleotide
  Target: SCN9A; (+) strand; PAM type: YTN; PAM sequence: TTA
cctgtgttatttattctgct

SEQ ID NO: 98020 - DNA, 20 bp, Artificial Sequence
  Description of Artificial Sequence: Synthetic oligonucleotide
  Target: SCN9A; (+) strand; PAM type: YTN; PAM sequence: CTG
tgttatttattctgctatga

SEQ ID NO: 98021 - DNA, 20 bp, Artificial Sequence
  Description of Artificial Sequence: Synthetic oligonucleotide
  Target: SCN9A; (+) strand; PAM type: YTN; PAM sequence: TTA
tttattctgctatgacataa

SEQ ID NO: 98022 - DNA, 20 bp, Artificial Sequence
  Description of Artificial Sequence: Synthetic oligonucleotide
  Target: SCN9A; (+) strand; PAM type: YTN; PAM sequence: TTT
attctgctatgacataaact

SEQ ID NO: 98023 - DNA, 20 bp, Artificial Sequence
  Description of Artificial Sequence: Synthetic oligonucleotide
  Target: SCN9A; (+) strand; PAM type: YTN; PAM sequence: TTA
ttctgctatgacataaactc

SEQ ID NO: 98024 - DNA, 20 bp, Artificial Sequence
  Description of Artificial Sequence: Synthetic oligonucleotide
  Target: SCN9A; (+) strand; PAM type: YTN; PAM sequence: TTC
tgctatgacataaactcctt

SEQ ID NO: 98025 - DNA, 20 bp, Artificial Sequence
  Description of Artificial Sequence: Synthetic oligonucleotide
  Target: SCN9A; (+) strand; PAM type: YTN; PAM sequence: CTG
ctatgacataaactccttga

SEQ ID NO: 98026 - DNA, 20 bp, Artificial Sequence
  Description of Artificial Sequence: Synthetic oligonucleotide
  Target: SCN9A; (+) strand; PAM type: YTN; PAM sequence: CTA
tgacataaactccttgagct

SEQ ID NO: 98027 - DNA, 20 bp, Artificial Sequence
  Description of Artificial Sequence: Synthetic oligonucleotide
  Target: SCN9A; (+) strand; PAM type: YTN; PAM sequence: CTC
cttgagctcaggaaccatat

SEQ ID NO: 98028 - DNA, 20 bp, Artificial Sequence
  Description of Artificial Sequence: Synthetic oligonucleotide
  Target: SCN9A; (+) strand; PAM type: YTN; PAM sequence: CTT
gagctcaggaaccatatctt

SEQ ID NO: 98029 - DNA, 20 bp, Artificial Sequence
  Description of Artificial Sequence: Synthetic oligonucleotide
  Target: SCN9A; (+) strand; PAM type: YTN; PAM sequence: TTG
agctcaggaaccatatctta

SEQ ID NO: 98030 - DNA, 20 bp, Artificial Sequence
  Description of Artificial Sequence: Synthetic oligonucleotide
  Target: SCN9A; (+) strand; PAM type: YTN; PAM sequence: CTC
aggaaccatatcttacgttg

SEQ ID NO: 98031 - DNA, 20 bp, Artificial Sequence
  Description of Artificial Sequence: Synthetic oligonucleotide
  Target: SCN9A; (+) strand; PAM type: YTN; PAM sequence: CTT
acgttggtctccccaagctc

SEQ ID NO: 98032 - DNA, 20 bp, Artificial Sequence
  Description of Artificial Sequence: Synthetic oligonucleotide
  Target: SCN9A; (+) strand; PAM type: YTN; PAM sequence: TTA
cgttggtctccccaagctcc

SEQ ID NO: 98033 - DNA, 20 bp, Artificial Sequence
  Description of Artificial Sequence: Synthetic oligonucleotide
  Target: SCN9A; (+) strand; PAM type: YTN; PAM sequence: TTG
gtctccccaagctccaaccc

SEQ ID NO: 98034 - DNA, 20 bp, Artificial Sequence
  Description of Artificial Sequence: Synthetic oligonucleotide
  Target: SCN9A; (+) strand; PAM type: YTN; PAM sequence: CTC
cccaagctccaacccaatat

SEQ ID NO: 98035 - DNA, 20 bp, Artificial Sequence
  Description of Artificial Sequence: Synthetic oligonucleotide
  Target: SCN9A; (+) strand; PAM type: YTN; PAM sequence: CTC
caacccaatatatattacac

SEQ ID NO: 98036 - DNA, 20 bp, Artificial Sequence
  Description of Artificial Sequence: Synthetic oligonucleotide
  Target: SCN9A; (+) strand; PAM type: YTN; PAM sequence: TTA
cacaaaataaaataaataac

SEQ ID NO: 98037 - DNA, 20 bp, Artificial Sequence
  Description of Artificial Sequence: Synthetic oligonucleotide
  Target: SCN9A; (+) strand; PAM type: YTN; PAM sequence: CTA
cttataaaatgtgttttgaa

SEQ ID NO: 98038 - DNA, 20 bp, Artificial Sequence
  Description of Artificial Sequence: Synthetic oligonucleotide
  Target: SCN9A; (+) strand; PAM type: YTN; PAM sequence: CTT
ataaaatgtgttttgaataa

SEQ ID NO: 98039 - DNA, 20 bp, Artificial Sequence
  Description of Artificial Sequence: Synthetic oligonucleotide
  Target: SCN9A; (+) strand; PAM type: YTN; PAM sequence: TTA
taaaatgtgttttgaataaa

SEQ ID NO: 98040 - DNA, 20 bp, Artificial Sequence
  Description of Artificial Sequence: Synthetic oligonucleotide
  Target: SCN9A; (+) strand; PAM type: YTN; PAM sequence: TTT
tgaataaatagtgtattgat

SEQ ID NO: 98041 - DNA, 20 bp, Artificial Sequence
  Description of Artificial Sequence: Synthetic oligonucleotide
  Target: SCN9A; (+) strand; PAM type: YTN; PAM sequence: TTT
gaataaatagtgtattgatt

SEQ ID NO: 98042 - DNA, 20 bp, Artificial Sequence
  Description of Artificial Sequence: Synthetic oligonucleotide
  Target: SCN9A; (+) strand; PAM type: YTN; PAM sequence: TTG
aataaatagtgtattgattt

SEQ ID NO: 98043 - DNA, 20 bp, Artificial Sequence
  Description of Artificial Sequence: Synthetic oligonucleotide
  Target: SCN9A; (+) strand; PAM type: YTN; PAM sequence: TTG
atttttcttaattattcaat

SEQ ID NO: 98044 - DNA, 20 bp, Artificial Sequence
  Description of Artificial Sequence: Synthetic oligonucleotide
  Target: SCN9A; (+) strand; PAM type: YTN; PAM sequence: TTT
ttcttaattattcaatcctc

SEQ ID NO: 98045 - DNA, 20 bp, Artificial Sequence
  Description of Artificial Sequence: Synthetic oligonucleotide
  Target: SCN9A; (+) strand; PAM type: YTN; PAM sequence: TTT
tcttaattattcaatcctct

SEQ ID NO: 98046 - DNA, 20 bp, Artificial Sequence
  Description of Artificial Sequence: Synthetic oligonucleotide
  Target: SCN9A; (+) strand; PAM type: YTN; PAM sequence: TTT
cttaattattcaatcctcta

SEQ ID NO: 98047 - DNA, 20 bp, Artificial Sequence
  Description of Artificial Sequence: Synthetic oligonucleotide
  Target: SCN9A; (+) strand; PAM type: YTN; PAM sequence: TTC
ttaattattcaatcctctat

SEQ ID NO: 98048 - DNA, 20 bp, Artificial Sequence
  Description of Artificial Sequence: Synthetic oligonucleotide
  Target: SCN9A; (+) strand; PAM type: YTN; PAM sequence: CTT
aattattcaatcctctatag

SEQ ID NO: 98049 - DNA, 20 bp, Artificial Sequence
  Description of Artificial Sequence: Synthetic oligonucleotide
  Target: SCN9A; (+) strand; PAM type: YTN; PAM sequence: TTA
attattcaatcctctatagg

SEQ ID NO: 98050 - DNA, 20 bp, Artificial Sequence
  Description of Artificial Sequence: Synthetic oligonucleotide
  Target: SCN9A; (+) strand; PAM type: YTN; PAM sequence: TTA
ttcaatcctctataggaaac

SEQ ID NO: 98051 - DNA, 20 bp, Artificial Sequence
  Description of Artificial Sequence: Synthetic oligonucleotide
  Target: SCN9A; (+) strand; PAM type: YTN; PAM sequence: TTC
aatcctctataggaaacatt

SEQ ID NO: 98052 - DNA, 20 bp, Artificial Sequence
  Description of Artificial Sequence: Synthetic oligonucleotide
  Target: SCN9A; (+) strand; PAM type: YTN; PAM sequence: CTC
tataggaaacattggaaaaa

SEQ ID NO: 98053 - DNA, 20 bp, Artificial Sequence
  Description of Artificial Sequence: Synthetic oligonucleotide
  Target: SCN9A; (+) strand; PAM type: YTN; PAM sequence: CTA
taggaaacattggaaaaaac

SEQ ID NO: 98054 - DNA, 20 bp, Artificial Sequence
  Description of Artificial Sequence: Synthetic oligonucleotide
  Target: SCN9A; (+) strand; PAM type: YTN; PAM sequence: TTG
gaaaaaacagaatagttgat

SEQ ID NO: 98055 - DNA, 20 bp, Artificial Sequence
  Description of Artificial Sequence: Synthetic oligonucleotide
  Target: SCN9A; (+) strand; PAM type: YTN; PAM sequence: TTG
atatattgctcaaaacctat

SEQ ID NO: 98056 - DNA, 20 bp, Artificial Sequence
  Description of Artificial Sequence: Synthetic oligonucleotide
  Target: SCN9A; (+) strand; PAM type: YTN; PAM sequence: TTG
ctcaaaacctatgggtttaa

SEQ ID NO: 98057 - DNA, 20 bp, Artificial Sequence
  Description of Artificial Sequence: Synthetic oligonucleotide
  Target: SCN9A; (+) strand; PAM type: YTN; PAM sequence: CTC
aaaacctatgggtttaacct

SEQ ID NO: 98058 - DNA, 20 bp, Artificial Sequence
  Description of Artificial Sequence: Synthetic oligonucleotide
  Target: SCN9A; (+) strand; PAM type: YTN; PAM sequence: CTA
tgggtttaacctaaatcata

SEQ ID NO: 98059 - DNA, 20 bp, Artificial Sequence
  Description of Artificial Sequence: Synthetic oligonucleotide
  Target: SCN9A; (+) strand; PAM type: YTN; PAM sequence: TTT
aacctaaatcataagttagc

SEQ ID NO: 98060 - DNA, 20 bp, Artificial Sequence
  Description of Artificial Sequence: Synthetic oligonucleotide
  Target: SCN9A; (+) strand; PAM type: YTN; PAM sequence: TTA
acctaaatcataagttagcc

SEQ ID NO: 98061 - DNA, 20 bp, Artificial Sequence
  Description of Artificial Sequence: Synthetic oligonucleotide
  Target: SCN9A; (+) strand; PAM type: YTN; PAM sequence: CTA
aatcataagttagccagaac

SEQ ID NO: 98062 - DNA, 20 bp, Artificial Sequence
  Description of Artificial Sequence: Synthetic oligonucleotide
  Target: SCN9A; (+) strand; PAM type: YTN; PAM sequence: TTA
gccagaacctattatttaga

SEQ ID NO: 98063 - DNA, 20 bp, Artificial Sequence
  Description of Artificial Sequence: Synthetic oligonucleotide
  Target: SCN9A; (+) strand; PAM type: YTN; PAM sequence: CTA
ttatttagaaaattgttttc

SEQ ID NO: 98064 - DNA, 20 bp, Artificial Sequence
  Description of Artificial Sequence: Synthetic oligonucleotide
  Target: SCN9A; (+) strand; PAM type: YTN; PAM sequence: TTA
tttagaaaattgttttctgt

SEQ ID NO: 98065 - DNA, 20 bp, Artificial Sequence
  Description of Artificial Sequence: Synthetic oligonucleotide
  Target: SCN9A; (+) strand; PAM type: YTN; PAM sequence: TTT
agaaaattgttttctgtgca

SEQ ID NO: 98066 - DNA, 20 bp, Artificial Sequence
  Description of Artificial Sequence: Synthetic oligonucleotide
  Target: SCN9A; (+) strand; PAM type: YTN; PAM sequence: TTA
gaaaattgttttctgtgcaa

SEQ ID NO: 98067 - DNA, 20 bp, Artificial Sequence
  Description of Artificial Sequence: Synthetic oligonucleotide
  Target: SCN9A; (+) strand; PAM type: YTN; PAM sequence: TTG
ttttctgtgcaaaaatgaat

SEQ ID NO: 98068 - DNA, 20 bp, Artificial Sequence
  Description of Artificial Sequence: Synthetic oligonucleotide
  Target: SCN9A; (+) strand; PAM type: YTN; PAM sequence: TTT
tctgtgcaaaaatgaataag

SEQ ID NO: 98069 - DNA, 20 bp, Artificial Sequence
  Description of Artificial Sequence: Synthetic oligonucleotide
  Target: SCN9A; (+) strand; PAM type: YTN; PAM sequence: TTT
ctgtgcaaaaatgaataaga

SEQ ID NO: 98070 - DNA, 20 bp, Artificial Sequence
  Description of Artificial Sequence: Synthetic oligonucleotide
  Target: SCN9A; (+) strand; PAM type: YTN; PAM sequence: TTC
tgtgcaaaaatgaataagat

SEQ ID NO: 98071 - DNA, 20 bp, Artificial Sequence
  Description of Artificial Sequence: Synthetic oligonucleotide
  Target: SCN9A; (+) strand; PAM type: YTN; PAM sequence: CTG
tgcaaaaatgaataagatta

SEQ ID NO: 98072 - DNA, 20 bp, Artificial Sequence
  Description of Artificial Sequence: Synthetic oligonucleotide
  Target: SCN9A; (+) strand; PAM type: YTN; PAM sequence: TTA
agcatatttgtaattgtata

SEQ ID NO: 98073 - DNA, 20 bp, Artificial Sequence
  Description of Artificial Sequence: Synthetic oligonucleotide
  Target: SCN9A; (+) strand; PAM type: YTN; PAM sequence: TTT
gtaattgtatactagtcaat

SEQ ID NO: 98074 - DNA, 20 bp, Artificial Sequence
  Description of Artificial Sequence: Synthetic oligonucleotide
  Target: SCN9A; (+) strand; PAM type: YTN; PAM sequence: TTG
taattgtatactagtcaatt

SEQ ID NO: 98075 - DNA, 20 bp, Artificial Sequence
  Description of Artificial Sequence: Synthetic oligonucleotide
  Target: SCN9A; (+) strand; PAM type: YTN; PAM sequence: TTG
tatactagtcaattatttga

SEQ ID NO: 98076 - DNA, 20 bp, Artificial Sequence
  Description of Artificial Sequence: Synthetic oligonucleotide
  Target: SCN9A; (+) strand; PAM type: YTN; PAM sequence: CTA
gtcaattatttgaaaaataa

SEQ ID NO: 98077 - DNA, 20 bp, Artificial Sequence
  Description of Artificial Sequence: Synthetic oligonucleotide
  Target: SCN9A; (+) strand; PAM type: YTN; PAM sequence: TTA
tttgaaaaataaatgaagtt

SEQ ID NO: 98078 - DNA, 20 bp, Artificial Sequence
  Description of Artificial Sequence: Synthetic oligonucleotide
  Target: SCN9A; (+) strand; PAM type: YTN; PAM sequence: TTT
gaaaaataaatgaagttcta

SEQ ID NO: 98079 - DNA, 20 bp, Artificial Sequence
  Description of Artificial Sequence: Synthetic oligonucleotide
  Target: SCN9A; (+) strand; PAM type: YTN; PAM sequence: TTG
aaaaataaatgaagttctaa

SEQ ID NO: 98080 - DNA, 20 bp, Artificial Sequence
  Description of Artificial Sequence: Synthetic oligonucleotide
  Target: SCN9A; (+) strand; PAM type: YTN; PAM sequence: TTC
taataaaattaatcatgaat

SEQ ID NO: 98081 - DNA, 20 bp, Artificial Sequence
  Description of Artificial Sequence: Synthetic oligonucleotide
  Target: SCN9A; (+) strand; PAM type: YTN; PAM sequence: CTA
ataaaattaatcatgaattg

SEQ ID NO: 98082 - DNA, 20 bp, Artificial Sequence
  Description of Artificial Sequence: Synthetic oligonucleotide
  Target: SCN9A; (+) strand; PAM type: YTN; PAM sequence: TTA
atcatgaattgatatcaaat

SEQ ID NO: 98083 - DNA, 20 bp, Artificial Sequence
  Description of Artificial Sequence: Synthetic oligonucleotide
  Target: SCN9A; (+) strand; PAM type: YTN; PAM sequence: TTG
atatcaaattaaactttaca

SEQ ID NO: 98084 - DNA, 20 bp, Artificial Sequence
  Description of Artificial Sequence: Synthetic oligonucleotide
  Target: SCN9A; (+) strand; PAM type: YTN; PAM sequence: TTA
aactttacattatctttttt

SEQ ID NO: 98085 - DNA, 20 bp, Artificial Sequence
  Description of Artificial Sequence: Synthetic oligonucleotide
  Target: SCN9A; (+) strand; PAM type: YTN; PAM sequence: CTT
tacattatcttttttggaaa

SEQ ID NO: 98086 - DNA, 20 bp, Artificial Sequence
  Description of Artificial Sequence: Synthetic oligonucleotide
  Target: SCN9A; (+) strand; PAM type: YTN; PAM sequence: TTT
acattatcttttttggaaaa

SEQ ID NO: 98087 - DNA, 20 bp, Artificial Sequence
  Description of Artificial Sequence: Synthetic oligonucleotide
  Target: SCN9A; (+) strand; PAM type: YTN; PAM sequence: TTA
cattatcttttttggaaaat

SEQ ID NO: 98088 - DNA, 20 bp, Artificial Sequence
  Description of Artificial Sequence: Synthetic oligonucleotide
  Target: SCN9A; (+) strand; PAM type: YTN; PAM sequence: TTA
tcttttttggaaaataattg

SEQ ID NO: 98089 - DNA, 20 bp, Artificial Sequence
  Description of Artificial Sequence: Synthetic oligonucleotide
  Target: SCN9A; (+) strand; PAM type: YTN; PAM sequence: CTT
ttttggaaaataattgttca

SEQ ID NO: 98090 - DNA, 20 bp, Artificial Sequence
  Description of Artificial Sequence: Synthetic oligonucleotide
  Target: SCN9A; (+) strand; PAM type: YTN; PAM sequence: TTT
tttggaaaataattgttcat

SEQ ID NO: 98091 - DNA, 20 bp, Artificial Sequence
  Description of Artificial Sequence: Synthetic oligonucleotide
  Target: SCN9A; (+) strand; PAM type: YTN; PAM sequence: TTT
ttggaaaataattgttcatc

SEQ ID NO: 98092 - DNA, 20 bp, Artificial Sequence
  Description of Artificial Sequence: Synthetic oligonucleotide
  Target: SCN9A; (+) strand; PAM type: YTN; PAM sequence: TTT
tggaaaataattgttcatcc

SEQ ID NO: 98093 - DNA, 20 bp, Artificial Sequence
  Description of Artificial Sequence: Synthetic oligonucleotide
  Target: SCN9A; (+) strand; PAM type: YTN; PAM sequence: TTT
ggaaaataattgttcatccc

SEQ ID NO: 98094 - DNA, 20 bp, Artificial Sequence
  Description of Artificial Sequence: Synthetic oligonucleotide
  Target: SCN9A; (+) strand; PAM type: YTN; PAM sequence: TTG
gaaaataattgttcatccct

SEQ ID NO: 98095 - DNA, 20 bp, Artificial Sequence
  Description of Artificial Sequence: Synthetic oligonucleotide
  Target: SCN9A; (+) strand; PAM type: YTN; PAM sequence: TTG
ttcatccctttcattacaat

SEQ ID NO: 98096 - DNA, 20 bp, Artificial Sequence
  Description of Artificial Sequence: Synthetic oligonucleotide
  Target: SCN9A; (+) strand; PAM type: YTN; PAM sequence: TTC
atccctttcattacaatgaa

SEQ ID NO: 98097 - DNA, 20 bp, Artificial Sequence
  Description of Artificial Sequence: Synthetic oligonucleotide
  Target: SCN9A; (+) strand; PAM type: YTN; PAM sequence: CTT
tcattacaatgaaaaatatt

SEQ ID NO: 98098 - DNA, 20 bp, Artificial Sequence
  Description of Artificial Sequence: Synthetic oligonucleotide
  Target: SCN9A; (+) strand; PAM type: YTN; PAM sequence: TTT
cattacaatgaaaaatattt

SEQ ID NO: 98099 - DNA, 20 bp, Artificial Sequence
  Description of Artificial Sequence: Synthetic oligonucleotide
  Target: SCN9A; (+) strand; PAM type: YTN; PAM sequence: TTC
attacaatgaaaaatatttg

SEQ ID NO: 98100 - DNA, 20 bp, Artificial Sequence
  Description of Artificial Sequence: Synthetic oligonucleotide
  Target: SCN9A; (+) strand; PAM type: YTN; PAM sequence: TTA
caatgaaaaatatttgaaat

SEQ ID NO: 98101 - DNA, 20 bp, Artificial Sequence
  Description of Artificial Sequence: Synthetic oligonucleotide
  Target: SCN9A; (+) strand; PAM type: YTN; PAM sequence: TTT
gaaatacttatcttcttttt

SEQ ID NO: 98102 - DNA, 20 bp, Artificial Sequence
  Description of Artificial Sequence: Synthetic oligonucleotide
  Target: SCN9A; (+) strand; PAM type: YTN; PAM sequence: TTG
aaatacttatcttctttttc

SEQ ID NO: 98103 - DNA, 20 bp, Artificial Sequence
  Description of Artificial Sequence: Synthetic oligonucleotide
  Target: SCN9A; (+) strand; PAM type: YTN; PAM sequence: CTT
atcttctttttctgttggtt

SEQ ID NO: 98104 - DNA, 20 bp, Artificial Sequence
  Description of Artificial Sequence: Synthetic oligonucleotide
  Target: SCN9A; (+) strand; PAM type: YTN; PAM sequence: TTA
tcttctttttctgttggttg

SEQ ID NO: 98105 - DNA, 20 bp, Artificial Sequence
  Description of Artificial Sequence: Synthetic oligonucleotide
  Target: SCN9A; (+) strand; PAM type: YTN; PAM sequence: CTT
ctttttctgttggttgaaat

SEQ ID NO: 98106 - DNA, 20 bp, Artificial Sequence
  Description of Artificial Sequence: Synthetic oligonucleotide
  Target: SCN9A; (+) strand; PAM type: YTN; PAM sequence: TTC
tttttctgttggttgaaatt

SEQ ID NO: 98107 - DNA, 20 bp, Artificial Sequence
  Description of Artificial Sequence: Synthetic oligonucleotide
  Target: SCN9A; (+) strand; PAM type: YTN; PAM sequence: CTT
tttctgttggttgaaattat

SEQ ID NO: 98108 - DNA, 20 bp, Artificial Sequence
  Description of Artificial Sequence: Synthetic oligonucleotide
  Target: SCN9A; (+) strand; PAM type: YTN; PAM sequence: TTT
ttctgttggttgaaattatc

SEQ ID NO: 98109 - DNA, 20 bp, Artificial Sequence
  Description of Artificial Sequence: Synthetic oligonucleotide
  Target: SCN9A; (+) strand; PAM type: YTN; PAM sequence: TTT
tctgttggttgaaattatct

SEQ ID NO: 98110 - DNA, 20 bp, Artificial Sequence
  Description of Artificial Sequence: Synthetic oligonucleotide
  Target: SCN9A; (+) strand; PAM type: YTN; PAM sequence: TTT
ctgttggttgaaattatcta

SEQ ID NO: 98111 - DNA, 20 bp, Artificial Sequence
  Description of Artificial Sequence: Synthetic oligonucleotide
  Target: SCN9A; (+) strand; PAM type: YTN; PAM sequence: TTC
tgttggttgaaattatctat

SEQ ID NO: 98112 - DNA, 20 bp, Artificial Sequence
  Description of Artificial Sequence: Synthetic oligonucleotide
  Target: SCN9A; (+) strand; PAM type: YTN; PAM sequence: CTG
ttggttgaaattatctatga

SEQ ID NO: 98113 - DNA, 20 bp, Artificial Sequence
  Description of Artificial Sequence: Synthetic oligonucleotide
  Target: SCN9A; (+) strand; PAM type: YTN; PAM sequence: TTG
gttgaaattatctatgatga

SEQ ID NO: 98114 - DNA, 20 bp, Artificial Sequence
  Description of Artificial Sequence: Synthetic oligonucleotide
  Target: SCN9A; (+) strand; PAM type: YTN; PAM sequence: TTG
aaattatctatgatgacacc

SEQ ID NO: 98115 - DNA, 20 bp, Artificial Sequence
  Description of Artificial Sequence: Synthetic oligonucleotide
  Target: SCN9A; (+) strand; PAM type: YTN; PAM sequence: TTA
tctatgatgacaccaatgaa

SEQ ID NO: 98116 - DNA, 20 bp, Artificial Sequence
  Description of Artificial Sequence: Synthetic oligonucleotide
  Target: SCN9A; (+) strand; PAM type: YTN; PAM sequence: CTA
tgatgacaccaatgaacaag

SEQ ID NO: 98117 - DNA, 20 bp, Artificial Sequence
  Description of Artificial Sequence: Synthetic oligonucleotide
  Target: SCN9A; (+) strand; PAM type: YTN; PAM sequence: TTC
aaagtgaagaatgacccaaa

SEQ ID NO: 98118 - DNA, 20 bp, Artificial Sequence
  Description of Artificial Sequence: Synthetic oligonucleotide
  Target: SCN9A; (+) strand; PAM type: YTN; PAM sequence: CTA
tattcatatttgggctgctt

SEQ ID NO: 98119 - DNA, 20 bp, Artificial Sequence
  Description of Artificial Sequence: Synthetic oligonucleotide
  Target: SCN9A; (+) strand; PAM type: YTN; PAM sequence: TTC
atatttgggctgcttgtcta

SEQ ID NO: 98120 - DNA, 20 bp, Artificial Sequence
  Description of Artificial Sequence: Synthetic oligonucleotide
  Target: SCN9A; (+) strand; PAM type: YTN; PAM sequence: TTT
gggctgcttgtctacctata

SEQ ID NO: 98121 - DNA, 20 bp, Artificial Sequence
  Description of Artificial Sequence: Synthetic oligonucleotide
  Target: SCN9A; (+) strand; PAM type: YTN; PAM sequence: TTG
ggctgcttgtctacctataa

SEQ ID NO: 98122 - DNA, 20 bp, Artificial Sequence
  Description of Artificial Sequence: Synthetic oligonucleotide
  Target: SCN9A; (+) strand; PAM type: YTN; PAM sequence: CTG
cttgtctacctataaaattt

SEQ ID NO: 98123 - DNA, 20 bp, Artificial Sequence
  Description of Artificial Sequence: Synthetic oligonucleotide
  Target: SCN9A; (+) strand; PAM type: YTN; PAM sequence: CTT
gtctacctataaaatttaca

SEQ ID NO: 98124 - DNA, 20 bp, Artificial Sequence
  Description of Artificial Sequence: Synthetic oligonucleotide
  Target: SCN9A; (+) strand; PAM type: YTN; PAM sequence: TTG
tctacctataaaatttacaa

SEQ ID NO: 98125 - DNA, 20 bp, Artificial Sequence
  Description of Artificial Sequence: Synthetic oligonucleotide
  Target: SCN9A; (+) strand; PAM type: YTN; PAM sequence: CTA
cctataaaatttacaaaagt

SEQ ID NO: 98126 - DNA, 20 bp, Artificial Sequence
  Description of Artificial Sequence: Synthetic oligonucleotide
  Target: SCN9A; (+) strand; PAM type: YTN; PAM sequence: CTA
taaaatttacaaaagttagc

SEQ ID NO: 98127 - DNA, 20 bp, Artificial Sequence
  Description of Artificial Sequence: Synthetic oligonucleotide
  Target: SCN9A; (+) strand; PAM type: YTN; PAM sequence: TTT
acaaaagttagcattatatg

SEQ ID NO: 98128 - DNA, 20 bp, Artificial Sequence
  Description of Artificial Sequence: Synthetic oligonucleotide
  Target: SCN9A; (+) strand; PAM type: YTN; PAM sequence: TTA
caaaagttagcattatatgg

SEQ ID NO: 98129 - DNA, 20 bp, Artificial Sequence
  Description of Artificial Sequence: Synthetic oligonucleotide
  Target: SCN9A; (+) strand; PAM type: YTN; PAM sequence: TTA
gcattatatggacagtaaca

SEQ ID NO: 98130 - DNA, 20 bp, Artificial Sequence
  Description of Artificial Sequence: Synthetic oligonucleotide
  Target: SCN9A; (+) strand; PAM type: YTN; PAM sequence: TTA
tatggacagtaacattcatt

SEQ ID NO: 98131 - DNA, 20 bp, Artificial Sequence
  Description of Artificial Sequence: Synthetic oligonucleotide
  Target: SCN9A; (+) strand; PAM type: YTN; PAM sequence: TTC
attattttctttttcacatg

SEQ ID NO: 98132 - DNA, 20 bp, Artificial Sequence
  Description of Artificial Sequence: Synthetic oligonucleotide
  Target: SCN9A; (+) strand; PAM type: YTN; PAM sequence: TTA
ttttctttttcacatggttt

SEQ ID NO: 98133 - DNA, 20 bp, Artificial Sequence
  Description of Artificial Sequence: Synthetic oligonucleotide
  Target: SCN9A; (+) strand; PAM type: YTN; PAM sequence: TTT
tctttttcacatggtttgac

SEQ ID NO: 98134 - DNA, 20 bp, Artificial Sequence
  Description of Artificial Sequence: Synthetic oligonucleotide
  Target: SCN9A; (+) strand; PAM type: YTN; PAM sequence: TTT
ctttttcacatggtttgacc

SEQ ID NO: 98135 - DNA, 20 bp, Artificial Sequence
  Description of Artificial Sequence: Synthetic oligonucleotide
  Target: SCN9A; (+) strand; PAM type: YTN; PAM sequence: TTC
tttttcacatggtttgacca

SEQ ID NO: 98136 - DNA, 20 bp, Artificial Sequence
  Description of Artificial Sequence: Synthetic oligonucleotide
  Target: SCN9A; (+) strand; PAM type: YTN; PAM sequence: CTT
tttcacatggtttgaccagg

SEQ ID NO: 98137 - DNA, 20 bp, Artificial Sequence
  Description of Artificial Sequence: Synthetic oligonucleotide
  Target: SCN9A; (+) strand; PAM type: YTN; PAM sequence: TTT
ttcacatggtttgaccaggt

SEQ ID NO: 98138 - DNA, 20 bp, Artificial Sequence
  Description of Artificial Sequence: Synthetic oligonucleotide
  Target: SCN9A; (+) strand; PAM type: YTN; PAM sequence: TTT
tcacatggtttgaccaggta

SEQ ID NO: 98139 - DNA, 20 bp, Artificial Sequence
  Description of Artificial Sequence: Synthetic oligonucleotide
  Target: SCN9A; (+) strand; PAM type: YTN; PAM sequence: TTT
cacatggtttgaccaggtaa

SEQ ID NO: 98140 - DNA, 20 bp, Artificial Sequence
  Description of Artificial Sequence: Synthetic oligonucleotide
  Target: SCN9A; (+) strand; PAM type: YTN; PAM sequence: TTC
acatggtttgaccaggtaat

SEQ ID NO: 98141 - DNA, 20 bp, Artificial Sequence
  Description of Artificial Sequence: Synthetic oligonucleotide
  Target: SCN9A; (+) strand; PAM type: YTN; PAM sequence: TTT
gaccaggtaattcaaacagt

SEQ ID NO: 98142 - DNA, 20 bp, Artificial Sequence
  Description of Artificial Sequence: Synthetic oligonucleotide
  Target: SCN9A; (+) strand; PAM type: YTN; PAM sequence: TTG
accaggtaattcaaacagtg

SEQ ID NO: 98143 - DNA, 20 bp, Artificial Sequence
  Description of Artificial Sequence: Synthetic oligonucleotide
  Target: SCN9A; (+) strand; PAM type: YTN; PAM sequence: TTC
aaacagtgctatcctaggta

SEQ ID NO: 98144 - DNA, 20 bp, Artificial Sequence
  Description of Artificial Sequence: Synthetic oligonucleotide
  Target: SCN9A; (+) strand; PAM type: YTN; PAM sequence: CTA
tcctaggtaaacataggatt

SEQ ID NO: 98145 - DNA, 20 bp, Artificial Sequence
  Description of Artificial Sequence: Synthetic oligonucleotide
  Target: SCN9A; (+) strand; PAM type: YTN; PAM sequence: CTA
ggtaaacataggatttaaga

SEQ ID NO: 98146 - DNA, 20 bp, Artificial Sequence
  Description of Artificial Sequence: Synthetic oligonucleotide
  Target: SCN9A; (+) strand; PAM type: YTN; PAM sequence: TTT
aagaagccatagcattgttg

SEQ ID NO: 98147 - DNA, 20 bp, Artificial Sequence
  Description of Artificial Sequence: Synthetic oligonucleotide
  Target: SCN9A; (+) strand; PAM type: YTN; PAM sequence: TTA
agaagccatagcattgttga

SEQ ID NO: 98148 - DNA, 20 bp, Artificial Sequence
  Description of Artificial Sequence: Synthetic oligonucleotide
  Target: SCN9A; (+) strand; PAM type: YTN; PAM sequence: TTG
ttgaggtttaacataatcac

SEQ ID NO: 98149 - DNA, 20 bp, Artificial Sequence
  Description of Artificial Sequence: Synthetic oligonucleotide
  Target: SCN9A; (+) strand; PAM type: YTN; PAM sequence: TTG
aggtttaacataatcactct

SEQ ID NO: 98150 - DNA, 20 bp, Artificial Sequence
  Description of Artificial Sequence: Synthetic oligonucleotide
  Target: SCN9A; (+) strand; PAM type: YTN; PAM sequence: TTT
aacataatcactcttaacaa

SEQ ID NO: 98151 - DNA, 20 bp, Artificial Sequence
  Description of Artificial Sequence: Synthetic oligonucleotide
  Target: SCN9A; (+) strand; PAM type: YTN; PAM sequence: TTA
acataatcactcttaacaat

SEQ ID NO: 98152 - DNA, 20 bp, Artificial Sequence
  Description of Artificial Sequence: Synthetic oligonucleotide
  Target: SCN9A; (+) strand; PAM type: YTN; PAM sequence: CTC
ttaacaatttattcaacatg

SEQ ID NO: 98153 - DNA, 20 bp, Artificial Sequence
  Description of Artificial Sequence: Synthetic oligonucleotide
  Target: SCN9A; (+) strand; PAM type: YTN; PAM sequence: CTT
aacaatttattcaacatgta

SEQ ID NO: 98154 - DNA, 20 bp, Artificial Sequence
  Description of Artificial Sequence: Synthetic oligonucleotide
  Target: SCN9A; (+) strand; PAM type: YTN; PAM sequence: TTA
acaatttattcaacatgtat

SEQ ID NO: 98155 - DNA, 20 bp, Artificial Sequence
  Description of Artificial Sequence: Synthetic oligonucleotide
  Target: SCN9A; (+) strand; PAM type: YTN; PAM sequence: TTT
attcaacatgtattcattac

SEQ ID NO: 98156 - DNA, 20 bp, Artificial Sequence
  Description of Artificial Sequence: Synthetic oligonucleotide
  Target: SCN9A; (+) strand; PAM type: YTN; PAM sequence: TTA
ttcaacatgtattcattaca

SEQ ID NO: 98157 - DNA, 20 bp, Artificial Sequence
  Description of Artificial Sequence: Synthetic oligonucleotide
  Target: SCN9A; (+) strand; PAM type: YTN; PAM sequence: TTC
aacatgtattcattacatac

SEQ ID NO: 98158 - DNA, 20 bp, Artificial Sequence
  Description of Artificial Sequence: Synthetic oligonucleotide
  Target: SCN9A; (+) strand; PAM type: YTN; PAM sequence: TTC
attacatacttattatttaa

SEQ ID NO: 98159 - DNA, 20 bp, Artificial Sequence
  Description of Artificial Sequence: Synthetic oligonucleotide
  Target: SCN9A; (+) strand; PAM type: YTN; PAM sequence: TTA
catacttattatttaattta

SEQ ID NO: 98160 - DNA, 20 bp, Artificial Sequence
  Description of Artificial Sequence: Synthetic oligonucleotide
  Target: SCN9A; (+) strand; PAM type: YTN; PAM sequence: CTT
attatttaatttattacata

SEQ ID NO: 98161 - DNA, 20 bp, Artificial Sequence
  Description of Artificial Sequence: Synthetic oligonucleotide
  Target: SCN9A; (+) strand; PAM type: YTN; PAM sequence: TTA
ttatttaatttattacatac

SEQ ID NO: 98162 - DNA, 20 bp, Artificial Sequence
  Description of Artificial Sequence: Synthetic oligonucleotide
  Target: SCN9A; (+) strand; PAM type: YTN; PAM sequence: TTA
tttaatttattacatactta

SEQ ID NO: 98163 - DNA, 20 bp, Artificial Sequence
  Description of Artificial Sequence: Synthetic oligonucleotide
  Target: SCN9A; (+) strand; PAM type: YTN; PAM sequence: TTT
aatttattacatacttatgt

SEQ ID NO: 98164 - DNA, 20 bp, Artificial Sequence
  Description of Artificial Sequence: Synthetic oligonucleotide
  Target: SCN9A; (+) strand; PAM type: YTN; PAM sequence: TTA
atttattacatacttatgta

SEQ ID NO: 98165 - DNA, 20 bp, Artificial Sequence
  Description of Artificial Sequence: Synthetic oligonucleotide
  Target: SCN9A; (+) strand; PAM type: YTN; PAM sequence: TTT
attacatacttatgtaataa

SEQ ID NO: 98166 - DNA, 20 bp, Artificial Sequence
  Description of Artificial Sequence: Synthetic oligonucleotide
  Target: SCN9A; (+) strand; PAM type: YTN; PAM sequence: TTA
ttacatacttatgtaataaa

SEQ ID NO: 98167 - DNA, 20 bp, Artificial Sequence
  Description of Artificial Sequence: Synthetic oligonucleotide
  Target: SCN9A; (+) strand; PAM type: YTN; PAM sequence: TTA
catacttatgtaataaataa

SEQ ID NO: 98168 - DNA, 20 bp, Artificial Sequence
  Description of Artificial Sequence: Synthetic oligonucleotide
  Target: SCN9A; (+) strand; PAM type: YTN; PAM sequence: CTT
atgtaataaataatataatc

SEQ ID NO: 98169 - DNA, 20 bp, Artificial Sequence
  Description of Artificial Sequence: Synthetic oligonucleotide
  Target: SCN9A; (+) strand; PAM type: YTN; PAM sequence: TTA
tgtaataaataatataatct

SEQ ID NO: 98170 - DNA, 20 bp, Artificial Sequence
  Description of Artificial Sequence: Synthetic oligonucleotide
  Target: SCN9A; (+) strand; PAM type: YTN; PAM sequence: CTT
caaataactacaaagggctt

SEQ ID NO: 98171 - DNA, 20 bp, Artificial Sequence
  Description of Artificial Sequence: Synthetic oligonucleotide
  Target: SCN9A; (+) strand; PAM type: YTN; PAM sequence: TTC
aaataactacaaagggctta

SEQ ID NO: 98172 - DNA, 20 bp, Artificial Sequence
  Description of Artificial Sequence: Synthetic oligonucleotide
  Target: SCN9A; (+) strand; PAM type: YTN; PAM sequence: CTA
caaagggcttaatcatatgc

SEQ ID NO: 98173 - DNA, 20 bp, Artificial Sequence
  Description of Artificial Sequence: Synthetic oligonucleotide
  Target: SCN9A; (+) strand; PAM type: YTN; PAM sequence: CTT
aatcatatgcatatttgtgc

SEQ ID NO: 98174 - DNA, 20 bp, Artificial Sequence
  Description of Artificial Sequence: Synthetic oligonucleotide
  Target: SCN9A; (+) strand; PAM type: YTN; PAM sequence: TTA
atcatatgcatatttgtgct

SEQ ID NO: 98175 - DNA, 20 bp, Artificial Sequence
  Description of Artificial Sequence: Synthetic oligonucleotide
  Target: SCN9A; (+) strand; PAM type: YTN; PAM sequence: TTT
gtgctcatattggtaggaaa

SEQ ID NO: 98176 - DNA, 20 bp, Artificial Sequence
  Description of Artificial Sequence: Synthetic oligonucleotide
  Target: SCN9A; (+) strand; PAM type: YTN; PAM sequence: TTG
tgctcatattggtaggaaaa

SEQ ID NO: 98177 - DNA, 20 bp, Artificial Sequence
  Description of Artificial Sequence: Synthetic oligonucleotide
  Target: SCN9A; (+) strand; PAM type: YTN; PAM sequence: CTC
atattggtaggaaaattcaa

SEQ ID NO: 98178 - DNA, 20 bp, Artificial Sequence
  Description of Artificial Sequence: Synthetic oligonucleotide
  Target: SCN9A; (+) strand; PAM type: YTN; PAM sequence: TTG
gtaggaaaattcaataacta

SEQ ID NO: 98179 - DNA, 20 bp, Artificial Sequence
  Description of Artificial Sequence: Synthetic oligonucleotide
  Target: SCN9A; (+) strand; PAM type: YTN; PAM sequence: TTC
aataactaagtgacatacta

SEQ ID NO: 98180 - DNA, 20 bp, Artificial Sequence
  Description of Artificial Sequence: Synthetic oligonucleotide
  Target: SCN9A; (+) strand; PAM type: YTN; PAM sequence: CTA
agtgacatactatgtatatg

SEQ ID NO: 98181 - DNA, 20 bp, Artificial Sequence
  Description of Artificial Sequence: Synthetic oligonucleotide
  Target: SCN9A; (+) strand; PAM type: YTN; PAM sequence: CTA
tgtatatgttatttccaaaa

SEQ ID NO: 98182 - DNA, 20 bp, Artificial Sequence
  Description of Artificial Sequence: Synthetic oligonucleotide
  Target: SCN9A; (+) strand; PAM type: YTN; PAM sequence: TTA
tttccaaaagtactgtaaat

SEQ ID NO: 98183 - DNA, 20 bp, Artificial Sequence
  Description of Artificial Sequence: Synthetic oligonucleotide
  Target: SCN9A; (+) strand; PAM type: YTN; PAM sequence: TTT
ccaaaagtactgtaaatgag

SEQ ID NO: 98184 - DNA, 20 bp, Artificial Sequence
  Description of Artificial Sequence: Synthetic oligonucleotide
  Target: SCN9A; (+) strand; PAM type: YTN; PAM sequence: TTC
caaaagtactgtaaatgaga

SEQ ID NO: 98185 - DNA, 20 bp, Artificial Sequence
  Description of Artificial Sequence: Synthetic oligonucleotide
  Target: SCN9A; (+) strand; PAM type: YTN; PAM sequence: CTG
taaatgagacattatcatat

SEQ ID NO: 98186 - DNA, 20 bp, Artificial Sequence
  Description of Artificial Sequence: Synthetic oligonucleotide
  Target: SCN9A; (+) strand; PAM type: YTN; PAM sequence: TTA
tcatatttatacacattttg

SEQ ID NO: 98187 - DNA, 20 bp, Artificial Sequence
  Description of Artificial Sequence: Synthetic oligonucleotide
  Target: SCN9A; (+) strand; PAM type: YTN; PAM sequence: TTT
atacacattttgccatgtat

SEQ ID NO: 98188 - DNA, 20 bp, Artificial Sequence
  Description of Artificial Sequence: Synthetic oligonucleotide
  Target: SCN9A; (+) strand; PAM type: YTN; PAM sequence: TTA
tacacattttgccatgtatt

SEQ ID NO: 98189 - DNA, 20 bp, Artificial Sequence
  Description of Artificial Sequence: Synthetic oligonucleotide
  Target: SCN9A; (+) strand; PAM type: YTN; PAM sequence: TTT
tgccatgtattttcttttga

SEQ ID NO: 98190 - DNA, 20 bp, Artificial Sequence
  Description of Artificial Sequence: Synthetic oligonucleotide
  Target: SCN9A; (+) strand; PAM type: YTN; PAM sequence: TTT
gccatgtattttcttttgat

SEQ ID NO: 98191 - DNA, 20 bp, Artificial Sequence
  Description of Artificial Sequence: Synthetic oligonucleotide
  Target: SCN9A; (+) strand; PAM type: YTN; PAM sequence: TTG
ccatgtattttcttttgatt

SEQ ID NO: 98192 - DNA, 20 bp, Artificial Sequence
  Description of Artificial Sequence: Synthetic oligonucleotide
  Target: SCN9A; (+) strand; PAM type: YTN; PAM sequence: TTT
tcttttgattccgaatacat

SEQ ID NO: 98193 - DNA, 20 bp, Artificial Sequence
  Description of Artificial Sequence: Synthetic oligonucleotide
  Target: SCN9A; (+) strand; PAM type: YTN; PAM sequence: TTT
cttttgattccgaatacatc

SEQ ID NO: 98194 - DNA, 20 bp, Artificial Sequence
  Description of Artificial Sequence: Synthetic oligonucleotide
  Target: SCN9A; (+) strand; PAM type: YTN; PAM sequence: TTC
ttttgattccgaatacatct

SEQ ID NO: 98195 - DNA, 20 bp, Artificial Sequence
  Description of Artificial Sequence: Synthetic oligonucleotide
  Target: SCN9A; (+) strand; PAM type: YTN; PAM sequence: CTT
ttgattccgaatacatcttt

SEQ ID NO: 98196 - DNA, 20 bp, Artificial Sequence
  Description of Artificial Sequence: Synthetic oligonucleotide
  Target: SCN9A; (+) strand; PAM type: YTN; PAM sequence: TTT
tgattccgaatacatcttta

SEQ ID NO: 98197 - DNA, 20 bp, Artificial Sequence
  Description of Artificial Sequence: Synthetic oligonucleotide
  Target: SCN9A; (+) strand; PAM type: YTN; PAM sequence: TTT
gattccgaatacatctttat

SEQ ID NO: 98198 - DNA, 20 bp, Artificial Sequence
  Description of Artificial Sequence: Synthetic oligonucleotide
  Target: SCN9A; (+) strand; PAM type: YTN; PAM sequence: TTG
attccgaatacatctttatt

SEQ ID NO: 98199 - DNA, 20 bp, Artificial Sequence
  Description of Artificial Sequence: Synthetic oligonucleotide
  Target: SCN9A; (+) strand; PAM type: YTN; PAM sequence: TTC
cgaatacatctttattatat

SEQ ID NO: 98200 - DNA, 20 bp, Artificial Sequence
  Description of Artificial Sequence: Synthetic oligonucleotide
  Target: SCN9A; (+) strand; PAM type: YTN; PAM sequence: CTT
tattatattttgtaaaaata

SEQ ID NO: 98201 - DNA, 20 bp, Artificial Sequence
  Description of Artificial Sequence: Synthetic oligonucleotide
  Target: SCN9A; (+) strand; PAM type: YTN; PAM sequence: TTT
attatattttgtaaaaatat

SEQ ID NO: 98202 - DNA, 20 bp, Artificial Sequence
  Description of Artificial Sequence: Synthetic oligonucleotide
  Target: SCN9A; (+) strand; PAM type: YTN; PAM sequence: TTA
ttatattttgtaaaaatatt

SEQ ID NO: 98203 - DNA, 20 bp, Artificial Sequence
  Description of Artificial Sequence: Synthetic oligonucleotide
  Target: SCN9A; (+) strand; PAM type: YTN; PAM sequence: TTA
tattttgtaaaaatattacc

SEQ ID NO: 98204 - DNA, 20 bp, Artificial Sequence
  Description of Artificial Sequence: Synthetic oligonucleotide
  Target: SCN9A; (+) strand; PAM type: YTN; PAM sequence: TTT
tgtaaaaatattacctaggg

SEQ ID NO: 98205 - DNA, 20 bp, Artificial Sequence
  Description of Artificial Sequence: Synthetic oligonucleotide
  Target: SCN9A; (+) strand; PAM type: YTN; PAM sequence: TTT
gtaaaaatattacctaggga

SEQ ID NO: 98206 - DNA, 20 bp, Artificial Sequence
  Description of Artificial Sequence: Synthetic oligonucleotide
  Target: SCN9A; (+) strand; PAM type: YTN; PAM sequence: TTG
taaaaatattacctagggag

SEQ ID NO: 98207 - DNA, 20 bp, Artificial Sequence
  Description of Artificial Sequence: Synthetic oligonucleotide
  Target: SCN9A; (+) strand; PAM type: YTN; PAM sequence: TTA
cctagggagtaatcattaaa

SEQ ID NO: 98208 - DNA, 20 bp, Artificial Sequence
  Description of Artificial Sequence: Synthetic oligonucleotide
  Target: SCN9A; (+) strand; PAM type: YTN; PAM sequence: CTA
gggagtaatcattaaagttt

SEQ ID NO: 98209 - DNA, 20 bp, Artificial Sequence
  Description of Artificial Sequence: Synthetic oligonucleotide
  Target: SCN9A; (+) strand; PAM type: YTN; PAM sequence: TTA
aagtttcttagcatggaact

SEQ ID NO: 98210 - DNA, 20 bp, Artificial Sequence
  Description of Artificial Sequence: Synthetic oligonucleotide
  Target: SCN9A; (+) strand; PAM type: YTN; PAM sequence: TTT
cttagcatggaacttatttc

SEQ ID NO: 98211 - DNA, 20 bp, Artificial Sequence
  Description of Artificial Sequence: Synthetic oligonucleotide
  Target: SCN9A; (+) strand; PAM type: YTN; PAM sequence: TTC
ttagcatggaacttatttca

SEQ ID NO: 98212 - DNA, 20 bp, Artificial Sequence
  Description of Artificial Sequence: Synthetic oligonucleotide
  Target: SCN9A; (+) strand; PAM type: YTN; PAM sequence: CTT
agcatggaacttatttcaca

SEQ ID NO: 98213 - DNA, 20 bp, Artificial Sequence
  Description of Artificial Sequence: Synthetic oligonucleotide
  Target: SCN9A; (+) strand; PAM type: YTN; PAM sequence: TTA
gcatggaacttatttcacat

SEQ ID NO: 98214 - DNA, 20 bp, Artificial Sequence
  Description of Artificial Sequence: Synthetic oligonucleotide
  Target: SCN9A; (+) strand; PAM type: YTN; PAM sequence: CTT
atttcacataaactcatcca

SEQ ID NO: 98215 - DNA, 20 bp, Artificial Sequence
  Description of Artificial Sequence: Synthetic oligonucleotide
  Target: SCN9A; (+) strand; PAM type: YTN; PAM sequence: TTA
tttcacataaactcatccaa

SEQ ID NO: 98216 - DNA, 20 bp, Artificial Sequence
  Description of Artificial Sequence: Synthetic oligonucleotide
  Target: SCN9A; (+) strand; PAM type: YTN; PAM sequence: TTT
cacataaactcatccaaggt

SEQ ID NO: 98217 - DNA, 20 bp, Artificial Sequence
  Description of Artificial Sequence: Synthetic oligonucleotide
  Target: SCN9A; (+) strand; PAM type: YTN; PAM sequence: TTC
acataaactcatccaaggtg

SEQ ID NO: 98218 - DNA, 20 bp, Artificial Sequence
  Description of Artificial Sequence: Synthetic oligonucleotide
  Target: SCN9A; (+) strand; PAM type: YTN; PAM sequence: CTC
atccaaggtgttttaaactg

SEQ ID NO: 98219 - DNA, 20 bp, Artificial Sequence
  Description of Artificial Sequence: Synthetic oligonucleotide
  Target: SCN9A; (+) strand; PAM type: YTN; PAM sequence: TTT
taaactgtaaaaacagtaaa

SEQ ID NO: 98220 - DNA, 20 bp, Artificial Sequence
  Description of Artificial Sequence: Synthetic oligonucleotide
  Target: SCN9A; (+) strand; PAM type: YTN; PAM sequence: TTT
aaactgtaaaaacagtaaaa

SEQ ID NO: 98221 - DNA, 20 bp, Artificial Sequence
  Description of Artificial Sequence: Synthetic oligonucleotide
  Target: SCN9A; (+) strand; PAM type: YTN; PAM sequence: TTA
aactgtaaaaacagtaaaag

SEQ ID NO: 98222 - DNA, 20 bp, Artificial Sequence
  Description of Artificial Sequence: Synthetic oligonucleotide
  Target: SCN9A; (+) strand; PAM type: YTN; PAM sequence: CTG
taaaaacagtaaaagctata

SEQ ID NO: 98223 - DNA, 20 bp, Artificial Sequence
  Description of Artificial Sequence: Synthetic oligonucleotide
  Target: SCN9A; (+) strand; PAM type: YTN; PAM sequence: CTA
tacattaaaattattttatt

SEQ ID NO: 98224 - DNA, 20 bp, Artificial Sequence
  Description of Artificial Sequence: Synthetic oligonucleotide
  Target: SCN9A; (+) strand; PAM type: YTN; PAM sequence: TTA
aaattattttatttttattt

SEQ ID NO: 98225 - DNA, 20 bp, Artificial Sequence
  Description of Artificial Sequence: Synthetic oligonucleotide
  Target: SCN9A; (+) strand; PAM type: YTN; PAM sequence: TTA
ttttatttttattttgataa

SEQ ID NO: 98226 - DNA, 20 bp, Artificial Sequence
  Description of Artificial Sequence: Synthetic oligonucleotide
  Target: SCN9A; (+) strand; PAM type: YTN; PAM sequence: TTT
tatttttattttgataagcg

SEQ ID NO: 98227 - DNA, 20 bp, Artificial Sequence
  Description of Artificial Sequence: Synthetic oligonucleotide
  Target: SCN9A; (+) strand; PAM type: YTN; PAM sequence: TTT
atttttattttgataagcgc

SEQ ID NO: 98228 - DNA, 20 bp, Artificial Sequence
  Description of Artificial Sequence: Synthetic oligonucleotide
  Target: SCN9A; (+) strand; PAM type: YTN; PAM sequence: TTA
tttttattttgataagcgca

SEQ ID NO: 98229 - DNA, 20 bp, Artificial Sequence
  Description of Artificial Sequence: Synthetic oligonucleotide
  Target: SCN9A; (+) strand; PAM type: YTN; PAM sequence: TTT
ttattttgataagcgcatat

SEQ ID NO: 98230 - DNA, 20 bp, Artificial Sequence
  Description of Artificial Sequence: Synthetic oligonucleotide
  Target: SCN9A; (+) strand; PAM type: YTN; PAM sequence: TTT
tattttgataagcgcatatt

SEQ ID NO: 98231 - DNA, 20 bp, Artificial Sequence
  Description of Artificial Sequence: Synthetic oligonucleotide
  Target: SCN9A; (+) strand; PAM type: YTN; PAM sequence: TTT
attttgataagcgcatattt

SEQ ID NO: 98232 - DNA, 20 bp, Artificial Sequence
  Description of Artificial Sequence: Synthetic oligonucleotide
  Target: SCN9A; (+) strand; PAM type: YTN; PAM sequence: TTA
ttttgataagcgcatattta

SEQ ID NO: 98233 - DNA, 20 bp, Artificial Sequence
  Description of Artificial Sequence: Synthetic oligonucleotide
  Target: SCN9A; (+) strand; PAM type: YTN; PAM sequence: TTT
tgataagcgcatatttactg

SEQ ID NO: 98234 - DNA, 20 bp, Artificial Sequence
  Description of Artificial Sequence: Synthetic oligonucleotide
  Target: SCN9A; (+) strand; PAM type: YTN; PAM sequence: TTT
gataagcgcatatttactga

SEQ ID NO: 98235 - DNA, 20 bp, Artificial Sequence
  Description of Artificial Sequence: Synthetic oligonucleotide
  Target: SCN9A; (+) strand; PAM type: YTN; PAM sequence: TTG
ataagcgcatatttactgag

SEQ ID NO: 98236 - DNA, 20 bp, Artificial Sequence
  Description of Artificial Sequence: Synthetic oligonucleotide
  Target: SCN9A; (+) strand; PAM type: YTN; PAM sequence: TTT
actgagcatttagtaatgcc

SEQ ID NO: 98237 - DNA, 20 bp, Artificial Sequence
  Description of Artificial Sequence: Synthetic oligonucleotide
  Target: SCN9A; (+) strand; PAM type: YTN; PAM sequence: TTA
ctgagcatttagtaatgcca

SEQ ID NO: 98238 - DNA, 20 bp, Artificial Sequence
  Description of Artificial Sequence: Synthetic oligonucleotide
  Target: SCN9A; (+) strand; PAM type: YTN; PAM sequence: CTG
agcatttagtaatgccagcc

SEQ ID NO: 98239 - DNA, 20 bp, Artificial Sequence
  Description of Artificial Sequence: Synthetic oligonucleotide
  Target: SCN9A; (+) strand; PAM type: YTN; PAM sequence: TTT
agtaatgccagcctgcacta

SEQ ID NO: 98240 - DNA, 20 bp, Artificial Sequence
  Description of Artificial Sequence: Synthetic oligonucleotide
  Target: SCN9A; (+) strand; PAM type: YTN; PAM sequence: TTA
gtaatgccagcctgcactaa

SEQ ID NO: 98241 - DNA, 20 bp, Artificial Sequence
  Description of Artificial Sequence: Synthetic oligonucleotide
  Target: SCN9A; (+) strand; PAM type: YTN; PAM sequence: CTG
cactaagtgccctgcttcta

SEQ ID NO: 98242 - DNA, 20 bp, Artificial Sequence
  Description of Artificial Sequence: Synthetic oligonucleotide
  Target: SCN9A; (+) strand; PAM type: YTN; PAM sequence: CTA
agtgccctgcttctattttc

SEQ ID NO: 98243 - DNA, 20 bp, Artificial Sequence
  Description of Artificial Sequence: Synthetic oligonucleotide
  Target: SCN9A; (+) strand; PAM type: YTN; PAM sequence: CTG
cttctattttcttgttgggt

SEQ ID NO: 98244 - DNA, 20 bp, Artificial Sequence
  Description of Artificial Sequence: Synthetic oligonucleotide
  Target: SCN9A; (+) strand; PAM type: YTN; PAM sequence: CTT
ctattttcttgttgggtcct

SEQ ID NO: 98245 - DNA, 20 bp, Artificial Sequence
  Description of Artificial Sequence: Synthetic oligonucleotide
  Target: SCN9A; (+) strand; PAM type: YTN; PAM sequence: TTC
tattttcttgttgggtcctc

SEQ ID NO: 98246 - DNA, 20 bp, Artificial Sequence
  Description of Artificial Sequence: Synthetic oligonucleotide
  Target: SCN9A; (+) strand; PAM type: YTN; PAM sequence: CTA
ttttcttgttgggtcctcac

SEQ ID NO: 98247 - DNA, 20 bp, Artificial Sequence
  Description of Artificial Sequence: Synthetic oligonucleotide
  Target: SCN9A; (+) strand; PAM type: YTN; PAM sequence: TTT
tcttgttgggtcctcacaac

SEQ ID NO: 98248 - DNA, 20 bp, Artificial Sequence
  Description of Artificial Sequence: Synthetic oligonucleotide
  Target: SCN9A; (+) strand; PAM type: YTN; PAM sequence: TTT
cttgttgggtcctcacaaca

SEQ ID NO: 98249 - DNA, 20 bp, Artificial Sequence
  Description of Artificial Sequence: Synthetic oligonucleotide
  Target: SCN9A; (+) strand; PAM type: YTN; PAM sequence: TTC
ttgttgggtcctcacaacac

SEQ ID NO: 98250 - DNA, 20 bp, Artificial Sequence
  Description of Artificial Sequence: Synthetic oligonucleotide
  Target: SCN9A; (+) strand; PAM type: YTN; PAM sequence: CTT
gttgggtcctcacaacacta

SEQ ID NO: 98251 - DNA, 20 bp, Artificial Sequence
  Description of Artificial Sequence: Synthetic oligonucleotide
  Target: SCN9A; (+) strand; PAM type: YTN; PAM sequence: TTG
ttgggtcctcacaacactat

SEQ ID NO: 98252 - DNA, 20 bp, Artificial Sequence
  Description of Artificial Sequence: Synthetic oligonucleotide
  Target: SCN9A; (+) strand; PAM type: YTN; PAM sequence: TTG
ggtcctcacaacactatgga

SEQ ID NO: 98253 - DNA, 20 bp, Artificial Sequence
  Description of Artificial Sequence: Synthetic oligonucleotide
  Target: SCN9A; (+) strand; PAM type: YTN; PAM sequence: CTC
acaacactatggagtaggca

SEQ ID NO: 98254 - DNA, 20 bp, Artificial Sequence
  Description of Artificial Sequence: Synthetic oligonucleotide
  Target: SCN9A; (+) strand; PAM type: YTN; PAM sequence: CTA
tggagtaggcattggatgat

SEQ ID NO: 98255 - DNA, 20 bp, Artificial Sequence
  Description of Artificial Sequence: Synthetic oligonucleotide
  Target: SCN9A; (+) strand; PAM type: YTN; PAM sequence: TTG
gatgattgtagacatttatt

SEQ ID NO: 98256 - DNA, 20 bp, Artificial Sequence
  Description of Artificial Sequence: Synthetic oligonucleotide
  Target: SCN9A; (+) strand; PAM type: YTN; PAM sequence: TTG
tagacatttattagacaaat

SEQ ID NO: 98257 - DNA, 20 bp, Artificial Sequence
  Description of Artificial Sequence: Synthetic oligonucleotide
  Target: SCN9A; (+) strand; PAM type: YTN; PAM sequence: TTT
attagacaaatgatagattc

SEQ ID NO: 98258 - DNA, 20 bp, Artificial Sequence
  Description of Artificial Sequence: Synthetic oligonucleotide
  Target: SCN9A; (+) strand; PAM type: YTN; PAM sequence: TTA
ttagacaaatgatagattca

SEQ ID NO: 98259 - DNA, 20 bp, Artificial Sequence
  Description of Artificial Sequence: Synthetic oligonucleotide
  Target: SCN9A; (+) strand; PAM type: YTN; PAM sequence: TTA
gacaaatgatagattcatta

SEQ ID NO: 98260 - DNA, 20 bp, Artificial Sequence
  Description of Artificial Sequence: Synthetic oligonucleotide
  Target: SCN9A; (+) strand; PAM type: YTN; PAM sequence: TTC
attaaattatagattagaca

SEQ ID NO: 98261 - DNA, 20 bp, Artificial Sequence
  Description of Artificial Sequence: Synthetic oligonucleotide
  Target: SCN9A; (+) strand; PAM type: YTN; PAM sequence: TTA
aattatagattagacaaata

SEQ ID NO: 98262 - DNA, 20 bp, Artificial Sequence
  Description of Artificial Sequence: Synthetic oligonucleotide
  Target: SCN9A; (+) strand; PAM type: YTN; PAM sequence: TTA
tagattagacaaataaacta

SEQ ID NO: 98263 - DNA, 20 bp, Artificial Sequence
  Description of Artificial Sequence: Synthetic oligonucleotide
  Target: SCN9A; (+) strand; PAM type: YTN; PAM sequence: TTA
gacaaataaactaagtctca

SEQ ID NO: 98264 - DNA, 20 bp, Artificial Sequence
  Description of Artificial Sequence: Synthetic oligonucleotide
  Target: SCN9A; (+) strand; PAM type: YTN; PAM sequence: CTA
agtctcaagaaggtaaggta

SEQ ID NO: 98265 - DNA, 20 bp, Artificial Sequence
  Description of Artificial Sequence: Synthetic oligonucleotide
  Target: SCN9A; (+) strand; PAM type: YTN; PAM sequence: CTC
aagaaggtaaggtaatttgc

SEQ ID NO: 98266 - DNA, 20 bp, Artificial Sequence
  Description of Artificial Sequence: Synthetic oligonucleotide
  Target: SCN9A; (+) strand; PAM type: YTN; PAM sequence: TTT
gcccgaagtcagttgtagag

SEQ ID NO: 98267 - DNA, 20 bp, Artificial Sequence
  Description of Artificial Sequence: Synthetic oligonucleotide
  Target: SCN9A; (+) strand; PAM type: YTN; PAM sequence: TTG
cccgaagtcagttgtagagc

SEQ ID NO: 98268 - DNA, 20 bp, Artificial Sequence
  Description of Artificial Sequence: Synthetic oligonucleotide
  Target: SCN9A; (+) strand; PAM type: YTN; PAM sequence: TTG
tagagcttggatgatatggt

SEQ ID NO: 98269 - DNA, 20 bp, Artificial Sequence
  Description of Artificial Sequence: Synthetic oligonucleotide
  Target: SCN9A; (+) strand; PAM type: YTN; PAM sequence: CTT
ggatgatatggtacagctag

SEQ ID NO: 98270 - DNA, 20 bp, Artificial Sequence
  Description of Artificial Sequence: Synthetic oligonucleotide
  Target: SCN9A; (+) strand; PAM type: YTN; PAM sequence: TTG
gatgatatggtacagctaga

SEQ ID NO: 98271 - DNA, 20 bp, Artificial Sequence
  Description of Artificial Sequence: Synthetic oligonucleotide
  Target: SCN9A; (+) strand; PAM type: YTN; PAM sequence: CTA
gaatttgaatcaggctctat

SEQ ID NO: 98272 - DNA, 20 bp, Artificial Sequence
  Description of Artificial Sequence: Synthetic oligonucleotide
  Target: SCN9A; (+) strand; PAM type: YTN; PAM sequence: TTT
gaatcaggctctatctccaa

SEQ ID NO: 98273 - DNA, 20 bp, Artificial Sequence
  Description of Artificial Sequence: Synthetic oligonucleotide
  Target: SCN9A; (+) strand; PAM type: YTN; PAM sequence: TTG
aatcaggctctatctccaac

SEQ ID NO: 98274 - DNA, 20 bp, Artificial Sequence
  Description of Artificial Sequence: Synthetic oligonucleotide
  Target: SCN9A; (+) strand; PAM type: YTN; PAM sequence: CTC
tatctccaactgctgtactc

SEQ ID NO: 98275 - DNA, 20 bp, Artificial Sequence
  Description of Artificial Sequence: Synthetic oligonucleotide
  Target: SCN9A; (+) strand; PAM type: YTN; PAM sequence: CTA
tctccaactgctgtactcac

SEQ ID NO: 98276 - DNA, 20 bp, Artificial Sequence
  Description of Artificial Sequence: Synthetic oligonucleotide
  Target: SCN9A; (+) strand; PAM type: YTN; PAM sequence: CTC
caactgctgtactcacaacc

SEQ ID NO: 98277 - DNA, 20 bp, Artificial Sequence
  Description of Artificial Sequence: Synthetic oligonucleotide
  Target: SCN9A; (+) strand; PAM type: YTN; PAM sequence: CTG
ctgtactcacaaccactagg

SEQ ID NO: 98278 - DNA, 20 bp, Artificial Sequence
  Description of Artificial Sequence: Synthetic oligonucleotide
  Target: SCN9A; (+) strand; PAM type: YTN; PAM sequence: CTG
tactcacaaccactaggcta

SEQ ID NO: 98279 - DNA, 20 bp, Artificial Sequence
  Description of Artificial Sequence: Synthetic oligonucleotide
  Target: SCN9A; (+) strand; PAM type: YTN; PAM sequence: CTC
acaaccactaggctactatc

SEQ ID NO: 98280 - DNA, 20 bp, Artificial Sequence
  Description of Artificial Sequence: Synthetic oligonucleotide
  Target: SCN9A; (+) strand; PAM type: YTN; PAM sequence: CTA
ggctactatcaggtggatgt

SEQ ID NO: 98281 - DNA, 20 bp, Artificial Sequence
  Description of Artificial Sequence: Synthetic oligonucleotide
  Target: SCN9A; (+) strand; PAM type: YTN; PAM sequence: CTA
ctatcaggtggatgttcttc

SEQ ID NO: 98282 - DNA, 20 bp, Artificial Sequence
  Description of Artificial Sequence: Synthetic oligonucleotide
  Target: SCN9A; (+) strand; PAM type: YTN; PAM sequence: CTA
tcaggtggatgttcttcatt

SEQ ID NO: 98283 - DNA, 20 bp, Artificial Sequence
  Description of Artificial Sequence: Synthetic oligonucleotide
  Target: SCN9A; (+) strand; PAM type: YTN; PAM sequence: TTC
ttcattgtctatgtgagtcc

SEQ ID NO: 98284 - DNA, 20 bp, Artificial Sequence
  Description of Artificial Sequence: Synthetic oligonucleotide
  Target: SCN9A; (+) strand; PAM type: YTN; PAM sequence: CTT
cattgtctatgtgagtccca

SEQ ID NO: 98285 - DNA, 20 bp, Artificial Sequence
  Description of Artificial Sequence: Synthetic oligonucleotide
  Target: SCN9A; (+) strand; PAM type: YTN; PAM sequence: TTC
attgtctatgtgagtcccaa

SEQ ID NO: 98286 - DNA, 20 bp, Artificial Sequence
  Description of Artificial Sequence: Synthetic oligonucleotide
  Target: SCN9A; (+) strand; PAM type: YTN; PAM sequence: TTG
tctatgtgagtcccaagggc

SEQ ID NO: 98287 - DNA, 20 bp, Artificial Sequence
  Description of Artificial Sequence: Synthetic oligonucleotide
  Target: SCN9A; (+) strand; PAM type: YTN; PAM sequence: CTA
tgtgagtcccaagggcttca

SEQ ID NO: 98288 - DNA, 20 bp, Artificial Sequence
  Description of Artificial Sequence: Synthetic oligonucleotide
  Target: SCN9A; (+) strand; PAM type: YTN; PAM sequence: CTT
catgaagttatagtttggaa

SEQ ID NO: 98289 - DNA, 20 bp, Artificial Sequence
  Description of Artificial Sequence: Synthetic oligonucleotide
  Target: SCN9A; (+) strand; PAM type: YTN; PAM sequence: TTC
atgaagttatagtttggaaa

SEQ ID NO: 98290 - DNA, 20 bp, Artificial Sequence
  Description of Artificial Sequence: Synthetic oligonucleotide
  Target: SCN9A; (+) strand; PAM type: YTN; PAM sequence: TTA
tagtttggaaatcactgaaa

SEQ ID NO: 98291 - DNA, 20 bp, Artificial Sequence
  Description of Artificial Sequence: Synthetic oligonucleotide
  Target: SCN9A; (+) strand; PAM type: YTN; PAM sequence: TTT
ggaaatcactgaaataaact

SEQ ID NO: 98292 - DNA, 20 bp, Artificial Sequence
  Description of Artificial Sequence: Synthetic oligonucleotide
  Target: SCN9A; (+) strand; PAM type: YTN; PAM sequence: TTG
gaaatcactgaaataaacta

SEQ ID NO: 98293 - DNA, 20 bp, Artificial Sequence
  Description of Artificial Sequence: Synthetic oligonucleotide
  Target: SCN9A; (+) strand; PAM type: YTN; PAM sequence: CTG
aaataaactaagaagctttt

SEQ ID NO: 98294 - DNA, 20 bp, Artificial Sequence
  Description of Artificial Sequence: Synthetic oligonucleotide
  Target: SCN9A; (+) strand; PAM type: YTN; PAM sequence: CTA
agaagcttttaaaaataaag

SEQ ID NO: 98295 - DNA, 20 bp, Artificial Sequence
  Description of Artificial Sequence: Synthetic oligonucleotide
  Target: SCN9A; (+) strand; PAM type: YTN; PAM sequence: CTT
ttaaaaataaagtttagtgc

SEQ ID NO: 98296 - DNA, 20 bp, Artificial Sequence
  Description of Artificial Sequence: Synthetic oligonucleotide
  Target: SCN9A; (+) strand; PAM type: YTN; PAM sequence: TTT
taaaaataaagtttagtgct

SEQ ID NO: 98297 - DNA, 20 bp, Artificial Sequence
  Description of Artificial Sequence: Synthetic oligonucleotide
  Target: SCN9A; (+) strand; PAM type: YTN; PAM sequence: TTT
aaaaataaagtttagtgcta

SEQ ID NO: 98298 - DNA, 20 bp, Artificial Sequence
  Description of Artificial Sequence: Synthetic oligonucleotide
  Target: SCN9A; (+) strand; PAM type: YTN; PAM sequence: TTA
aaaataaagtttagtgctaa

SEQ ID NO: 98299 - DNA, 20 bp, Artificial Sequence
  Description of Artificial Sequence: Synthetic oligonucleotide
  Target: SCN9A; (+) strand; PAM type: YTN; PAM sequence: TTT
agtgctaagataatcaatac

SEQ ID NO: 98300 - DNA, 20 bp, Artificial Sequence
  Description of Artificial Sequence: Synthetic oligonucleotide
  Target: SCN9A; (+) strand; PAM type: YTN; PAM sequence: TTA
gtgctaagataatcaatact

SEQ ID NO: 98301 - DNA, 20 bp, Artificial Sequence
  Description of Artificial Sequence: Synthetic oligonucleotide
  Target: SCN9A; (+) strand; PAM type: YTN; PAM sequence: CTA
agataatcaatacttacatt

SEQ ID NO: 98302 - DNA, 20 bp, Artificial Sequence
  Description of Artificial Sequence: Synthetic oligonucleotide
  Target: SCN9A; (+) strand; PAM type: YTN; PAM sequence: CTT
acattaacagaatccactgc

SEQ ID NO: 98303 - DNA, 20 bp, Artificial Sequence
  Description of Artificial Sequence: Synthetic oligonucleotide
  Target: SCN9A; (+) strand; PAM type: YTN; PAM sequence: TTA
cattaacagaatccactgct

SEQ ID NO: 98304 - DNA, 20 bp, Artificial Sequence
  Description of Artificial Sequence: Synthetic oligonucleotide
  Target: SCN9A; (+) strand; PAM type: YTN; PAM sequence: TTA
acagaatccactgctgcata

SEQ ID NO: 98305 - DNA, 20 bp, Artificial Sequence
  Description of Artificial Sequence: Synthetic oligonucleotide
  Target: SCN9A; (+) strand; PAM type: YTN; PAM sequence: CTG
ctgcatacataataatcgtc

SEQ ID NO: 98306 - DNA, 20 bp, Artificial Sequence
  Description of Artificial Sequence: Synthetic oligonucleotide
  Target: SCN9A; (+) strand; PAM type: YTN; PAM sequence: CTG
catacataataatcgtccat

SEQ ID NO: 98307 - DNA, 20 bp, Artificial Sequence
  Description of Artificial Sequence: Synthetic oligonucleotide
  Target: SCN9A; (+) strand; PAM type: YTN; PAM sequence: CTT
aaaagttgcctttaagaata

SEQ ID NO: 98308 - DNA, 20 bp, Artificial Sequence
  Description of Artificial Sequence: Synthetic oligonucleotide
  Target: SCN9A; (+) strand; PAM type: YTN; PAM sequence: TTA
aaagttgcctttaagaataa

SEQ ID NO: 98309 - DNA, 20 bp, Artificial Sequence
  Description of Artificial Sequence: Synthetic oligonucleotide
  Target: SCN9A; (+) strand; PAM type: YTN; PAM sequence: TTG
cctttaagaataacattaat

SEQ ID NO: 98310 - DNA, 20 bp, Artificial Sequence
  Description of Artificial Sequence: Synthetic oligonucleotide
  Target: SCN9A; (+) strand; PAM type: YTN; PAM sequence: CTT
taagaataacattaatagaa

SEQ ID NO: 98311 - DNA, 20 bp, Artificial Sequence
  Description of Artificial Sequence: Synthetic oligonucleotide
  Target: SCN9A; (+) strand; PAM type: YTN; PAM sequence: TTT
aagaataacattaatagaat

SEQ ID NO: 98312 - DNA, 20 bp, Artificial Sequence
  Description of Artificial Sequence: Synthetic oligonucleotide
  Target: SCN9A; (+) strand; PAM type: YTN; PAM sequence: TTA
agaataacattaatagaatt

SEQ ID NO: 98313 - DNA, 20 bp, Artificial Sequence
  Description of Artificial Sequence: Synthetic oligonucleotide
  Target: SCN9A; (+) strand; PAM type: YTN; PAM sequence: TTA
atagaatttgaatgttaagc

SEQ ID NO: 98314 - DNA, 20 bp, Artificial Sequence
  Description of Artificial Sequence: Synthetic oligonucleotide
  Target: SCN9A; (+) strand; PAM type: YTN; PAM sequence: TTT
gaatgttaagctcatattct

SEQ ID NO: 98315 - DNA, 20 bp, Artificial Sequence
  Description of Artificial Sequence: Synthetic oligonucleotide
  Target: SCN9A; (+) strand; PAM type: YTN; PAM sequence: TTG
aatgttaagctcatattcta

SEQ ID NO: 98316 - DNA, 20 bp, Artificial Sequence
  Description of Artificial Sequence: Synthetic oligonucleotide
  Target: SCN9A; (+) strand; PAM type: YTN; PAM sequence: TTA
agctcatattctaaaatagc

SEQ ID NO: 98317 - DNA, 20 bp, Artificial Sequence
  Description of Artificial Sequence: Synthetic oligonucleotide
  Target: SCN9A; (+) strand; PAM type: YTN; PAM sequence: CTC
atattctaaaatagccataa

SEQ ID NO: 98318 - DNA, 20 bp, Artificial Sequence
  Description of Artificial Sequence: Synthetic oligonucleotide
  Target: SCN9A; (+) strand; PAM type: YTN; PAM sequence: TTC
taaaatagccataaacagag

SEQ ID NO: 98319 - DNA, 20 bp, Artificial Sequence
  Description of Artificial Sequence: Synthetic oligonucleotide
  Target: SCN9A; (+) strand; PAM type: YTN; PAM sequence: CTA
aaatagccataaacagagtt

SEQ ID NO: 98320 - DNA, 20 bp, Artificial Sequence
  Description of Artificial Sequence: Synthetic oligonucleotide
  Target: SCN9A; (+) strand; PAM type: YTN; PAM sequence: TTT
tgtctgtttaatgttaccac

SEQ ID NO: 98321 - DNA, 20 bp, Artificial Sequence
  Description of Artificial Sequence: Synthetic oligonucleotide
  Target: SCN9A; (+) strand; PAM type: YTN; PAM sequence: TTT
gtctgtttaatgttaccaca

SEQ ID NO: 98322 - DNA, 20 bp, Artificial Sequence
  Description of Artificial Sequence: Synthetic oligonucleotide
  Target: SCN9A; (+) strand; PAM type: YTN; PAM sequence: TTG
tctgtttaatgttaccacaa

SEQ ID NO: 98323 - DNA, 20 bp, Artificial Sequence
  Description of Artificial Sequence: Synthetic oligonucleotide
  Target: SCN9A; (+) strand; PAM type: YTN; PAM sequence: CTG
tttaatgttaccacaattat

SEQ ID NO: 98324 - DNA, 20 bp, Artificial Sequence
  Description of Artificial Sequence: Synthetic oligonucleotide
  Target: SCN9A; (+) strand; PAM type: YTN; PAM sequence: TTT
aatgttaccacaattattaa

SEQ ID NO: 98325 - DNA, 20 bp, Artificial Sequence
  Description of Artificial Sequence: Synthetic oligonucleotide
  Target: SCN9A; (+) strand; PAM type: YTN; PAM sequence: TTA
atgttaccacaattattaag

SEQ ID NO: 98326 - DNA, 20 bp, Artificial Sequence
  Description of Artificial Sequence: Synthetic oligonucleotide
  Target: SCN9A; (+) strand; PAM type: YTN; PAM sequence: TTA
ccacaattattaagtaatac

SEQ ID NO: 98327 - DNA, 20 bp, Artificial Sequence
  Description of Artificial Sequence: Synthetic oligonucleotide
  Target: SCN9A; (+) strand; PAM type: YTN; PAM sequence: TTA
ttaagtaatactagtaagtt

SEQ ID NO: 98328 - DNA, 20 bp, Artificial Sequence
  Description of Artificial Sequence: Synthetic oligonucleotide
  Target: SCN9A; (+) strand; PAM type: YTN; PAM sequence: TTA
agtaatactagtaagttttg

SEQ ID NO: 98329 - DNA, 20 bp, Artificial Sequence
  Description of Artificial Sequence: Synthetic oligonucleotide
  Target: SCN9A; (+) strand; PAM type: YTN; PAM sequence: CTA
gtaagttttgctgtattcaa

SEQ ID NO: 98330 - DNA, 20 bp, Artificial Sequence
  Description of Artificial Sequence: Synthetic oligonucleotide
  Target: SCN9A; (+) strand; PAM type: YTN; PAM sequence: TTT
tgctgtattcaacatgtcca

SEQ ID NO: 98331 - DNA, 20 bp, Artificial Sequence
  Description of Artificial Sequence: Synthetic oligonucleotide
  Target: SCN9A; (+) strand; PAM type: YTN; PAM sequence: TTT
gctgtattcaacatgtccat

SEQ ID NO: 98332 - DNA, 20 bp, Artificial Sequence
  Description of Artificial Sequence: Synthetic oligonucleotide
  Target: SCN9A; (+) strand; PAM type: YTN; PAM sequence: TTG
ctgtattcaacatgtccatt

SEQ ID NO: 98333 - DNA, 20 bp, Artificial Sequence
  Description of Artificial Sequence: Synthetic oligonucleotide
  Target: SCN9A; (+) strand; PAM type: YTN; PAM sequence: CTG
tattcaacatgtccatttaa

SEQ ID NO: 98334 - DNA, 20 bp, Artificial Sequence
  Description of Artificial Sequence: Synthetic oligonucleotide
  Target: SCN9A; (+) strand; PAM type: YTN; PAM sequence: TTC
aacatgtccatttaatgtaa

SEQ ID NO: 98335 - DNA, 20 bp, Artificial Sequence
  Description of Artificial Sequence: Synthetic oligonucleotide
  Target: SCN9A; (+) strand; PAM type: YTN; PAM sequence: TTT
aatgtaaagatttttttaaa

SEQ ID NO: 98336 - DNA, 20 bp, Artificial Sequence
  Description of Artificial Sequence: Synthetic oligonucleotide
  Target: SCN9A; (+) strand; PAM type: YTN; PAM sequence: TTA
atgtaaagatttttttaaaa

SEQ ID NO: 98337 - DNA, 20 bp, Artificial Sequence
  Description of Artificial Sequence: Synthetic oligonucleotide
  Target: SCN9A; (+) strand; PAM type: YTN; PAM sequence: TTT
ttttaaaaaggacatattcc

SEQ ID NO: 98338 - DNA, 20 bp, Artificial Sequence
  Description of Artificial Sequence: Synthetic oligonucleotide
  Target: SCN9A; (+) strand; PAM type: YTN; PAM sequence: TTT
tttaaaaaggacatattccc

SEQ ID NO: 98339 - DNA, 20 bp, Artificial Sequence
  Description of Artificial Sequence: Synthetic oligonucleotide
  Target: SCN9A; (+) strand; PAM type: YTN; PAM sequence: TTT
ttaaaaaggacatattccca

SEQ ID NO: 98340 - DNA, 20 bp, Artificial Sequence
  Description of Artificial Sequence: Synthetic oligonucleotide
  Target: SCN9A; (+) strand; PAM type: YTN; PAM sequence: TTT
taaaaaggacatattcccaa

SEQ ID NO: 98341 - DNA, 20 bp, Artificial Sequence
  Description of Artificial Sequence: Synthetic oligonucleotide
  Target: SCN9A; (+) strand; PAM type: YTN; PAM sequence: TTT
aaaaaggacatattcccaag

SEQ ID NO: 98342 - DNA, 20 bp, Artificial Sequence
  Description of Artificial Sequence: Synthetic oligonucleotide
  Target: SCN9A; (+) strand; PAM type: YTN; PAM sequence: TTA
aaaaggacatattcccaagt

SEQ ID NO: 98343 - DNA, 20 bp, Artificial Sequence
  Description of Artificial Sequence: Synthetic oligonucleotide
  Target: SCN9A; (+) strand; PAM type: YTN; PAM sequence: TTC
ccaagtaacattctaaatct

SEQ ID NO: 98344 - DNA, 20 bp, Artificial Sequence
  Description of Artificial Sequence: Synthetic oligonucleotide
  Target: SCN9A; (+) strand; PAM type: YTN; PAM sequence: TTC
taaatcttagtcccagttaa

SEQ ID NO: 98345 - DNA, 20 bp, Artificial Sequence
  Description of Artificial Sequence: Synthetic oligonucleotide
  Target: SCN9A; (+) strand; PAM type: YTN; PAM sequence: CTA
aatcttagtcccagttaatt

SEQ ID NO: 98346 - DNA, 20 bp, Artificial Sequence
  Description of Artificial Sequence: Synthetic oligonucleotide
  Target: SCN9A; (+) strand; PAM type: YTN; PAM sequence: CTT
agtcccagttaattatttct

SEQ ID NO: 98347 - DNA, 20 bp, Artificial Sequence
  Description of Artificial Sequence: Synthetic oligonucleotide
  Target: SCN9A; (+) strand; PAM type: YTN; PAM sequence: TTA
gtcccagttaattatttcta

SEQ ID NO: 98348 - DNA, 20 bp, Artificial Sequence
  Description of Artificial Sequence: Synthetic oligonucleotide
  Target: SCN9A; (+) strand; PAM type: YTN; PAM sequence: TTA
attatttctaaattgttaca

SEQ ID NO: 98349 - DNA, 20 bp, Artificial Sequence
  Description of Artificial Sequence: Synthetic oligonucleotide
  Target: SCN9A; (+) strand; PAM type: YTN; PAM sequence: TTA
tttctaaattgttacagttg

SEQ ID NO: 98350 - DNA, 20 bp, Artificial Sequence
  Description of Artificial Sequence: Synthetic oligonucleotide
  Target: SCN9A; (+) strand; PAM type: YTN; PAM sequence: TTT
ctaaattgttacagttgcct

SEQ ID NO: 98351 - DNA, 20 bp, Artificial Sequence
  Description of Artificial Sequence: Synthetic oligonucleotide
  Target: SCN9A; (+) strand; PAM type: YTN; PAM sequence: TTC
taaattgttacagttgcctg

SEQ ID NO: 98352 - DNA, 20 bp, Artificial Sequence
  Description of Artificial Sequence: Synthetic oligonucleotide
  Target: SCN9A; (+) strand; PAM type: YTN; PAM sequence: CTA
aattgttacagttgcctgtg

SEQ ID NO: 98353 - DNA, 20 bp, Artificial Sequence
  Description of Artificial Sequence: Synthetic oligonucleotide
  Target: SCN9A; (+) strand; PAM type: YTN; PAM sequence: TTG
ttacagttgcctgtgaattt

SEQ ID NO: 98354 - DNA, 20 bp, Artificial Sequence
  Description of Artificial Sequence: Synthetic oligonucleotide
  Target: SCN9A; (+) strand; PAM type: YTN; PAM sequence: TTA
cagttgcctgtgaatttcgc

SEQ ID NO: 98355 - DNA, 20 bp, Artificial Sequence
  Description of Artificial Sequence: Synthetic oligonucleotide
  Target: SCN9A; (+) strand; PAM type: YTN; PAM sequence: TTG
cctgtgaatttcgcacataa

SEQ ID NO: 98356 - DNA, 20 bp, Artificial Sequence
  Description of Artificial Sequence: Synthetic oligonucleotide
  Target: SCN9A; (+) strand; PAM type: YTN; PAM sequence: CTG
tgaatttcgcacataacctt

SEQ ID NO: 98357 - DNA, 20 bp, Artificial Sequence
  Description of Artificial Sequence: Synthetic oligonucleotide
  Target: SCN9A; (+) strand; PAM type: YTN; PAM sequence: TTT
cgcacataaccttttatttt

SEQ ID NO: 98358 - DNA, 20 bp, Artificial Sequence
  Description of Artificial Sequence: Synthetic oligonucleotide
  Target: SCN9A; (+) strand; PAM type: YTN; PAM sequence: TTC
gcacataaccttttattttt

SEQ ID NO: 98359 - DNA, 20 bp, Artificial Sequence
  Description of Artificial Sequence: Synthetic oligonucleotide
  Target: SCN9A; (+) strand; PAM type: YTN; PAM sequence: CTT
ttattttttaaaggtgaagg

SEQ ID NO: 98360 - DNA, 20 bp, Artificial Sequence
  Description of Artificial Sequence: Synthetic oligonucleotide
  Target: SCN9A; (+) strand; PAM type: YTN; PAM sequence: TTT
tattttttaaaggtgaagga

SEQ ID NO: 98361 - DNA, 20 bp, Artificial Sequence
  Description of Artificial Sequence: Synthetic oligonucleotide
  Target: SCN9A; (+) strand; PAM type: YTN; PAM sequence: TTT
attttttaaaggtgaaggaa

SEQ ID NO: 98362 - DNA, 20 bp, Artificial Sequence
  Description of Artificial Sequence: Synthetic oligonucleotide
  Target: SCN9A; (+) strand; PAM type: YTN; PAM sequence: TTA
ttttttaaaggtgaaggaaa

SEQ ID NO: 98363 - DNA, 20 bp, Artificial Sequence
  Description of Artificial Sequence: Synthetic oligonucleotide
  Target: SCN9A; (+) strand; PAM type: YTN; PAM sequence: TTT
tttaaaggtgaaggaaaatt

SEQ ID NO: 98364 - DNA, 20 bp, Artificial Sequence
  Description of Artificial Sequence: Synthetic oligonucleotide
  Target: SCN9A; (+) strand; PAM type: YTN; PAM sequence: TTT
ttaaaggtgaaggaaaattt

SEQ ID NO: 98365 - DNA, 20 bp, Artificial Sequence
  Description of Artificial Sequence: Synthetic oligonucleotide
  Target: SCN9A; (+) strand; PAM type: YTN; PAM sequence: TTT
taaaggtgaaggaaaatttt

SEQ ID NO: 98366 - DNA, 20 bp, Artificial Sequence
  Description of Artificial Sequence: Synthetic oligonucleotide
  Target: SCN9A; (+) strand; PAM type: YTN; PAM sequence: TTT
aaaggtgaaggaaaatttta

SEQ ID NO: 98367 - DNA, 20 bp, Artificial Sequence
  Description of Artificial Sequence: Synthetic oligonucleotide
  Target: SCN9A; (+) strand; PAM type: YTN; PAM sequence: TTA
aaggtgaaggaaaattttat

SEQ ID NO: 98368 - DNA, 20 bp, Artificial Sequence
  Description of Artificial Sequence: Synthetic oligonucleotide
  Target: SCN9A; (+) strand; PAM type: YTN; PAM sequence: TTT
tatgaataagacaggaaaca

SEQ ID NO: 98369 - DNA, 20 bp, Artificial Sequence
  Description of Artificial Sequence: Synthetic oligonucleotide
  Target: SCN9A; (+) strand; PAM type: YTN; PAM sequence: TTT
atgaataagacaggaaacat

SEQ ID NO: 98370 - DNA, 20 bp, Artificial Sequence
  Description of Artificial Sequence: Synthetic oligonucleotide
  Target: SCN9A; (+) strand; PAM type: YTN; PAM sequence: TTA
tgaataagacaggaaacatc

SEQ ID NO: 98371 - DNA, 20 bp, Artificial Sequence
  Description of Artificial Sequence: Synthetic oligonucleotide
  Target: SCN9A; (+) strand; PAM type: YTN; PAM sequence: CTT
ttctccattttttaaagggt

SEQ ID NO: 98372 - DNA, 20 bp, Artificial Sequence
  Description of Artificial Sequence: Synthetic oligonucleotide
  Target: SCN9A; (+) strand; PAM type: YTN; PAM sequence: TTT
tctccattttttaaagggtt

SEQ ID NO: 98373 - DNA, 20 bp, Artificial Sequence
  Description of Artificial Sequence: Synthetic oligonucleotide
  Target: SCN9A; (+) strand; PAM type: YTN; PAM sequence: TTT
ctccattttttaaagggttc

SEQ ID NO: 98374 - DNA, 20 bp, Artificial Sequence
  Description of Artificial Sequence: Synthetic oligonucleotide
  Target: SCN9A; (+) strand; PAM type: YTN; PAM sequence: TTC
tccattttttaaagggttct

SEQ ID NO: 98375 - DNA, 20 bp, Artificial Sequence
  Description of Artificial Sequence: Synthetic oligonucleotide
  Target: SCN9A; (+) strand; PAM type: YTN; PAM sequence: CTC
cattttttaaagggttctcc

SEQ ID NO: 98376 - DNA, 20 bp, Artificial Sequence
  Description of Artificial Sequence: Synthetic oligonucleotide
  Target: SCN9A; (+) strand; PAM type: YTN; PAM sequence: TTT
tttaaagggttctccatgcc

SEQ ID NO: 98377 - DNA, 20 bp, Artificial Sequence
  Description of Artificial Sequence: Synthetic oligonucleotide
  Target: SCN9A; (+) strand; PAM type: YTN; PAM sequence: TTT
ttaaagggttctccatgcct

SEQ ID NO: 98378 - DNA, 20 bp, Artificial Sequence
  Description of Artificial Sequence: Synthetic oligonucleotide
  Target: SCN9A; (+) strand; PAM type: YTN; PAM sequence: TTT
taaagggttctccatgcctg

SEQ ID NO: 98379 - DNA, 20 bp, Artificial Sequence
  Description of Artificial Sequence: Synthetic oligonucleotide
  Target: SCN9A; (+) strand; PAM type: YTN; PAM sequence: TTT
aaagggttctccatgcctgt

SEQ ID NO: 98380 - DNA, 20 bp, Artificial Sequence
  Description of Artificial Sequence: Synthetic oligonucleotide
  Target: SCN9A; (+) strand; PAM type: YTN; PAM sequence: TTA
aagggttctccatgcctgtg

SEQ ID NO: 98381 - DNA, 20 bp, Artificial Sequence
  Description of Artificial Sequence: Synthetic oligonucleotide
  Target: SCN9A; (+) strand; PAM type: YTN; PAM sequence: TTC
tccatgcctgtgggaagttc

SEQ ID NO: 98382 - DNA, 20 bp, Artificial Sequence
  Description of Artificial Sequence: Synthetic oligonucleotide
  Target: SCN9A; (+) strand; PAM type: YTN; PAM sequence: CTC
catgcctgtgggaagttcct

SEQ ID NO: 98383 - DNA, 20 bp, Artificial Sequence
  Description of Artificial Sequence: Synthetic oligonucleotide
  Target: SCN9A; (+) strand; PAM type: YTN; PAM sequence: CTG
tgggaagttcctctcatccc

SEQ ID NO: 98384 - DNA, 20 bp, Artificial Sequence
  Description of Artificial Sequence: Synthetic oligonucleotide
  Target: SCN9A; (+) strand; PAM type: YTN; PAM sequence: TTC
ctctcatcccttcatagtgt

SEQ ID NO: 98385 - DNA, 20 bp, Artificial Sequence
  Description of Artificial Sequence: Synthetic oligonucleotide
  Target: SCN9A; (+) strand; PAM type: YTN; PAM sequence: CTC
tcatcccttcatagtgtgaa

SEQ ID NO: 98386 - DNA, 20 bp, Artificial Sequence
  Description of Artificial Sequence: Synthetic oligonucleotide
  Target: SCN9A; (+) strand; PAM type: YTN; PAM sequence: CTC
atcccttcatagtgtgaagc

SEQ ID NO: 98387 - DNA, 20 bp, Artificial Sequence
  Description of Artificial Sequence: Synthetic oligonucleotide
  Target: SCN9A; (+) strand; PAM type: YTN; PAM sequence: CTT
catagtgtgaagcaggaagt

SEQ ID NO: 98388 - DNA, 20 bp, Artificial Sequence
  Description of Artificial Sequence: Synthetic oligonucleotide
  Target: SCN9A; (+) strand; PAM type: YTN; PAM sequence: TTC
atagtgtgaagcaggaagtt

SEQ ID NO: 98389 - DNA, 20 bp, Artificial Sequence
  Description of Artificial Sequence: Synthetic oligonucleotide
  Target: SCN9A; (+) strand; PAM type: YTN; PAM sequence: TTC
aaaaacgttcatttttgaag

SEQ ID NO: 98390 - DNA, 20 bp, Artificial Sequence
  Description of Artificial Sequence: Synthetic oligonucleotide
  Target: SCN9A; (+) strand; PAM type: YTN; PAM sequence: TTC
atttttgaagcaatatttga

SEQ ID NO: 98391 - DNA, 20 bp, Artificial Sequence
  Description of Artificial Sequence: Synthetic oligonucleotide
  Target: SCN9A; (+) strand; PAM type: YTN; PAM sequence: TTT
ttgaagcaatatttgaatgg

SEQ ID NO: 98392 - DNA, 20 bp, Artificial Sequence
  Description of Artificial Sequence: Synthetic oligonucleotide
  Target: SCN9A; (+) strand; PAM type: YTN; PAM sequence: TTT
tgaagcaatatttgaatggt

SEQ ID NO: 98393 - DNA, 20 bp, Artificial Sequence
  Description of Artificial Sequence: Synthetic oligonucleotide
  Target: SCN9A; (+) strand; PAM type: YTN; PAM sequence: TTT
gaagcaatatttgaatggtg

SEQ ID NO: 98394 - DNA, 20 bp, Artificial Sequence
  Description of Artificial Sequence: Synthetic oligonucleotide
  Target: SCN9A; (+) strand; PAM type: YTN; PAM sequence: TTG
aagcaatatttgaatggtgc

SEQ ID NO: 98395 - DNA, 20 bp, Artificial Sequence
  Description of Artificial Sequence: Synthetic oligonucleotide
  Target: SCN9A; (+) strand; PAM type: YTN; PAM sequence: TTT
gaatggtgcaagatgggagt

SEQ ID NO: 98396 - DNA, 20 bp, Artificial Sequence
  Description of Artificial Sequence: Synthetic oligonucleotide
  Target: SCN9A; (+) strand; PAM type: YTN; PAM sequence: TTG
aatggtgcaagatgggagtc

SEQ ID NO: 98397 - DNA, 20 bp, Artificial Sequence
  Description of Artificial Sequence: Synthetic oligonucleotide
  Target: SCN9A; (+) strand; PAM type: YTN; PAM sequence: TTA
taaattaataactcaaatgc

SEQ ID NO: 98398 - DNA, 20 bp, Artificial Sequence
  Description of Artificial Sequence: Synthetic oligonucleotide
  Target: SCN9A; (+) strand; PAM type: YTN; PAM sequence: TTA
ataactcaaatgcaacagaa

SEQ ID NO: 98399 - DNA, 20 bp, Artificial Sequence
  Description of Artificial Sequence: Synthetic oligonucleotide
  Target: SCN9A; (+) strand; PAM type: YTN; PAM sequence: CTC
aaatgcaacagaacccatgc

SEQ ID NO: 98400 - DNA, 20 bp, Artificial Sequence
  Description of Artificial Sequence: Synthetic oligonucleotide
  Target: SCN9A; (+) strand; PAM type: YTN; PAM sequence: CTT
cttattcatgtaggaacatg

SEQ ID NO: 98401 - DNA, 20 bp, Artificial Sequence
  Description of Artificial Sequence: Synthetic oligonucleotide
  Target: SCN9A; (+) strand; PAM type: YTN; PAM sequence: TTC
ttattcatgtaggaacatgt

SEQ ID NO: 98402 - DNA, 20 bp, Artificial Sequence
  Description of Artificial Sequence: Synthetic oligonucleotide
  Target: SCN9A; (+) strand; PAM type: YTN; PAM sequence: CTT
attcatgtaggaacatgttc

SEQ ID NO: 98403 - DNA, 20 bp, Artificial Sequence
  Description of Artificial Sequence: Synthetic oligonucleotide
  Target: SCN9A; (+) strand; PAM type: YTN; PAM sequence: TTA
ttcatgtaggaacatgttct

SEQ ID NO: 98404 - DNA, 20 bp, Artificial Sequence
  Description of Artificial Sequence: Synthetic oligonucleotide
  Target: SCN9A; (+) strand; PAM type: YTN; PAM sequence: TTC
atgtaggaacatgttctagg

SEQ ID NO: 98405 - DNA, 20 bp, Artificial Sequence
  Description of Artificial Sequence: Synthetic oligonucleotide
  Target: SCN9A; (+) strand; PAM type: YTN; PAM sequence: TTC
taggaaagaccaacactttt

SEQ ID NO: 98406 - DNA, 20 bp, Artificial Sequence
  Description of Artificial Sequence: Synthetic oligonucleotide
  Target: SCN9A; (+) strand; PAM type: YTN; PAM sequence: CTA
ggaaagaccaacactttttt

SEQ ID NO: 98407 - DNA, 20 bp, Artificial Sequence
  Description of Artificial Sequence: Synthetic oligonucleotide
  Target: SCN9A; (+) strand; PAM type: YTN; PAM sequence: CTT
tttttttttttttttttttt

SEQ ID NO: 98408 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttttttttt

SEQ ID NO: 98409 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttttttttt

SEQ ID NO: 98410 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttttttttt

SEQ ID NO: 98411 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttttttttt

SEQ ID NO: 98412 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttttttttg

SEQ ID NO: 98413 - DNA, 20 bp, Artificial Sequence
  Description of Artificial Sequence: Synthetic oligonucleotide
  Target: SCN9A; (+) strand; PAM type: YTN; PAM sequence: TTT
ttttttttttttttttttga

SEQ ID NO: 98414 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttttttgag

SEQ ID NO: 98415 - DNA, 20 bp, Artificial Sequence
  Description of Artificial Sequence: Synthetic oligonucleotide
  Target: SCN9A; (+) strand; PAM type: YTN; PAM sequence: TTT
ttttttttttttttttgaga

SEQ ID NO: 98416 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttttgagac

SEQ ID NO: 98417 - DNA, 20 bp, Artificial Sequence
  Description of Artificial Sequence: Synthetic oligonucleotide
  Target: SCN9A; (+) strand; PAM type: YTN; PAM sequence: TTT
ttttttttttttttgagaca

SEQ ID NO: 98418 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttgagacaa

SEQ ID NO: 98419 - DNA, 20 bp, Artificial Sequence
  Description of Artificial Sequence: Synthetic oligonucleotide
  Target: SCN9A; (+) strand; PAM type: YTN; PAM sequence: TTT
ttttttttttttgagacaag

SEQ ID NO: 98420 - DNA, 20 bp, Artificial Sequence
  Description of Artificial Sequence: Synthetic oligonucleotide
  Target: SCN9A; (+) strand; PAM type: YTN; PAM sequence: TTT
tttttttttttgagacaaga

SEQ ID NO: 98421 - DNA, 20 bp, Artificial Sequence
  Description of Artificial Sequence: Synthetic oligonucleotide
  Target: SCN9A; (+) strand; PAM type: YTN; PAM sequence: TTT
ttttttttttgagacaagag

SEQ ID NO: 98422 - DNA, 20 bp, Artificial Sequence
  Description of Artificial Sequence: Synthetic oligonucleotide
  Target: SCN9A; (+) strand; PAM type: YTN; PAM sequence: TTT
tttttttttgagacaagagt

SEQ ID NO: 98423 - DNA, 20 bp, Artificial Sequence
  Description of Artificial Sequence: Synthetic oligonucleotide
  Target: SCN9A; (+) strand; PAM type: YTN; PAM sequence: TTT
ttttttttgagacaagagtc

SEQ ID NO: 98424 - DNA, 20 bp, Artificial Sequence
  Description of Artificial Sequence: Synthetic oligonucleotide
  Target: SCN9A; (+) strand; PAM type: YTN; PAM sequence: TTT
tttttttgagacaagagtct

SEQ ID NO: 98425 - DNA, 20 bp, Artificial Sequence
  Description of Artificial Sequence: Synthetic oligonucleotide
  Target: SCN9A; (+) strand; PAM type: YTN; PAM sequence: TTT
ttttttgagacaagagtctc

SEQ ID NO: 98426 - DNA, 20 bp, Artificial Sequence
  Description of Artificial Sequence: Synthetic oligonucleotide
  Target: SCN9A; (+) strand; PAM type: YTN; PAM sequence: TTT
tttttgagacaagagtctcg

SEQ ID NO: 98427 - DNA, 20 bp, Artificial Sequence
  Description of Artificial Sequence: Synthetic oligonucleotide
  Target: SCN9A; (+) strand; PAM type: YTN; PAM sequence: TTT
ttttgagacaagagtctcgc

SEQ ID NO: 98428 - DNA, 20 bp, Artificial Sequence
  Description of Artificial Sequence: Synthetic oligonucleotide
  Target: SCN9A; (+) strand; PAM type: YTN; PAM sequence: TTT
tttgagacaagagtctcgct

SEQ ID NO: 98429 - DNA, 20 bp, Artificial Sequence
  Description of Artificial Sequence: Synthetic oligonucleotide
  Target: SCN9A; (+) strand; PAM type: YTN; PAM sequence: TTT
ttgagacaagagtctcgctc

SEQ ID NO: 98430 - DNA, 20 bp, Artificial Sequence
  Description of Artificial Sequence: Synthetic oligonucleotide
  Target: SCN9A; (+) strand; PAM type: YTN; PAM sequence: TTT
tgagacaagagtctcgctct

SEQ ID NO: 98431 - DNA, 20 bp, Artificial Sequence
  Description of Artificial Sequence: Synthetic oligonucleotide
  Target: SCN9A; (+) strand; PAM type: YTN; PAM sequence: TTT
gagacaagagtctcgctctg

SEQ ID NO: 98432 - DNA, 20 bp, Artificial Sequence
  Description of Artificial Sequence: Synthetic oligonucleotide
  Target: SCN9A; (+) strand; PAM type: YTN; PAM sequence: TTG
agacaagagtctcgctctgt

SEQ ID NO: 98433 - DNA, 20 bp, Artificial Sequence
  Description of Artificial Sequence: Synthetic oligonucleotide
  Target: SCN9A; (+) strand; PAM type: YTN; PAM sequence: CTC
gctctgtagcccaggctgga

SEQ ID NO: 98434 - DNA, 20 bp, Artificial Sequence
  Description of Artificial Sequence: Synthetic oligonucleotide
  Target: SCN9A; (+) strand; PAM type: YTN; PAM sequence: CTC
tgtagcccaggctggagtgc

SEQ ID NO: 98435 - DNA, 20 bp, Artificial Sequence
  Description of Artificial Sequence: Synthetic oligonucleotide
  Target: SCN9A; (+) strand; PAM type: YTN; PAM sequence: CTG
tagcccaggctggagtgcag

SEQ ID NO: 98436 - DNA, 20 bp, Artificial Sequence
  Description of Artificial Sequence: Synthetic oligonucleotide
  Target: SCN9A; (+) strand; PAM type: YTN; PAM sequence: CTG
gagtgcagtggcacgatctt

SEQ ID NO: 98437 - DNA, 20 bp, Artificial Sequence
  Description of Artificial Sequence: Synthetic oligonucleotide
  Target: SCN9A; (+) strand; PAM type: YTN; PAM sequence: CTT
ggcccactgcaacctccgcc

SEQ ID NO: 98438 - DNA, 20 bp, Artificial Sequence
  Description of Artificial Sequence: Synthetic oligonucleotide
  Target: SCN9A; (+) strand; PAM type: YTN; PAM sequence: TTG
gcccactgcaacctccgcct

SEQ ID NO: 98439 - DNA, 20 bp, Artificial Sequence
  Description of Artificial Sequence: Synthetic oligonucleotide
  Target: SCN9A; (+) strand; PAM type: YTN; PAM sequence: CTG
caacctccgcctcccaggtt

SEQ ID NO: 98440 - DNA, 20 bp, Artificial Sequence
  Description of Artificial Sequence: Synthetic oligonucleotide
  Target: SCN9A; (+) strand; PAM type: YTN; PAM sequence: CTC
cgcctcccaggttcacgtga

SEQ ID NO: 98441 - DNA, 20 bp, Artificial Sequence
  Description of Artificial Sequence: Synthetic oligonucleotide
  Target: SCN9A; (+) strand; PAM type: YTN; PAM sequence: CTC
ccaggttcacgtgattctcc

SEQ ID NO: 98442 - DNA, 20 bp, Artificial Sequence
  Description of Artificial Sequence: Synthetic oligonucleotide
  Target: SCN9A; (+) strand; PAM type: YTN; PAM sequence: TTC
acgtgattctcctgcctcag

SEQ ID NO: 98443 - DNA, 20 bp, Artificial Sequence
  Description of Artificial Sequence: Synthetic oligonucleotide
  Target: SCN9A; (+) strand; PAM type: YTN; PAM sequence: TTC
tcctgcctcagcctcccaag

SEQ ID NO: 98444 - DNA, 20 bp, Artificial Sequence
  Description of Artificial Sequence: Synthetic oligonucleotide
  Target: SCN9A; (+) strand; PAM type: YTN; PAM sequence: CTC
ctgcctcagcctcccaagca

SEQ ID NO: 98445 - DNA, 20 bp, Artificial Sequence
  Description of Artificial Sequence: Synthetic oligonucleotide
  Target: SCN9A; (+) strand; PAM type: YTN; PAM sequence: CTG
cctcagcctcccaagcagct

SEQ ID NO: 98446 - DNA, 20 bp, Artificial Sequence
  Description of Artificial Sequence: Synthetic oligonucleotide
  Target: SCN9A; (+) strand; PAM type: YTN; PAM sequence: CTC
agcctcccaagcagctagga

SEQ ID NO: 98447 - DNA, 20 bp, Artificial Sequence
  Description of Artificial Sequence: Synthetic oligonucleotide
  Target: SCN9A; (+) strand; PAM type: YTN; PAM sequence: CTC
ccaagcagctaggattacag

SEQ ID NO: 98448 - DNA, 20 bp, Artificial Sequence
  Description of Artificial Sequence: Synthetic oligonucleotide
  Target: SCN9A; (+) strand; PAM type: YTN; PAM sequence: CTA
ggattacaggcgcctgccac

SEQ ID NO: 98449 - DNA, 20 bp, Artificial Sequence
  Description of Artificial Sequence: Synthetic oligonucleotide
  Target: SCN9A; (+) strand; PAM type: YTN; PAM sequence: TTA
caggcgcctgccaccacacc

SEQ ID NO: 98450 - DNA, 20 bp, Artificial Sequence
  Description of Artificial Sequence: Synthetic oligonucleotide
  Target: SCN9A; (+) strand; PAM type: YTN; PAM sequence: CTG
ccaccacacccagctaattt

SEQ ID NO: 98451 - DNA, 20 bp, Artificial Sequence
  Description of Artificial Sequence: Synthetic oligonucleotide
  Target: SCN9A; (+) strand; PAM type: YTN; PAM sequence: CTA
atttttttgtatttttagta

SEQ ID NO: 98452 - DNA, 20 bp, Artificial Sequence
  Description of Artificial Sequence: Synthetic oligonucleotide
  Target: SCN9A; (+) strand; PAM type: YTN; PAM sequence: TTT
ttttgtatttttagtagaga

SEQ ID NO: 98453 - DNA, 20 bp, Artificial Sequence
  Description of Artificial Sequence: Synthetic oligonucleotide
  Target: SCN9A; (+) strand; PAM type: YTN; PAM sequence: TTT
tttgtatttttagtagagat

SEQ ID NO: 98454 - DNA, 20 bp, Artificial Sequence
  Description of Artificial Sequence: Synthetic oligonucleotide
  Target: SCN9A; (+) strand; PAM type: YTN; PAM sequence: TTT
ttgtatttttagtagagatg

SEQ ID NO: 98455 - DNA, 20 bp, Artificial Sequence
  Description of Artificial Sequence: Synthetic oligonucleotide
  Target: SCN9A; (+) strand; PAM type: YTN; PAM sequence: TTT
tgtatttttagtagagatgg

SEQ ID NO: 98456 - DNA, 20 bp, Artificial Sequence
  Description of Artificial Sequence: Synthetic oligonucleotide
  Target: SCN9A; (+) strand; PAM type: YTN; PAM sequence: TTT
gtatttttagtagagatggg

SEQ ID NO: 98457 - DNA, 20 bp, Artificial Sequence
  Description of Artificial Sequence: Synthetic oligonucleotide
  Target: SCN9A; (+) strand; PAM type: YTN; PAM sequence: TTG
tatttttagtagagatgggg

SEQ ID NO: 98458 - DNA, 20 bp, Artificial Sequence
  Description of Artificial Sequence: Synthetic oligonucleotide
  Target: SCN9A; (+) strand; PAM type: YTN; PAM sequence: TTT
ttagtagagatggggtttca

SEQ ID NO: 98459 - DNA, 20 bp, Artificial Sequence
  Description of Artificial Sequence: Synthetic oligonucleotide
  Target: SCN9A; (+) strand; PAM type: YTN; PAM sequence: TTT
tagtagagatggggtttcac

SEQ ID NO: 98460 - DNA, 20 bp, Artificial Sequence
  Description of Artificial Sequence: Synthetic oligonucleotide
  Target: SCN9A; (+) strand; PAM type: YTN; PAM sequence: TTT
agtagagatggggtttcact

SEQ ID NO: 98461 - DNA, 20 bp, Artificial Sequence
  Description of Artificial Sequence: Synthetic oligonucleotide
  Target: SCN9A; (+) strand; PAM type: YTN; PAM sequence: TTA
gtagagatggggtttcacta

SEQ ID NO: 98462 - DNA, 20 bp, Artificial Sequence
  Description of Artificial Sequence: Synthetic oligonucleotide
  Target: SCN9A; (+) strand; PAM type: YTN; PAM sequence: TTT
cactatgttggccagactgg

SEQ ID NO: 98463 - DNA, 20 bp, Artificial Sequence
  Description of Artificial Sequence: Synthetic oligonucleotide
  Target: SCN9A; (+) strand; PAM type: YTN; PAM sequence: TTC
actatgttggccagactggt

SEQ ID NO: 98464 - DNA, 20 bp, Artificial Sequence
  Description of Artificial Sequence: Synthetic oligonucleotide
  Target: SCN9A; (+) strand; PAM type: YTN; PAM sequence: CTA
tgttggccagactggtctcg

SEQ ID NO: 98465 - DNA, 20 bp, Artificial Sequence
  Description of Artificial Sequence: Synthetic oligonucleotide
  Target: SCN9A; (+) strand; PAM type: YTN; PAM sequence: TTG
gccagactggtctcgaactc

SEQ ID NO: 98466 - DNA, 20 bp, Artificial Sequence
  Description of Artificial Sequence: Synthetic oligonucleotide
  Target: SCN9A; (+) strand; PAM type: YTN; PAM sequence: CTG
gtctcgaactcctgacctca

SEQ ID NO: 98467 - DNA, 20 bp, Artificial Sequence
  Description of Artificial Sequence: Synthetic oligonucleotide
  Target: SCN9A; (+) strand; PAM type: YTN; PAM sequence: CTC
gaactcctgacctcatgatc

SEQ ID NO: 98468 - DNA, 20 bp, Artificial Sequence
  Description of Artificial Sequence: Synthetic oligonucleotide
  Target: SCN9A; (+) strand; PAM type: YTN; PAM sequence: CTC
ctgacctcatgatctgccca

SEQ ID NO: 98469 - DNA, 20 bp, Artificial Sequence
  Description of Artificial Sequence: Synthetic oligonucleotide
  Target: SCN9A; (+) strand; PAM type: YTN; PAM sequence: CTG
acctcatgatctgcccacct

SEQ ID NO: 98470 - DNA, 20 bp, Artificial Sequence
  Description of Artificial Sequence: Synthetic oligonucleotide
  Target: SCN9A; (+) strand; PAM type: YTN; PAM sequence: CTC
atgatctgcccaccttggcc

SEQ ID NO: 98471 - DNA, 20 bp, Artificial Sequence
  Description of Artificial Sequence: Synthetic oligonucleotide
  Target: SCN9A; (+) strand; PAM type: YTN; PAM sequence: CTG
cccaccttggcctcccaaag

SEQ ID NO: 98472 - DNA, 20 bp, Artificial Sequence
  Description of Artificial Sequence: Synthetic oligonucleotide
  Target: SCN9A; (+) strand; PAM type: YTN; PAM sequence: CTT
ggcctcccaaagtgaagaga

SEQ ID NO: 98473 - DNA, 20 bp, Artificial Sequence
  Description of Artificial Sequence: Synthetic oligonucleotide
  Target: SCN9A; (+) strand; PAM type: YTN; PAM sequence: TTG
gcctcccaaagtgaagagac

SEQ ID NO: 98474 - DNA, 20 bp, Artificial Sequence
  Description of Artificial Sequence: Synthetic oligonucleotide
  Target: SCN9A; (+) strand; PAM type: YTN; PAM sequence: CTC
ccaaagtgaagagactacag

SEQ ID NO: 98475 - DNA, 20 bp, Artificial Sequence
  Description of Artificial Sequence: Synthetic oligonucleotide
  Target: SCN9A; (+) strand; PAM type: YTN; PAM sequence: CTA
caggcatgagccactgcgcc

SEQ ID NO: 98476 - DNA, 20 bp, Artificial Sequence
  Description of Artificial Sequence: Synthetic oligonucleotide
  Target: SCN9A; (+) strand; PAM type: YTN; PAM sequence: CTG
cgcccggccaagactggcac

SEQ ID NO: 98477 - DNA, 20 bp, Artificial Sequence
  Description of Artificial Sequence: Synthetic oligonucleotide
  Target: SCN9A; (+) strand; PAM type: YTN; PAM sequence: CTG
gcactgttttaaaaaccaca

SEQ ID NO: 98478 - DNA, 20 bp, Artificial Sequence
  Description of Artificial Sequence: Synthetic oligonucleotide
  Target: SCN9A; (+) strand; PAM type: YTN; PAM sequence: CTG
ttttaaaaaccacacagtat

SEQ ID NO: 98479 - DNA, 20 bp, Artificial Sequence
  Description of Artificial Sequence: Synthetic oligonucleotide
  Target: SCN9A; (+) strand; PAM type: YTN; PAM sequence: TTT
taaaaaccacacagtatttt

SEQ ID NO: 98480 - DNA, 20 bp, Artificial Sequence
  Description of Artificial Sequence: Synthetic oligonucleotide
  Target: SCN9A; (+) strand; PAM type: YTN; PAM sequence: TTT
aaaaaccacacagtatttta

SEQ ID NO: 98481 - DNA, 20 bp, Artificial Sequence
  Description of Artificial Sequence: Synthetic oligonucleotide
  Target: SCN9A; (+) strand; PAM type: YTN; PAM sequence: TTA
aaaaccacacagtattttat

SEQ ID NO: 98482 - DNA, 20 bp, Artificial Sequence
  Description of Artificial Sequence: Synthetic oligonucleotide
  Target: SCN9A; (+) strand; PAM type: YTN; PAM sequence: TTT
tatcttcaatttataattaa

SEQ ID NO: 98483 - DNA, 20 bp, Artificial Sequence
  Description of Artificial Sequence: Synthetic oligonucleotide
  Target: SCN9A; (+) strand; PAM type: YTN; PAM sequence: TTT
atcttcaatttataattaat

SEQ ID NO: 98484 - DNA, 20 bp, Artificial Sequence
  Description of Artificial Sequence: Synthetic oligonucleotide
  Target: SCN9A; (+) strand; PAM type: YTN; PAM sequence: TTA
tcttcaatttataattaata

SEQ ID NO: 98485 - DNA, 20 bp, Artificial Sequence
  Description of Artificial Sequence: Synthetic oligonucleotide
  Target: SCN9A; (+) strand; PAM type: YTN; PAM sequence: CTT
caatttataattaatatact

SEQ ID NO: 98486 - DNA, 20 bp, Artificial Sequence
  Description of Artificial Sequence: Synthetic oligonucleotide
  Target: SCN9A; (+) strand; PAM type: YTN; PAM sequence: TTC
aatttataattaatatacta

SEQ ID NO: 98487 - DNA, 20 bp, Artificial Sequence
  Description of Artificial Sequence: Synthetic oligonucleotide
  Target: SCN9A; (+) strand; PAM type: YTN; PAM sequence: TTT
ataattaatatactatttaa

SEQ ID NO: 98488 - DNA, 20 bp, Artificial Sequence
  Description of Artificial Sequence: Synthetic oligonucleotide
  Target: SCN9A; (+) strand; PAM type: YTN; PAM sequence: TTA
taattaatatactatttaaa

SEQ ID NO: 98489 - DNA, 20 bp, Artificial Sequence
  Description of Artificial Sequence: Synthetic oligonucleotide
  Target: SCN9A; (+) strand; PAM type: YTN; PAM sequence: TTA
atatactatttaaagaataa

SEQ ID NO: 98490 - DNA, 20 bp, Artificial Sequence
  Description of Artificial Sequence: Synthetic oligonucleotide
  Target: SCN9A; (+) strand; PAM type: YTN; PAM sequence: CTA
tttaaagaataacttatatc

SEQ ID NO: 98491 - DNA, 20 bp, Artificial Sequence
  Description of Artificial Sequence: Synthetic oligonucleotide
  Target: SCN9A; (+) strand; PAM type: YTN; PAM sequence: TTT
aaagaataacttatatcctt

SEQ ID NO: 98492 - DNA, 20 bp, Artificial Sequence
  Description of Artificial Sequence: Synthetic oligonucleotide
  Target: SCN9A; (+) strand; PAM type: YTN; PAM sequence: TTA
aagaataacttatatccttc

SEQ ID NO: 98493 - DNA, 20 bp, Artificial Sequence
  Description of Artificial Sequence: Synthetic oligonucleotide
  Target: SCN9A; (+) strand; PAM type: YTN; PAM sequence: CTT
atatccttcgtccaatatct

SEQ ID NO: 98494 - DNA, 20 bp, Artificial Sequence
  Description of Artificial Sequence: Synthetic oligonucleotide
  Target: SCN9A; (+) strand; PAM type: YTN; PAM sequence: TTA
tatccttcgtccaatatcta

SEQ ID NO: 98495 - DNA, 20 bp, Artificial Sequence
  Description of Artificial Sequence: Synthetic oligonucleotide
  Target: SCN9A; (+) strand; PAM type: YTN; PAM sequence: CTT
cgtccaatatctattaaaat

SEQ ID NO: 98496 - DNA, 20 bp, Artificial Sequence
  Description of Artificial Sequence: Synthetic oligonucleotide
  Target: SCN9A; (+) strand; PAM type: YTN; PAM sequence: TTC
gtccaatatctattaaaata

SEQ ID NO: 98497 - DNA, 20 bp, Artificial Sequence
  Description of Artificial Sequence: Synthetic oligonucleotide
  Target: SCN9A; (+) strand; PAM type: YTN; PAM sequence: CTA
ttaaaataccaagcactcat

SEQ ID NO: 98498 - DNA, 20 bp, Artificial Sequence
  Description of Artificial Sequence: Synthetic oligonucleotide
  Target: SCN9A; (+) strand; PAM type: YTN; PAM sequence: TTA
aaataccaagcactcatgaa

SEQ ID NO: 98499 - DNA, 20 bp, Artificial Sequence
  Description of Artificial Sequence: Synthetic oligonucleotide
  Target: SCN9A; (+) strand; PAM type: YTN; PAM sequence: CTC
atgaaatgggacacttacaa

SEQ ID NO: 98500 - DNA, 20 bp, Artificial Sequence
  Description of Artificial Sequence: Synthetic oligonucleotide
  Target: SCN9A; (+) strand; PAM type: YTN; PAM sequence: CTT
acaacttgaagcagagatag

SEQ ID NO: 98501 - DNA, 20 bp, Artificial Sequence
  Description of Artificial Sequence: Synthetic oligonucleotide
  Target: SCN9A; (+) strand; PAM type: YTN; PAM sequence: TTA
caacttgaagcagagatagg

SEQ ID NO: 98502 - DNA, 20 bp, Artificial Sequence
  Description of Artificial Sequence: Synthetic oligonucleotide
  Target: SCN9A; (+) strand; PAM type: YTN; PAM sequence: CTT
gaagcagagataggtaacca

SEQ ID NO: 98503 - DNA, 20 bp, Artificial Sequence
  Description of Artificial Sequence: Synthetic oligonucleotide
  Target: SCN9A; (+) strand; PAM type: YTN; PAM sequence: TTG
aagcagagataggtaaccaa

SEQ ID NO: 98504 - DNA, 20 bp, Artificial Sequence
  Description of Artificial Sequence: Synthetic oligonucleotide
  Target: SCN9A; (+) strand; PAM type: YTN; PAM sequence: TTA
tcaaagttcactttcaggtt

SEQ ID NO: 98505 - DNA, 20 bp, Artificial Sequence
  Description of Artificial Sequence: Synthetic oligonucleotide
  Target: SCN9A; (+) strand; PAM type: YTN; PAM sequence: TTC
actttcaggtttttccatcg

SEQ ID NO: 98506 - DNA, 20 bp, Artificial Sequence
  Description of Artificial Sequence: Synthetic oligonucleotide
  Target: SCN9A; (+) strand; PAM type: YTN; PAM sequence: CTT
tcaggtttttccatcgcaca

SEQ ID NO: 98507 - DNA, 20 bp, Artificial Sequence
  Description of Artificial Sequence: Synthetic oligonucleotide
  Target: SCN9A; (+) strand; PAM type: YTN; PAM sequence: TTT
caggtttttccatcgcacat

SEQ ID NO: 98508 - DNA, 20 bp, Artificial Sequence
  Description of Artificial Sequence: Synthetic oligonucleotide
  Target: SCN9A; (+) strand; PAM type: YTN; PAM sequence: TTC
aggtttttccatcgcacatt

SEQ ID NO: 98509 - DNA, 20 bp, Artificial Sequence
  Description of Artificial Sequence: Synthetic oligonucleotide
  Target: SCN9A; (+) strand; PAM type: YTN; PAM sequence: TTT
ttccatcgcacattttgact

SEQ ID NO: 98510 - DNA, 20 bp, Artificial Sequence
  Description of Artificial Sequence: Synthetic oligonucleotide
  Target: SCN9A; (+) strand; PAM type: YTN; PAM sequence: TTT
tccatcgcacattttgacta

SEQ ID NO: 98511 - DNA, 20 bp, Artificial Sequence
  Description of Artificial Sequence: Synthetic oligonucleotide
  Target: SCN9A; (+) strand; PAM type: YTN; PAM sequence: TTT
ccatcgcacattttgactaa

SEQ ID NO: 98512 - DNA, 20 bp, Artificial Sequence
  Description of Artificial Sequence: Synthetic oligonucleotide
  Target: SCN9A; (+) strand; PAM type: YTN; PAM sequence: TTC
catcgcacattttgactaac

SEQ ID NO: 98513 - DNA, 20 bp, Artificial Sequence
  Description of Artificial Sequence: Synthetic oligonucleotide
  Target: SCN9A; (+) strand; PAM type: YTN; PAM sequence: TTT
tgactaacattcataagggc

SEQ ID NO: 98514 - DNA, 20 bp, Artificial Sequence
  Description of Artificial Sequence: Synthetic oligonucleotide
  Target: SCN9A; (+) strand; PAM type: YTN; PAM sequence: TTT
gactaacattcataagggca

SEQ ID NO: 98515 - DNA, 20 bp, Artificial Sequence
  Description of Artificial Sequence: Synthetic oligonucleotide
  Target: SCN9A; (+) strand; PAM type: YTN; PAM sequence: TTG
actaacattcataagggcaa

SEQ ID NO: 98516 - DNA, 20 bp, Artificial Sequence
  Description of Artificial Sequence: Synthetic oligonucleotide
  Target: SCN9A; (+) strand; PAM type: YTN; PAM sequence: CTA
acattcataagggcaaaaca

SEQ ID NO: 98517 - DNA, 20 bp, Artificial Sequence
  Description of Artificial Sequence: Synthetic oligonucleotide
  Target: SCN9A; (+) strand; PAM type: YTN; PAM sequence: TTC
ataagggcaaaacattcgga

SEQ ID NO: 98518 - DNA, 20 bp, Artificial Sequence
  Description of Artificial Sequence: Synthetic oligonucleotide
  Target: SCN9A; (+) strand; PAM type: YTN; PAM sequence: TTC
ggaacgatttggaacttgac

SEQ ID NO: 98519 - DNA, 20 bp, Artificial Sequence
  Description of Artificial Sequence: Synthetic oligonucleotide
  Target: SCN9A; (+) strand; PAM type: YTN; PAM sequence: TTT
ggaacttgacttgcaggaaa

SEQ ID NO: 98520 - DNA, 20 bp, Artificial Sequence
  Description of Artificial Sequence: Synthetic oligonucleotide
  Target: SCN9A; (+) strand; PAM type: YTN; PAM sequence: TTG
gaacttgacttgcaggaaac

SEQ ID NO: 98521 - DNA, 20 bp, Artificial Sequence
  Description of Artificial Sequence: Synthetic oligonucleotide
  Target: SCN9A; (+) strand; PAM type: YTN; PAM sequence: CTT
gacttgcaggaaaccgtgac

SEQ ID NO: 98522 - DNA, 20 bp, Artificial Sequence
  Description of Artificial Sequence: Synthetic oligonucleotide
  Target: SCN9A; (+) strand; PAM type: YTN; PAM sequence: TTG
acttgcaggaaaccgtgacc

SEQ ID NO: 98523 - DNA, 20 bp, Artificial Sequence
  Description of Artificial Sequence: Synthetic oligonucleotide
  Target: SCN9A; (+) strand; PAM type: YTN; PAM sequence: CTT
gcaggaaaccgtgacccatc

SEQ ID NO: 98524 - DNA, 20 bp, Artificial Sequence
  Description of Artificial Sequence: Synthetic oligonucleotide
  Target: SCN9A; (+) strand; PAM type: YTN; PAM sequence: TTG
caggaaaccgtgacccatct

SEQ ID NO: 98525 - DNA, 20 bp, Artificial Sequence
  Description of Artificial Sequence: Synthetic oligonucleotide
  Target: SCN9A; (+) strand; PAM type: YTN; PAM sequence: CTG
tggtgttaatacactcatag

SEQ ID NO: 98526 - DNA, 20 bp, Artificial Sequence
  Description of Artificial Sequence: Synthetic oligonucleotide
  Target: SCN9A; (+) strand; PAM type: YTN; PAM sequence: TTA
atacactcatagaacttgcc

SEQ ID NO: 98527 - DNA, 20 bp, Artificial Sequence
  Description of Artificial Sequence: Synthetic oligonucleotide
  Target: SCN9A; (+) strand; PAM type: YTN; PAM sequence: CTC
atagaacttgccagcaaaca

SEQ ID NO: 98528 - DNA, 20 bp, Artificial Sequence
  Description of Artificial Sequence: Synthetic oligonucleotide
  Target: SCN9A; (+) strand; PAM type: YTN; PAM sequence: CTT
gccagcaaacaaatttactc

SEQ ID NO: 98529 - DNA, 20 bp, Artificial Sequence
  Description of Artificial Sequence: Synthetic oligonucleotide
  Target: SCN9A; (+) strand; PAM type: YTN; PAM sequence: TTG
ccagcaaacaaatttactcc

SEQ ID NO: 98530 - DNA, 20 bp, Artificial Sequence
  Description of Artificial Sequence: Synthetic oligonucleotide
  Target: SCN9A; (+) strand; PAM type: YTN; PAM sequence: TTT
actcccatgatgctgaatat

SEQ ID NO: 98531 - DNA, 20 bp, Artificial Sequence
  Description of Artificial Sequence: Synthetic oligonucleotide
  Target: SCN9A; (+) strand; PAM type: YTN; PAM sequence: TTA
ctcccatgatgctgaatatc

SEQ ID NO: 98532 - DNA, 20 bp, Artificial Sequence
  Description of Artificial Sequence: Synthetic oligonucleotide
  Target: SCN9A; (+) strand; PAM type: YTN; PAM sequence: CTC
ccatgatgctgaatatcagc

SEQ ID NO: 98533 - DNA, 20 bp, Artificial Sequence
  Description of Artificial Sequence: Synthetic oligonucleotide
  Target: SCN9A; (+) strand; PAM type: YTN; PAM sequence: CTG
aatatcagccagaatataag

SEQ ID NO: 98534 - DNA, 20 bp, Artificial Sequence
  Description of Artificial Sequence: Synthetic oligonucleotide
  Target: SCN9A; (+) strand; PAM type: YTN; PAM sequence: TTC
atgatggaaggaattgctcc

SEQ ID NO: 98535 - DNA, 20 bp, Artificial Sequence
  Description of Artificial Sequence: Synthetic oligonucleotide
  Target: SCN9A; (+) strand; PAM type: YTN; PAM sequence: TTG
ctcctatgagtgcattcaca

SEQ ID NO: 98536 - DNA, 20 bp, Artificial Sequence
  Description of Artificial Sequence: Synthetic oligonucleotide
  Target: SCN9A; (+) strand; PAM type: YTN; PAM sequence: CTC
ctatgagtgcattcacaacg

SEQ ID NO: 98537 - DNA, 20 bp, Artificial Sequence
  Description of Artificial Sequence: Synthetic oligonucleotide
  Target: SCN9A; (+) strand; PAM type: YTN; PAM sequence: CTA
tgagtgcattcacaacgacc

SEQ ID NO: 98538 - DNA, 20 bp, Artificial Sequence
  Description of Artificial Sequence: Synthetic oligonucleotide
  Target: SCN9A; (+) strand; PAM type: YTN; PAM sequence: TTC
acaacgacctagtattcaaa

SEQ ID NO: 98539 - DNA, 20 bp, Artificial Sequence
  Description of Artificial Sequence: Synthetic oligonucleotide
  Target: SCN9A; (+) strand; PAM type: YTN; PAM sequence: CTA
gtattcaaaagaaagaaaag

SEQ ID NO: 98540 - DNA, 20 bp, Artificial Sequence
  Description of Artificial Sequence: Synthetic oligonucleotide
  Target: SCN9A; (+) strand; PAM type: YTN; PAM sequence: TTC
aaaagaaagaaaagcatgat

SEQ ID NO: 98541 - DNA, 20 bp, Artificial Sequence
  Description of Artificial Sequence: Synthetic oligonucleotide
  Target: SCN9A; (+) strand; PAM type: YTN; PAM sequence: TTA
ggattagtaagatgttaaat

SEQ ID NO: 98542 - DNA, 20 bp, Artificial Sequence
  Description of Artificial Sequence: Synthetic oligonucleotide
  Target: SCN9A; (+) strand; PAM type: YTN; PAM sequence: TTA
gtaagatgttaaataggcaa

SEQ ID NO: 98543 - DNA, 20 bp, Artificial Sequence
  Description of Artificial Sequence: Synthetic oligonucleotide
  Target: SCN9A; (+) strand; PAM type: YTN; PAM sequence: TTA
aataggcaacatgaaagaaa

SEQ ID NO: 98544 - DNA, 20 bp, Artificial Sequence
  Description of Artificial Sequence: Synthetic oligonucleotide
  Target: SCN9A; (+) strand; PAM type: YTN; PAM sequence: TTA
gaaaagccgcccttaaatat

SEQ ID NO: 98545 - DNA, 20 bp, Artificial Sequence
  Description of Artificial Sequence: Synthetic oligonucleotide
  Target: SCN9A; (+) strand; PAM type: YTN; PAM sequence: CTT
aaatatctaagacatcaaac

SEQ ID NO: 98546 - DNA, 20 bp, Artificial Sequence
  Description of Artificial Sequence: Synthetic oligonucleotide
  Target: SCN9A; (+) strand; PAM type: YTN; PAM sequence: TTA
aatatctaagacatcaaacc

SEQ ID NO: 98547 - DNA, 20 bp, Artificial Sequence
  Description of Artificial Sequence: Synthetic oligonucleotide
  Target: SCN9A; (+) strand; PAM type: YTN; PAM sequence: CTA
agacatcaaaccaaccagcc

SEQ ID NO: 98548 - DNA, 20 bp, Artificial Sequence
  Description of Artificial Sequence: Synthetic oligonucleotide
  Target: SCN9A; (+) strand; PAM type: YTN; PAM sequence: CTC
atgtttattaaatgcctact

SEQ ID NO: 98549 - DNA, 20 bp, Artificial Sequence
  Description of Artificial Sequence: Synthetic oligonucleotide
  Target: SCN9A; (+) strand; PAM type: YTN; PAM sequence: TTT
attaaatgcctactctacac

SEQ ID NO: 98550 - DNA, 20 bp, Artificial Sequence
  Description of Artificial Sequence: Synthetic oligonucleotide
  Target: SCN9A; (+) strand; PAM type: YTN; PAM sequence: TTA
ttaaatgcctactctacact

SEQ ID NO: 98551 - DNA, 20 bp, Artificial Sequence
  Description of Artificial Sequence: Synthetic oligonucleotide
  Target: SCN9A; (+) strand; PAM type: YTN; PAM sequence: TTA
aatgcctactctacactcag

SEQ ID NO: 98552 - DNA, 20 bp, Artificial Sequence
  Description of Artificial Sequence: Synthetic oligonucleotide
  Target: SCN9A; (+) strand; PAM type: YTN; PAM sequence: CTA
ctctacactcagcagtgtgc

SEQ ID NO: 98553 - DNA, 20 bp, Artificial Sequence
  Description of Artificial Sequence: Synthetic oligonucleotide
  Target: SCN9A; (+) strand; PAM type: YTN; PAM sequence: CTC
tacactcagcagtgtgccaa

SEQ ID NO: 98554 - DNA, 20 bp, Artificial Sequence
  Description of Artificial Sequence: Synthetic oligonucleotide
  Target: SCN9A; (+) strand; PAM type: YTN; PAM sequence: CTA
cactcagcagtgtgccaagc

SEQ ID NO: 98555 - DNA, 20 bp, Artificial Sequence
  Description of Artificial Sequence: Synthetic oligonucleotide
  Target: SCN9A; (+) strand; PAM type: YTN; PAM sequence: CTC
agcagtgtgccaagcaagac

SEQ ID NO: 98556 - DNA, 20 bp, Artificial Sequence
  Description of Artificial Sequence: Synthetic oligonucleotide
  Target: SCN9A; (+) strand; PAM type: YTN; PAM sequence: CTC
tgtgatcaccaggcttacaa

SEQ ID NO: 98557 - DNA, 20 bp, Artificial Sequence
  Description of Artificial Sequence: Synthetic oligonucleotide
  Target: SCN9A; (+) strand; PAM type: YTN; PAM sequence: CTG
tgatcaccaggcttacaaat

SEQ ID NO: 98558 - DNA, 20 bp, Artificial Sequence
  Description of Artificial Sequence: Synthetic oligonucleotide
  Target: SCN9A; (+) strand; PAM type: YTN; PAM sequence: CTT
acaaattacatgattatcac

SEQ ID NO: 98559 - DNA, 20 bp, Artificial Sequence
  Description of Artificial Sequence: Synthetic oligonucleotide
  Target: SCN9A; (+) strand; PAM type: YTN; PAM sequence: TTA
caaattacatgattatcaca

SEQ ID NO: 98560 - DNA, 20 bp, Artificial Sequence
  Description of Artificial Sequence: Synthetic oligonucleotide
  Target: SCN9A; (+) strand; PAM type: YTN; PAM sequence: TTA
catgattatcacacaataaa

SEQ ID NO: 98561 - DNA, 20 bp, Artificial Sequence
  Description of Artificial Sequence: Synthetic oligonucleotide
  Target: SCN9A; (+) strand; PAM type: YTN; PAM sequence: TTA
tcacacaataaaattgttag

SEQ ID NO: 98562 - DNA, 20 bp, Artificial Sequence
  Description of Artificial Sequence: Synthetic oligonucleotide
  Target: SCN9A; (+) strand; PAM type: YTN; PAM sequence: TTG
ttagcaaaatataagacaaa

SEQ ID NO: 98563 - DNA, 20 bp, Artificial Sequence
  Description of Artificial Sequence: Synthetic oligonucleotide
  Target: SCN9A; (+) strand; PAM type: YTN; PAM sequence: TTA
gcaaaatataagacaaaata

SEQ ID NO: 98564 - DNA, 20 bp, Artificial Sequence
  Description of Artificial Sequence: Synthetic oligonucleotide
  Target: SCN9A; (+) strand; PAM type: YTN; PAM sequence: CTA
agataatataatagcttaaa

SEQ ID NO: 98565 - DNA, 20 bp, Artificial Sequence
  Description of Artificial Sequence: Synthetic oligonucleotide
  Target: SCN9A; (+) strand; PAM type: YTN; PAM sequence: CTT
aaataaatgtaaaataaata

SEQ ID NO: 98566 - DNA, 20 bp, Artificial Sequence
  Description of Artificial Sequence: Synthetic oligonucleotide
  Target: SCN9A; (+) strand; PAM type: YTN; PAM sequence: TTA
aataaatgtaaaataaataa

SEQ ID NO: 98567 - DNA, 20 bp, Artificial Sequence
  Description of Artificial Sequence: Synthetic oligonucleotide
  Target: SCN9A; (+) strand; PAM type: YTN; PAM sequence: CTG
ttattgataaggtaaacttg

SEQ ID NO: 98568 - DNA, 20 bp, Artificial Sequence
  Description of Artificial Sequence: Synthetic oligonucleotide
  Target: SCN9A; (+) strand; PAM type: YTN; PAM sequence: TTA
ttgataaggtaaacttgtaa

SEQ ID NO: 98569 - DNA, 20 bp, Artificial Sequence
  Description of Artificial Sequence: Synthetic oligonucleotide
  Target: SCN9A; (+) strand; PAM type: YTN; PAM sequence: TTG
ataaggtaaacttgtaaaat

SEQ ID NO: 98570 - DNA, 20 bp, Artificial Sequence
  Description of Artificial Sequence: Synthetic oligonucleotide
  Target: SCN9A; (+) strand; PAM type: YTN; PAM sequence: CTT
gtaaaatctgtacactctgg

SEQ ID NO: 98571 - DNA, 20 bp, Artificial Sequence
  Description of Artificial Sequence: Synthetic oligonucleotide
  Target: SCN9A; (+) strand; PAM type: YTN; PAM sequence: TTG
taaaatctgtacactctgga

SEQ ID NO: 98572 - DNA, 20 bp, Artificial Sequence
  Description of Artificial Sequence: Synthetic oligonucleotide
  Target: SCN9A; (+) strand; PAM type: YTN; PAM sequence: CTG
tacactctggaaaaaaaaga

SEQ ID NO: 98573 - DNA, 20 bp, Artificial Sequence
  Description of Artificial Sequence: Synthetic oligonucleotide
  Target: SCN9A; (+) strand; PAM type: YTN; PAM sequence: CTC
tggaaaaaaaagaaatgtat

SEQ ID NO: 98574 - DNA, 20 bp, Artificial Sequence
  Description of Artificial Sequence: Synthetic oligonucleotide
  Target: SCN9A; (+) strand; PAM type: YTN; PAM sequence: CTG
gaaaaaaaagaaatgtataa

SEQ ID NO: 98575 - DNA, 20 bp, Artificial Sequence
  Description of Artificial Sequence: Synthetic oligonucleotide
  Target: SCN9A; (+) strand; PAM type: YTN; PAM sequence: TTT
atatacatttaaatgttcat

SEQ ID NO: 98576 - DNA, 20 bp, Artificial Sequence
  Description of Artificial Sequence: Synthetic oligonucleotide
  Target: SCN9A; (+) strand; PAM type: YTN; PAM sequence: TTA
tatacatttaaatgttcatg

SEQ ID NO: 98577 - DNA, 20 bp, Artificial Sequence
  Description of Artificial Sequence: Synthetic oligonucleotide
  Target: SCN9A; (+) strand; PAM type: YTN; PAM sequence: TTT
aaatgttcatgatcctatta

SEQ ID NO: 98578 - DNA, 20 bp, Artificial Sequence
  Description of Artificial Sequence: Synthetic oligonucleotide
  Target: SCN9A; (+) strand; PAM type: YTN; PAM sequence: TTA
aatgttcatgatcctattat

SEQ ID NO: 98579 - DNA, 20 bp, Artificial Sequence
  Description of Artificial Sequence: Synthetic oligonucleotide
  Target: SCN9A; (+) strand; PAM type: YTN; PAM sequence: TTC
atgatcctattattaccagc

SEQ ID NO: 98580 - DNA, 20 bp, Artificial Sequence
  Description of Artificial Sequence: Synthetic oligonucleotide
  Target: SCN9A; (+) strand; PAM type: YTN; PAM sequence: CTA
ttattaccagcattaaagat

SEQ ID NO: 98581 - DNA, 20 bp, Artificial Sequence
  Description of Artificial Sequence: Synthetic oligonucleotide
  Target: SCN9A; (+) strand; PAM type: YTN; PAM sequence: TTA
ttaccagcattaaagattcc

SEQ ID NO: 98582 - DNA, 20 bp, Artificial Sequence
  Description of Artificial Sequence: Synthetic oligonucleotide
  Target: SCN9A; (+) strand; PAM type: YTN; PAM sequence: TTA
ccagcattaaagattccccc

SEQ ID NO: 98583 - DNA, 20 bp, Artificial Sequence
  Description of Artificial Sequence: Synthetic oligonucleotide
  Target: SCN9A; (+) strand; PAM type: YTN; PAM sequence: TTA
aagattcccccatagagaaa

SEQ ID NO: 98584 - DNA, 20 bp, Artificial Sequence
  Description of Artificial Sequence: Synthetic oligonucleotide
  Target: SCN9A; (+) strand; PAM type: YTN; PAM sequence: TTC
ccccatagagaaactattgg

SEQ ID NO: 98585 - DNA, 20 bp, Artificial Sequence
  Description of Artificial Sequence: Synthetic oligonucleotide
  Target: SCN9A; (+) strand; PAM type: YTN; PAM sequence: CTA
ttggtgtatatcaggtaggt

SEQ ID NO: 98586 - DNA, 20 bp, Artificial Sequence
  Description of Artificial Sequence: Synthetic oligonucleotide
  Target: SCN9A; (+) strand; PAM type: YTN; PAM sequence: TTG
gtgtatatcaggtaggtgga

SEQ ID NO: 98587 - DNA, 20 bp, Artificial Sequence
  Description of Artificial Sequence: Synthetic oligonucleotide
  Target: SCN9A; (+) strand; PAM type: YTN; PAM sequence: TTA
tgactggacatcattttaat

SEQ ID NO: 98588 - DNA, 20 bp, Artificial Sequence
  Description of Artificial Sequence: Synthetic oligonucleotide
  Target: SCN9A; (+) strand; PAM type: YTN; PAM sequence: CTG
gacatcattttaatttaatt

SEQ ID NO: 98589 - DNA, 20 bp, Artificial Sequence
  Description of Artificial Sequence: Synthetic oligonucleotide
  Target: SCN9A; (+) strand; PAM type: YTN; PAM sequence: TTT
taatttaatttaattatttt

SEQ ID NO: 98590 - DNA, 20 bp, Artificial Sequence
  Description of Artificial Sequence: Synthetic oligonucleotide
  Target: SCN9A; (+) strand; PAM type: YTN; PAM sequence: TTT
aatttaatttaattattttc

SEQ ID NO: 98591 - DNA, 20 bp, Artificial Sequence
  Description of Artificial Sequence: Synthetic oligonucleotide
  Target: SCN9A; (+) strand; PAM type: YTN; PAM sequence: TTA
atttaatttaattattttct

SEQ ID NO: 98592 - DNA, 20 bp, Artificial Sequence
  Description of Artificial Sequence: Synthetic oligonucleotide
  Target: SCN9A; (+) strand; PAM type: YTN; PAM sequence: TTT
aatttaattattttcttttc

SEQ ID NO: 98593 - DNA, 20 bp, Artificial Sequence
  Description of Artificial Sequence: Synthetic oligonucleotide
  Target: SCN9A; (+) strand; PAM type: YTN; PAM sequence: TTA
atttaattattttcttttct

SEQ ID NO: 98594 - DNA, 20 bp, Artificial Sequence
  Description of Artificial Sequence: Synthetic oligonucleotide
  Target: SCN9A; (+) strand; PAM type: YTN; PAM sequence: TTT
aattattttcttttcttatt

SEQ ID NO: 98595 - DNA, 20 bp, Artificial Sequence
  Description of Artificial Sequence: Synthetic oligonucleotide
  Target: SCN9A; (+) strand; PAM type: YTN; PAM sequence: TTA
attattttcttttcttattc

SEQ ID NO: 98596 - DNA, 20 bp, Artificial Sequence
  Description of Artificial Sequence: Synthetic oligonucleotide
  Target: SCN9A; (+) strand; PAM type: YTN; PAM sequence: TTA
ttttcttttcttattctctt

SEQ ID NO: 98597 - DNA, 20 bp, Artificial Sequence
  Description of Artificial Sequence: Synthetic oligonucleotide
  Target: SCN9A; (+) strand; PAM type: YTN; PAM sequence: TTT
tcttttcttattctcttttt

SEQ ID NO: 98598 - DNA, 20 bp, Artificial Sequence
  Description of Artificial Sequence: Synthetic oligonucleotide
  Target: SCN9A; (+) strand; PAM type: YTN; PAM sequence: TTT
cttttcttattctctttttt

SEQ ID NO: 98599 - DNA, 20 bp, Artificial Sequence
  Description of Artificial Sequence: Synthetic oligonucleotide
  Target: SCN9A; (+) strand; PAM type: YTN; PAM sequence: TTC
ttttcttattctcttttttt

SEQ ID NO: 98600 - DNA, 20 bp, Artificial Sequence
  Description of Artificial Sequence: Synthetic oligonucleotide
  Target: SCN9A; (+) strand; PAM type: YTN; PAM sequence: CTT
ttcttattctctttttttga

SEQ ID NO: 98601 - DNA, 20 bp, Artificial Sequence
  Description of Artificial Sequence: Synthetic oligonucleotide
  Target: SCN9A; (+) strand; PAM type: YTN; PAM sequence: TTT
tcttattctctttttttgag

SEQ ID NO: 98602 - DNA, 20 bp, Artificial Sequence
  Description of Artificial Sequence: Synthetic oligonucleotide
  Target: SCN9A; (+) strand; PAM type: YTN; PAM sequence: TTT
cttattctctttttttgaga

SEQ ID NO: 98603 - DNA, 20 bp, Artificial Sequence
  Description of Artificial Sequence: Synthetic oligonucleotide
  Target: SCN9A; (+) strand; PAM type: YTN; PAM sequence: TTC
ttattctctttttttgagac

SEQ ID NO: 98604 - DNA, 20 bp, Artificial Sequence
  Description of Artificial Sequence: Synthetic oligonucleotide
  Target: SCN9A; (+) strand; PAM type: YTN; PAM sequence: CTT
attctctttttttgagacat

SEQ ID NO: 98605 - DNA, 20 bp, Artificial Sequence
  Description of Artificial Sequence: Synthetic oligonucleotide
  Target: SCN9A; (+) strand; PAM type: YTN; PAM sequence: TTA
ttctctttttttgagacatt

SEQ ID NO: 98606 - DNA, 20 bp, Artificial Sequence
  Description of Artificial Sequence: Synthetic oligonucleotide
  Target: SCN9A; (+) strand; PAM type: YTN; PAM sequence: TTC
tctttttttgagacattctc

SEQ ID NO: 98607 - DNA, 20 bp, Artificial Sequence
  Description of Artificial Sequence: Synthetic oligonucleotide
  Target: SCN9A; (+) strand; PAM type: YTN; PAM sequence: CTC
tttttttgagacattctcca

SEQ ID NO: 98608 - DNA, 20 bp, Artificial Sequence
  Description of Artificial Sequence: Synthetic oligonucleotide
  Target: SCN9A; (+) strand; PAM type: YTN; PAM sequence: CTT
tttttgagacattctccaca

SEQ ID NO: 98609 - DNA, 20 bp, Artificial Sequence
  Description of Artificial Sequence: Synthetic oligonucleotide
  Target: SCN9A; (+) strand; PAM type: YTN; PAM sequence: TTT
ttttgagacattctccacaa

SEQ ID NO: 98610 - DNA, 20 bp, Artificial Sequence
  Description of Artificial Sequence: Synthetic oligonucleotide
  Target: SCN9A; (+) strand; PAM type: YTN; PAM sequence: TTT
tttgagacattctccacaaa

SEQ ID NO: 98611 - DNA, 20 bp, Artificial Sequence
  Description of Artificial Sequence: Synthetic oligonucleotide
  Target: SCN9A; (+) strand; PAM type: YTN; PAM sequence: TTT
ttgagacattctccacaaaa

SEQ ID NO: 98612 - DNA, 20 bp, Artificial Sequence
  Description of Artificial Sequence: Synthetic oligonucleotide
  Target: SCN9A; (+) strand; PAM type: YTN; PAM sequence: TTT
tgagacattctccacaaaag

SEQ ID NO: 98613 - DNA, 20 bp, Artificial Sequence
  Description of Artificial Sequence: Synthetic oligonucleotide
  Target: SCN9A; (+) strand; PAM type: YTN; PAM sequence: TTT
gagacattctccacaaaagg

SEQ ID NO: 98614 - DNA, 20 bp, Artificial Sequence
  Description of Artificial Sequence: Synthetic oligonucleotide
  Target: SCN9A; (+) strand; PAM type: YTN; PAM sequence: TTG
agacattctccacaaaagga

SEQ ID NO: 98615 - DNA, 20 bp, Artificial Sequence
  Description of Artificial Sequence: Synthetic oligonucleotide
  Target: SCN9A; (+) strand; PAM type: YTN; PAM sequence: TTC
tccacaaaaggattgagaat

SEQ ID NO: 98616 - DNA, 20 bp, Artificial Sequence
  Description of Artificial Sequence: Synthetic oligonucleotide
  Target: SCN9A; (+) strand; PAM type: YTN; PAM sequence: CTC
cacaaaaggattgagaatct

SEQ ID NO: 98617 - DNA, 20 bp, Artificial Sequence
  Description of Artificial Sequence: Synthetic oligonucleotide
  Target: SCN9A; (+) strand; PAM type: YTN; PAM sequence: TTG
agaatctttaaatggtttaa

SEQ ID NO: 98618 - DNA, 20 bp, Artificial Sequence
  Description of Artificial Sequence: Synthetic oligonucleotide
  Target: SCN9A; (+) strand; PAM type: YTN; PAM sequence: CTT
taaatggtttaaatccttta

SEQ ID NO: 98619 - DNA, 20 bp, Artificial Sequence
  Description of Artificial Sequence: Synthetic oligonucleotide
  Target: SCN9A; (+) strand; PAM type: YTN; PAM sequence: TTT
aaatggtttaaatcctttag

SEQ ID NO: 98620 - DNA, 20 bp, Artificial Sequence
  Description of Artificial Sequence: Synthetic oligonucleotide
  Target: SCN9A; (+) strand; PAM type: YTN; PAM sequence: TTA
aatggtttaaatcctttaga

SEQ ID NO: 98621 - DNA, 20 bp, Artificial Sequence
  Description of Artificial Sequence: Synthetic oligonucleotide
  Target: SCN9A; (+) strand; PAM type: YTN; PAM sequence: TTT
aaatcctttagatttggctg

SEQ ID NO: 98622 - DNA, 20 bp, Artificial Sequence
  Description of Artificial Sequence: Synthetic oligonucleotide
  Target: SCN9A; (+) strand; PAM type: YTN; PAM sequence: TTA
aatcctttagatttggctgg

SEQ ID NO: 98623 - DNA, 20 bp, Artificial Sequence
  Description of Artificial Sequence: Synthetic oligonucleotide
  Target: SCN9A; (+) strand; PAM type: YTN; PAM sequence: CTT
tagatttggctggttctacg

SEQ ID NO: 98624 - DNA, 20 bp, Artificial Sequence
  Description of Artificial Sequence: Synthetic oligonucleotide
  Target: SCN9A; (+) strand; PAM type: YTN; PAM sequence: TTT
agatttggctggttctacga

SEQ ID NO: 98625 - DNA, 20 bp, Artificial Sequence
  Description of Artificial Sequence: Synthetic oligonucleotide
  Target: SCN9A; (+) strand; PAM type: YTN; PAM sequence: TTA
gatttggctggttctacgaa

SEQ ID NO: 98626 - DNA, 20 bp, Artificial Sequence
  Description of Artificial Sequence: Synthetic oligonucleotide
  Target: SCN9A; (+) strand; PAM type: YTN; PAM sequence: TTT
ggctggttctacgaaataag

SEQ ID NO: 98627 - DNA, 20 bp, Artificial Sequence
  Description of Artificial Sequence: Synthetic oligonucleotide
  Target: SCN9A; (+) strand; PAM type: YTN; PAM sequence: TTG
gctggttctacgaaataaga

SEQ ID NO: 98628 - DNA, 20 bp, Artificial Sequence
  Description of Artificial Sequence: Synthetic oligonucleotide
  Target: SCN9A; (+) strand; PAM type: YTN; PAM sequence: CTG
gttctacgaaataagagcaa

SEQ ID NO: 98629 - DNA, 20 bp, Artificial Sequence
  Description of Artificial Sequence: Synthetic oligonucleotide
  Target: SCN9A; (+) strand; PAM type: YTN; PAM sequence: TTC
tacgaaataagagcaatcgt

SEQ ID NO: 98630 - DNA, 20 bp, Artificial Sequence
  Description of Artificial Sequence: Synthetic oligonucleotide
  Target: SCN9A; (+) strand; PAM type: YTN; PAM sequence: CTA
cgaaataagagcaatcgttt

SEQ ID NO: 98631 - DNA, 20 bp, Artificial Sequence
  Description of Artificial Sequence: Synthetic oligonucleotide
  Target: SCN9A; (+) strand; PAM type: YTN; PAM sequence: TTT
taaatttattattattactc

SEQ ID NO: 98632 - DNA, 20 bp, Artificial Sequence
  Description of Artificial Sequence: Synthetic oligonucleotide
  Target: SCN9A; (+) strand; PAM type: YTN; PAM sequence: TTT
aaatttattattattactct

SEQ ID NO: 98633 - DNA, 20 bp, Artificial Sequence
  Description of Artificial Sequence: Synthetic oligonucleotide
  Target: SCN9A; (+) strand; PAM type: YTN; PAM sequence: TTA
aatttattattattactcta

SEQ ID NO: 98634 - DNA, 20 bp, Artificial Sequence
  Description of Artificial Sequence: Synthetic oligonucleotide
  Target: SCN9A; (+) strand; PAM type: YTN; PAM sequence: TTT
attattattactctaaatac

SEQ ID NO: 98635 - DNA, 20 bp, Artificial Sequence
  Description of Artificial Sequence: Synthetic oligonucleotide
  Target: SCN9A; (+) strand; PAM type: YTN; PAM sequence: TTA
ttattattactctaaatact

SEQ ID NO: 98636 - DNA, 20 bp, Artificial Sequence
  Description of Artificial Sequence: Synthetic oligonucleotide
  Target: SCN9A; (+) strand; PAM type: YTN; PAM sequence: TTA
ttattactctaaatacttta

SEQ ID NO: 98637 - DNA, 20 bp, Artificial Sequence
  Description of Artificial Sequence: Synthetic oligonucleotide
  Target: SCN9A; (+) strand; PAM type: YTN; PAM sequence: TTA
ttactctaaatactttatat

SEQ ID NO: 98638 - DNA, 20 bp, Artificial Sequence
  Description of Artificial Sequence: Synthetic oligonucleotide
  Target: SCN9A; (+) strand; PAM type: YTN; PAM sequence: TTA
ctctaaatactttatatgta

SEQ ID NO: 98639 - DNA, 20 bp, Artificial Sequence
  Description of Artificial Sequence: Synthetic oligonucleotide
  Target: SCN9A; (+) strand; PAM type: YTN; PAM sequence: CTC
taaatactttatatgtaagc

SEQ ID NO: 98640 - DNA, 20 bp, Artificial Sequence
  Description of Artificial Sequence: Synthetic oligonucleotide
  Target: SCN9A; (+) strand; PAM type: YTN; PAM sequence: CTA
aatactttatatgtaagcct

SEQ ID NO: 98641 - DNA, 20 bp, Artificial Sequence
  Description of Artificial Sequence: Synthetic oligonucleotide
  Target: SCN9A; (+) strand; PAM type: YTN; PAM sequence: CTT
tatatgtaagcctttgacta

SEQ ID NO: 98642 - DNA, 20 bp, Artificial Sequence
  Description of Artificial Sequence: Synthetic oligonucleotide
  Target: SCN9A; (+) strand; PAM type: YTN; PAM sequence: TTT
atatgtaagcctttgactaa

SEQ ID NO: 98643 - DNA, 20 bp, Artificial Sequence
  Description of Artificial Sequence: Synthetic oligonucleotide
  Target: SCN9A; (+) strand; PAM type: YTN; PAM sequence: TTA
tatgtaagcctttgactaaa

SEQ ID NO: 98644 - DNA, 20 bp, Artificial Sequence
  Description of Artificial Sequence: Synthetic oligonucleotide
  Target: SCN9A; (+) strand; PAM type: YTN; PAM sequence: CTT
tgactaaatatatatagtgc

SEQ ID NO: 98645 - DNA, 20 bp, Artificial Sequence
  Description of Artificial Sequence: Synthetic oligonucleotide
  Target: SCN9A; (+) strand; PAM type: YTN; PAM sequence: TTT
gactaaatatatatagtgct

SEQ ID NO: 98646 - DNA, 20 bp, Artificial Sequence
  Description of Artificial Sequence: Synthetic oligonucleotide
  Target: SCN9A; (+) strand; PAM type: YTN; PAM sequence: TTG
actaaatatatatagtgctg

SEQ ID NO: 98647 - DNA, 20 bp, Artificial Sequence
  Description of Artificial Sequence: Synthetic oligonucleotide
  Target: SCN9A; (+) strand; PAM type: YTN; PAM sequence: CTA
aatatatatagtgctggcct

SEQ ID NO: 98648 - DNA, 20 bp, Artificial Sequence
  Description of Artificial Sequence: Synthetic oligonucleotide
  Target: SCN9A; (+) strand; PAM type: YTN; PAM sequence: CTG
gcctcagttaagacaaaaat

SEQ ID NO: 98649 - DNA, 20 bp, Artificial Sequence
  Description of Artificial Sequence: Synthetic oligonucleotide
  Target: SCN9A; (+) strand; PAM type: YTN; PAM sequence: CTC
agttaagacaaaaattagga

SEQ ID NO: 98650 - DNA, 20 bp, Artificial Sequence
  Description of Artificial Sequence: Synthetic oligonucleotide
  Target: SCN9A; (+) strand; PAM type: YTN; PAM sequence: TTA
agacaaaaattaggaacagt

SEQ ID NO: 98651 - DNA, 20 bp, Artificial Sequence
  Description of Artificial Sequence: Synthetic oligonucleotide
  Target: SCN9A; (+) strand; PAM type: YTN; PAM sequence: TTA
ggaacagtttttctttaatc

SEQ ID NO: 98652 - DNA, 20 bp, Artificial Sequence
  Description of Artificial Sequence: Synthetic oligonucleotide
  Target: SCN9A; (+) strand; PAM type: YTN; PAM sequence: TTT
ttctttaatcctttctttat

SEQ ID NO: 98653 - DNA, 20 bp, Artificial Sequence
  Description of Artificial Sequence: Synthetic oligonucleotide
  Target: SCN9A; (+) strand; PAM type: YTN; PAM sequence: TTT
tctttaatcctttctttatt

SEQ ID NO: 98654 - DNA, 20 bp, Artificial Sequence
  Description of Artificial Sequence: Synthetic oligonucleotide
  Target: SCN9A; (+) strand; PAM type: YTN; PAM sequence: TTT
ctttaatcctttctttattt

SEQ ID NO: 98655 - DNA, 20 bp, Artificial Sequence
  Description of Artificial Sequence: Synthetic oligonucleotide
  Target: SCN9A; (+) strand; PAM type: YTN; PAM sequence: TTC
tttaatcctttctttatttc

SEQ ID NO: 98656 - DNA, 20 bp, Artificial Sequence
  Description of Artificial Sequence: Synthetic oligonucleotide
  Target: SCN9A; (+) strand; PAM type: YTN; PAM sequence: CTT
taatcctttctttatttctg

SEQ ID NO: 98657 - DNA, 20 bp, Artificial Sequence
  Description of Artificial Sequence: Synthetic oligonucleotide
  Target: SCN9A; (+) strand; PAM type: YTN; PAM sequence: TTT
aatcctttctttatttctgc

SEQ ID NO: 98658 - DNA, 20 bp, Artificial Sequence
  Description of Artificial Sequence: Synthetic oligonucleotide
  Target: SCN9A; (+) strand; PAM type: YTN; PAM sequence: TTA
atcctttctttatttctgct

SEQ ID NO: 98659 - DNA, 20 bp, Artificial Sequence
  Description of Artificial Sequence: Synthetic oligonucleotide
  Target: SCN9A; (+) strand; PAM type: YTN; PAM sequence: CTT
tctttatttctgcttttcag

SEQ ID NO: 98660 - DNA, 20 bp, Artificial Sequence
  Description of Artificial Sequence: Synthetic oligonucleotide
  Target: SCN9A; (+) strand; PAM type: YTN; PAM sequence: TTT
ctttatttctgcttttcagc

SEQ ID NO: 98661 - DNA, 20 bp, Artificial Sequence
  Description of Artificial Sequence: Synthetic oligonucleotide
  Target: SCN9A; (+) strand; PAM type: YTN; PAM sequence: TTC
tttatttctgcttttcagca

SEQ ID NO: 98662 - DNA, 20 bp, Artificial Sequence
  Description of Artificial Sequence: Synthetic oligonucleotide
  Target: SCN9A; (+) strand; PAM type: YTN; PAM sequence: CTT
tatttctgcttttcagcatt

SEQ ID NO: 98663 - DNA, 20 bp, Artificial Sequence
  Description of Artificial Sequence: Synthetic oligonucleotide
  Target: SCN9A; (+) strand; PAM type: YTN; PAM sequence: TTT
atttctgcttttcagcattt

SEQ ID NO: 98664 - DNA, 20 bp, Artificial Sequence
  Description of Artificial Sequence: Synthetic oligonucleotide
  Target: SCN9A; (+) strand; PAM type: YTN; PAM sequence: TTA
tttctgcttttcagcatttg

SEQ ID NO: 98665 - DNA, 20 bp, Artificial Sequence
  Description of Artificial Sequence: Synthetic oligonucleotide
  Target: SCN9A; (+) strand; PAM type: YTN; PAM sequence: TTT
ctgcttttcagcatttgtac

SEQ ID NO: 98666 - DNA, 20 bp, Artificial Sequence
  Description of Artificial Sequence: Synthetic oligonucleotide
  Target: SCN9A; (+) strand; PAM type: YTN; PAM sequence: TTC
tgcttttcagcatttgtact

SEQ ID NO: 98667 - DNA, 20 bp, Artificial Sequence
  Description of Artificial Sequence: Synthetic oligonucleotide
  Target: SCN9A; (+) strand; PAM type: YTN; PAM sequence: CTG
cttttcagcatttgtactgc

SEQ ID NO: 98668 - DNA, 20 bp, Artificial Sequence
  Description of Artificial Sequence: Synthetic oligonucleotide
  Target: SCN9A; (+) strand; PAM type: YTN; PAM sequence: CTT
ttcagcatttgtactgctat

SEQ ID NO: 98669 - DNA, 20 bp, Artificial Sequence
  Description of Artificial Sequence: Synthetic oligonucleotide
  Target: SCN9A; (+) strand; PAM type: YTN; PAM sequence: TTT
tcagcatttgtactgctatt

SEQ ID NO: 98670 - DNA, 20 bp, Artificial Sequence
  Description of Artificial Sequence: Synthetic oligonucleotide
  Target: SCN9A; (+) strand; PAM type: YTN; PAM sequence: TTT
cagcatttgtactgctattg

SEQ ID NO: 98671 - DNA, 20 bp, Artificial Sequence
  Description of Artificial Sequence: Synthetic oligonucleotide
  Target: SCN9A; (+) strand; PAM type: YTN; PAM sequence: TTC
agcatttgtactgctattga

SEQ ID NO: 98672 - DNA, 20 bp, Artificial Sequence
  Description of Artificial Sequence: Synthetic oligonucleotide
  Target: SCN9A; (+) strand; PAM type: YTN; PAM sequence: TTT
gtactgctattgatcaccag

SEQ ID NO: 98673 - DNA, 20 bp, Artificial Sequence
  Description of Artificial Sequence: Synthetic oligonucleotide
  Target: SCN9A; (+) strand; PAM type: YTN; PAM sequence: TTG
tactgctattgatcaccagt

SEQ ID NO: 98674 - DNA, 20 bp, Artificial Sequence
  Description of Artificial Sequence: Synthetic oligonucleotide
  Target: SCN9A; (+) strand; PAM type: YTN; PAM sequence: CTG
ctattgatcaccagtttgtc

SEQ ID NO: 98675 - DNA, 20 bp, Artificial Sequence
  Description of Artificial Sequence: Synthetic oligonucleotide
  Target: SCN9A; (+) strand; PAM type: YTN; PAM sequence: CTA
ttgatcaccagtttgtcttt

SEQ ID NO: 98676 - DNA, 20 bp, Artificial Sequence
  Description of Artificial Sequence: Synthetic oligonucleotide
  Target: SCN9A; (+) strand; PAM type: YTN; PAM sequence: TTG
atcaccagtttgtctttgcc

SEQ ID NO: 98677 - DNA, 20 bp, Artificial Sequence
  Description of Artificial Sequence: Synthetic oligonucleotide
  Target: SCN9A; (+) strand; PAM type: YTN; PAM sequence: TTT
gtctttgccactccagtttt

SEQ ID NO: 98678 - DNA, 20 bp, Artificial Sequence
  Description of Artificial Sequence: Synthetic oligonucleotide
  Target: SCN9A; (+) strand; PAM type: YTN; PAM sequence: TTG
tctttgccactccagttttc

SEQ ID NO: 98679 - DNA, 20 bp, Artificial Sequence
  Description of Artificial Sequence: Synthetic oligonucleotide
  Target: SCN9A; (+) strand; PAM type: YTN; PAM sequence: CTT
tgccactccagttttcatcc

SEQ ID NO: 98680 - DNA, 20 bp, Artificial Sequence
  Description of Artificial Sequence: Synthetic oligonucleotide
  Target: SCN9A; (+) strand; PAM type: YTN; PAM sequence: TTT
gccactccagttttcatcca

SEQ ID NO: 98681 - DNA, 20 bp, Artificial Sequence
  Description of Artificial Sequence: Synthetic oligonucleotide
  Target: SCN9A; (+) strand; PAM type: YTN; PAM sequence: TTG
ccactccagttttcatccag

SEQ ID NO: 98682 - DNA, 20 bp, Artificial Sequence
  Description of Artificial Sequence: Synthetic oligonucleotide
  Target: SCN9A; (+) strand; PAM type: YTN; PAM sequence: CTC
cagttttcatccagggcaat

SEQ ID NO: 98683 - DNA, 20 bp, Artificial Sequence
  Description of Artificial Sequence: Synthetic oligonucleotide
  Target: SCN9A; (+) strand; PAM type: YTN; PAM sequence: TTT
tcatccagggcaattcctgt

SEQ ID NO: 98684 - DNA, 20 bp, Artificial Sequence
  Description of Artificial Sequence: Synthetic oligonucleotide
  Target: SCN9A; (+) strand; PAM type: YTN; PAM sequence: TTT
catccagggcaattcctgtg

SEQ ID NO: 98685 - DNA, 20 bp, Artificial Sequence
  Description of Artificial Sequence: Synthetic oligonucleotide
  Target: SCN9A; (+) strand; PAM type: YTN; PAM sequence: TTC
atccagggcaattcctgtgg

SEQ ID NO: 98686 - DNA, 20 bp, Artificial Sequence
  Description of Artificial Sequence: Synthetic oligonucleotide
  Target: SCN9A; (+) strand; PAM type: YTN; PAM sequence: TTC
ctgtggcatttaacactctc

SEQ ID NO: 98687 - DNA, 20 bp, Artificial Sequence
  Description of Artificial Sequence: Synthetic oligonucleotide
  Target: SCN9A; (+) strand; PAM type: YTN; PAM sequence: CTG
tggcatttaacactctccag

SEQ ID NO: 98688 - DNA, 20 bp, Artificial Sequence
  Description of Artificial Sequence: Synthetic oligonucleotide
  Target: SCN9A; (+) strand; PAM type: YTN; PAM sequence: TTT
aacactctccagattttctt

SEQ ID NO: 98689 - DNA, 20 bp, Artificial Sequence
  Description of Artificial Sequence: Synthetic oligonucleotide
  Target: SCN9A; (+) strand; PAM type: YTN; PAM sequence: TTA
acactctccagattttctta

SEQ ID NO: 98690 - DNA, 20 bp, Artificial Sequence
  Description of Artificial Sequence: Synthetic oligonucleotide
  Target: SCN9A; (+) strand; PAM type: YTN; PAM sequence: CTC
tccagattttcttatttact

SEQ ID NO: 98691 - DNA, 20 bp, Artificial Sequence
  Description of Artificial Sequence: Synthetic oligonucleotide
  Target: SCN9A; (+) strand; PAM type: YTN; PAM sequence: CTC
cagattttcttatttactta

SEQ ID NO: 98692 - DNA, 20 bp, Artificial Sequence
  Description of Artificial Sequence: Synthetic oligonucleotide
  Target: SCN9A; (+) strand; PAM type: YTN; PAM sequence: TTT
tcttatttacttaatctttc

SEQ ID NO: 98693 - DNA, 20 bp, Artificial Sequence
  Description of Artificial Sequence: Synthetic oligonucleotide
  Target: SCN9A; (+) strand; PAM type: YTN; PAM sequence: TTT
cttatttacttaatctttca

SEQ ID NO: 98694 - DNA, 20 bp, Artificial Sequence
  Description of Artificial Sequence: Synthetic oligonucleotide
  Target: SCN9A; (+) strand; PAM type: YTN; PAM sequence: TTC
ttatttacttaatctttcaa

SEQ ID NO: 98695 - DNA, 20 bp, Artificial Sequence
  Description of Artificial Sequence: Synthetic oligonucleotide
  Target: SCN9A; (+) strand; PAM type: YTN; PAM sequence: CTT
atttacttaatctttcaaaa

SEQ ID NO: 98696 - DNA, 20 bp, Artificial Sequence
  Description of Artificial Sequence: Synthetic oligonucleotide
  Target: SCN9A; (+) strand; PAM type: YTN; PAM sequence: TTA
tttacttaatctttcaaaac

SEQ ID NO: 98697 - DNA, 20 bp, Artificial Sequence
  Description of Artificial Sequence: Synthetic oligonucleotide
  Target: SCN9A; (+) strand; PAM type: YTN; PAM sequence: TTT
acttaatctttcaaaaccta

SEQ ID NO: 98698 - DNA, 20 bp, Artificial Sequence
  Description of Artificial Sequence: Synthetic oligonucleotide
  Target: SCN9A; (+) strand; PAM type: YTN; PAM sequence: TTA
cttaatctttcaaaacctac

SEQ ID NO: 98699 - DNA, 20 bp, Artificial Sequence
  Description of Artificial Sequence: Synthetic oligonucleotide
  Target: SCN9A; (+) strand; PAM type: YTN; PAM sequence: CTT
aatctttcaaaacctacctg

SEQ ID NO: 98700 - DNA, 20 bp, Artificial Sequence
  Description of Artificial Sequence: Synthetic oligonucleotide
  Target: SCN9A; (+) strand; PAM type: YTN; PAM sequence: TTA
atctttcaaaacctacctgt

SEQ ID NO: 98701 - DNA, 20 bp, Artificial Sequence
  Description of Artificial Sequence: Synthetic oligonucleotide
  Target: SCN9A; (+) strand; PAM type: YTN; PAM sequence: CTT
tcaaaacctacctgtcatct

SEQ ID NO: 98702 - DNA, 20 bp, Artificial Sequence
  Description of Artificial Sequence: Synthetic oligonucleotide
  Target: SCN9A; (+) strand; PAM type: YTN; PAM sequence: TTT
caaaacctacctgtcatctt

SEQ ID NO: 98703 - DNA, 20 bp, Artificial Sequence
  Description of Artificial Sequence: Synthetic oligonucleotide
  Target: SCN9A; (+) strand; PAM type: YTN; PAM sequence: TTC
aaaacctacctgtcatctta

SEQ ID NO: 98704 - DNA, 20 bp, Artificial Sequence
  Description of Artificial Sequence: Synthetic oligonucleotide
  Target: SCN9A; (+) strand; PAM type: YTN; PAM sequence: CTA
cctgtcatcttacacttcag

SEQ ID NO: 98705 - DNA, 20 bp, Artificial Sequence
  Description of Artificial Sequence: Synthetic oligonucleotide
  Target: SCN9A; (+) strand; PAM type: YTN; PAM sequence: CTG
tcatcttacacttcagcttg

SEQ ID NO: 98706 - DNA, 20 bp, Artificial Sequence
  Description of Artificial Sequence: Synthetic oligonucleotide
  Target: SCN9A; (+) strand; PAM type: YTN; PAM sequence: CTT
acacttcagcttgagcaccc

SEQ ID NO: 98707 - DNA, 20 bp, Artificial Sequence
  Description of Artificial Sequence: Synthetic oligonucleotide
  Target: SCN9A; (+) strand; PAM type: YTN; PAM sequence: TTA
cacttcagcttgagcaccca

SEQ ID NO: 98708 - DNA, 20 bp, Artificial Sequence
  Description of Artificial Sequence: Synthetic oligonucleotide
  Target: SCN9A; (+) strand; PAM type: YTN; PAM sequence: CTT
cagcttgagcacccattcaa

SEQ ID NO: 98709 - DNA, 20 bp, Artificial Sequence
  Description of Artificial Sequence: Synthetic oligonucleotide
  Target: SCN9A; (+) strand; PAM type: YTN; PAM sequence: TTC
agcttgagcacccattcaag

SEQ ID NO: 98710 - DNA, 20 bp, Artificial Sequence
  Description of Artificial Sequence: Synthetic oligonucleotide
  Target: SCN9A; (+) strand; PAM type: YTN; PAM sequence: CTT
gagcacccattcaagtacaa

SEQ ID NO: 98711 - DNA, 20 bp, Artificial Sequence
  Description of Artificial Sequence: Synthetic oligonucleotide
  Target: SCN9A; (+) strand; PAM type: YTN; PAM sequence: TTG
agcacccattcaagtacaaa

SEQ ID NO: 98712 - DNA, 20 bp, Artificial Sequence
  Description of Artificial Sequence: Synthetic oligonucleotide
  Target: SCN9A; (+) strand; PAM type: YTN; PAM sequence: TTC
aagtacaaatgtgttaaaga

SEQ ID NO: 98713 - DNA, 20 bp, Artificial Sequence
  Description of Artificial Sequence: Synthetic oligonucleotide
  Target: SCN9A; (+) strand; PAM type: YTN; PAM sequence: TTA
aagattaacctgttagggaa

SEQ ID NO: 98714 - DNA, 20 bp, Artificial Sequence
  Description of Artificial Sequence: Synthetic oligonucleotide
  Target: SCN9A; (+) strand; PAM type: YTN; PAM sequence: TTA
acctgttagggaaggagcac

SEQ ID NO: 98715 - DNA, 20 bp, Artificial Sequence
  Description of Artificial Sequence: Synthetic oligonucleotide
  Target: SCN9A; (+) strand; PAM type: YTN; PAM sequence: CTG
ttagggaaggagcactggga

SEQ ID NO: 98716 - DNA, 20 bp, Artificial Sequence
  Description of Artificial Sequence: Synthetic oligonucleotide
  Target: SCN9A; (+) strand; PAM type: YTN; PAM sequence: TTA
gggaaggagcactgggatcc

SEQ ID NO: 98717 - DNA, 20 bp, Artificial Sequence
  Description of Artificial Sequence: Synthetic oligonucleotide
  Target: SCN9A; (+) strand; PAM type: YTN; PAM sequence: CTG
ggatccttcttttctgcaat

SEQ ID NO: 98718 - DNA, 20 bp, Artificial Sequence
  Description of Artificial Sequence: Synthetic oligonucleotide
  Target: SCN9A; (+) strand; PAM type: YTN; PAM sequence: CTT
cttttctgcaatgtattaag

SEQ ID NO: 98719 - DNA, 20 bp, Artificial Sequence
  Description of Artificial Sequence: Synthetic oligonucleotide
  Target: SCN9A; (+) strand; PAM type: YTN; PAM sequence: TTC
ttttctgcaatgtattaagc

SEQ ID NO: 98720 - DNA, 20 bp, Artificial Sequence
  Description of Artificial Sequence: Synthetic oligonucleotide
  Target: SCN9A; (+) strand; PAM type: YTN; PAM sequence: CTT
ttctgcaatgtattaagcag

SEQ ID NO: 98721 - DNA, 20 bp, Artificial Sequence
  Description of Artificial Sequence: Synthetic oligonucleotide
  Target: SCN9A; (+) strand; PAM type: YTN; PAM sequence: TTT
tctgcaatgtattaagcagg

SEQ ID NO: 98722 - DNA, 20 bp, Artificial Sequence
  Description of Artificial Sequence: Synthetic oligonucleotide
  Target: SCN9A; (+) strand; PAM type: YTN; PAM sequence: TTT
ctgcaatgtattaagcaggt

SEQ ID NO: 98723 - DNA, 20 bp, Artificial Sequence
  Description of Artificial Sequence: Synthetic oligonucleotide
  Target: SCN9A; (+) strand; PAM type: YTN; PAM sequence: TTC
tgcaatgtattaagcaggtt

SEQ ID NO: 98724 - DNA, 20 bp, Artificial Sequence
  Description of Artificial Sequence: Synthetic oligonucleotide
  Target: SCN9A; (+) strand; PAM type: YTN; PAM sequence: CTG
caatgtattaagcaggttct

SEQ ID NO: 98725 - DNA, 20 bp, Artificial Sequence
  Description of Artificial Sequence: Synthetic oligonucleotide
  Target: SCN9A; (+) strand; PAM type: YTN; PAM sequence: TTA
agcaggttctcaagatgctt

SEQ ID NO: 98726 - DNA, 20 bp, Artificial Sequence
  Description of Artificial Sequence: Synthetic oligonucleotide
  Target: SCN9A; (+) strand; PAM type: YTN; PAM sequence: TTC
tcaagatgctttaaaataga

SEQ ID NO: 98727 - DNA, 20 bp, Artificial Sequence
  Description of Artificial Sequence: Synthetic oligonucleotide
  Target: SCN9A; (+) strand; PAM type: YTN; PAM sequence: CTC
aagatgctttaaaatagaga

SEQ ID NO: 98728 - DNA, 20 bp, Artificial Sequence
  Description of Artificial Sequence: Synthetic oligonucleotide
  Target: SCN9A; (+) strand; PAM type: YTN; PAM sequence: CTT
taaaatagagaaatactaag

SEQ ID NO: 98729 - DNA, 20 bp, Artificial Sequence
  Description of Artificial Sequence: Synthetic oligonucleotide
  Target: SCN9A; (+) strand; PAM type: YTN; PAM sequence: TTT
aaaatagagaaatactaagg

SEQ ID NO: 98730 - DNA, 20 bp, Artificial Sequence
  Description of Artificial Sequence: Synthetic oligonucleotide
  Target: SCN9A; (+) strand; PAM type: YTN; PAM sequence: TTA
aaatagagaaatactaagga

SEQ ID NO: 98731 - DNA, 20 bp, Artificial Sequence
  Description of Artificial Sequence: Synthetic oligonucleotide
  Target: SCN9A; (+) strand; PAM type: YTN; PAM sequence: CTA
aggatctctgactactaatc

SEQ ID NO: 98732 - DNA, 20 bp, Artificial Sequence
  Description of Artificial Sequence: Synthetic oligonucleotide
  Target: SCN9A; (+) strand; PAM type: YTN; PAM sequence: CTC
tgactactaatcagatcatc

SEQ ID NO: 98733 - DNA, 20 bp, Artificial Sequence
  Description of Artificial Sequence: Synthetic oligonucleotide
  Target: SCN9A; (+) strand; PAM type: YTN; PAM sequence: CTG
actactaatcagatcatcta

SEQ ID NO: 98734 - DNA, 20 bp, Artificial Sequence
  Description of Artificial Sequence: Synthetic oligonucleotide
  Target: SCN9A; (+) strand; PAM type: YTN; PAM sequence: CTA
ctaatcagatcatctaggga

SEQ ID NO: 98735 - DNA, 20 bp, Artificial Sequence
  Description of Artificial Sequence: Synthetic oligonucleotide
  Target: SCN9A; (+) strand; PAM type: YTN; PAM sequence: CTA
atcagatcatctagggagaa

SEQ ID NO: 98736 - DNA, 20 bp, Artificial Sequence
  Description of Artificial Sequence: Synthetic oligonucleotide
  Target: SCN9A; (+) strand; PAM type: YTN; PAM sequence: CTA
gggagaaggtttgcaaacat

SEQ ID NO: 98737 - DNA, 20 bp, Artificial Sequence
  Description of Artificial Sequence: Synthetic oligonucleotide
  Target: SCN9A; (+) strand; PAM type: YTN; PAM sequence: TTT
gcaaacatttttataaatat

SEQ ID NO: 98738 - DNA, 20 bp, Artificial Sequence
  Description of Artificial Sequence: Synthetic oligonucleotide
  Target: SCN9A; (+) strand; PAM type: YTN; PAM sequence: TTG
caaacatttttataaatatt

SEQ ID NO: 98739 - DNA, 20 bp, Artificial Sequence
  Description of Artificial Sequence: Synthetic oligonucleotide
  Target: SCN9A; (+) strand; PAM type: YTN; PAM sequence: TTT
ttataaatatttttaggctt

SEQ ID NO: 98740 - DNA, 20 bp, Artificial Sequence
  Description of Artificial Sequence: Synthetic oligonucleotide
  Target: SCN9A; (+) strand; PAM type: YTN; PAM sequence: TTT
tataaatatttttaggcttt

SEQ ID NO: 98741 - DNA, 20 bp, Artificial Sequence
  Description of Artificial Sequence: Synthetic oligonucleotide
  Target: SCN9A; (+) strand; PAM type: YTN; PAM sequence: TTT
ataaatatttttaggctttg

SEQ ID NO: 98742 - DNA, 20 bp, Artificial Sequence
  Description of Artificial Sequence: Synthetic oligonucleotide
  Target: SCN9A; (+) strand; PAM type: YTN; PAM sequence: TTA
taaatatttttaggctttgt

SEQ ID NO: 98743 - DNA, 20 bp, Artificial Sequence
  Description of Artificial Sequence: Synthetic oligonucleotide
  Target: SCN9A; (+) strand; PAM type: YTN; PAM sequence: TTT
ttaggctttgtgggttatat

SEQ ID NO: 98744 - DNA, 20 bp, Artificial Sequence
  Description of Artificial Sequence: Synthetic oligonucleotide
  Target: SCN9A; (+) strand; PAM type: YTN; PAM sequence: TTT
taggctttgtgggttatatc

SEQ ID NO: 98745 - DNA, 20 bp, Artificial Sequence
  Description of Artificial Sequence: Synthetic oligonucleotide
  Target: SCN9A; (+) strand; PAM type: YTN; PAM sequence: TTT
aggctttgtgggttatatct

SEQ ID NO: 98746 - DNA, 20 bp, Artificial Sequence
  Description of Artificial Sequence: Synthetic oligonucleotide
  Target: SCN9A; (+) strand; PAM type: YTN; PAM sequence: TTA
ggctttgtgggttatatctc

SEQ ID NO: 98747 - DNA, 20 bp, Artificial Sequence
  Description of Artificial Sequence: Synthetic oligonucleotide
  Target: SCN9A; (+) strand; PAM type: YTN; PAM sequence: CTT
tgtgggttatatctccgttg

SEQ ID NO: 98748 - DNA, 20 bp, Artificial Sequence
  Description of Artificial Sequence: Synthetic oligonucleotide
  Target: SCN9A; (+) strand; PAM type: YTN; PAM sequence: TTT
gtgggttatatctccgttgc

SEQ ID NO: 98749 - DNA, 20 bp, Artificial Sequence
  Description of Artificial Sequence: Synthetic oligonucleotide
  Target: SCN9A; (+) strand; PAM type: YTN; PAM sequence: TTG
tgggttatatctccgttgca

SEQ ID NO: 98750 - DNA, 20 bp, Artificial Sequence
  Description of Artificial Sequence: Synthetic oligonucleotide
  Target: SCN9A; (+) strand; PAM type: YTN; PAM sequence: TTA
tatctccgttgcaactattc

SEQ ID NO: 98751 - DNA, 20 bp, Artificial Sequence
  Description of Artificial Sequence: Synthetic oligonucleotide
  Target: SCN9A; (+) strand; PAM type: YTN; PAM sequence: CTC
cgttgcaactattcaactct

SEQ ID NO: 98752 - DNA, 20 bp, Artificial Sequence
  Description of Artificial Sequence: Synthetic oligonucleotide
  Target: SCN9A; (+) strand; PAM type: YTN; PAM sequence: TTG
caactattcaactctgccat

SEQ ID NO: 98753 - DNA, 20 bp, Artificial Sequence
  Description of Artificial Sequence: Synthetic oligonucleotide
  Target: SCN9A; (+) strand; PAM type: YTN; PAM sequence: CTA
ttcaactctgccatggtagt

SEQ ID NO: 98754 - DNA, 20 bp, Artificial Sequence
  Description of Artificial Sequence: Synthetic oligonucleotide
  Target: SCN9A; (+) strand; PAM type: YTN; PAM sequence: TTC
aactctgccatggtagtcat

SEQ ID NO: 98755 - DNA, 20 bp, Artificial Sequence
  Description of Artificial Sequence: Synthetic oligonucleotide
  Target: SCN9A; (+) strand; PAM type: YTN; PAM sequence: CTC
tgccatggtagtcatgggtc

SEQ ID NO: 98756 - DNA, 20 bp, Artificial Sequence
  Description of Artificial Sequence: Synthetic oligonucleotide
  Target: SCN9A; (+) strand; PAM type: YTN; PAM sequence: CTG
ccatggtagtcatgggtcat

SEQ ID NO: 98757 - DNA, 20 bp, Artificial Sequence
  Description of Artificial Sequence: Synthetic oligonucleotide
  Target: SCN9A; (+) strand; PAM type: YTN; PAM sequence: CTG
gtatggctgtgttccaagaa

SEQ ID NO: 98758 - DNA, 20 bp, Artificial Sequence
  Description of Artificial Sequence: Synthetic oligonucleotide
  Target: SCN9A; (+) strand; PAM type: YTN; PAM sequence: CTG
tgttccaagaacatttttac

SEQ ID NO: 98759 - DNA, 20 bp, Artificial Sequence
  Description of Artificial Sequence: Synthetic oligonucleotide
  Target: SCN9A; (+) strand; PAM type: YTN; PAM sequence: TTC
caagaacatttttacaaaaa

SEQ ID NO: 98760 - DNA, 20 bp, Artificial Sequence
  Description of Artificial Sequence: Synthetic oligonucleotide
  Target: SCN9A; (+) strand; PAM type: YTN; PAM sequence: TTT
ttacaaaaacaggctggggt

SEQ ID NO: 98761 - DNA, 20 bp, Artificial Sequence
  Description of Artificial Sequence: Synthetic oligonucleotide
  Target: SCN9A; (+) strand; PAM type: YTN; PAM sequence: TTT
tacaaaaacaggctggggtt

SEQ ID NO: 98762 - DNA, 20 bp, Artificial Sequence
  Description of Artificial Sequence: Synthetic oligonucleotide
  Target: SCN9A; (+) strand; PAM type: YTN; PAM sequence: TTT
acaaaaacaggctggggttt

SEQ ID NO: 98763 - DNA, 20 bp, Artificial Sequence
  Description of Artificial Sequence: Synthetic oligonucleotide
  Target: SCN9A; (+) strand; PAM type: YTN; PAM sequence: TTA
caaaaacaggctggggtttg

SEQ ID NO: 98764 - DNA, 20 bp, Artificial Sequence
  Description of Artificial Sequence: Synthetic oligonucleotide
  Target: SCN9A; (+) strand; PAM type: YTN; PAM sequence: CTG
gggtttgttgacctttggtc

SEQ ID NO: 98765 - DNA, 20 bp, Artificial Sequence
  Description of Artificial Sequence: Synthetic oligonucleotide
  Target: SCN9A; (+) strand; PAM type: YTN; PAM sequence: TTT
gttgacctttggtccagagc

SEQ ID NO: 98766 - DNA, 20 bp, Artificial Sequence
  Description of Artificial Sequence: Synthetic oligonucleotide
  Target: SCN9A; (+) strand; PAM type: YTN; PAM sequence: TTG
ttgacctttggtccagagca

SEQ ID NO: 98767 - DNA, 20 bp, Artificial Sequence
  Description of Artificial Sequence: Synthetic oligonucleotide
  Target: SCN9A; (+) strand; PAM type: YTN; PAM sequence: TTG
acctttggtccagagcaatg

SEQ ID NO: 98768 - DNA, 20 bp, Artificial Sequence
  Description of Artificial Sequence: Synthetic oligonucleotide
  Target: SCN9A; (+) strand; PAM type: YTN; PAM sequence: CTT
tggtccagagcaatgattat

SEQ ID NO: 98769 - DNA, 20 bp, Artificial Sequence
  Description of Artificial Sequence: Synthetic oligonucleotide
  Target: SCN9A; (+) strand; PAM type: YTN; PAM sequence: TTT
ggtccagagcaatgattatt

SEQ ID NO: 98770 - DNA, 20 bp, Artificial Sequence
  Description of Artificial Sequence: Synthetic oligonucleotide
  Target: SCN9A; (+) strand; PAM type: YTN; PAM sequence: TTG
gtccagagcaatgattattt

SEQ ID NO: 98771 - DNA, 20 bp, Artificial Sequence
  Description of Artificial Sequence: Synthetic oligonucleotide
  Target: SCN9A; (+) strand; PAM type: YTN; PAM sequence: TTA
tttggagttcatggacctgt

SEQ ID NO: 98772 - DNA, 20 bp, Artificial Sequence
  Description of Artificial Sequence: Synthetic oligonucleotide
  Target: SCN9A; (+) strand; PAM type: YTN; PAM sequence: TTT
ggagttcatggacctgtaga

SEQ ID NO: 98773 - DNA, 20 bp, Artificial Sequence
  Description of Artificial Sequence: Synthetic oligonucleotide
  Target: SCN9A; (+) strand; PAM type: YTN; PAM sequence: TTG
gagttcatggacctgtagag

SEQ ID NO: 98774 - DNA, 20 bp, Artificial Sequence
  Description of Artificial Sequence: Synthetic oligonucleotide
  Target: SCN9A; (+) strand; PAM type: YTN; PAM sequence: TTC
atggacctgtagaggtttcc

SEQ ID NO: 98775 - DNA, 20 bp, Artificial Sequence
  Description of Artificial Sequence: Synthetic oligonucleotide
  Target: SCN9A; (+) strand; PAM type: YTN; PAM sequence: CTG
tagaggtttcctgggggcat

SEQ ID NO: 98776 - DNA, 20 bp, Artificial Sequence
  Description of Artificial Sequence: Synthetic oligonucleotide
  Target: SCN9A; (+) strand; PAM type: YTN; PAM sequence: TTT
cctgggggcatgaaattata

SEQ ID NO: 98777 - DNA, 20 bp, Artificial Sequence
  Description of Artificial Sequence: Synthetic oligonucleotide
  Target: SCN9A; (+) strand; PAM type: YTN; PAM sequence: TTC
ctgggggcatgaaattatat

SEQ ID NO: 98778 - DNA, 20 bp, Artificial Sequence
  Description of Artificial Sequence: Synthetic oligonucleotide
  Target: SCN9A; (+) strand; PAM type: YTN; PAM sequence: CTG
ggggcatgaaattatataac

SEQ ID NO: 98779 - DNA, 20 bp, Artificial Sequence
  Description of Artificial Sequence: Synthetic oligonucleotide
  Target: SCN9A; (+) strand; PAM type: YTN; PAM sequence: TTA
tataacaaacattatggttg

SEQ ID NO: 98780 - DNA, 20 bp, Artificial Sequence
  Description of Artificial Sequence: Synthetic oligonucleotide
  Target: SCN9A; (+) strand; PAM type: YTN; PAM sequence: TTA
tggttgtgctgtctttccgg

SEQ ID NO: 98781 - DNA, 20 bp, Artificial Sequence
  Description of Artificial Sequence: Synthetic oligonucleotide
  Target: SCN9A; (+) strand; PAM type: YTN; PAM sequence: TTG
tgctgtctttccggaaagac

SEQ ID NO: 98782 - DNA, 20 bp, Artificial Sequence
  Description of Artificial Sequence: Synthetic oligonucleotide
  Target: SCN9A; (+) strand; PAM type: YTN; PAM sequence: CTG
tctttccggaaagacaattc

SEQ ID NO: 98783 - DNA, 20 bp, Artificial Sequence
  Description of Artificial Sequence: Synthetic oligonucleotide
  Target: SCN9A; (+) strand; PAM type: YTN; PAM sequence: CTT
tccggaaagacaattctaac

SEQ ID NO: 98784 - DNA, 20 bp, Artificial Sequence
  Description of Artificial Sequence: Synthetic oligonucleotide
  Target: SCN9A; (+) strand; PAM type: YTN; PAM sequence: TTT
ccggaaagacaattctaact

SEQ ID NO: 98785 - DNA, 20 bp, Artificial Sequence
  Description of Artificial Sequence: Synthetic oligonucleotide
  Target: SCN9A; (+) strand; PAM type: YTN; PAM sequence: TTC
cggaaagacaattctaactt

SEQ ID NO: 98786 - DNA, 20 bp, Artificial Sequence
  Description of Artificial Sequence: Synthetic oligonucleotide
  Target: SCN9A; (+) strand; PAM type: YTN; PAM sequence: TTC
taactttcatcagattctta

SEQ ID NO: 98787 - DNA, 20 bp, Artificial Sequence
  Description of Artificial Sequence: Synthetic oligonucleotide
  Target: SCN9A; (+) strand; PAM type: YTN; PAM sequence: CTA
actttcatcagattcttaca

SEQ ID NO: 98788 - DNA, 20 bp, Artificial Sequence
  Description of Artificial Sequence: Synthetic oligonucleotide
  Target: SCN9A; (+) strand; PAM type: YTN; PAM sequence: CTT
tcatcagattcttacagtct

SEQ ID NO: 98789 - DNA, 20 bp, Artificial Sequence
  Description of Artificial Sequence: Synthetic oligonucleotide
  Target: SCN9A; (+) strand; PAM type: YTN; PAM sequence: TTT
catcagattcttacagtcta

SEQ ID NO: 98790 - DNA, 20 bp, Artificial Sequence
  Description of Artificial Sequence: Synthetic oligonucleotide
  Target: SCN9A; (+) strand; PAM type: YTN; PAM sequence: TTC
atcagattcttacagtctat

SEQ ID NO: 98791 - DNA, 20 bp, Artificial Sequence
  Description of Artificial Sequence: Synthetic oligonucleotide
  Target: SCN9A; (+) strand; PAM type: YTN; PAM sequence: TTC
ttacagtctatgtgacctca

SEQ ID NO: 98792 - DNA, 20 bp, Artificial Sequence
  Description of Artificial Sequence: Synthetic oligonucleotide
  Target: SCN9A; (+) strand; PAM type: YTN; PAM sequence: CTT
acagtctatgtgacctcaaa

SEQ ID NO: 98793 - DNA, 20 bp, Artificial Sequence
  Description of Artificial Sequence: Synthetic oligonucleotide
  Target: SCN9A; (+) strand; PAM type: YTN; PAM sequence: TTA
cagtctatgtgacctcaaaa

SEQ ID NO: 98794 - DNA, 20 bp, Artificial Sequence
  Description of Artificial Sequence: Synthetic oligonucleotide
  Target: SCN9A; (+) strand; PAM type: YTN; PAM sequence: CTA
tgtgacctcaaaaaagatta

SEQ ID NO: 98795 - DNA, 20 bp, Artificial Sequence
  Description of Artificial Sequence: Synthetic oligonucleotide
  Target: SCN9A; (+) strand; PAM type: YTN; PAM sequence: CTC
aaaaaagattaggaggaata

SEQ ID NO: 98796 - DNA, 20 bp, Artificial Sequence
  Description of Artificial Sequence: Synthetic oligonucleotide
  Target: SCN9A; (+) strand; PAM type: YTN; PAM sequence: TTA
ggaggaataggaatagagaa

SEQ ID NO: 98797 - DNA, 20 bp, Artificial Sequence
  Description of Artificial Sequence: Synthetic oligonucleotide
  Target: SCN9A; (+) strand; PAM type: YTN; PAM sequence: TTC
aaagtagccagctcttaata

SEQ ID NO: 98798 - DNA, 20 bp, Artificial Sequence
  Description of Artificial Sequence: Synthetic oligonucleotide
  Target: SCN9A; (+) strand; PAM type: YTN; PAM sequence: CTC
ttaatagagcctaccttttc

SEQ ID NO: 98799 - DNA, 20 bp, Artificial Sequence
  Description of Artificial Sequence: Synthetic oligonucleotide
  Target: SCN9A; (+) strand; PAM type: YTN; PAM sequence: CTT
aatagagcctaccttttcat

SEQ ID NO: 98800 - DNA, 20 bp, Artificial Sequence
  Description of Artificial Sequence: Synthetic oligonucleotide
  Target: SCN9A; (+) strand; PAM type: YTN; PAM sequence: TTA
atagagcctaccttttcatg

SEQ ID NO: 98801 - DNA, 20 bp, Artificial Sequence
  Description of Artificial Sequence: Synthetic oligonucleotide
  Target: SCN9A; (+) strand; PAM type: YTN; PAM sequence: CTA
ccttttcatgctcatttcct

SEQ ID NO: 98802 - DNA, 20 bp, Artificial Sequence
  Description of Artificial Sequence: Synthetic oligonucleotide
  Target: SCN9A; (+) strand; PAM type: YTN; PAM sequence: CTT
ttcatgctcatttcctgctg

SEQ ID NO: 98803 - DNA, 20 bp, Artificial Sequence
  Description of Artificial Sequence: Synthetic oligonucleotide
  Target: SCN9A; (+) strand; PAM type: YTN; PAM sequence: TTT
tcatgctcatttcctgctgc

SEQ ID NO: 98804 - DNA, 20 bp, Artificial Sequence
  Description of Artificial Sequence: Synthetic oligonucleotide
  Target: SCN9A; (+) strand; PAM type: YTN; PAM sequence: TTT
catgctcatttcctgctgcc

SEQ ID NO: 98805 - DNA, 20 bp, Artificial Sequence
  Description of Artificial Sequence: Synthetic oligonucleotide
  Target: SCN9A; (+) strand; PAM type: YTN; PAM sequence: TTC
atgctcatttcctgctgccc

SEQ ID NO: 98806 - DNA, 20 bp, Artificial Sequence
  Description of Artificial Sequence: Synthetic oligonucleotide
  Target: SCN9A; (+) strand; PAM type: YTN; PAM sequence: CTC
atttcctgctgccctcccta

SEQ ID NO: 98807 - DNA, 20 bp, Artificial Sequence
  Description of Artificial Sequence: Synthetic oligonucleotide
  Target: SCN9A; (+) strand; PAM type: YTN; PAM sequence: TTT
cctgctgccctccctactat

SEQ ID NO: 98808 - DNA, 20 bp, Artificial Sequence
  Description of Artificial Sequence: Synthetic oligonucleotide
  Target: SCN9A; (+) strand; PAM type: YTN; PAM sequence: TTC
ctgctgccctccctactatg

SEQ ID NO: 98809 - DNA, 20 bp, Artificial Sequence
  Description of Artificial Sequence: Synthetic oligonucleotide
  Target: SCN9A; (+) strand; PAM type: YTN; PAM sequence: CTG
ctgccctccctactatgttt

SEQ ID NO: 98810 - DNA, 20 bp, Artificial Sequence
  Description of Artificial Sequence: Synthetic oligonucleotide
  Target: SCN9A; (+) strand; PAM type: YTN; PAM sequence: CTG
ccctccctactatgtttatc

SEQ ID NO: 98811 - DNA, 20 bp, Artificial Sequence
  Description of Artificial Sequence: Synthetic oligonucleotide
  Target: SCN9A; (+) strand; PAM type: YTN; PAM sequence: CTC
cctactatgtttatcacgta

SEQ ID NO: 98812 - DNA, 20 bp, Artificial Sequence
  Description of Artificial Sequence: Synthetic oligonucleotide
  Target: SCN9A; (+) strand; PAM type: YTN; PAM sequence: CTA
ctatgtttatcacgtaggca

SEQ ID NO: 98813 - DNA, 20 bp, Artificial Sequence
  Description of Artificial Sequence: Synthetic oligonucleotide
  Target: SCN9A; (+) strand; PAM type: YTN; PAM sequence: CTA
tgtttatcacgtaggcactc

SEQ ID NO: 98814 - DNA, 20 bp, Artificial Sequence
  Description of Artificial Sequence: Synthetic oligonucleotide
  Target: SCN9A; (+) strand; PAM type: YTN; PAM sequence: TTT
atcacgtaggcactctgata

SEQ ID NO: 98815 - DNA, 20 bp, Artificial Sequence
  Description of Artificial Sequence: Synthetic oligonucleotide
  Target: SCN9A; (+) strand; PAM type: YTN; PAM sequence: TTA
tcacgtaggcactctgatac

SEQ ID NO: 98816 - DNA, 20 bp, Artificial Sequence
  Description of Artificial Sequence: Synthetic oligonucleotide
  Target: SCN9A; (+) strand; PAM type: YTN; PAM sequence: CTC
tgatacatctagtcactgac

SEQ ID NO: 98817 - DNA, 20 bp, Artificial Sequence
  Description of Artificial Sequence: Synthetic oligonucleotide
  Target: SCN9A; (+) strand; PAM type: YTN; PAM sequence: CTG
atacatctagtcactgacca

SEQ ID NO: 98818 - DNA, 20 bp, Artificial Sequence
  Description of Artificial Sequence: Synthetic oligonucleotide
  Target: SCN9A; (+) strand; PAM type: YTN; PAM sequence: CTA
gtcactgaccaagcacacct

SEQ ID NO: 98819 - DNA, 20 bp, Artificial Sequence
  Description of Artificial Sequence: Synthetic oligonucleotide
  Target: SCN9A; (+) strand; PAM type: YTN; PAM sequence: CTG
accaagcacaccttgcacaa

SEQ ID NO: 98820 - DNA, 20 bp, Artificial Sequence
  Description of Artificial Sequence: Synthetic oligonucleotide
  Target: SCN9A; (+) strand; PAM type: YTN; PAM sequence: CTT
gcacaatctattctgtgcct

SEQ ID NO: 98821 - DNA, 20 bp, Artificial Sequence
  Description of Artificial Sequence: Synthetic oligonucleotide
  Target: SCN9A; (+) strand; PAM type: YTN; PAM sequence: TTG
cacaatctattctgtgcctc

SEQ ID NO: 98822 - DNA, 20 bp, Artificial Sequence
  Description of Artificial Sequence: Synthetic oligonucleotide
  Target: SCN9A; (+) strand; PAM type: YTN; PAM sequence: CTA
ttctgtgcctccctaccatg

SEQ ID NO: 98823 - DNA, 20 bp, Artificial Sequence
  Description of Artificial Sequence: Synthetic oligonucleotide
  Target: SCN9A; (+) strand; PAM type: YTN; PAM sequence: TTC
tgtgcctccctaccatgtgg

SEQ ID NO: 98824 - DNA, 20 bp, Artificial Sequence
  Description of Artificial Sequence: Synthetic oligonucleotide
  Target: SCN9A; (+) strand; PAM type: YTN; PAM sequence: CTG
tgcctccctaccatgtggta

SEQ ID NO: 98825 - DNA, 20 bp, Artificial Sequence
  Description of Artificial Sequence: Synthetic oligonucleotide
  Target: SCN9A; (+) strand; PAM type: YTN; PAM sequence: CTC
cctaccatgtggtatcactg

SEQ ID NO: 98826 - DNA, 20 bp, Artificial Sequence
  Description of Artificial Sequence: Synthetic oligonucleotide
  Target: SCN9A; (+) strand; PAM type: YTN; PAM sequence: CTA
ccatgtggtatcactgcctt

SEQ ID NO: 98827 - DNA, 20 bp, Artificial Sequence
  Description of Artificial Sequence: Synthetic oligonucleotide
  Target: SCN9A; (+) strand; PAM type: YTN; PAM sequence: CTG
ccttgaatgcctatctgcct

SEQ ID NO: 98828 - DNA, 20 bp, Artificial Sequence
  Description of Artificial Sequence: Synthetic oligonucleotide
  Target: SCN9A; (+) strand; PAM type: YTN; PAM sequence: CTT
gaatgcctatctgcctatga

SEQ ID NO: 98829 - DNA, 20 bp, Artificial Sequence
  Description of Artificial Sequence: Synthetic oligonucleotide
  Target: SCN9A; (+) strand; PAM type: YTN; PAM sequence: TTG
aatgcctatctgcctatgat

SEQ ID NO: 98830 - DNA, 20 bp, Artificial Sequence
  Description of Artificial Sequence: Synthetic oligonucleotide
  Target: SCN9A; (+) strand; PAM type: YTN; PAM sequence: CTA
tctgcctatgatttggggct

SEQ ID NO: 98831 - DNA, 20 bp, Artificial Sequence
  Description of Artificial Sequence: Synthetic oligonucleotide
  Target: SCN9A; (+) strand; PAM type: YTN; PAM sequence: CTG
cctatgatttggggcttact

SEQ ID NO: 98832 - DNA, 20 bp, Artificial Sequence
  Description of Artificial Sequence: Synthetic oligonucleotide
  Target: SCN9A; (+) strand; PAM type: YTN; PAM sequence: CTA
tgatttggggcttactcttc

SEQ ID NO: 98833 - DNA, 20 bp, Artificial Sequence
  Description of Artificial Sequence: Synthetic oligonucleotide
  Target: SCN9A; (+) strand; PAM type: YTN; PAM sequence: TTT
ggggcttactcttcagtcat

SEQ ID NO: 98834 - DNA, 20 bp, Artificial Sequence
  Description of Artificial Sequence: Synthetic oligonucleotide
  Target: SCN9A; (+) strand; PAM type: YTN; PAM sequence: TTG
gggcttactcttcagtcatg

SEQ ID NO: 98835 - DNA, 20 bp, Artificial Sequence
  Description of Artificial Sequence: Synthetic oligonucleotide
  Target: SCN9A; (+) strand; PAM type: YTN; PAM sequence: CTT
actcttcagtcatgaaatgt

SEQ ID NO: 98836 - DNA, 20 bp, Artificial Sequence
  Description of Artificial Sequence: Synthetic oligonucleotide
  Target: SCN9A; (+) strand; PAM type: YTN; PAM sequence: TTA
ctcttcagtcatgaaatgtc

SEQ ID NO: 98837 - DNA, 20 bp, Artificial Sequence
  Description of Artificial Sequence: Synthetic oligonucleotide
  Target: SCN9A; (+) strand; PAM type: YTN; PAM sequence: CTC
ttcagtcatgaaatgtctga

SEQ ID NO: 98838 - DNA, 20 bp, Artificial Sequence
  Description of Artificial Sequence: Synthetic oligonucleotide
  Target: SCN9A; (+) strand; PAM type: YTN; PAM sequence: CTT
cagtcatgaaatgtctgaaa

SEQ ID NO: 98839 - DNA, 20 bp, Artificial Sequence
  Description of Artificial Sequence: Synthetic oligonucleotide
  Target: SCN9A; (+) strand; PAM type: YTN; PAM sequence: TTC
agtcatgaaatgtctgaaat

SEQ ID NO: 98840 - DNA, 20 bp, Artificial Sequence
  Description of Artificial Sequence: Synthetic oligonucleotide
  Target: SCN9A; (+) strand; PAM type: YTN; PAM sequence: CTG
aaatgtcacctccttgtgat

SEQ ID NO: 98841 - DNA, 20 bp, Artificial Sequence
  Description of Artificial Sequence: Synthetic oligonucleotide
  Target: SCN9A; (+) strand; PAM type: YTN; PAM sequence: CTC
cttgtgatgtcttcccagac

SEQ ID NO: 98842 - DNA, 20 bp, Artificial Sequence
  Description of Artificial Sequence: Synthetic oligonucleotide
  Target: SCN9A; (+) strand; PAM type: YTN; PAM sequence: CTT
gtgatgtcttcccagacttc

SEQ ID NO: 98843 - DNA, 20 bp, Artificial Sequence
  Description of Artificial Sequence: Synthetic oligonucleotide
  Target: SCN9A; (+) strand; PAM type: YTN; PAM sequence: TTG
tgatgtcttcccagacttcc

SEQ ID NO: 98844 - DNA, 20 bp, Artificial Sequence
  Description of Artificial Sequence: Synthetic oligonucleotide
  Target: SCN9A; (+) strand; PAM type: YTN; PAM sequence: CTT
cccagacttccccggatagc

SEQ ID NO: 98845 - DNA, 20 bp, Artificial Sequence
  Description of Artificial Sequence: Synthetic oligonucleotide
  Target: SCN9A; (+) strand; PAM type: YTN; PAM sequence: TTC
ccagacttccccggatagcc

SEQ ID NO: 98846 - DNA, 20 bp, Artificial Sequence
  Description of Artificial Sequence: Synthetic oligonucleotide
  Target: SCN9A; (+) strand; PAM type: YTN; PAM sequence: CTT
ccccggatagccactcccta

SEQ ID NO: 98847 - DNA, 20 bp, Artificial Sequence
  Description of Artificial Sequence: Synthetic oligonucleotide
  Target: SCN9A; (+) strand; PAM type: YTN; PAM sequence: TTC
cccggatagccactccctac

SEQ ID NO: 98848 - DNA, 20 bp, Artificial Sequence
  Description of Artificial Sequence: Synthetic oligonucleotide
  Target: SCN9A; (+) strand; PAM type: YTN; PAM sequence: CTC
cctactgtatattcctgtat

SEQ ID NO: 98849 - DNA, 20 bp, Artificial Sequence
  Description of Artificial Sequence: Synthetic oligonucleotide
  Target: SCN9A; (+) strand; PAM type: YTN; PAM sequence: CTA
ctgtatattcctgtatcatt

SEQ ID NO: 98850 - DNA, 20 bp, Artificial Sequence
  Description of Artificial Sequence: Synthetic oligonucleotide
  Target: SCN9A; (+) strand; PAM type: YTN; PAM sequence: CTG
tatattcctgtatcattatg

SEQ ID NO: 98851 - DNA, 20 bp, Artificial Sequence
  Description of Artificial Sequence: Synthetic oligonucleotide
  Target: SCN9A; (+) strand; PAM type: YTN; PAM sequence: TTC
ctgtatcattatgtgccctt

SEQ ID NO: 98852 - DNA, 20 bp, Artificial Sequence
  Description of Artificial Sequence: Synthetic oligonucleotide
  Target: SCN9A; (+) strand; PAM type: YTN; PAM sequence: CTG
tatcattatgtgcccttgtc

SEQ ID NO: 98853 - DNA, 20 bp, Artificial Sequence
  Description of Artificial Sequence: Synthetic oligonucleotide
  Target: SCN9A; (+) strand; PAM type: YTN; PAM sequence: TTA
tgtgcccttgtctgtctctc

SEQ ID NO: 98854 - DNA, 20 bp, Artificial Sequence
  Description of Artificial Sequence: Synthetic oligonucleotide
  Target: SCN9A; (+) strand; PAM type: YTN; PAM sequence: CTT
gtctgtctctcttgtaacca

SEQ ID NO: 98855 - DNA, 20 bp, Artificial Sequence
  Description of Artificial Sequence: Synthetic oligonucleotide
  Target: SCN9A; (+) strand; PAM type: YTN; PAM sequence: TTG
tctgtctctcttgtaaccat

SEQ ID NO: 98856 - DNA, 20 bp, Artificial Sequence
  Description of Artificial Sequence: Synthetic oligonucleotide
  Target: SCN9A; (+) strand; PAM type: YTN; PAM sequence: CTG
tctctcttgtaaccattgac

SEQ ID NO: 98857 - DNA, 20 bp, Artificial Sequence
  Description of Artificial Sequence: Synthetic oligonucleotide
  Target: SCN9A; (+) strand; PAM type: YTN; PAM sequence: CTC
tcttgtaaccattgacccta

SEQ ID NO: 98858 - DNA, 20 bp, Artificial Sequence
  Description of Artificial Sequence: Synthetic oligonucleotide
  Target: SCN9A; (+) strand; PAM type: YTN; PAM sequence: CTC
ttgtaaccattgaccctact

SEQ ID NO: 98859 - DNA, 20 bp, Artificial Sequence
  Description of Artificial Sequence: Synthetic oligonucleotide
  Target: SCN9A; (+) strand; PAM type: YTN; PAM sequence: CTT
gtaaccattgaccctactca

SEQ ID NO: 98860 - DNA, 20 bp, Artificial Sequence
  Description of Artificial Sequence: Synthetic oligonucleotide
  Target: SCN9A; (+) strand; PAM type: YTN; PAM sequence: TTG
taaccattgaccctactcac

SEQ ID NO: 98861 - DNA, 20 bp, Artificial Sequence
  Description of Artificial Sequence: Synthetic oligonucleotide
  Target: SCN9A; (+) strand; PAM type: YTN; PAM sequence: TTG
accctactcactctttgggg

SEQ ID NO: 98862 - DNA, 20 bp, Artificial Sequence
  Description of Artificial Sequence: Synthetic oligonucleotide
  Target: SCN9A; (+) strand; PAM type: YTN; PAM sequence: CTA
ctcactctttggggaccggg

SEQ ID NO: 98863 - DNA, 20 bp, Artificial Sequence
  Description of Artificial Sequence: Synthetic oligonucleotide
  Target: SCN9A; (+) strand; PAM type: YTN; PAM sequence: CTC
actctttggggaccggggtc

SEQ ID NO: 98864 - DNA, 20 bp, Artificial Sequence
  Description of Artificial Sequence: Synthetic oligonucleotide
  Target: SCN9A; (+) strand; PAM type: YTN; PAM sequence: CTC
tttggggaccggggtctatg

SEQ ID NO: 98865 - DNA, 20 bp, Artificial Sequence
  Description of Artificial Sequence: Synthetic oligonucleotide
  Target: SCN9A; (+) strand; PAM type: YTN; PAM sequence: CTT
tggggaccggggtctatgta

SEQ ID NO: 98866 - DNA, 20 bp, Artificial Sequence
  Description of Artificial Sequence: Synthetic oligonucleotide
  Target: SCN9A; (+) strand; PAM type: YTN; PAM sequence: TTT
ggggaccggggtctatgtac

SEQ ID NO: 98867 - DNA, 20 bp, Artificial Sequence
  Description of Artificial Sequence: Synthetic oligonucleotide
  Target: SCN9A; (+) strand; PAM type: YTN; PAM sequence: TTG
gggaccggggtctatgtacc

SEQ ID NO: 98868 - DNA, 20 bp, Artificial Sequence
  Description of Artificial Sequence: Synthetic oligonucleotide
  Target: SCN9A; (+) strand; PAM type: YTN; PAM sequence: CTA
tgtaccactgtactctgtgt

SEQ ID NO: 98869 - DNA, 20 bp, Artificial Sequence
  Description of Artificial Sequence: Synthetic oligonucleotide
  Target: SCN9A; (+) strand; PAM type: YTN; PAM sequence: CTG
tactctgtgttttttatatc

SEQ ID NO: 98870 - DNA, 20 bp, Artificial Sequence
  Description of Artificial Sequence: Synthetic oligonucleotide
  Target: SCN9A; (+) strand; PAM type: YTN; PAM sequence: CTC
tgtgttttttatatcacaac

SEQ ID NO: 98871 - DNA, 20 bp, Artificial Sequence
  Description of Artificial Sequence: Synthetic oligonucleotide
  Target: SCN9A; (+) strand; PAM type: YTN; PAM sequence: CTG
tgttttttatatcacaacac

SEQ ID NO: 98872 - DNA, 20 bp, Artificial Sequence
  Description of Artificial Sequence: Synthetic oligonucleotide
  Target: SCN9A; (+) strand; PAM type: YTN; PAM sequence: TTT
tttatatcacaacacctgac

SEQ ID NO: 98873 - DNA, 20 bp, Artificial Sequence
  Description of Artificial Sequence: Synthetic oligonucleotide
  Target: SCN9A; (+) strand; PAM type: YTN; PAM sequence: TTT
ttatatcacaacacctgaca

SEQ ID NO: 98874 - DNA, 20 bp, Artificial Sequence
  Description of Artificial Sequence: Synthetic oligonucleotide
  Target: SCN9A; (+) strand; PAM type: YTN; PAM sequence: TTT
tatatcacaacacctgacac

SEQ ID NO: 98875 - DNA, 20 bp, Artificial Sequence
  Description of Artificial Sequence: Synthetic oligonucleotide
  Target: SCN9A; (+) strand; PAM type: YTN; PAM sequence: TTT
atatcacaacacctgacaca

SEQ ID NO: 98876 - DNA, 20 bp, Artificial Sequence
  Description of Artificial Sequence: Synthetic oligonucleotide
  Target: SCN9A; (+) strand; PAM type: YTN; PAM sequence: TTA
tatcacaacacctgacacat

SEQ ID NO: 98877 - DNA, 20 bp, Artificial Sequence
  Description of Artificial Sequence: Synthetic oligonucleotide
  Target: SCN9A; (+) strand; PAM type: YTN; PAM sequence: CTG
acacatagttggtgtttaaa

SEQ ID NO: 98878 - DNA, 20 bp, Artificial Sequence
  Description of Artificial Sequence: Synthetic oligonucleotide
  Target: SCN9A; (+) strand; PAM type: YTN; PAM sequence: TTG
gtgtttaaaatgtttttcta

SEQ ID NO: 98879 - DNA, 20 bp, Artificial Sequence
  Description of Artificial Sequence: Synthetic oligonucleotide
  Target: SCN9A; (+) strand; PAM type: YTN; PAM sequence: TTT
aaaatgtttttctaaaaaat

SEQ ID NO: 98880 - DNA, 20 bp, Artificial Sequence
  Description of Artificial Sequence: Synthetic oligonucleotide
  Target: SCN9A; (+) strand; PAM type: YTN; PAM sequence: TTA
aaatgtttttctaaaaaatg

SEQ ID NO: 98881 - DNA, 20 bp, Artificial Sequence
  Description of Artificial Sequence: Synthetic oligonucleotide
  Target: SCN9A; (+) strand; PAM type: YTN; PAM sequence: TTT
ttctaaaaaatgtgagtaat

SEQ ID NO: 98882 - DNA, 20 bp, Artificial Sequence
  Description of Artificial Sequence: Synthetic oligonucleotide
  Target: SCN9A; (+) strand; PAM type: YTN; PAM sequence: TTT
tctaaaaaatgtgagtaatg

SEQ ID NO: 98883 - DNA, 20 bp, Artificial Sequence
  Description of Artificial Sequence: Synthetic oligonucleotide
  Target: SCN9A; (+) strand; PAM type: YTN; PAM sequence: TTT
ctaaaaaatgtgagtaatga

SEQ ID NO: 98884 - DNA, 20 bp, Artificial Sequence
  Description of Artificial Sequence: Synthetic oligonucleotide
  Target: SCN9A; (+) strand; PAM type: YTN; PAM sequence: TTC
taaaaaatgtgagtaatgat

SEQ ID NO: 98885 - DNA, 20 bp, Artificial Sequence
  Description of Artificial Sequence: Synthetic oligonucleotide
  Target: SCN9A; (+) strand; PAM type: YTN; PAM sequence: CTA
aaaaatgtgagtaatgatgg

SEQ ID NO: 98886 - DNA, 20 bp, Artificial Sequence
  Description of Artificial Sequence: Synthetic oligonucleotide
  Target: SCN9A; (+) strand; PAM type: YTN; PAM sequence: CTC
tgagaaagacaggcacctat

SEQ ID NO: 98887 - DNA, 20 bp, Artificial Sequence
  Description of Artificial Sequence: Synthetic oligonucleotide
  Target: SCN9A; (+) strand; PAM type: YTN; PAM sequence: CTG
agaaagacaggcacctattg

SEQ ID NO: 98888 - DNA, 20 bp, Artificial Sequence
  Description of Artificial Sequence: Synthetic oligonucleotide
  Target: SCN9A; (+) strand; PAM type: YTN; PAM sequence: CTA
ttggtctgatgagaagccag

SEQ ID NO: 98889 - DNA, 20 bp, Artificial Sequence
  Description of Artificial Sequence: Synthetic oligonucleotide
  Target: SCN9A; (+) strand; PAM type: YTN; PAM sequence: TTG
gtctgatgagaagccagttg

SEQ ID NO: 98890 - DNA, 20 bp, Artificial Sequence
  Description of Artificial Sequence: Synthetic oligonucleotide
  Target: SCN9A; (+) strand; PAM type: YTN; PAM sequence: CTG
atgagaagccagttgggaaa

SEQ ID NO: 98891 - DNA, 20 bp, Artificial Sequence
  Description of Artificial Sequence: Synthetic oligonucleotide
  Target: SCN9A; (+) strand; PAM type: YTN; PAM sequence: TTG
ggaaagctaaagagcctaag

SEQ ID NO: 98892 - DNA, 20 bp, Artificial Sequence
  Description of Artificial Sequence: Synthetic oligonucleotide
  Target: SCN9A; (+) strand; PAM type: YTN; PAM sequence: CTA
aagagcctaaggactcaaac

SEQ ID NO: 98893 - DNA, 20 bp, Artificial Sequence
  Description of Artificial Sequence: Synthetic oligonucleotide
  Target: SCN9A; (+) strand; PAM type: YTN; PAM sequence: CTA
aggactcaaacaagctgact

SEQ ID NO: 98894 - DNA, 20 bp, Artificial Sequence
  Description of Artificial Sequence: Synthetic oligonucleotide
  Target: SCN9A; (+) strand; PAM type: YTN; PAM sequence: CTC
aaacaagctgactacaatat

SEQ ID NO: 98895 - DNA, 20 bp, Artificial Sequence
  Description of Artificial Sequence: Synthetic oligonucleotide
  Target: SCN9A; (+) strand; PAM type: YTN; PAM sequence: CTG
actacaatatgcctcaaatg

SEQ ID NO: 98896 - DNA, 20 bp, Artificial Sequence
  Description of Artificial Sequence: Synthetic oligonucleotide
  Target: SCN9A; (+) strand; PAM type: YTN; PAM sequence: CTA
caatatgcctcaaatgcatt

SEQ ID NO: 98897 - DNA, 20 bp, Artificial Sequence
  Description of Artificial Sequence: Synthetic oligonucleotide
  Target: SCN9A; (+) strand; PAM type: YTN; PAM sequence: CTC
aaatgcattatttcattatt

SEQ ID NO: 98898 - DNA, 20 bp, Artificial Sequence
  Description of Artificial Sequence: Synthetic oligonucleotide
  Target: SCN9A; (+) strand; PAM type: YTN; PAM sequence: TTA
tttcattatttcatttatcc

SEQ ID NO: 98899 - DNA, 20 bp, Artificial Sequence
  Description of Artificial Sequence: Synthetic oligonucleotide
  Target: SCN9A; (+) strand; PAM type: YTN; PAM sequence: TTT
cattatttcatttatccttc

SEQ ID NO: 98900 - DNA, 20 bp, Artificial Sequence
  Description of Artificial Sequence: Synthetic oligonucleotide
  Target: SCN9A; (+) strand; PAM type: YTN; PAM sequence: TTC
attatttcatttatccttca

SEQ ID NO: 98901 - DNA, 20 bp, Artificial Sequence
  Description of Artificial Sequence: Synthetic oligonucleotide
  Target: SCN9A; (+) strand; PAM type: YTN; PAM sequence: TTA
tttcatttatccttcaaaat

SEQ ID NO: 98902 - DNA, 20 bp, Artificial Sequence
  Description of Artificial Sequence: Synthetic oligonucleotide
  Target: SCN9A; (+) strand; PAM type: YTN; PAM sequence: TTT
catttatccttcaaaatagc

SEQ ID NO: 98903 - DNA, 20 bp, Artificial Sequence
  Description of Artificial Sequence: Synthetic oligonucleotide
  Target: SCN9A; (+) strand; PAM type: YTN; PAM sequence: TTC
atttatccttcaaaatagcc

SEQ ID NO: 98904 - DNA, 20 bp, Artificial Sequence
  Description of Artificial Sequence: Synthetic oligonucleotide
  Target: SCN9A; (+) strand; PAM type: YTN; PAM sequence: TTT
atccttcaaaatagccctgc

SEQ ID NO: 98905 - DNA, 20 bp, Artificial Sequence
  Description of Artificial Sequence: Synthetic oligonucleotide
  Target: SCN9A; (+) strand; PAM type: YTN; PAM sequence: TTA
tccttcaaaatagccctgcg

SEQ ID NO: 98906 - DNA, 20 bp, Artificial Sequence
  Description of Artificial Sequence: Synthetic oligonucleotide
  Target: SCN9A; (+) strand; PAM type: YTN; PAM sequence: CTT
caaaatagccctgcggcatg

SEQ ID NO: 98907 - DNA, 20 bp, Artificial Sequence
  Description of Artificial Sequence: Synthetic oligonucleotide
  Target: SCN9A; (+) strand; PAM type: YTN; PAM sequence: TTC
aaaatagccctgcggcatga

SEQ ID NO: 98908 - DNA, 20 bp, Artificial Sequence
  Description of Artificial Sequence: Synthetic oligonucleotide
  Target: SCN9A; (+) strand; PAM type: YTN; PAM sequence: CTG
cggcatgaataaatgtctct

SEQ ID NO: 98909 - DNA, 20 bp, Artificial Sequence
  Description of Artificial Sequence: Synthetic oligonucleotide
  Target: SCN9A; (+) strand; PAM type: YTN; PAM sequence: CTC
tttttgcatggttaacaaat

SEQ ID NO: 98910 - DNA, 20 bp, Artificial Sequence
  Description of Artificial Sequence: Synthetic oligonucleotide
  Target: SCN9A; (+) strand; PAM type: YTN; PAM sequence: CTT
tttgcatggttaacaaatgt

SEQ ID NO: 98911 - DNA, 20 bp, Artificial Sequence
  Description of Artificial Sequence: Synthetic oligonucleotide
  Target: SCN9A; (+) strand; PAM type: YTN; PAM sequence: TTT
ttgcatggttaacaaatgta

SEQ ID NO: 98912 - DNA, 20 bp, Artificial Sequence
  Description of Artificial Sequence: Synthetic oligonucleotide
  Target: SCN9A; (+) strand; PAM type: YTN; PAM sequence: TTT
tgcatggttaacaaatgtaa

SEQ ID NO: 98913 - DNA, 20 bp, Artificial Sequence
  Description of Artificial Sequence: Synthetic oligonucleotide
  Target: SCN9A; (+) strand; PAM type: YTN; PAM sequence: TTT
gcatggttaacaaatgtaac

SEQ ID NO: 98914 - DNA, 20 bp, Artificial Sequence
  Description of Artificial Sequence: Synthetic oligonucleotide
  Target: SCN9A; (+) strand; PAM type: YTN; PAM sequence: TTG
catggttaacaaatgtaact

SEQ ID NO: 98915 - DNA, 20 bp, Artificial Sequence
  Description of Artificial Sequence: Synthetic oligonucleotide
  Target: SCN9A; (+) strand; PAM type: YTN; PAM sequence: TTA
acaaatgtaactaaatagac

SEQ ID NO: 98916 - DNA, 20 bp, Artificial Sequence
  Description of Artificial Sequence: Synthetic oligonucleotide
  Target: SCN9A; (+) strand; PAM type: YTN; PAM sequence: CTA
aatagacatttgcctctcaa

SEQ ID NO: 98917 - DNA, 20 bp, Artificial Sequence
  Description of Artificial Sequence: Synthetic oligonucleotide
  Target: SCN9A; (+) strand; PAM type: YTN; PAM sequence: TTT
gcctctcaaaatatactaaa

SEQ ID NO: 98918 - DNA, 20 bp, Artificial Sequence
  Description of Artificial Sequence: Synthetic oligonucleotide
  Target: SCN9A; (+) strand; PAM type: YTN; PAM sequence: TTG
cctctcaaaatatactaaac

SEQ ID NO: 98919 - DNA, 20 bp, Artificial Sequence
  Description of Artificial Sequence: Synthetic oligonucleotide
  Target: SCN9A; (+) strand; PAM type: YTN; PAM sequence: CTC
tcaaaatatactaaactatt

SEQ ID NO: 98920 - DNA, 20 bp, Artificial Sequence
  Description of Artificial Sequence: Synthetic oligonucleotide
  Target: SCN9A; (+) strand; PAM type: YTN; PAM sequence: CTC
aaaatatactaaactattct

SEQ ID NO: 98921 - DNA, 20 bp, Artificial Sequence
  Description of Artificial Sequence: Synthetic oligonucleotide
  Target: SCN9A; (+) strand; PAM type: YTN; PAM sequence: CTA
aactattctcctgcatccaa

SEQ ID NO: 98922 - DNA, 20 bp, Artificial Sequence
  Description of Artificial Sequence: Synthetic oligonucleotide
  Target: SCN9A; (+) strand; PAM type: YTN; PAM sequence: CTA
ttctcctgcatccaattcac

SEQ ID NO: 98923 - DNA, 20 bp, Artificial Sequence
  Description of Artificial Sequence: Synthetic oligonucleotide
  Target: SCN9A; (+) strand; PAM type: YTN; PAM sequence: TTC
tcctgcatccaattcacctg

SEQ ID NO: 98924 - DNA, 20 bp, Artificial Sequence
  Description of Artificial Sequence: Synthetic oligonucleotide
  Target: SCN9A; (+) strand; PAM type: YTN; PAM sequence: CTC
ctgcatccaattcacctgta

SEQ ID NO: 98925 - DNA, 20 bp, Artificial Sequence
  Description of Artificial Sequence: Synthetic oligonucleotide
  Target: SCN9A; (+) strand; PAM type: YTN; PAM sequence: CTG
catccaattcacctgtaata

SEQ ID NO: 98926 - DNA, 20 bp, Artificial Sequence
  Description of Artificial Sequence: Synthetic oligonucleotide
  Target: SCN9A; (+) strand; PAM type: YTN; PAM sequence: TTC
acctgtaatacagataaaga

SEQ ID NO: 98927 - DNA, 20 bp, Artificial Sequence
  Description of Artificial Sequence: Synthetic oligonucleotide
  Target: SCN9A; (+) strand; PAM type: YTN; PAM sequence: CTG
taatacagataaagaacaaa

SEQ ID NO: 98928 - DNA, 20 bp, Artificial Sequence
  Description of Artificial Sequence: Synthetic oligonucleotide
  Target: SCN9A; (+) strand; PAM type: YTN; PAM sequence: TTA
aatagtgggctggcttaatc

SEQ ID NO: 98929 - DNA, 20 bp, Artificial Sequence
  Description of Artificial Sequence: Synthetic oligonucleotide
  Target: SCN9A; (+) strand; PAM type: YTN; PAM sequence: CTG
gcttaatcactgaaggaagt

SEQ ID NO: 98930 - DNA, 20 bp, Artificial Sequence
  Description of Artificial Sequence: Synthetic oligonucleotide
  Target: SCN9A; (+) strand; PAM type: YTN; PAM sequence: CTT
aatcactgaaggaagtggtt

SEQ ID NO: 98931 - DNA, 20 bp, Artificial Sequence
  Description of Artificial Sequence: Synthetic oligonucleotide
  Target: SCN9A; (+) strand; PAM type: YTN; PAM sequence: TTA
atcactgaaggaagtggttt

SEQ ID NO: 98932 - DNA, 20 bp, Artificial Sequence
  Description of Artificial Sequence: Synthetic oligonucleotide
  Target: SCN9A; (+) strand; PAM type: YTN; PAM sequence: CTG
aaggaagtggttttgtaggg

SEQ ID NO: 98933 - DNA, 20 bp, Artificial Sequence
  Description of Artificial Sequence: Synthetic oligonucleotide
  Target: SCN9A; (+) strand; PAM type: YTN; PAM sequence: TTT
tgtaggggaaagttgtgata

SEQ ID NO: 98934 - DNA, 20 bp, Artificial Sequence
  Description of Artificial Sequence: Synthetic oligonucleotide
  Target: SCN9A; (+) strand; PAM type: YTN; PAM sequence: TTT
gtaggggaaagttgtgatag

SEQ ID NO: 98935 - DNA, 20 bp, Artificial Sequence
  Description of Artificial Sequence: Synthetic oligonucleotide
  Target: SCN9A; (+) strand; PAM type: YTN; PAM sequence: TTG
taggggaaagttgtgataga

SEQ ID NO: 98936 - DNA, 20 bp, Artificial Sequence
  Description of Artificial Sequence: Synthetic oligonucleotide
  Target: SCN9A; (+) strand; PAM type: YTN; PAM sequence: TTG
tgatagattgtaacattcta

SEQ ID NO: 98937 - DNA, 20 bp, Artificial Sequence
  Description of Artificial Sequence: Synthetic oligonucleotide
  Target: SCN9A; (+) strand; PAM type: YTN; PAM sequence: TTG
taacattctattaatgctca

SEQ ID NO: 98938 - DNA, 20 bp, Artificial Sequence
  Description of Artificial Sequence: Synthetic oligonucleotide
  Target: SCN9A; (+) strand; PAM type: YTN; PAM sequence: TTC
tattaatgctcaaaaaatta

SEQ ID NO: 98939 - DNA, 20 bp, Artificial Sequence
  Description of Artificial Sequence: Synthetic oligonucleotide
  Target: SCN9A; (+) strand; PAM type: YTN; PAM sequence: CTA
ttaatgctcaaaaaattaag

SEQ ID NO: 98940 - DNA, 20 bp, Artificial Sequence
  Description of Artificial Sequence: Synthetic oligonucleotide
  Target: SCN9A; (+) strand; PAM type: YTN; PAM sequence: TTA
atgctcaaaaaattaagtta

SEQ ID NO: 98941 - DNA, 20 bp, Artificial Sequence
  Description of Artificial Sequence: Synthetic oligonucleotide
  Target: SCN9A; (+) strand; PAM type: YTN; PAM sequence: CTC
aaaaaattaagttaatgtca

SEQ ID NO: 98942 - DNA, 20 bp, Artificial Sequence
  Description of Artificial Sequence: Synthetic oligonucleotide
  Target: SCN9A; (+) strand; PAM type: YTN; PAM sequence: TTA
agttaatgtcaatgaattct

SEQ ID NO: 98943 - DNA, 20 bp, Artificial Sequence
  Description of Artificial Sequence: Synthetic oligonucleotide
  Target: SCN9A; (+) strand; PAM type: YTN; PAM sequence: TTA
atgtcaatgaattctaatac

SEQ ID NO: 98944 - DNA, 20 bp, Artificial Sequence
  Description of Artificial Sequence: Synthetic oligonucleotide
  Target: SCN9A; (+) strand; PAM type: YTN; PAM sequence: TTC
taataccacctttctgcaca

SEQ ID NO: 98945 - DNA, 20 bp, Artificial Sequence
  Description of Artificial Sequence: Synthetic oligonucleotide
  Target: SCN9A; (+) strand; PAM type: YTN; PAM sequence: CTA
ataccacctttctgcacaaa

SEQ ID NO: 98946 - DNA, 20 bp, Artificial Sequence
  Description of Artificial Sequence: Synthetic oligonucleotide
  Target: SCN9A; (+) strand; PAM type: YTN; PAM sequence: CTT
tctgcacaaaatgaaacttg

SEQ ID NO: 98947 - DNA, 20 bp, Artificial Sequence
  Description of Artificial Sequence: Synthetic oligonucleotide
  Target: SCN9A; (+) strand; PAM type: YTN; PAM sequence: TTT
ctgcacaaaatgaaacttgt

SEQ ID NO: 98948 - DNA, 20 bp, Artificial Sequence
  Description of Artificial Sequence: Synthetic oligonucleotide
  Target: SCN9A; (+) strand; PAM type: YTN; PAM sequence: TTC
tgcacaaaatgaaacttgta

SEQ ID NO: 98949 - DNA, 20 bp, Artificial Sequence
  Description of Artificial Sequence: Synthetic oligonucleotide
  Target: SCN9A; (+) strand; PAM type: YTN; PAM sequence: CTG
cacaaaatgaaacttgtaat

SEQ ID NO: 98950 - DNA, 20 bp, Artificial Sequence
  Description of Artificial Sequence: Synthetic oligonucleotide
  Target: SCN9A; (+) strand; PAM type: YTN; PAM sequence: CTT
gtaattttcaacttgtagat

SEQ ID NO: 98951 - DNA, 20 bp, Artificial Sequence
  Description of Artificial Sequence: Synthetic oligonucleotide
  Target: SCN9A; (+) strand; PAM type: YTN; PAM sequence: TTG
taattttcaacttgtagata

SEQ ID NO: 98952 - DNA, 20 bp, Artificial Sequence
  Description of Artificial Sequence: Synthetic oligonucleotide
  Target: SCN9A; (+) strand; PAM type: YTN; PAM sequence: TTT
tcaacttgtagatagaatat

SEQ ID NO: 98953 - DNA, 20 bp, Artificial Sequence
  Description of Artificial Sequence: Synthetic oligonucleotide
  Target: SCN9A; (+) strand; PAM type: YTN; PAM sequence: TTT
caacttgtagatagaatatt

SEQ ID NO: 98954 - DNA, 20 bp, Artificial Sequence
  Description of Artificial Sequence: Synthetic oligonucleotide
  Target: SCN9A; (+) strand; PAM type: YTN; PAM sequence: TTC
aacttgtagatagaatattt

SEQ ID NO: 98955 - DNA, 20 bp, Artificial Sequence
  Description of Artificial Sequence: Synthetic oligonucleotide
  Target: SCN9A; (+) strand; PAM type: YTN; PAM sequence: CTT
gtagatagaatatttttgaa

SEQ ID NO: 98956 - DNA, 20 bp, Artificial Sequence
  Description of Artificial Sequence: Synthetic oligonucleotide
  Target: SCN9A; (+) strand; PAM type: YTN; PAM sequence: TTG
tagatagaatatttttgaat

SEQ ID NO: 98957 - DNA, 20 bp, Artificial Sequence
  Description of Artificial Sequence: Synthetic oligonucleotide
  Target: SCN9A; (+) strand; PAM type: YTN; PAM sequence: TTT
ttgaattgtgcttatgaact

SEQ ID NO: 98958 - DNA, 20 bp, Artificial Sequence
  Description of Artificial Sequence: Synthetic oligonucleotide
  Target: SCN9A; (+) strand; PAM type: YTN; PAM sequence: TTT
tgaattgtgcttatgaactt

SEQ ID NO: 98959 - DNA, 20 bp, Artificial Sequence
  Description of Artificial Sequence: Synthetic oligonucleotide
  Target: SCN9A; (+) strand; PAM type: YTN; PAM sequence: TTT
gaattgtgcttatgaacttt

SEQ ID NO: 98960 - DNA, 20 bp, Artificial Sequence
  Description of Artificial Sequence: Synthetic oligonucleotide
  Target: SCN9A; (+) strand; PAM type: YTN; PAM sequence: TTG
aattgtgcttatgaactttt

SEQ ID NO: 98961 - DNA, 20 bp, Artificial Sequence
  Description of Artificial Sequence: Synthetic oligonucleotide
  Target: SCN9A; (+) strand; PAM type: YTN; PAM sequence: TTG
tgcttatgaacttttttgta

SEQ ID NO: 98962 - DNA, 20 bp, Artificial Sequence
  Description of Artificial Sequence: Synthetic oligonucleotide
  Target: SCN9A; (+) strand; PAM type: YTN; PAM sequence: CTT
atgaacttttttgtataatc

SEQ ID NO: 98963 - DNA, 20 bp, Artificial Sequence
  Description of Artificial Sequence: Synthetic oligonucleotide
  Target: SCN9A; (+) strand; PAM type: YTN; PAM sequence: TTA
tgaacttttttgtataatca

SEQ ID NO: 98964 - DNA, 20 bp, Artificial Sequence
  Description of Artificial Sequence: Synthetic oligonucleotide
  Target: SCN9A; (+) strand; PAM type: YTN; PAM sequence: CTT
ttttgtataatcatgatctt

SEQ ID NO: 98965 - DNA, 20 bp, Artificial Sequence
  Description of Artificial Sequence: Synthetic oligonucleotide
  Target: SCN9A; (+) strand; PAM type: YTN; PAM sequence: TTT
tttgtataatcatgatcttt

SEQ ID NO: 98966 - DNA, 20 bp, Artificial Sequence
  Description of Artificial Sequence: Synthetic oligonucleotide
  Target: SCN9A; (+) strand; PAM type: YTN; PAM sequence: TTT
ttgtataatcatgatctttc

SEQ ID NO: 98967 - DNA, 20 bp, Artificial Sequence
  Description of Artificial Sequence: Synthetic oligonucleotide
  Target: SCN9A; (+) strand; PAM type: YTN; PAM sequence: TTT
tgtataatcatgatctttct

SEQ ID NO: 98968 - DNA, 20 bp, Artificial Sequence
  Description of Artificial Sequence: Synthetic oligonucleotide
  Target: SCN9A; (+) strand; PAM type: YTN; PAM sequence: TTT
gtataatcatgatctttctt

SEQ ID NO: 98969 - DNA, 20 bp, Artificial Sequence
  Description of Artificial Sequence: Synthetic oligonucleotide
  Target: SCN9A; (+) strand; PAM type: YTN; PAM sequence: TTG
tataatcatgatctttcttt

SEQ ID NO: 98970 - DNA, 20 bp, Artificial Sequence
  Description of Artificial Sequence: Synthetic oligonucleotide
  Target: SCN9A; (+) strand; PAM type: YTN; PAM sequence: CTT
tcttttatacttggaaaccg

SEQ ID NO: 98971 - DNA, 20 bp, Artificial Sequence
  Description of Artificial Sequence: Synthetic oligonucleotide
  Target: SCN9A; (+) strand; PAM type: YTN; PAM sequence: TTT
cttttatacttggaaaccgt

SEQ ID NO: 98972 - DNA, 20 bp, Artificial Sequence
  Description of Artificial Sequence: Synthetic oligonucleotide
  Target: SCN9A; (+) strand; PAM type: YTN; PAM sequence: TTC
ttttatacttggaaaccgtt

SEQ ID NO: 98973 - DNA, 20 bp, Artificial Sequence
  Description of Artificial Sequence: Synthetic oligonucleotide
  Target: SCN9A; (+) strand; PAM type: YTN; PAM sequence: CTT
ttatacttggaaaccgttat

SEQ ID NO: 98974 - DNA, 20 bp, Artificial Sequence
  Description of Artificial Sequence: Synthetic oligonucleotide
  Target: SCN9A; (+) strand; PAM type: YTN; PAM sequence: TTT
tatacttggaaaccgttata

SEQ ID NO: 98975 - DNA, 20 bp, Artificial Sequence
  Description of Artificial Sequence: Synthetic oligonucleotide
  Target: SCN9A; (+) strand; PAM type: YTN; PAM sequence: TTT
atacttggaaaccgttatac

SEQ ID NO: 98976 - DNA, 20 bp, Artificial Sequence
  Description of Artificial Sequence: Synthetic oligonucleotide
  Target: SCN9A; (+) strand; PAM type: YTN; PAM sequence: TTA
tacttggaaaccgttataca

SEQ ID NO: 98977 - DNA, 20 bp, Artificial Sequence
  Description of Artificial Sequence: Synthetic oligonucleotide
  Target: SCN9A; (+) strand; PAM type: YTN; PAM sequence: CTT
ggaaaccgttatacactgga

SEQ ID NO: 98978 - DNA, 20 bp, Artificial Sequence
  Description of Artificial Sequence: Synthetic oligonucleotide
  Target: SCN9A; (+) strand; PAM type: YTN; PAM sequence: TTG
gaaaccgttatacactggat

SEQ ID NO: 98979 - DNA, 20 bp, Artificial Sequence
  Description of Artificial Sequence: Synthetic oligonucleotide
  Target: SCN9A; (+) strand; PAM type: YTN; PAM sequence: TTA
tacactggataattaaaata

SEQ ID NO: 98980 - DNA, 20 bp, Artificial Sequence
  Description of Artificial Sequence: Synthetic oligonucleotide
  Target: SCN9A; (+) strand; PAM type: YTN; PAM sequence: CTG
gataattaaaatagcagaga

SEQ ID NO: 98981 - DNA, 20 bp, Artificial Sequence
  Description of Artificial Sequence: Synthetic oligonucleotide
  Target: SCN9A; (+) strand; PAM type: YTN; PAM sequence: TTA
aaatagcagagattgcagtc

SEQ ID NO: 98982 - DNA, 20 bp, Artificial Sequence
  Description of Artificial Sequence: Synthetic oligonucleotide
  Target: SCN9A; (+) strand; PAM type: YTN; PAM sequence: TTG
cagtcataattaggtttgta

SEQ ID NO: 98983 - DNA, 20 bp, Artificial Sequence
  Description of Artificial Sequence: Synthetic oligonucleotide
  Target: SCN9A; (+) strand; PAM type: YTN; PAM sequence: TTA
ggtttgtagggataacagtg

SEQ ID NO: 98984 - DNA, 20 bp, Artificial Sequence
  Description of Artificial Sequence: Synthetic oligonucleotide
  Target: SCN9A; (+) strand; PAM type: YTN; PAM sequence: TTT
gtagggataacagtgaagat

SEQ ID NO: 98985 - DNA, 20 bp, Artificial Sequence
  Description of Artificial Sequence: Synthetic oligonucleotide
  Target: SCN9A; (+) strand; PAM type: YTN; PAM sequence: TTG
tagggataacagtgaagatt

SEQ ID NO: 98986 - DNA, 20 bp, Artificial Sequence
  Description of Artificial Sequence: Synthetic oligonucleotide
  Target: SCN9A; (+) strand; PAM type: YTN; PAM sequence: TTT
ggtaggctgaaagatctcta

SEQ ID NO: 98987 - DNA, 20 bp, Artificial Sequence
  Description of Artificial Sequence: Synthetic oligonucleotide
  Target: SCN9A; (+) strand; PAM type: YTN; PAM sequence: TTG
gtaggctgaaagatctctaa

SEQ ID NO: 98988 - DNA, 20 bp, Artificial Sequence
  Description of Artificial Sequence: Synthetic oligonucleotide
  Target: SCN9A; (+) strand; PAM type: YTN; PAM sequence: CTG
aaagatctctaatgttcact

SEQ ID NO: 98989 - DNA, 20 bp, Artificial Sequence
  Description of Artificial Sequence: Synthetic oligonucleotide
  Target: SCN9A; (+) strand; PAM type: YTN; PAM sequence: CTC
taatgttcacttgaggctgg

SEQ ID NO: 98990 - DNA, 20 bp, Artificial Sequence
  Description of Artificial Sequence: Synthetic oligonucleotide
  Target: SCN9A; (+) strand; PAM type: YTN; PAM sequence: CTA
atgttcacttgaggctggtt

SEQ ID NO: 98991 - DNA, 20 bp, Artificial Sequence
  Description of Artificial Sequence: Synthetic oligonucleotide
  Target: SCN9A; (+) strand; PAM type: YTN; PAM sequence: TTC
acttgaggctggttaaaacc

SEQ ID NO: 98992 - DNA, 20 bp, Artificial Sequence
  Description of Artificial Sequence: Synthetic oligonucleotide
  Target: SCN9A; (+) strand; PAM type: YTN; PAM sequence: CTT
gaggctggttaaaacccaag

SEQ ID NO: 98993 - DNA, 20 bp, Artificial Sequence
  Description of Artificial Sequence: Synthetic oligonucleotide
  Target: SCN9A; (+) strand; PAM type: YTN; PAM sequence: TTG
aggctggttaaaacccaagt

SEQ ID NO: 98994 - DNA, 20 bp, Artificial Sequence
  Description of Artificial Sequence: Synthetic oligonucleotide
  Target: SCN9A; (+) strand; PAM type: YTN; PAM sequence: CTG
gttaaaacccaagtttctta

SEQ ID NO: 98995 - DNA, 20 bp, Artificial Sequence
  Description of Artificial Sequence: Synthetic oligonucleotide
  Target: SCN9A; (+) strand; PAM type: YTN; PAM sequence: TTA
aaacccaagtttcttatccc

SEQ ID NO: 98996 - DNA, 20 bp, Artificial Sequence
  Description of Artificial Sequence: Synthetic oligonucleotide
  Target: SCN9A; (+) strand; PAM type: YTN; PAM sequence: TTT
cttatccccatcctggagtt

SEQ ID NO: 98997 - DNA, 20 bp, Artificial Sequence
  Description of Artificial Sequence: Synthetic oligonucleotide
  Target: SCN9A; (+) strand; PAM type: YTN; PAM sequence: TTC
ttatccccatcctggagttt

SEQ ID NO: 98998 - DNA, 20 bp, Artificial Sequence
  Description of Artificial Sequence: Synthetic oligonucleotide
  Target: SCN9A; (+) strand; PAM type: YTN; PAM sequence: CTT
atccccatcctggagtttct

SEQ ID NO: 98999 - DNA, 20 bp, Artificial Sequence
  Description of Artificial Sequence: Synthetic oligonucleotide
  Target: SCN9A; (+) strand; PAM type: YTN; PAM sequence: TTA
tccccatcctggagtttctg

SEQ ID NO: 99000 - DNA, 20 bp, Artificial Sequence
  Description of Artificial Sequence: Synthetic oligonucleotide
  Target: SCN9A; (+) strand; PAM type: YTN; PAM sequence: CTG
gagtttctgactcagtaggt

SEQ ID NO: 99001 - DNA, 20 bp, Artificial Sequence
  Description of Artificial Sequence: Synthetic oligonucleotide
  Target: SCN9A; (+) strand; PAM type: YTN; PAM sequence: TTT
ctgactcagtaggtctgggg

SEQ ID NO: 99002 - DNA, 20 bp, Artificial Sequence
  Description of Artificial Sequence: Synthetic oligonucleotide
  Target: SCN9A; (+) strand; PAM type: YTN; PAM sequence: TTC
tgactcagtaggtctggggt

SEQ ID NO: 99003 - DNA, 20 bp, Artificial Sequence
  Description of Artificial Sequence: Synthetic oligonucleotide
  Target: SCN9A; (+) strand; PAM type: YTN; PAM sequence: CTG
actcagtaggtctggggtga

SEQ ID NO: 99004 - DNA, 20 bp, Artificial Sequence
  Description of Artificial Sequence: Synthetic oligonucleotide
  Target: SCN9A; (+) strand; PAM type: YTN; PAM sequence: CTC
agtaggtctggggtgagatc

SEQ ID NO: 99005 - DNA, 20 bp, Artificial Sequence
  Description of Artificial Sequence: Synthetic oligonucleotide
  Target: SCN9A; (+) strand; PAM type: YTN; PAM sequence: CTG
gggtgagatccaagaatttg

SEQ ID NO: 99006 - DNA, 20 bp, Artificial Sequence
  Description of Artificial Sequence: Synthetic oligonucleotide
  Target: SCN9A; (+) strand; PAM type: YTN; PAM sequence: TTT
gctttttttttttttttttt

SEQ ID NO: 99007 - DNA, 20 bp, Artificial Sequence
  Description of Artificial Sequence: Synthetic oligonucleotide
  Target: SCN9A; (+) strand; PAM type: YTN; PAM sequence: TTG
cttttttttttttttttttt

SEQ ID NO: 99008 - DNA, 20 bp, Artificial Sequence
  Description of Artificial Sequence: Synthetic oligonucleotide
  Target: SCN9A; (+) strand; PAM type: YTN; PAM sequence: CTT
tttttttttttttttttttg

SEQ ID NO: 99009 - DNA, 20 bp, Artificial Sequence
  Description of Artificial Sequence: Synthetic oligonucleotide
  Target: SCN9A; (+) strand; PAM type: YTN; PAM sequence: TTT
ttttttttttttttttttga

SEQ ID NO: 99010 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttttttgat

SEQ ID NO: 99011 - DNA, 20 bp, Artificial Sequence
  Description of Artificial Sequence: Synthetic oligonucleotide
  Target: SCN9A; (+) strand; PAM type: YTN; PAM sequence: TTT
ttttttttttttttttgata

SEQ ID NO: 99012 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttttgatac

SEQ ID NO: 99013 - DNA, 20 bp, Artificial Sequence
  Description of Artificial Sequence: Synthetic oligonucleotide
  Target: SCN9A; (+) strand; PAM type: YTN; PAM sequence: TTT
ttttttttttttttgataca

SEQ ID NO: 99014 - DNA, 20 bp, Artificial Sequence
  Description of Artificial Sequence: Synthetic oligonucleotide
  Target: SCN9A; (+) strand; PAM type: YTN; PAM sequence: TTT
tttttttttttttgatacag

SEQ ID NO: 99015 - DNA, 20 bp, Artificial Sequence
  Description of Artificial Sequence: Synthetic oligonucleotide
  Target: SCN9A; (+) strand; PAM type: YTN; PAM sequence: TTT
ttttttttttttgatacaga

SEQ ID NO: 99016 - DNA, 20 bp, Artificial Sequence
  Description of Artificial Sequence: Synthetic oligonucleotide
  Target: SCN9A; (+) strand; PAM type: YTN; PAM sequence: TTT
tttttttttttgatacagag

SEQ ID NO: 99017 - DNA, 20 bp, Artificial Sequence
  Description of Artificial Sequence: Synthetic oligonucleotide
  Target: SCN9A; (+) strand; PAM type: YTN; PAM sequence: TTT
ttttttttttgatacagagt

SEQ ID NO: 99018 - DNA, 20 bp, Artificial Sequence
  Description of Artificial Sequence: Synthetic oligonucleotide
  Target: SCN9A; (+) strand; PAM type: YTN; PAM sequence: TTT
tttttttttgatacagagtc

SEQ ID NO: 99019 - DNA, 20 bp, Artificial Sequence
  Description of Artificial Sequence: Synthetic oligonucleotide
  Target: SCN9A; (+) strand; PAM type: YTN; PAM sequence: TTT
ttttttttgatacagagtct

SEQ ID NO: 99020 - DNA, 20 bp, Artificial Sequence
  Description of Artificial Sequence: Synthetic oligonucleotide
  Target: SCN9A; (+) strand; PAM type: YTN; PAM sequence: TTT
tttttttgatacagagtctt

SEQ ID NO: 99021 - DNA, 20 bp, Artificial Sequence
  Description of Artificial Sequence: Synthetic oligonucleotide
  Target: SCN9A; (+) strand; PAM type: YTN; PAM sequence: TTT
ttttttgatacagagtcttg

SEQ ID NO: 99022 - DNA, 20 bp, Artificial Sequence
  Description of Artificial Sequence: Synthetic oligonucleotide
  Target: SCN9A; (+) strand; PAM type: YTN; PAM sequence: TTT
tttttgatacagagtcttgc

SEQ ID NO: 99023 - DNA, 20 bp, Artificial Sequence
  Description of Artificial Sequence: Synthetic oligonucleotide
  Target: SCN9A; (+) strand; PAM type: YTN; PAM sequence: TTT
ttttgatacagagtcttgct

SEQ ID NO: 99024 - DNA, 20 bp, Artificial Sequence
  Description of Artificial Sequence: Synthetic oligonucleotide
  Target: SCN9A; (+) strand; PAM type: YTN; PAM sequence: TTT
tttgatacagagtcttgctc

SEQ ID NO: 99025 - DNA, 20 bp, Artificial Sequence
  Description of Artificial Sequence: Synthetic oligonucleotide
  Target: SCN9A; (+) strand; PAM type: YTN; PAM sequence: TTT
ttgatacagagtcttgctct

SEQ ID NO: 99026 - DNA, 20 bp, Artificial Sequence
  Description of Artificial Sequence: Synthetic oligonucleotide
  Target: SCN9A; (+) strand; PAM type: YTN; PAM sequence: TTT
tgatacagagtcttgctctg

SEQ ID NO: 99027 - DNA, 20 bp, Artificial Sequence
  Description of Artificial Sequence: Synthetic oligonucleotide
  Target: SCN9A; (+) strand; PAM type: YTN; PAM sequence: TTT
gatacagagtcttgctctgt

SEQ ID NO: 99028 - DNA, 20 bp, Artificial Sequence
  Description of Artificial Sequence: Synthetic oligonucleotide
  Target: SCN9A; (+) strand; PAM type: YTN; PAM sequence: TTG
atacagagtcttgctctgtt

SEQ ID NO: 99029 - DNA, 20 bp, Artificial Sequence
  Description of Artificial Sequence: Synthetic oligonucleotide
  Target: SCN9A; (+) strand; PAM type: YTN; PAM sequence: CTT
gctctgttccccaggctgga

SEQ ID NO: 99030 - DNA, 20 bp, Artificial Sequence
  Description of Artificial Sequence: Synthetic oligonucleotide
  Target: SCN9A; (+) strand; PAM type: YTN; PAM sequence: TTG
ctctgttccccaggctggag

SEQ ID NO: 99031 - DNA, 20 bp, Artificial Sequence
  Description of Artificial Sequence: Synthetic oligonucleotide
  Target: SCN9A; (+) strand; PAM type: YTN; PAM sequence: CTC
tgttccccaggctggagtgc

SEQ ID NO: 99032 - DNA, 20 bp, Artificial Sequence
  Description of Artificial Sequence: Synthetic oligonucleotide
  Target: SCN9A; (+) strand; PAM type: YTN; PAM sequence: CTG
ttccccaggctggagtgcag

SEQ ID NO: 99033 - DNA, 20 bp, Artificial Sequence
  Description of Artificial Sequence: Synthetic oligonucleotide
  Target: SCN9A; (+) strand; PAM type: YTN; PAM sequence: TTC
cccaggctggagtgcagttg

SEQ ID NO: 99034 - DNA, 20 bp, Artificial Sequence
  Description of Artificial Sequence: Synthetic oligonucleotide
  Target: SCN9A; (+) strand; PAM type: YTN; PAM sequence: CTG
gagtgcagttgcatgatctc

SEQ ID NO: 99035 - DNA, 20 bp, Artificial Sequence
  Description of Artificial Sequence: Synthetic oligonucleotide
  Target: SCN9A; (+) strand; PAM type: YTN; PAM sequence: TTG
catgatctcggctcactgca

SEQ ID NO: 99036 - DNA, 20 bp, Artificial Sequence
  Description of Artificial Sequence: Synthetic oligonucleotide
  Target: SCN9A; (+) strand; PAM type: YTN; PAM sequence: CTC
ggctcactgcaacctctgcc

SEQ ID NO: 99037 - DNA, 20 bp, Artificial Sequence
  Description of Artificial Sequence: Synthetic oligonucleotide
  Target: SCN9A; (+) strand; PAM type: YTN; PAM sequence: CTC
actgcaacctctgcctcccg

SEQ ID NO: 99038 - DNA, 20 bp, Artificial Sequence
  Description of Artificial Sequence: Synthetic oligonucleotide
  Target: SCN9A; (+) strand; PAM type: YTN; PAM sequence: CTG
caacctctgcctcccgggtt

SEQ ID NO: 99039 - DNA, 20 bp, Artificial Sequence
  Description of Artificial Sequence: Synthetic oligonucleotide
  Target: SCN9A; (+) strand; PAM type: YTN; PAM sequence: CTC
tgcctcccgggttcaagcga

SEQ ID NO: 99040 - DNA, 20 bp, Artificial Sequence
  Description of Artificial Sequence: Synthetic oligonucleotide
  Target: SCN9A; (+) strand; PAM type: YTN; PAM sequence: CTG
cctcccgggttcaagcgatt

SEQ ID NO: 99041 - DNA, 20 bp, Artificial Sequence
  Description of Artificial Sequence: Synthetic oligonucleotide
  Target: SCN9A; (+) strand; PAM type: YTN; PAM sequence: CTC
ccgggttcaagcgattcttc

SEQ ID NO: 99042 - DNA, 20 bp, Artificial Sequence
  Description of Artificial Sequence: Synthetic oligonucleotide
  Target: SCN9A; (+) strand; PAM type: YTN; PAM sequence: TTC
aagcgattcttctgcctcag

SEQ ID NO: 99043 - DNA, 20 bp, Artificial Sequence
  Description of Artificial Sequence: Synthetic oligonucleotide
  Target: SCN9A; (+) strand; PAM type: YTN; PAM sequence: TTC
ttctgcctcagcctccctag

SEQ ID NO: 99044 - DNA, 20 bp, Artificial Sequence
  Description of Artificial Sequence: Synthetic oligonucleotide
  Target: SCN9A; (+) strand; PAM type: YTN; PAM sequence: CTT
ctgcctcagcctccctagta

SEQ ID NO: 99045 - DNA, 20 bp, Artificial Sequence
  Description of Artificial Sequence: Synthetic oligonucleotide
  Target: SCN9A; (+) strand; PAM type: YTN; PAM sequence: TTC
tgcctcagcctccctagtag

SEQ ID NO: 99046 - DNA, 20 bp, Artificial Sequence
  Description of Artificial Sequence: Synthetic oligonucleotide
  Target: SCN9A; (+) strand; PAM type: YTN; PAM sequence: CTG
cctcagcctccctagtagct

SEQ ID NO: 99047 - DNA, 20 bp, Artificial Sequence
  Description of Artificial Sequence: Synthetic oligonucleotide
  Target: SCN9A; (+) strand; PAM type: YTN; PAM sequence: CTC
agcctccctagtagctgaga

SEQ ID NO: 99048 - DNA, 20 bp, Artificial Sequence
  Description of Artificial Sequence: Synthetic oligonucleotide
  Target: SCN9A; (+) strand; PAM type: YTN; PAM sequence: CTC
cctagtagctgagactacag

SEQ ID NO: 99049 - DNA, 20 bp, Artificial Sequence
  Description of Artificial Sequence: Synthetic oligonucleotide
  Target: SCN9A; (+) strand; PAM type: YTN; PAM sequence: CTA
gtagctgagactacaggtga

SEQ ID NO: 99050 - DNA, 20 bp, Artificial Sequence
  Description of Artificial Sequence: Synthetic oligonucleotide
  Target: SCN9A; (+) strand; PAM type: YTN; PAM sequence: CTG
agactacaggtgagcaccac

SEQ ID NO: 99051 - DNA, 20 bp, Artificial Sequence
  Description of Artificial Sequence: Synthetic oligonucleotide
  Target: SCN9A; (+) strand; PAM type: YTN; PAM sequence: CTA
caggtgagcaccactatgcc

SEQ ID NO: 99052 - DNA, 20 bp, Artificial Sequence
  Description of Artificial Sequence: Synthetic oligonucleotide
  Target: SCN9A; (+) strand; PAM type: YTN; PAM sequence: CTA
tgcccgggtaattttttgca

SEQ ID NO: 99053 - DNA, 20 bp, Artificial Sequence
  Description of Artificial Sequence: Synthetic oligonucleotide
  Target: SCN9A; (+) strand; PAM type: YTN; PAM sequence: TTT
tttgcatttttagtagagat

SEQ ID NO: 99054 - DNA, 20 bp, Artificial Sequence
  Description of Artificial Sequence: Synthetic oligonucleotide
  Target: SCN9A; (+) strand; PAM type: YTN; PAM sequence: TTT
ttgcatttttagtagagatg

SEQ ID NO: 99055 - DNA, 20 bp, Artificial Sequence
  Description of Artificial Sequence: Synthetic oligonucleotide
  Target: SCN9A; (+) strand; PAM type: YTN; PAM sequence: TTT
tgcatttttagtagagatgg

SEQ ID NO: 99056 - DNA, 20 bp, Artificial Sequence
  Description of Artificial Sequence: Synthetic oligonucleotide
  Target: SCN9A; (+) strand; PAM type: YTN; PAM sequence: TTT
gcatttttagtagagatggg

SEQ ID NO: 99057 - DNA, 20 bp, Artificial Sequence
  Description of Artificial Sequence: Synthetic oligonucleotide
  Target: SCN9A; (+) strand; PAM type: YTN; PAM sequence: TTG
catttttagtagagatgggg

SEQ ID NO: 99058 - DNA, 20 bp, Artificial Sequence
  Description of Artificial Sequence: Synthetic oligonucleotide
  Target: SCN9A; (+) strand; PAM type: YTN; PAM sequence: TTT
ttagtagagatggggtttca

SEQ ID NO: 99059 - DNA, 20 bp, Artificial Sequence
  Description of Artificial Sequence: Synthetic oligonucleotide
  Target: SCN9A; (+) strand; PAM type: YTN; PAM sequence: TTT
tagtagagatggggtttcac

SEQ ID NO: 99060 - DNA, 20 bp, Artificial Sequence
  Description of Artificial Sequence: Synthetic oligonucleotide
  Target: SCN9A; (+) strand; PAM type: YTN; PAM sequence: TTT
agtagagatggggtttcacc

SEQ ID NO: 99061 - DNA, 20 bp, Artificial Sequence
  Description of Artificial Sequence: Synthetic oligonucleotide
  Target: SCN9A; (+) strand; PAM type: YTN; PAM sequence: TTA
gtagagatggggtttcacca

SEQ ID NO: 99062 - DNA, 20 bp, Artificial Sequence
  Description of Artificial Sequence: Synthetic oligonucleotide
  Target: SCN9A; (+) strand; PAM type: YTN; PAM sequence: TTT
caccatattggccaggctgg

SEQ ID NO: 99063 - DNA, 20 bp, Artificial Sequence
  Description of Artificial Sequence: Synthetic oligonucleotide
  Target: SCN9A; (+) strand; PAM type: YTN; PAM sequence: TTC
accatattggccaggctggt

SEQ ID NO: 99064 - DNA, 20 bp, Artificial Sequence
  Description of Artificial Sequence: Synthetic oligonucleotide
  Target: SCN9A; (+) strand; PAM type: YTN; PAM sequence: TTG
gccaggctggtctcgaactc

SEQ ID NO: 99065 - DNA, 20 bp, Artificial Sequence
  Description of Artificial Sequence: Synthetic oligonucleotide
  Target: SCN9A; (+) strand; PAM type: YTN; PAM sequence: CTG
gtctcgaactcctgacctca

SEQ ID NO: 99066 - DNA, 20 bp, Artificial Sequence
  Description of Artificial Sequence: Synthetic oligonucleotide
  Target: SCN9A; (+) strand; PAM type: YTN; PAM sequence: CTC
gaactcctgacctcatgatc

SEQ ID NO: 99067 - DNA, 20 bp, Artificial Sequence
  Description of Artificial Sequence: Synthetic oligonucleotide
  Target: SCN9A; (+) strand; PAM type: YTN; PAM sequence: CTC
ctgacctcatgatccgtccg

SEQ ID NO: 99068 - DNA, 20 bp, Artificial Sequence
  Description of Artificial Sequence: Synthetic oligonucleotide
  Target: SCN9A; (+) strand; PAM type: YTN; PAM sequence: CTG
acctcatgatccgtccgtct

SEQ ID NO: 99069 - DNA, 20 bp, Artificial Sequence
  Description of Artificial Sequence: Synthetic oligonucleotide
  Target: SCN9A; (+) strand; PAM type: YTN; PAM sequence: CTC
atgatccgtccgtcttttta

SEQ ID NO: 99070 - DNA, 20 bp, Artificial Sequence
  Description of Artificial Sequence: Synthetic oligonucleotide
  Target: SCN9A; (+) strand; PAM type: YTN; PAM sequence: CTT
tttaataagtttgtagataa

SEQ ID NO: 99071 - DNA, 20 bp, Artificial Sequence
  Description of Artificial Sequence: Synthetic oligonucleotide
  Target: SCN9A; (+) strand; PAM type: YTN; PAM sequence: TTT
ttaataagtttgtagataat

SEQ ID NO: 99072 - DNA, 20 bp, Artificial Sequence
  Description of Artificial Sequence: Synthetic oligonucleotide
  Target: SCN9A; (+) strand; PAM type: YTN; PAM sequence: TTT
taataagtttgtagataatg

SEQ ID NO: 99073 - DNA, 20 bp, Artificial Sequence
  Description of Artificial Sequence: Synthetic oligonucleotide
  Target: SCN9A; (+) strand; PAM type: YTN; PAM sequence: TTT
aataagtttgtagataatgc

SEQ ID NO: 99074 - DNA, 20 bp, Artificial Sequence
  Description of Artificial Sequence: Synthetic oligonucleotide
  Target: SCN9A; (+) strand; PAM type: YTN; PAM sequence: TTA
ataagtttgtagataatgct

SEQ ID NO: 99075 - DNA, 20 bp, Artificial Sequence
  Description of Artificial Sequence: Synthetic oligonucleotide
  Target: SCN9A; (+) strand; PAM type: YTN; PAM sequence: TTT
gtagataatgctaatagctg

SEQ ID NO: 99076 - DNA, 20 bp, Artificial Sequence
  Description of Artificial Sequence: Synthetic oligonucleotide
  Target: SCN9A; (+) strand; PAM type: YTN; PAM sequence: TTG
tagataatgctaatagctgg

SEQ ID NO: 99077 - DNA, 20 bp, Artificial Sequence
  Description of Artificial Sequence: Synthetic oligonucleotide
  Target: SCN9A; (+) strand; PAM type: YTN; PAM sequence: CTA
atagctggtcagtaaaccac

SEQ ID NO: 99078 - DNA, 20 bp, Artificial Sequence
  Description of Artificial Sequence: Synthetic oligonucleotide
  Target: SCN9A; (+) strand; PAM type: YTN; PAM sequence: CTG
gtcagtaaaccacacttaaa

SEQ ID NO: 99079 - DNA, 20 bp, Artificial Sequence
  Description of Artificial Sequence: Synthetic oligonucleotide
  Target: SCN9A; (+) strand; PAM type: YTN; PAM sequence: CTT
aaagtatcagtaagctggac

SEQ ID NO: 99080 - DNA, 20 bp, Artificial Sequence
  Description of Artificial Sequence: Synthetic oligonucleotide
  Target: SCN9A; (+) strand; PAM type: YTN; PAM sequence: TTA
aagtatcagtaagctggact

SEQ ID NO: 99081 - DNA, 20 bp, Artificial Sequence
  Description of Artificial Sequence: Synthetic oligonucleotide
  Target: SCN9A; (+) strand; PAM type: YTN; PAM sequence: CTG
gactaatctccgtgttaaat

SEQ ID NO: 99082 - DNA, 20 bp, Artificial Sequence
  Description of Artificial Sequence: Synthetic oligonucleotide
  Target: SCN9A; (+) strand; PAM type: YTN; PAM sequence: CTA
atctccgtgttaaattgctc

SEQ ID NO: 99083 - DNA, 20 bp, Artificial Sequence
  Description of Artificial Sequence: Synthetic oligonucleotide
  Target: SCN9A; (+) strand; PAM type: YTN; PAM sequence: CTC
cgtgttaaattgctcagaga

SEQ ID NO: 99084 - DNA, 20 bp, Artificial Sequence
  Description of Artificial Sequence: Synthetic oligonucleotide
  Target: SCN9A; (+) strand; PAM type: YTN; PAM sequence: TTA
aattgctcagagaaggtaag

SEQ ID NO: 99085 - DNA, 20 bp, Artificial Sequence
  Description of Artificial Sequence: Synthetic oligonucleotide
  Target: SCN9A; (+) strand; PAM type: YTN; PAM sequence: TTG
ctcagagaaggtaaggtagg

SEQ ID NO: 99086 - DNA, 20 bp, Artificial Sequence
  Description of Artificial Sequence: Synthetic oligonucleotide
  Target: SCN9A; (+) strand; PAM type: YTN; PAM sequence: CTC
agagaaggtaaggtagggag

SEQ ID NO: 99087 - DNA, 20 bp, Artificial Sequence
  Description of Artificial Sequence: Synthetic oligonucleotide
  Target: SCN9A; (+) strand; PAM type: YTN; PAM sequence: TTA
agtaaacaaataagtaaaat

SEQ ID NO: 99088 - DNA, 20 bp, Artificial Sequence
  Description of Artificial Sequence: Synthetic oligonucleotide
  Target: SCN9A; (+) strand; PAM type: YTN; PAM sequence: TTT
taggtgtctgaacagagaga

SEQ ID NO: 99089 - DNA, 20 bp, Artificial Sequence
  Description of Artificial Sequence: Synthetic oligonucleotide
  Target: SCN9A; (+) strand; PAM type: YTN; PAM sequence: TTT
aggtgtctgaacagagagag

SEQ ID NO: 99090 - DNA, 20 bp, Artificial Sequence
  Description of Artificial Sequence: Synthetic oligonucleotide
  Target: SCN9A; (+) strand; PAM type: YTN; PAM sequence: TTA
ggtgtctgaacagagagaga

SEQ ID NO: 99091 - DNA, 20 bp, Artificial Sequence
  Description of Artificial Sequence: Synthetic oligonucleotide
  Target: SCN9A; (+) strand; PAM type: YTN; PAM sequence: CTG
aacagagagagaatatccag

SEQ ID NO: 99092 - DNA, 20 bp, Artificial Sequence
  Description of Artificial Sequence: Synthetic oligonucleotide
  Target: SCN9A; (+) strand; PAM type: YTN; PAM sequence: TTA
tgtctcctggtggacggaca

SEQ ID NO: 99093 - DNA, 20 bp, Artificial Sequence
  Description of Artificial Sequence: Synthetic oligonucleotide
  Target: SCN9A; (+) strand; PAM type: YTN; PAM sequence: CTC
ctggtggacggacaaggcaa

SEQ ID NO: 99094 - DNA, 20 bp, Artificial Sequence
  Description of Artificial Sequence: Synthetic oligonucleotide
  Target: SCN9A; (+) strand; PAM type: YTN; PAM sequence: CTG
gtggacggacaaggcaactt

SEQ ID NO: 99095 - DNA, 20 bp, Artificial Sequence
  Description of Artificial Sequence: Synthetic oligonucleotide
  Target: SCN9A; (+) strand; PAM type: YTN; PAM sequence: CTT
taaattgagccttaaaggac

SEQ ID NO: 99096 - DNA, 20 bp, Artificial Sequence
  Description of Artificial Sequence: Synthetic oligonucleotide
  Target: SCN9A; (+) strand; PAM type: YTN; PAM sequence: TTT
aaattgagccttaaaggaca

SEQ ID NO: 99097 - DNA, 20 bp, Artificial Sequence
  Description of Artificial Sequence: Synthetic oligonucleotide
  Target: SCN9A; (+) strand; PAM type: YTN; PAM sequence: TTA
aattgagccttaaaggacag

SEQ ID NO: 99098 - DNA, 20 bp, Artificial Sequence
  Description of Artificial Sequence: Synthetic oligonucleotide
  Target: SCN9A; (+) strand; PAM type: YTN; PAM sequence: TTG
agccttaaaggacagatagg

SEQ ID NO: 99099 - DNA, 20 bp, Artificial Sequence
  Description of Artificial Sequence: Synthetic oligonucleotide
  Target: SCN9A; (+) strand; PAM type: YTN; PAM sequence: CTT
aaaggacagataggtgtttg

SEQ ID NO: 99100 - DNA, 20 bp, Artificial Sequence
  Description of Artificial Sequence: Synthetic oligonucleotide
  Target: SCN9A; (+) strand; PAM type: YTN; PAM sequence: TTA
aaggacagataggtgtttgt

SEQ ID NO: 99101 - DNA, 20 bp, Artificial Sequence
  Description of Artificial Sequence: Synthetic oligonucleotide
  Target: SCN9A; (+) strand; PAM type: YTN; PAM sequence: TTT
gtctgctatacaaacgggtt

SEQ ID NO: 99102 - DNA, 20 bp, Artificial Sequence
  Description of Artificial Sequence: Synthetic oligonucleotide
  Target: SCN9A; (+) strand; PAM type: YTN; PAM sequence: TTG
tctgctatacaaacgggtta

SEQ ID NO: 99103 - DNA, 20 bp, Artificial Sequence
  Description of Artificial Sequence: Synthetic oligonucleotide
  Target: SCN9A; (+) strand; PAM type: YTN; PAM sequence: CTG
ctatacaaacgggttagggt

SEQ ID NO: 99104 - DNA, 20 bp, Artificial Sequence
  Description of Artificial Sequence: Synthetic oligonucleotide
  Target: SCN9A; (+) strand; PAM type: YTN; PAM sequence: CTA
tacaaacgggttagggtcgg

SEQ ID NO: 99105 - DNA, 20 bp, Artificial Sequence
  Description of Artificial Sequence: Synthetic oligonucleotide
  Target: SCN9A; (+) strand; PAM type: YTN; PAM sequence: TTA
gggtcgggacagggcagggg

SEQ ID NO: 99106 - DNA, 20 bp, Artificial Sequence
  Description of Artificial Sequence: Synthetic oligonucleotide
  Target: SCN9A; (+) strand; PAM type: YTN; PAM sequence: TTC
cagaacagaggcataaaata

SEQ ID NO: 99107 - DNA, 20 bp, Artificial Sequence
  Description of Artificial Sequence: Synthetic oligonucleotide
  Target: SCN9A; (+) strand; PAM type: YTN; PAM sequence: CTG
gagaagaaattttagaggag

SEQ ID NO: 99108 - DNA, 20 bp, Artificial Sequence
  Description of Artificial Sequence: Synthetic oligonucleotide
  Target: SCN9A; (+) strand; PAM type: YTN; PAM sequence: TTT
tagaggagtaccaacacatg

SEQ ID NO: 99109 - DNA, 20 bp, Artificial Sequence
  Description of Artificial Sequence: Synthetic oligonucleotide
  Target: SCN9A; (+) strand; PAM type: YTN; PAM sequence: TTT
agaggagtaccaacacatga

SEQ ID NO: 99110 - DNA, 20 bp, Artificial Sequence
  Description of Artificial Sequence: Synthetic oligonucleotide
  Target: SCN9A; (+) strand; PAM type: YTN; PAM sequence: TTA
gaggagtaccaacacatgag

SEQ ID NO: 99111 - DNA, 20 bp, Artificial Sequence
  Description of Artificial Sequence: Synthetic oligonucleotide
  Target: SCN9A; (+) strand; PAM type: YTN; PAM sequence: CTA
attacagaaaatagagttgt

SEQ ID NO: 99112 - DNA, 20 bp, Artificial Sequence
  Description of Artificial Sequence: Synthetic oligonucleotide
  Target: SCN9A; (+) strand; PAM type: YTN; PAM sequence: TTA
cagaaaatagagttgttgtc

SEQ ID NO: 99113 - DNA, 20 bp, Artificial Sequence
  Description of Artificial Sequence: Synthetic oligonucleotide
  Target: SCN9A; (+) strand; PAM type: YTN; PAM sequence: TTG
ttgtcctccatgtgtgttac

SEQ ID NO: 99114 - DNA, 20 bp, Artificial Sequence
  Description of Artificial Sequence: Synthetic oligonucleotide
  Target: SCN9A; (+) strand; PAM type: YTN; PAM sequence: TTG
tcctccatgtgtgttacaaa

SEQ ID NO: 99115 - DNA, 20 bp, Artificial Sequence
  Description of Artificial Sequence: Synthetic oligonucleotide
  Target: SCN9A; (+) strand; PAM type: YTN; PAM sequence: CTC
catgtgtgttacaaagttgc

SEQ ID NO: 99116 - DNA, 20 bp, Artificial Sequence
  Description of Artificial Sequence: Synthetic oligonucleotide
  Target: SCN9A; (+) strand; PAM type: YTN; PAM sequence: TTA
caaagttgctggtttaatac

SEQ ID NO: 99117 - DNA, 20 bp, Artificial Sequence
  Description of Artificial Sequence: Synthetic oligonucleotide
  Target: SCN9A; (+) strand; PAM type: YTN; PAM sequence: TTG
ctggtttaatacaatcctta

SEQ ID NO: 99118 - DNA, 20 bp, Artificial Sequence
  Description of Artificial Sequence: Synthetic oligonucleotide
  Target: SCN9A; (+) strand; PAM type: YTN; PAM sequence: CTG
gtttaatacaatccttaaag

SEQ ID NO: 99119 - DNA, 20 bp, Artificial Sequence
  Description of Artificial Sequence: Synthetic oligonucleotide
  Target: SCN9A; (+) strand; PAM type: YTN; PAM sequence: TTT
aatacaatccttaaagctag

SEQ ID NO: 99120 - DNA, 20 bp, Artificial Sequence
  Description of Artificial Sequence: Synthetic oligonucleotide
  Target: SCN9A; (+) strand; PAM type: YTN; PAM sequence: TTA
atacaatccttaaagctagg

SEQ ID NO: 99121 - DNA, 20 bp, Artificial Sequence
  Description of Artificial Sequence: Synthetic oligonucleotide
  Target: SCN9A; (+) strand; PAM type: YTN; PAM sequence: CTT
aaagctaggttatggtagtt

SEQ ID NO: 99122 - DNA, 20 bp, Artificial Sequence
  Description of Artificial Sequence: Synthetic oligonucleotide
  Target: SCN9A; (+) strand; PAM type: YTN; PAM sequence: TTA
aagctaggttatggtagttg

SEQ ID NO: 99123 - DNA, 20 bp, Artificial Sequence
  Description of Artificial Sequence: Synthetic oligonucleotide
  Target: SCN9A; (+) strand; PAM type: YTN; PAM sequence: CTA
ggttatggtagttgttattc

SEQ ID NO: 99124 - DNA, 20 bp, Artificial Sequence
  Description of Artificial Sequence: Synthetic oligonucleotide
  Target: SCN9A; (+) strand; PAM type: YTN; PAM sequence: TTA
tggtagttgttattcattat

SEQ ID NO: 99125 - DNA, 20 bp, Artificial Sequence
  Description of Artificial Sequence: Synthetic oligonucleotide
  Target: SCN9A; (+) strand; PAM type: YTN; PAM sequence: TTG
ttattcattataacttgttt

SEQ ID NO: 99126 - DNA, 20 bp, Artificial Sequence
  Description of Artificial Sequence: Synthetic oligonucleotide
  Target: SCN9A; (+) strand; PAM type: YTN; PAM sequence: TTA
ttcattataacttgtttgtc

SEQ ID NO: 99127 - DNA, 20 bp, Artificial Sequence
  Description of Artificial Sequence: Synthetic oligonucleotide
  Target: SCN9A; (+) strand; PAM type: YTN; PAM sequence: TTC
attataacttgtttgtctct

SEQ ID NO: 99128 - DNA, 20 bp, Artificial Sequence
  Description of Artificial Sequence: Synthetic oligonucleotide
  Target: SCN9A; (+) strand; PAM type: YTN; PAM sequence: TTA
taacttgtttgtctctgcta

SEQ ID NO: 99129 - DNA, 20 bp, Artificial Sequence
  Description of Artificial Sequence: Synthetic oligonucleotide
  Target: SCN9A; (+) strand; PAM type: YTN; PAM sequence: CTT
gtttgtctctgctaattgag

SEQ ID NO: 99130 - DNA, 20 bp, Artificial Sequence
  Description of Artificial Sequence: Synthetic oligonucleotide
  Target: SCN9A; (+) strand; PAM type: YTN; PAM sequence: TTG
tttgtctctgctaattgagt

SEQ ID NO: 99131 - DNA, 20 bp, Artificial Sequence
  Description of Artificial Sequence: Synthetic oligonucleotide
  Target: SCN9A; (+) strand; PAM type: YTN; PAM sequence: TTT
gtctctgctaattgagtatc

SEQ ID NO: 99132 - DNA, 20 bp, Artificial Sequence
  Description of Artificial Sequence: Synthetic oligonucleotide
  Target: SCN9A; (+) strand; PAM type: YTN; PAM sequence: TTG
tctctgctaattgagtatct

SEQ ID NO: 99133 - DNA, 20 bp, Artificial Sequence
  Description of Artificial Sequence: Synthetic oligonucleotide
  Target: SCN9A; (+) strand; PAM type: YTN; PAM sequence: CTC
tgctaattgagtatcttttc

SEQ ID NO: 99134 - DNA, 20 bp, Artificial Sequence
  Description of Artificial Sequence: Synthetic oligonucleotide
  Target: SCN9A; (+) strand; PAM type: YTN; PAM sequence: CTG
ctaattgagtatcttttcag

SEQ ID NO: 99135 - DNA, 20 bp, Artificial Sequence
  Description of Artificial Sequence: Synthetic oligonucleotide
  Target: SCN9A; (+) strand; PAM type: YTN; PAM sequence: CTA
attgagtatcttttcaggca

SEQ ID NO: 99136 - DNA, 20 bp, Artificial Sequence
  Description of Artificial Sequence: Synthetic oligonucleotide
  Target: SCN9A; (+) strand; PAM type: YTN; PAM sequence: TTG
agtatcttttcaggcactct

SEQ ID NO: 99137 - DNA, 20 bp, Artificial Sequence
  Description of Artificial Sequence: Synthetic oligonucleotide
  Target: SCN9A; (+) strand; PAM type: YTN; PAM sequence: CTT
ttcaggcactctgcagccta

SEQ ID NO: 99138 - DNA, 20 bp, Artificial Sequence
  Description of Artificial Sequence: Synthetic oligonucleotide
  Target: SCN9A; (+) strand; PAM type: YTN; PAM sequence: TTT
tcaggcactctgcagcctaa

SEQ ID NO: 99139 - DNA, 20 bp, Artificial Sequence
  Description of Artificial Sequence: Synthetic oligonucleotide
  Target: SCN9A; (+) strand; PAM type: YTN; PAM sequence: TTT
caggcactctgcagcctaag

SEQ ID NO: 99140 - DNA, 20 bp, Artificial Sequence
  Description of Artificial Sequence: Synthetic oligonucleotide
  Target: SCN9A; (+) strand; PAM type: YTN; PAM sequence: TTC
aggcactctgcagcctaagt

SEQ ID NO: 99141 - DNA, 20 bp, Artificial Sequence
  Description of Artificial Sequence: Synthetic oligonucleotide
  Target: SCN9A; (+) strand; PAM type: YTN; PAM sequence: CTC
tgcagcctaagtgcaaatta

SEQ ID NO: 99142 - DNA, 20 bp, Artificial Sequence
  Description of Artificial Sequence: Synthetic oligonucleotide
  Target: SCN9A; (+) strand; PAM type: YTN; PAM sequence: CTG
cagcctaagtgcaaattaag

SEQ ID NO: 99143 - DNA, 20 bp, Artificial Sequence
  Description of Artificial Sequence: Synthetic oligonucleotide
  Target: SCN9A; (+) strand; PAM type: YTN; PAM sequence: CTA
agtgcaaattaagtaaactc

SEQ ID NO: 99144 - DNA, 20 bp, Artificial Sequence
  Description of Artificial Sequence: Synthetic oligonucleotide
  Target: SCN9A; (+) strand; PAM type: YTN; PAM sequence: TTA
agtaaactctctgagcttta

SEQ ID NO: 99145 - DNA, 20 bp, Artificial Sequence
  Description of Artificial Sequence: Synthetic oligonucleotide
  Target: SCN9A; (+) strand; PAM type: YTN; PAM sequence: CTC
tctgagctttagttttctca

SEQ ID NO: 99146 - DNA, 20 bp, Artificial Sequence
  Description of Artificial Sequence: Synthetic oligonucleotide
  Target: SCN9A; (+) strand; PAM type: YTN; PAM sequence: CTC
tgagctttagttttctcaaa

SEQ ID NO: 99147 - DNA, 20 bp, Artificial Sequence
  Description of Artificial Sequence: Synthetic oligonucleotide
  Target: SCN9A; (+) strand; PAM type: YTN; PAM sequence: CTG
agctttagttttctcaaata

SEQ ID NO: 99148 - DNA, 20 bp, Artificial Sequence
  Description of Artificial Sequence: Synthetic oligonucleotide
  Target: SCN9A; (+) strand; PAM type: YTN; PAM sequence: CTT
tagttttctcaaatataatt

SEQ ID NO: 99149 - DNA, 20 bp, Artificial Sequence
  Description of Artificial Sequence: Synthetic oligonucleotide
  Target: SCN9A; (+) strand; PAM type: YTN; PAM sequence: TTT
agttttctcaaatataattt

SEQ ID NO: 99150 - DNA, 20 bp, Artificial Sequence
  Description of Artificial Sequence: Synthetic oligonucleotide
  Target: SCN9A; (+) strand; PAM type: YTN; PAM sequence: TTA
gttttctcaaatataattta

SEQ ID NO: 99151 - DNA, 20 bp, Artificial Sequence
  Description of Artificial Sequence: Synthetic oligonucleotide
  Target: SCN9A; (+) strand; PAM type: YTN; PAM sequence: TTT
tctcaaatataatttagtta

SEQ ID NO: 99152 - DNA, 20 bp, Artificial Sequence
  Description of Artificial Sequence: Synthetic oligonucleotide
  Target: SCN9A; (+) strand; PAM type: YTN; PAM sequence: TTT
ctcaaatataatttagttat

SEQ ID NO: 99153 - DNA, 20 bp, Artificial Sequence
  Description of Artificial Sequence: Synthetic oligonucleotide
  Target: SCN9A; (+) strand; PAM type: YTN; PAM sequence: TTC
tcaaatataatttagttata

SEQ ID NO: 99154 - DNA, 20 bp, Artificial Sequence
  Description of Artificial Sequence: Synthetic oligonucleotide
  Target: SCN9A; (+) strand; PAM type: YTN; PAM sequence: CTC
aaatataatttagttataat

SEQ ID NO: 99155 - DNA, 20 bp, Artificial Sequence
  Description of Artificial Sequence: Synthetic oligonucleotide
  Target: SCN9A; (+) strand; PAM type: YTN; PAM sequence: TTT
agttataattccacttactt

SEQ ID NO: 99156 - DNA, 20 bp, Artificial Sequence
  Description of Artificial Sequence: Synthetic oligonucleotide
  Target: SCN9A; (+) strand; PAM type: YTN; PAM sequence: TTA
gttataattccacttacttt

SEQ ID NO: 99157 - DNA, 20 bp, Artificial Sequence
  Description of Artificial Sequence: Synthetic oligonucleotide
  Target: SCN9A; (+) strand; PAM type: YTN; PAM sequence: TTA
taattccacttactttgcaa

SEQ ID NO: 99158 - DNA, 20 bp, Artificial Sequence
  Description of Artificial Sequence: Synthetic oligonucleotide
  Target: SCN9A; (+) strand; PAM type: YTN; PAM sequence: TTC
cacttactttgcaatgttat

SEQ ID NO: 99159 - DNA, 20 bp, Artificial Sequence
  Description of Artificial Sequence: Synthetic oligonucleotide
  Target: SCN9A; (+) strand; PAM type: YTN; PAM sequence: CTT
actttgcaatgttattttaa

SEQ ID NO: 99160 - DNA, 20 bp, Artificial Sequence
  Description of Artificial Sequence: Synthetic oligonucleotide
  Target: SCN9A; (+) strand; PAM type: YTN; PAM sequence: TTA
ctttgcaatgttattttaaa

SEQ ID NO: 99161 - DNA, 20 bp, Artificial Sequence
  Description of Artificial Sequence: Synthetic oligonucleotide
  Target: SCN9A; (+) strand; PAM type: YTN; PAM sequence: CTT
tgcaatgttattttaaaggt

SEQ ID NO: 99162 - DNA, 20 bp, Artificial Sequence
  Description of Artificial Sequence: Synthetic oligonucleotide
  Target: SCN9A; (+) strand; PAM type: YTN; PAM sequence: TTT
gcaatgttattttaaaggtg

SEQ ID NO: 99163 - DNA, 20 bp, Artificial Sequence
  Description of Artificial Sequence: Synthetic oligonucleotide
  Target: SCN9A; (+) strand; PAM type: YTN; PAM sequence: TTG
caatgttattttaaaggtga

SEQ ID NO: 99164 - DNA, 20 bp, Artificial Sequence
  Description of Artificial Sequence: Synthetic oligonucleotide
  Target: SCN9A; (+) strand; PAM type: YTN; PAM sequence: TTA
ttttaaaggtgaaattaaat

SEQ ID NO: 99165 - DNA, 20 bp, Artificial Sequence
  Description of Artificial Sequence: Synthetic oligonucleotide
  Target: SCN9A; (+) strand; PAM type: YTN; PAM sequence: TTT
taaaggtgaaattaaatgtg

SEQ ID NO: 99166 - DNA, 20 bp, Artificial Sequence
  Description of Artificial Sequence: Synthetic oligonucleotide
  Target: SCN9A; (+) strand; PAM type: YTN; PAM sequence: TTT
aaaggtgaaattaaatgtga

SEQ ID NO: 99167 - DNA, 20 bp, Artificial Sequence
  Description of Artificial Sequence: Synthetic oligonucleotide
  Target: SCN9A; (+) strand; PAM type: YTN; PAM sequence: TTA
aaggtgaaattaaatgtgat

SEQ ID NO: 99168 - DNA, 20 bp, Artificial Sequence
  Description of Artificial Sequence: Synthetic oligonucleotide
  Target: SCN9A; (+) strand; PAM type: YTN; PAM sequence: TTA
aatgtgatggctgatgctgt

SEQ ID NO: 99169 - DNA, 20 bp, Artificial Sequence
  Description of Artificial Sequence: Synthetic oligonucleotide
  Target: SCN9A; (+) strand; PAM type: YTN; PAM sequence: CTG
atgctgtctcacttacctat

SEQ ID NO: 99170 - DNA, 20 bp, Artificial Sequence
  Description of Artificial Sequence: Synthetic oligonucleotide
  Target: SCN9A; (+) strand; PAM type: YTN; PAM sequence: CTG
tctcacttacctatcttttc

SEQ ID NO: 99171 - DNA, 20 bp, Artificial Sequence
  Description of Artificial Sequence: Synthetic oligonucleotide
  Target: SCN9A; (+) strand; PAM type: YTN; PAM sequence: CTC
acttacctatcttttctaat

SEQ ID NO: 99172 - DNA, 20 bp, Artificial Sequence
  Description of Artificial Sequence: Synthetic oligonucleotide
  Target: SCN9A; (+) strand; PAM type: YTN; PAM sequence: CTT
acctatcttttctaatgctc

SEQ ID NO: 99173 - DNA, 20 bp, Artificial Sequence
  Description of Artificial Sequence: Synthetic oligonucleotide
  Target: SCN9A; (+) strand; PAM type: YTN; PAM sequence: TTA
cctatcttttctaatgctcc

SEQ ID NO: 99174 - DNA, 20 bp, Artificial Sequence
  Description of Artificial Sequence: Synthetic oligonucleotide
  Target: SCN9A; (+) strand; PAM type: YTN; PAM sequence: CTA
tcttttctaatgctccttac

SEQ ID NO: 99175 - DNA, 20 bp, Artificial Sequence
  Description of Artificial Sequence: Synthetic oligonucleotide
  Target: SCN9A; (+) strand; PAM type: YTN; PAM sequence: CTT
ttctaatgctccttacccag

SEQ ID NO: 99176 - DNA, 20 bp, Artificial Sequence
  Description of Artificial Sequence: Synthetic oligonucleotide
  Target: SCN9A; (+) strand; PAM type: YTN; PAM sequence: TTT
tctaatgctccttacccagg

SEQ ID NO: 99177 - DNA, 20 bp, Artificial Sequence
  Description of Artificial Sequence: Synthetic oligonucleotide
  Target: SCN9A; (+) strand; PAM type: YTN; PAM sequence: TTT
ctaatgctccttacccaggt

SEQ ID NO: 99178 - DNA, 20 bp, Artificial Sequence
  Description of Artificial Sequence: Synthetic oligonucleotide
  Target: SCN9A; (+) strand; PAM type: YTN; PAM sequence: TTC
taatgctccttacccaggta

SEQ ID NO: 99179 - DNA, 20 bp, Artificial Sequence
  Description of Artificial Sequence: Synthetic oligonucleotide
  Target: SCN9A; (+) strand; PAM type: YTN; PAM sequence: CTA
atgctccttacccaggtagt

SEQ ID NO: 99180 - DNA, 20 bp, Artificial Sequence
  Description of Artificial Sequence: Synthetic oligonucleotide
  Target: SCN9A; (+) strand; PAM type: YTN; PAM sequence: CTC
cttacccaggtagtttctta

SEQ ID NO: 99181 - DNA, 20 bp, Artificial Sequence
  Description of Artificial Sequence: Synthetic oligonucleotide
  Target: SCN9A; (+) strand; PAM type: YTN; PAM sequence: CTT
acccaggtagtttcttaaac

SEQ ID NO: 99182 - DNA, 20 bp, Artificial Sequence
  Description of Artificial Sequence: Synthetic oligonucleotide
  Target: SCN9A; (+) strand; PAM type: YTN; PAM sequence: TTA
cccaggtagtttcttaaaca

SEQ ID NO: 99183 - DNA, 20 bp, Artificial Sequence
  Description of Artificial Sequence: Synthetic oligonucleotide
  Target: SCN9A; (+) strand; PAM type: YTN; PAM sequence: TTT
cttaaacaaatattatttga

SEQ ID NO: 99184 - DNA, 20 bp, Artificial Sequence
  Description of Artificial Sequence: Synthetic oligonucleotide
  Target: SCN9A; (+) strand; PAM type: YTN; PAM sequence: TTC
ttaaacaaatattatttgaa

SEQ ID NO: 99185 - DNA, 20 bp, Artificial Sequence
  Description of Artificial Sequence: Synthetic oligonucleotide
  Target: SCN9A; (+) strand; PAM type: YTN; PAM sequence: CTT
aaacaaatattatttgaaca

SEQ ID NO: 99186 - DNA, 20 bp, Artificial Sequence
  Description of Artificial Sequence: Synthetic oligonucleotide
  Target: SCN9A; (+) strand; PAM type: YTN; PAM sequence: TTA
aacaaatattatttgaacac

SEQ ID NO: 99187 - DNA, 20 bp, Artificial Sequence
  Description of Artificial Sequence: Synthetic oligonucleotide
  Target: SCN9A; (+) strand; PAM type: YTN; PAM sequence: TTA
tttgaacacctgatataagt

SEQ ID NO: 99188 - DNA, 20 bp, Artificial Sequence
  Description of Artificial Sequence: Synthetic oligonucleotide
  Target: SCN9A; (+) strand; PAM type: YTN; PAM sequence: TTT
gaacacctgatataagtagg

SEQ ID NO: 99189 - DNA, 20 bp, Artificial Sequence
  Description of Artificial Sequence: Synthetic oligonucleotide
  Target: SCN9A; (+) strand; PAM type: YTN; PAM sequence: TTG
aacacctgatataagtaggt

SEQ ID NO: 99190 - DNA, 20 bp, Artificial Sequence
  Description of Artificial Sequence: Synthetic oligonucleotide
  Target: SCN9A; (+) strand; PAM type: YTN; PAM sequence: CTG
atataagtaggtccttgatt

SEQ ID NO: 99191 - DNA, 20 bp, Artificial Sequence
  Description of Artificial Sequence: Synthetic oligonucleotide
  Target: SCN9A; (+) strand; PAM type: YTN; PAM sequence: CTT
gattacttatgtatgagaga

SEQ ID NO: 99192 - DNA, 20 bp, Artificial Sequence
  Description of Artificial Sequence: Synthetic oligonucleotide
  Target: SCN9A; (+) strand; PAM type: YTN; PAM sequence: TTG
attacttatgtatgagagat

SEQ ID NO: 99193 - DNA, 20 bp, Artificial Sequence
  Description of Artificial Sequence: Synthetic oligonucleotide
  Target: SCN9A; (+) strand; PAM type: YTN; PAM sequence: TTA
cttatgtatgagagatgatg

SEQ ID NO: 99194 - DNA, 20 bp, Artificial Sequence
  Description of Artificial Sequence: Synthetic oligonucleotide
  Target: SCN9A; (+) strand; PAM type: YTN; PAM sequence: CTT
atgtatgagagatgatgtta

SEQ ID NO: 99195 - DNA, 20 bp, Artificial Sequence
  Description of Artificial Sequence: Synthetic oligonucleotide
  Target: SCN9A; (+) strand; PAM type: YTN; PAM sequence: TTA
tgtatgagagatgatgttag

SEQ ID NO: 99196 - DNA, 20 bp, Artificial Sequence
  Description of Artificial Sequence: Synthetic oligonucleotide
  Target: SCN9A; (+) strand; PAM type: YTN; PAM sequence: TTA
ggaacaatagtttccccttt

SEQ ID NO: 99197 - DNA, 20 bp, Artificial Sequence
  Description of Artificial Sequence: Synthetic oligonucleotide
  Target: SCN9A; (+) strand; PAM type: YTN; PAM sequence: TTT
cccctttcacttggacttcc

SEQ ID NO: 99198 - DNA, 20 bp, Artificial Sequence
  Description of Artificial Sequence: Synthetic oligonucleotide
  Target: SCN9A; (+) strand; PAM type: YTN; PAM sequence: TTC
ccctttcacttggacttcct

SEQ ID NO: 99199 - DNA, 20 bp, Artificial Sequence
  Description of Artificial Sequence: Synthetic oligonucleotide
  Target: SCN9A; (+) strand; PAM type: YTN; PAM sequence: CTT
tcacttggacttcctagcac

SEQ ID NO: 99200 - DNA, 20 bp, Artificial Sequence
  Description of Artificial Sequence: Synthetic oligonucleotide
  Target: SCN9A; (+) strand; PAM type: YTN; PAM sequence: TTT
cacttggacttcctagcaca

SEQ ID NO: 99201 - DNA, 20 bp, Artificial Sequence
  Description of Artificial Sequence: Synthetic oligonucleotide
  Target: SCN9A; (+) strand; PAM type: YTN; PAM sequence: TTC
acttggacttcctagcacag

SEQ ID NO: 99202 - DNA, 20 bp, Artificial Sequence
  Description of Artificial Sequence: Synthetic oligonucleotide
  Target: SCN9A; (+) strand; PAM type: YTN; PAM sequence: CTT
ggacttcctagcacagggaa

SEQ ID NO: 99203 - DNA, 20 bp, Artificial Sequence
  Description of Artificial Sequence: Synthetic oligonucleotide
  Target: SCN9A; (+) strand; PAM type: YTN; PAM sequence: TTG
gacttcctagcacagggaag

SEQ ID NO: 99204 - DNA, 20 bp, Artificial Sequence
  Description of Artificial Sequence: Synthetic oligonucleotide
  Target: SCN9A; (+) strand; PAM type: YTN; PAM sequence: CTT
cctagcacagggaagatttc

SEQ ID NO: 99205 - DNA, 20 bp, Artificial Sequence
  Description of Artificial Sequence: Synthetic oligonucleotide
  Target: SCN9A; (+) strand; PAM type: YTN; PAM sequence: TTC
ctagcacagggaagatttcc

SEQ ID NO: 99206 - DNA, 20 bp, Artificial Sequence
  Description of Artificial Sequence: Synthetic oligonucleotide
  Target: SCN9A; (+) strand; PAM type: YTN; PAM sequence: CTA
gcacagggaagatttccatt

SEQ ID NO: 99207 - DNA, 20 bp, Artificial Sequence
  Description of Artificial Sequence: Synthetic oligonucleotide
  Target: SCN9A; (+) strand; PAM type: YTN; PAM sequence: TTT
ccatttaatatgaaaaaagt

SEQ ID NO: 99208 - DNA, 20 bp, Artificial Sequence
  Description of Artificial Sequence: Synthetic oligonucleotide
  Target: SCN9A; (+) strand; PAM type: YTN; PAM sequence: TTC
catttaatatgaaaaaagtc

SEQ ID NO: 99209 - DNA, 20 bp, Artificial Sequence
  Description of Artificial Sequence: Synthetic oligonucleotide
  Target: SCN9A; (+) strand; PAM type: YTN; PAM sequence: TTT
aatatgaaaaaagtcactca

SEQ ID NO: 99210 - DNA, 20 bp, Artificial Sequence
  Description of Artificial Sequence: Synthetic oligonucleotide
  Target: SCN9A; (+) strand; PAM type: YTN; PAM sequence: TTA
atatgaaaaaagtcactcat

SEQ ID NO: 99211 - DNA, 20 bp, Artificial Sequence
  Description of Artificial Sequence: Synthetic oligonucleotide
  Target: SCN9A; (+) strand; PAM type: YTN; PAM sequence: CTC
atttggatcattctattgtt

SEQ ID NO: 99212 - DNA, 20 bp, Artificial Sequence
  Description of Artificial Sequence: Synthetic oligonucleotide
  Target: SCN9A; (+) strand; PAM type: YTN; PAM sequence: TTT
ggatcattctattgtttgac

SEQ ID NO: 99213 - DNA, 20 bp, Artificial Sequence
  Description of Artificial Sequence: Synthetic oligonucleotide
  Target: SCN9A; (+) strand; PAM type: YTN; PAM sequence: TTG
gatcattctattgtttgaca

SEQ ID NO: 99214 - DNA, 20 bp, Artificial Sequence
  Description of Artificial Sequence: Synthetic oligonucleotide
  Target: SCN9A; (+) strand; PAM type: YTN; PAM sequence: TTC
tattgtttgacaatattaga

SEQ ID NO: 99215 - DNA, 20 bp, Artificial Sequence
  Description of Artificial Sequence: Synthetic oligonucleotide
  Target: SCN9A; (+) strand; PAM type: YTN; PAM sequence: CTA
ttgtttgacaatattagata

SEQ ID NO: 99216 - DNA, 20 bp, Artificial Sequence
  Description of Artificial Sequence: Synthetic oligonucleotide
  Target: SCN9A; (+) strand; PAM type: YTN; PAM sequence: TTG
tttgacaatattagataaag

SEQ ID NO: 99217 - DNA, 20 bp, Artificial Sequence
  Description of Artificial Sequence: Synthetic oligonucleotide
  Target: SCN9A; (+) strand; PAM type: YTN; PAM sequence: TTT
gacaatattagataaaggca

SEQ ID NO: 99218 - DNA, 20 bp, Artificial Sequence
  Description of Artificial Sequence: Synthetic oligonucleotide
  Target: SCN9A; (+) strand; PAM type: YTN; PAM sequence: TTG
acaatattagataaaggcag

SEQ ID NO: 99219 - DNA, 20 bp, Artificial Sequence
  Description of Artificial Sequence: Synthetic oligonucleotide
  Target: SCN9A; (+) strand; PAM type: YTN; PAM sequence: TTA
gataaaggcaggattactgt

SEQ ID NO: 99220 - DNA, 20 bp, Artificial Sequence
  Description of Artificial Sequence: Synthetic oligonucleotide
  Target: SCN9A; (+) strand; PAM type: YTN; PAM sequence: TTA
ctgtgattaacttattccct

SEQ ID NO: 99221 - DNA, 20 bp, Artificial Sequence
  Description of Artificial Sequence: Synthetic oligonucleotide
  Target: SCN9A; (+) strand; PAM type: YTN; PAM sequence: CTG
tgattaacttattcccttgt

SEQ ID NO: 99222 - DNA, 20 bp, Artificial Sequence
  Description of Artificial Sequence: Synthetic oligonucleotide
  Target: SCN9A; (+) strand; PAM type: YTN; PAM sequence: TTA
acttattcccttgttaaaca

SEQ ID NO: 99223 - DNA, 20 bp, Artificial Sequence
  Description of Artificial Sequence: Synthetic oligonucleotide
  Target: SCN9A; (+) strand; PAM type: YTN; PAM sequence: CTT
attcccttgttaaacaatat

SEQ ID NO: 99224 - DNA, 20 bp, Artificial Sequence
  Description of Artificial Sequence: Synthetic oligonucleotide
  Target: SCN9A; (+) strand; PAM type: YTN; PAM sequence: TTA
ttcccttgttaaacaatatg

SEQ ID NO: 99225 - DNA, 20 bp, Artificial Sequence
  Description of Artificial Sequence: Synthetic oligonucleotide
  Target: SCN9A; (+) strand; PAM type: YTN; PAM sequence: TTC
ccttgttaaacaatatgcac

SEQ ID NO: 99226 - DNA, 20 bp, Artificial Sequence
  Description of Artificial Sequence: Synthetic oligonucleotide
  Target: SCN9A; (+) strand; PAM type: YTN; PAM sequence: CTT
gttaaacaatatgcactgaa

SEQ ID NO: 99227 - DNA, 20 bp, Artificial Sequence
  Description of Artificial Sequence: Synthetic oligonucleotide
  Target: SCN9A; (+) strand; PAM type: YTN; PAM sequence: TTG
ttaaacaatatgcactgaaa

SEQ ID NO: 99228 - DNA, 20 bp, Artificial Sequence
  Description of Artificial Sequence: Synthetic oligonucleotide
  Target: SCN9A; (+) strand; PAM type: YTN; PAM sequence: TTA
aacaatatgcactgaaatac

SEQ ID NO: 99229 - DNA, 20 bp, Artificial Sequence
  Description of Artificial Sequence: Synthetic oligonucleotide
  Target: SCN9A; (+) strand; PAM type: YTN; PAM sequence: CTG
aaatactgtgtgtgtatata

SEQ ID NO: 99230 - DNA, 20 bp, Artificial Sequence
  Description of Artificial Sequence: Synthetic oligonucleotide
  Target: SCN9A; (+) strand; PAM type: YTN; PAM sequence: CTG
tgtgtgtatatatatatata

SEQ ID NO: 99231 - DNA, 20 bp, Artificial Sequence
  Description of Artificial Sequence: Synthetic oligonucleotide
  Target: SCN9A; (+) strand; PAM type: YTN; PAM sequence: CTA
atatgtacagtaaatgaaat

SEQ ID NO: 99232 - DNA, 20 bp, Artificial Sequence
  Description of Artificial Sequence: Synthetic oligonucleotide
  Target: SCN9A; (+) strand; PAM type: YTN; PAM sequence: CTA
tactatatatgcatatttta

SEQ ID NO: 99233 - DNA, 20 bp, Artificial Sequence
  Description of Artificial Sequence: Synthetic oligonucleotide
  Target: SCN9A; (+) strand; PAM type: YTN; PAM sequence: CTA
tatatgcatattttatatat

SEQ ID NO: 99234 - DNA, 20 bp, Artificial Sequence
  Description of Artificial Sequence: Synthetic oligonucleotide
  Target: SCN9A; (+) strand; PAM type: YTN; PAM sequence: TTT
tatatatagtctttcatatt

SEQ ID NO: 99235 - DNA, 20 bp, Artificial Sequence
  Description of Artificial Sequence: Synthetic oligonucleotide
  Target: SCN9A; (+) strand; PAM type: YTN; PAM sequence: TTT
atatatagtctttcatattc

SEQ ID NO: 99236 - DNA, 20 bp, Artificial Sequence
  Description of Artificial Sequence: Synthetic oligonucleotide
  Target: SCN9A; (+) strand; PAM type: YTN; PAM sequence: TTA
tatatagtctttcatattct

SEQ ID NO: 99237 - DNA, 20 bp, Artificial Sequence
  Description of Artificial Sequence: Synthetic oligonucleotide
  Target: SCN9A; (+) strand; PAM type: YTN; PAM sequence: CTT
tcatattctgtatatattaa

SEQ ID NO: 99238 - DNA, 20 bp, Artificial Sequence
  Description of Artificial Sequence: Synthetic oligonucleotide
  Target: SCN9A; (+) strand; PAM type: YTN; PAM sequence: TTT
catattctgtatatattaat

SEQ ID NO: 99239 - DNA, 20 bp, Artificial Sequence
  Description of Artificial Sequence: Synthetic oligonucleotide
  Target: SCN9A; (+) strand; PAM type: YTN; PAM sequence: TTC
atattctgtatatattaata

SEQ ID NO: 99240 - DNA, 20 bp, Artificial Sequence
  Description of Artificial Sequence: Synthetic oligonucleotide
  Target: SCN9A; (+) strand; PAM type: YTN; PAM sequence: TTC
tgtatatattaatatataat

SEQ ID NO: 99241 - DNA, 20 bp, Artificial Sequence
  Description of Artificial Sequence: Synthetic oligonucleotide
  Target: SCN9A; (+) strand; PAM type: YTN; PAM sequence: CTG
tatatattaatatataatag

SEQ ID NO: 99242 - DNA, 20 bp, Artificial Sequence
  Description of Artificial Sequence: Synthetic oligonucleotide
  Target: SCN9A; (+) strand; PAM type: YTN; PAM sequence: TTA
atatataatagtatatacta

SEQ ID NO: 99243 - DNA, 20 bp, Artificial Sequence
  Description of Artificial Sequence: Synthetic oligonucleotide
  Target: SCN9A; (+) strand; PAM type: YTN; PAM sequence: CTA
attagtattatactttttta

SEQ ID NO: 99244 - DNA, 20 bp, Artificial Sequence
  Description of Artificial Sequence: Synthetic oligonucleotide
  Target: SCN9A; (+) strand; PAM type: YTN; PAM sequence: TTA
gtattatacttttttagtaa

SEQ ID NO: 99245 - DNA, 20 bp, Artificial Sequence
  Description of Artificial Sequence: Synthetic oligonucleotide
  Target: SCN9A; (+) strand; PAM type: YTN; PAM sequence: TTA
tacttttttagtaatatact

SEQ ID NO: 99246 - DNA, 20 bp, Artificial Sequence
  Description of Artificial Sequence: Synthetic oligonucleotide
  Target: SCN9A; (+) strand; PAM type: YTN; PAM sequence: CTT
ttttagtaatatactagtat

SEQ ID NO: 99247 - DNA, 20 bp, Artificial Sequence
  Description of Artificial Sequence: Synthetic oligonucleotide
  Target: SCN9A; (+) strand; PAM type: YTN; PAM sequence: TTT
tttagtaatatactagtata

SEQ ID NO: 99248 - DNA, 20 bp, Artificial Sequence
  Description of Artificial Sequence: Synthetic oligonucleotide
  Target: SCN9A; (+) strand; PAM type: YTN; PAM sequence: TTT
ttagtaatatactagtatat

SEQ ID NO: 99249 - DNA, 20 bp, Artificial Sequence
  Description of Artificial Sequence: Synthetic oligonucleotide
  Target: SCN9A; (+) strand; PAM type: YTN; PAM sequence: TTT
tagtaatatactagtatata

SEQ ID NO: 99250 - DNA, 20 bp, Artificial Sequence
  Description of Artificial Sequence: Synthetic oligonucleotide
  Target: SCN9A; (+) strand; PAM type: YTN; PAM sequence: TTT
agtaatatactagtatatac

SEQ ID NO: 99251 - DNA, 20 bp, Artificial Sequence
  Description of Artificial Sequence: Synthetic oligonucleotide
  Target: SCN9A; (+) strand; PAM type: YTN; PAM sequence: TTA
gtaatatactagtatatact

SEQ ID NO: 99252 - DNA, 20 bp, Artificial Sequence
  Description of Artificial Sequence: Synthetic oligonucleotide
  Target: SCN9A; (+) strand; PAM type: YTN; PAM sequence: CTA
gtatatactaatgagtatta

SEQ ID NO: 99253 - DNA, 20 bp, Artificial Sequence
  Description of Artificial Sequence: Synthetic oligonucleotide
  Target: SCN9A; (+) strand; PAM type: YTN; PAM sequence: CTA
atgagtattatactattttt

SEQ ID NO: 99254 - DNA, 20 bp, Artificial Sequence
  Description of Artificial Sequence: Synthetic oligonucleotide
  Target: SCN9A; (+) strand; PAM type: YTN; PAM sequence: TTA
tactatttttagtaatatac

SEQ ID NO: 99255 - DNA, 20 bp, Artificial Sequence
  Description of Artificial Sequence: Synthetic oligonucleotide
  Target: SCN9A; (+) strand; PAM type: YTN; PAM sequence: CTA
tttttagtaatatactattt

SEQ ID NO: 99256 - DNA, 20 bp, Artificial Sequence
  Description of Artificial Sequence: Synthetic oligonucleotide
  Target: SCN9A; (+) strand; PAM type: YTN; PAM sequence: TTT
ttagtaatatactatttaat

SEQ ID NO: 99257 - DNA, 20 bp, Artificial Sequence
  Description of Artificial Sequence: Synthetic oligonucleotide
  Target: SCN9A; (+) strand; PAM type: YTN; PAM sequence: TTT
tagtaatatactatttaatt

SEQ ID NO: 99258 - DNA, 20 bp, Artificial Sequence
  Description of Artificial Sequence: Synthetic oligonucleotide
  Target: SCN9A; (+) strand; PAM type: YTN; PAM sequence: TTT
agtaatatactatttaatta

SEQ ID NO: 99259 - DNA, 20 bp, Artificial Sequence
  Description of Artificial Sequence: Synthetic oligonucleotide
  Target: SCN9A; (+) strand; PAM type: YTN; PAM sequence: TTA
gtaatatactatttaattaa

SEQ ID NO: 99260 - DNA, 20 bp, Artificial Sequence
  Description of Artificial Sequence: Synthetic oligonucleotide
  Target: SCN9A; (+) strand; PAM type: YTN; PAM sequence: CTA
tttaattaatgctataatta

SEQ ID NO: 99261 - DNA, 20 bp, Artificial Sequence
  Description of Artificial Sequence: Synthetic oligonucleotide
  Target: SCN9A; (+) strand; PAM type: YTN; PAM sequence: TTT
aattaatgctataattagta

SEQ ID NO: 99262 - DNA, 20 bp, Artificial Sequence
  Description of Artificial Sequence: Synthetic oligonucleotide
  Target: SCN9A; (+) strand; PAM type: YTN; PAM sequence: TTA
attaatgctataattagtat

SEQ ID NO: 99263 - DNA, 20 bp, Artificial Sequence
  Description of Artificial Sequence: Synthetic oligonucleotide
  Target: SCN9A; (+) strand; PAM type: YTN; PAM sequence: TTA
atgctataattagtatttat

SEQ ID NO: 99264 - DNA, 20 bp, Artificial Sequence
  Description of Artificial Sequence: Synthetic oligonucleotide
  Target: SCN9A; (+) strand; PAM type: YTN; PAM sequence: CTA
taattagtatttatatatta

SEQ ID NO: 99265 - DNA, 20 bp, Artificial Sequence
  Description of Artificial Sequence: Synthetic oligonucleotide
  Target: SCN9A; (+) strand; PAM type: YTN; PAM sequence: TTA
gtatttatatattagtatgc

SEQ ID NO: 99266 - DNA, 20 bp, Artificial Sequence
  Description of Artificial Sequence: Synthetic oligonucleotide
  Target: SCN9A; (+) strand; PAM type: YTN; PAM sequence: TTT
atatattagtatgcatatat

SEQ ID NO: 99267 - DNA, 20 bp, Artificial Sequence
  Description of Artificial Sequence: Synthetic oligonucleotide
  Target: SCN9A; (+) strand; PAM type: YTN; PAM sequence: TTA
tatattagtatgcatatata

SEQ ID NO: 99268 - DNA, 20 bp, Artificial Sequence
  Description of Artificial Sequence: Synthetic oligonucleotide
  Target: SCN9A; (+) strand; PAM type: YTN; PAM sequence: TTA
gtatgcatatataccattag

SEQ ID NO: 99269 - DNA, 20 bp, Artificial Sequence
  Description of Artificial Sequence: Synthetic oligonucleotide
  Target: SCN9A; (+) strand; PAM type: YTN; PAM sequence: TTA
gtatatataatatgcatata

SEQ ID NO: 99270 - DNA, 20 bp, Artificial Sequence
  Description of Artificial Sequence: Synthetic oligonucleotide
  Target: SCN9A; (+) strand; PAM type: YTN; PAM sequence: CTA
ttagtatatgtaatatgcat

SEQ ID NO: 99271 - DNA, 20 bp, Artificial Sequence
  Description of Artificial Sequence: Synthetic oligonucleotide
  Target: SCN9A; (+) strand; PAM type: YTN; PAM sequence: TTA
gtatatgtaatatgcatata

SEQ ID NO: 99272 - DNA, 20 bp, Artificial Sequence
  Description of Artificial Sequence: Synthetic oligonucleotide
  Target: SCN9A; (+) strand; PAM type: YTN; PAM sequence: CTA
ttagtgtatataatatgcat

SEQ ID NO: 99273 - DNA, 20 bp, Artificial Sequence
  Description of Artificial Sequence: Synthetic oligonucleotide
  Target: SCN9A; (+) strand; PAM type: YTN; PAM sequence: TTA
gtgtatataatatgcatata

SEQ ID NO: 99274 - DNA, 20 bp, Artificial Sequence
  Description of Artificial Sequence: Synthetic oligonucleotide
  Target: SCN9A; (+) strand; PAM type: YTN; PAM sequence: CTA
tatatagtatatatgcatac

SEQ ID NO: 99275 - DNA, 20 bp, Artificial Sequence
  Description of Artificial Sequence: Synthetic oligonucleotide
  Target: SCN9A; (+) strand; PAM type: YTN; PAM sequence: CTG
tatatagtatgtaaatgcat

SEQ ID NO: 99276 - DNA, 20 bp, Artificial Sequence
  Description of Artificial Sequence: Synthetic oligonucleotide
  Target: SCN9A; (+) strand; PAM type: YTN; PAM sequence: CTA
tatagtatacatatgcatat

SEQ ID NO: 99277 - DNA, 20 bp, Artificial Sequence
  Description of Artificial Sequence: Synthetic oligonucleotide
  Target: SCN9A; (+) strand; PAM type: YTN; PAM sequence: CTA
tgtatttatgtaaacagaaa

SEQ ID NO: 99278 - DNA, 20 bp, Artificial Sequence
  Description of Artificial Sequence: Synthetic oligonucleotide
  Target: SCN9A; (+) strand; PAM type: YTN; PAM sequence: TTT
atgtaaacagaaacaactca

SEQ ID NO: 99279 - DNA, 20 bp, Artificial Sequence
  Description of Artificial Sequence: Synthetic oligonucleotide
  Target: SCN9A; (+) strand; PAM type: YTN; PAM sequence: TTA
tgtaaacagaaacaactcat

SEQ ID NO: 99280 - DNA, 20 bp, Artificial Sequence
  Description of Artificial Sequence: Synthetic oligonucleotide
  Target: SCN9A; (+) strand; PAM type: YTN; PAM sequence: CTC
ataatttctacatacccatt

SEQ ID NO: 99281 - DNA, 20 bp, Artificial Sequence
  Description of Artificial Sequence: Synthetic oligonucleotide
  Target: SCN9A; (+) strand; PAM type: YTN; PAM sequence: TTT
ctacatacccattgttttta

SEQ ID NO: 99282 - DNA, 20 bp, Artificial Sequence
  Description of Artificial Sequence: Synthetic oligonucleotide
  Target: SCN9A; (+) strand; PAM type: YTN; PAM sequence: TTC
tacatacccattgtttttat

SEQ ID NO: 99283 - DNA, 20 bp, Artificial Sequence
  Description of Artificial Sequence: Synthetic oligonucleotide
  Target: SCN9A; (+) strand; PAM type: YTN; PAM sequence: CTA
catacccattgtttttatat

SEQ ID NO: 99284 - DNA, 20 bp, Artificial Sequence
  Description of Artificial Sequence: Synthetic oligonucleotide
  Target: SCN9A; (+) strand; PAM type: YTN; PAM sequence: TTG
tttttatattttaaacccca

SEQ ID NO: 99285 - DNA, 20 bp, Artificial Sequence
  Description of Artificial Sequence: Synthetic oligonucleotide
  Target: SCN9A; (+) strand; PAM type: YTN; PAM sequence: TTT
ttatattttaaaccccatta

SEQ ID NO: 99286 - DNA, 20 bp, Artificial Sequence
  Description of Artificial Sequence: Synthetic oligonucleotide
  Target: SCN9A; (+) strand; PAM type: YTN; PAM sequence: TTT
tatattttaaaccccattaa

SEQ ID NO: 99287 - DNA, 20 bp, Artificial Sequence
  Description of Artificial Sequence: Synthetic oligonucleotide
  Target: SCN9A; (+) strand; PAM type: YTN; PAM sequence: TTT
atattttaaaccccattaaa

SEQ ID NO: 99288 - DNA, 20 bp, Artificial Sequence
  Description of Artificial Sequence: Synthetic oligonucleotide
  Target: SCN9A; (+) strand; PAM type: YTN; PAM sequence: TTA
tattttaaaccccattaaaa

SEQ ID NO: 99289 - DNA, 20 bp, Artificial Sequence
  Description of Artificial Sequence: Synthetic oligonucleotide
  Target: SCN9A; (+) strand; PAM type: YTN; PAM sequence: TTT
taaaccccattaaaaaataa

SEQ ID NO: 99290 - DNA, 20 bp, Artificial Sequence
  Description of Artificial Sequence: Synthetic oligonucleotide
  Target: SCN9A; (+) strand; PAM type: YTN; PAM sequence: TTT
aaaccccattaaaaaataag

SEQ ID NO: 99291 - DNA, 20 bp, Artificial Sequence
  Description of Artificial Sequence: Synthetic oligonucleotide
  Target: SCN9A; (+) strand; PAM type: YTN; PAM sequence: TTA
aaccccattaaaaaataaga

SEQ ID NO: 99292 - DNA, 20 bp, Artificial Sequence
  Description of Artificial Sequence: Synthetic oligonucleotide
  Target: SCN9A; (+) strand; PAM type: YTN; PAM sequence: TTA
aaaaataagaacattataaa

SEQ ID NO: 99293 - DNA, 20 bp, Artificial Sequence
  Description of Artificial Sequence: Synthetic oligonucleotide
  Target: SCN9A; (+) strand; PAM type: YTN; PAM sequence: TTA
taaagtttagtattttctta

SEQ ID NO: 99294 - DNA, 20 bp, Artificial Sequence
  Description of Artificial Sequence: Synthetic oligonucleotide
  Target: SCN9A; (+) strand; PAM type: YTN; PAM sequence: TTT
agtattttcttaccctcatt

SEQ ID NO: 99295 - DNA, 20 bp, Artificial Sequence
  Description of Artificial Sequence: Synthetic oligonucleotide
  Target: SCN9A; (+) strand; PAM type: YTN; PAM sequence: TTA
gtattttcttaccctcattc

SEQ ID NO: 99296 - DNA, 20 bp, Artificial Sequence
  Description of Artificial Sequence: Synthetic oligonucleotide
  Target: SCN9A; (+) strand; PAM type: YTN; PAM sequence: TTT
tcttaccctcattccttcaa

SEQ ID NO: 99297 - DNA, 20 bp, Artificial Sequence
  Description of Artificial Sequence: Synthetic oligonucleotide
  Target: SCN9A; (+) strand; PAM type: YTN; PAM sequence: TTT
cttaccctcattccttcaaa

SEQ ID NO: 99298 - DNA, 20 bp, Artificial Sequence
  Description of Artificial Sequence: Synthetic oligonucleotide
  Target: SCN9A; (+) strand; PAM type: YTN; PAM sequence: TTC
ttaccctcattccttcaaat

SEQ ID NO: 99299 - DNA, 20 bp, Artificial Sequence
  Description of Artificial Sequence: Synthetic oligonucleotide
  Target: SCN9A; (+) strand; PAM type: YTN; PAM sequence: CTT
accctcattccttcaaatct

SEQ ID NO: 99300 - DNA, 20 bp, Artificial Sequence
  Description of Artificial Sequence: Synthetic oligonucleotide
  Target: SCN9A; (+) strand; PAM type: YTN; PAM sequence: TTA
ccctcattccttcaaatcta

SEQ ID NO: 99301 - DNA, 20 bp, Artificial Sequence
  Description of Artificial Sequence: Synthetic oligonucleotide
  Target: SCN9A; (+) strand; PAM type: YTN; PAM sequence: CTC
attccttcaaatctagataa

SEQ ID NO: 99302 - DNA, 20 bp, Artificial Sequence
  Description of Artificial Sequence: Synthetic oligonucleotide
  Target: SCN9A; (+) strand; PAM type: YTN; PAM sequence: TTC
cttcaaatctagataaggct

SEQ ID NO: 99303 - DNA, 20 bp, Artificial Sequence
  Description of Artificial Sequence: Synthetic oligonucleotide
  Target: SCN9A; (+) strand; PAM type: YTN; PAM sequence: CTT
caaatctagataaggctctt

SEQ ID NO: 99304 - DNA, 20 bp, Artificial Sequence
  Description of Artificial Sequence: Synthetic oligonucleotide
  Target: SCN9A; (+) strand; PAM type: YTN; PAM sequence: TTC
aaatctagataaggctctta

SEQ ID NO: 99305 - DNA, 20 bp, Artificial Sequence
  Description of Artificial Sequence: Synthetic oligonucleotide
  Target: SCN9A; (+) strand; PAM type: YTN; PAM sequence: CTA
gataaggctcttagaggtct

SEQ ID NO: 99306 - DNA, 20 bp, Artificial Sequence
  Description of Artificial Sequence: Synthetic oligonucleotide
  Target: SCN9A; (+) strand; PAM type: YTN; PAM sequence: CTC
ttagaggtcttaaagctctc

SEQ ID NO: 99307 - DNA, 20 bp, Artificial Sequence
  Description of Artificial Sequence: Synthetic oligonucleotide
  Target: SCN9A; (+) strand; PAM type: YTN; PAM sequence: CTT
agaggtcttaaagctctcag

SEQ ID NO: 99308 - DNA, 20 bp, Artificial Sequence
  Description of Artificial Sequence: Synthetic oligonucleotide
  Target: SCN9A; (+) strand; PAM type: YTN; PAM sequence: TTA
gaggtcttaaagctctcagt

SEQ ID NO: 99309 - DNA, 20 bp, Artificial Sequence
  Description of Artificial Sequence: Synthetic oligonucleotide
  Target: SCN9A; (+) strand; PAM type: YTN; PAM sequence: CTT
aaagctctcagtgtccgaag

SEQ ID NO: 99310 - DNA, 20 bp, Artificial Sequence
  Description of Artificial Sequence: Synthetic oligonucleotide
  Target: SCN9A; (+) strand; PAM type: YTN; PAM sequence: TTA
aagctctcagtgtccgaagg

SEQ ID NO: 99311 - DNA, 20 bp, Artificial Sequence
  Description of Artificial Sequence: Synthetic oligonucleotide
  Target: SCN9A; (+) strand; PAM type: YTN; PAM sequence: CTC
tcagtgtccgaagggattta

SEQ ID NO: 99312 - DNA, 20 bp, Artificial Sequence
  Description of Artificial Sequence: Synthetic oligonucleotide
  Target: SCN9A; (+) strand; PAM type: YTN; PAM sequence: CTC
agtgtccgaagggatttaat

SEQ ID NO: 99313 - DNA, 20 bp, Artificial Sequence
  Description of Artificial Sequence: Synthetic oligonucleotide
  Target: SCN9A; (+) strand; PAM type: YTN; PAM sequence: TTT
aatggggccaagatctgagt

SEQ ID NO: 99314 - DNA, 20 bp, Artificial Sequence
  Description of Artificial Sequence: Synthetic oligonucleotide
  Target: SCN9A; (+) strand; PAM type: YTN; PAM sequence: TTA
atggggccaagatctgagta

SEQ ID NO: 99315 - DNA, 20 bp, Artificial Sequence
  Description of Artificial Sequence: Synthetic oligonucleotide
  Target: SCN9A; (+) strand; PAM type: YTN; PAM sequence: CTG
agtagccaagagtgtttgcc

SEQ ID NO: 99316 - DNA, 20 bp, Artificial Sequence
  Description of Artificial Sequence: Synthetic oligonucleotide
  Target: SCN9A; (+) strand; PAM type: YTN; PAM sequence: TTT
gccactaaagtaaccaaaga

SEQ ID NO: 99317 - DNA, 20 bp, Artificial Sequence
  Description of Artificial Sequence: Synthetic oligonucleotide
  Target: SCN9A; (+) strand; PAM type: YTN; PAM sequence: TTG
ccactaaagtaaccaaagaa

SEQ ID NO: 99318 - DNA, 20 bp, Artificial Sequence
  Description of Artificial Sequence: Synthetic oligonucleotide
  Target: SCN9A; (+) strand; PAM type: YTN; PAM sequence: CTA
aagtaaccaaagaaacctat

SEQ ID NO: 99319 - DNA, 20 bp, Artificial Sequence
  Description of Artificial Sequence: Synthetic oligonucleotide
  Target: SCN9A; (+) strand; PAM type: YTN; PAM sequence: CTA
taaaaataacattttcatta

SEQ ID NO: 99320 - DNA, 20 bp, Artificial Sequence
  Description of Artificial Sequence: Synthetic oligonucleotide
  Target: SCN9A; (+) strand; PAM type: YTN; PAM sequence: TTT
tcattaattgtgtcaataaa

SEQ ID NO: 99321 - DNA, 20 bp, Artificial Sequence
  Description of Artificial Sequence: Synthetic oligonucleotide
  Target: SCN9A; (+) strand; PAM type: YTN; PAM sequence: TTT
cattaattgtgtcaataaaa

SEQ ID NO: 99322 - DNA, 20 bp, Artificial Sequence
  Description of Artificial Sequence: Synthetic oligonucleotide
  Target: SCN9A; (+) strand; PAM type: YTN; PAM sequence: TTC
attaattgtgtcaataaaat

SEQ ID NO: 99323 - DNA, 20 bp, Artificial Sequence
  Description of Artificial Sequence: Synthetic oligonucleotide
  Target: SCN9A; (+) strand; PAM type: YTN; PAM sequence: TTA
attgtgtcaataaaatgatg

SEQ ID NO: 99324 - DNA, 20 bp, Artificial Sequence
  Description of Artificial Sequence: Synthetic oligonucleotide
  Target: SCN9A; (+) strand; PAM type: YTN; PAM sequence: TTG
tgtcaataaaatgatgaagc

SEQ ID NO: 99325 - DNA, 20 bp, Artificial Sequence
  Description of Artificial Sequence: Synthetic oligonucleotide
  Target: SCN9A; (+) strand; PAM type: YTN; PAM sequence: TTC
tgaaactcactaaaagcaac

SEQ ID NO: 99326 - DNA, 20 bp, Artificial Sequence
  Description of Artificial Sequence: Synthetic oligonucleotide
  Target: SCN9A; (+) strand; PAM type: YTN; PAM sequence: CTG
aaactcactaaaagcaactc

SEQ ID NO: 99327 - DNA, 20 bp, Artificial Sequence
  Description of Artificial Sequence: Synthetic oligonucleotide
  Target: SCN9A; (+) strand; PAM type: YTN; PAM sequence: CTC
actaaaagcaactcaacagg

SEQ ID NO: 99328 - DNA, 20 bp, Artificial Sequence
  Description of Artificial Sequence: Synthetic oligonucleotide
  Target: SCN9A; (+) strand; PAM type: YTN; PAM sequence: CTA
aaagcaactcaacaggaaca

SEQ ID NO: 99329 - DNA, 20 bp, Artificial Sequence
  Description of Artificial Sequence: Synthetic oligonucleotide
  Target: SCN9A; (+) strand; PAM type: YTN; PAM sequence: CTC
aacaggaacaataagatggt

SEQ ID NO: 99330 - DNA, 20 bp, Artificial Sequence
  Description of Artificial Sequence: Synthetic oligonucleotide
  Target: SCN9A; (+) strand; PAM type: YTN; PAM sequence: TTG
tgtagtcaatgcctaaaaat

SEQ ID NO: 99331 - DNA, 20 bp, Artificial Sequence
  Description of Artificial Sequence: Synthetic oligonucleotide
  Target: SCN9A; (+) strand; PAM type: YTN; PAM sequence: CTA
aaaatagggtaagatggatg

SEQ ID NO: 99332 - DNA, 20 bp, Artificial Sequence
  Description of Artificial Sequence: Synthetic oligonucleotide
  Target: SCN9A; (+) strand; PAM type: YTN; PAM sequence: TTT
ctgtaaggaaatagatttaa

SEQ ID NO: 99333 - DNA, 20 bp, Artificial Sequence
  Description of Artificial Sequence: Synthetic oligonucleotide
  Target: SCN9A; (+) strand; PAM type: YTN; PAM sequence: TTC
tgtaaggaaatagatttaaa

SEQ ID NO: 99334 - DNA, 20 bp, Artificial Sequence
  Description of Artificial Sequence: Synthetic oligonucleotide
  Target: SCN9A; (+) strand; PAM type: YTN; PAM sequence: CTG
taaggaaatagatttaaaag

SEQ ID NO: 99335 - DNA, 20 bp, Artificial Sequence
  Description of Artificial Sequence: Synthetic oligonucleotide
  Target: SCN9A; (+) strand; PAM type: YTN; PAM sequence: TTT
aaaagaaggttaaccaaaat

SEQ ID NO: 99336 - DNA, 20 bp, Artificial Sequence
  Description of Artificial Sequence: Synthetic oligonucleotide
  Target: SCN9A; (+) strand; PAM type: YTN; PAM sequence: TTA
aaagaaggttaaccaaaata

SEQ ID NO: 99337 - DNA, 20 bp, Artificial Sequence
  Description of Artificial Sequence: Synthetic oligonucleotide
  Target: SCN9A; (+) strand; PAM type: YTN; PAM sequence: TTA
accaaaataagaagaaataa

SEQ ID NO: 99338 - DNA, 20 bp, Artificial Sequence
  Description of Artificial Sequence: Synthetic oligonucleotide
  Target: SCN9A; (+) strand; PAM type: YTN; PAM sequence: TTG
tttattctatttgaatagaa

SEQ ID NO: 99339 - DNA, 20 bp, Artificial Sequence
  Description of Artificial Sequence: Synthetic oligonucleotide
  Target: SCN9A; (+) strand; PAM type: YTN; PAM sequence: TTT
attctatttgaatagaaatc

SEQ ID NO: 99340 - DNA, 20 bp, Artificial Sequence
  Description of Artificial Sequence: Synthetic oligonucleotide
  Target: SCN9A; (+) strand; PAM type: YTN; PAM sequence: TTA
ttctatttgaatagaaatca

SEQ ID NO: 99341 - DNA, 20 bp, Artificial Sequence
  Description of Artificial Sequence: Synthetic oligonucleotide
  Target: SCN9A; (+) strand; PAM type: YTN; PAM sequence: TTC
tatttgaatagaaatcatgc

SEQ ID NO: 99342 - DNA, 20 bp, Artificial Sequence
  Description of Artificial Sequence: Synthetic oligonucleotide
  Target: SCN9A; (+) strand; PAM type: YTN; PAM sequence: CTA
tttgaatagaaatcatgcat

SEQ ID NO: 99343 - DNA, 20 bp, Artificial Sequence
  Description of Artificial Sequence: Synthetic oligonucleotide
  Target: SCN9A; (+) strand; PAM type: YTN; PAM sequence: TTT
gaatagaaatcatgcatatg

SEQ ID NO: 99344 - DNA, 20 bp, Artificial Sequence
  Description of Artificial Sequence: Synthetic oligonucleotide
  Target: SCN9A; (+) strand; PAM type: YTN; PAM sequence: TTG
aatagaaatcatgcatatgc

SEQ ID NO: 99345 - DNA, 20 bp, Artificial Sequence
  Description of Artificial Sequence: Synthetic oligonucleotide
  Target: SCN9A; (+) strand; PAM type: YTN; PAM sequence: CTT
ttcacacttttgtaatcaat

SEQ ID NO: 99346 - DNA, 20 bp, Artificial Sequence
  Description of Artificial Sequence: Synthetic oligonucleotide
  Target: SCN9A; (+) strand; PAM type: YTN; PAM sequence: TTT
tcacacttttgtaatcaatt

SEQ ID NO: 99347 - DNA, 20 bp, Artificial Sequence
  Description of Artificial Sequence: Synthetic oligonucleotide
  Target: SCN9A; (+) strand; PAM type: YTN; PAM sequence: TTT
cacacttttgtaatcaattg

SEQ ID NO: 99348 - DNA, 20 bp, Artificial Sequence
  Description of Artificial Sequence: Synthetic oligonucleotide
  Target: SCN9A; (+) strand; PAM type: YTN; PAM sequence: TTC
acacttttgtaatcaattgc

SEQ ID NO: 99349 - DNA, 20 bp, Artificial Sequence
  Description of Artificial Sequence: Synthetic oligonucleotide
  Target: SCN9A; (+) strand; PAM type: YTN; PAM sequence: CTT
ttgtaatcaattgctttgta

SEQ ID NO: 99350 - DNA, 20 bp, Artificial Sequence
  Description of Artificial Sequence: Synthetic oligonucleotide
  Target: SCN9A; (+) strand; PAM type: YTN; PAM sequence: TTT
tgtaatcaattgctttgtaa

SEQ ID NO: 99351 - DNA, 20 bp, Artificial Sequence
  Description of Artificial Sequence: Synthetic oligonucleotide
  Target: SCN9A; (+) strand; PAM type: YTN; PAM sequence: TTT
gtaatcaattgctttgtaat

SEQ ID NO: 99352 - DNA, 20 bp, Artificial Sequence
  Description of Artificial Sequence: Synthetic oligonucleotide
  Target: SCN9A; (+) strand; PAM type: YTN; PAM sequence: TTG
taatcaattgctttgtaatt

SEQ ID NO: 99353 - DNA, 20 bp, Artificial Sequence
  Description of Artificial Sequence: Synthetic oligonucleotide
  Target: SCN9A; (+) strand; PAM type: YTN; PAM sequence: TTG
ctttgtaattccttattaaa

SEQ ID NO: 99354 - DNA, 20 bp, Artificial Sequence
  Description of Artificial Sequence: Synthetic oligonucleotide
  Target: SCN9A; (+) strand; PAM type: YTN; PAM sequence: CTT
tgtaattccttattaaatct

SEQ ID NO: 99355 - DNA, 20 bp, Artificial Sequence
  Description of Artificial Sequence: Synthetic oligonucleotide
  Target: SCN9A; (+) strand; PAM type: YTN; PAM sequence: TTT
gtaattccttattaaatcta

SEQ ID NO: 99356 - DNA, 20 bp, Artificial Sequence
  Description of Artificial Sequence: Synthetic oligonucleotide
  Target: SCN9A; (+) strand; PAM type: YTN; PAM sequence: TTG
taattccttattaaatctaa

SEQ ID NO: 99357 - DNA, 20 bp, Artificial Sequence
  Description of Artificial Sequence: Synthetic oligonucleotide
  Target: SCN9A; (+) strand; PAM type: YTN; PAM sequence: TTC
cttattaaatctaaaaattt

SEQ ID NO: 99358 - DNA, 20 bp, Artificial Sequence
  Description of Artificial Sequence: Synthetic oligonucleotide
  Target: SCN9A; (+) strand; PAM type: YTN; PAM sequence: CTT
attaaatctaaaaatttaat

SEQ ID NO: 99359 - DNA, 20 bp, Artificial Sequence
  Description of Artificial Sequence: Synthetic oligonucleotide
  Target: SCN9A; (+) strand; PAM type: YTN; PAM sequence: TTA
ttaaatctaaaaatttaatt

SEQ ID NO: 99360 - DNA, 20 bp, Artificial Sequence
  Description of Artificial Sequence: Synthetic oligonucleotide
  Target: SCN9A; (+) strand; PAM type: YTN; PAM sequence: TTA
aatctaaaaatttaattaga

SEQ ID NO: 99361 - DNA, 20 bp, Artificial Sequence
  Description of Artificial Sequence: Synthetic oligonucleotide
  Target: SCN9A; (+) strand; PAM type: YTN; PAM sequence: CTA
aaaatttaattagaacaatg

SEQ ID NO: 99362 - DNA, 20 bp, Artificial Sequence
  Description of Artificial Sequence: Synthetic oligonucleotide
  Target: SCN9A; (+) strand; PAM type: YTN; PAM sequence: TTT
aattagaacaatggtgaaca

SEQ ID NO: 99363 - DNA, 20 bp, Artificial Sequence
  Description of Artificial Sequence: Synthetic oligonucleotide
  Target: SCN9A; (+) strand; PAM type: YTN; PAM sequence: TTA
attagaacaatggtgaacat

SEQ ID NO: 99364 - DNA, 20 bp, Artificial Sequence
  Description of Artificial Sequence: Synthetic oligonucleotide
  Target: SCN9A; (+) strand; PAM type: YTN; PAM sequence: TTA
gaacaatggtgaacatttta

SEQ ID NO: 99365 - DNA, 20 bp, Artificial Sequence
  Description of Artificial Sequence: Synthetic oligonucleotide
  Target: SCN9A; (+) strand; PAM type: YTN; PAM sequence: TTT
taattataaaactcaggtca

SEQ ID NO: 99366 - DNA, 20 bp, Artificial Sequence
  Description of Artificial Sequence: Synthetic oligonucleotide
  Target: SCN9A; (+) strand; PAM type: YTN; PAM sequence: TTT
aattataaaactcaggtcaa

SEQ ID NO: 99367 - DNA, 20 bp, Artificial Sequence
  Description of Artificial Sequence: Synthetic oligonucleotide
  Target: SCN9A; (+) strand; PAM type: YTN; PAM sequence: TTA
attataaaactcaggtcaaa

SEQ ID NO: 99368 - DNA, 20 bp, Artificial Sequence
  Description of Artificial Sequence: Synthetic oligonucleotide
  Target: SCN9A; (+) strand; PAM type: YTN; PAM sequence: TTA
taaaactcaggtcaaaatga

SEQ ID NO: 99369 - DNA, 20 bp, Artificial Sequence
  Description of Artificial Sequence: Synthetic oligonucleotide
  Target: SCN9A; (+) strand; PAM type: YTN; PAM sequence: CTC
aggtcaaaatgaagtgtgtg

SEQ ID NO: 99370 - DNA, 20 bp, Artificial Sequence
  Description of Artificial Sequence: Synthetic oligonucleotide
  Target: SCN9A; (+) strand; PAM type: YTN; PAM sequence: TTC
tgaagctaagccctaaaagt

SEQ ID NO: 99371 - DNA, 20 bp, Artificial Sequence
  Description of Artificial Sequence: Synthetic oligonucleotide
  Target: SCN9A; (+) strand; PAM type: YTN; PAM sequence: CTG
aagctaagccctaaaagtgt

SEQ ID NO: 99372 - DNA, 20 bp, Artificial Sequence
  Description of Artificial Sequence: Synthetic oligonucleotide
  Target: SCN9A; (+) strand; PAM type: YTN; PAM sequence: CTA
agccctaaaagtgtggtatt

SEQ ID NO: 99373 - DNA, 20 bp, Artificial Sequence
  Description of Artificial Sequence: Synthetic oligonucleotide
  Target: SCN9A; (+) strand; PAM type: YTN; PAM sequence: CTA
aaagtgtggtattcactcaa

SEQ ID NO: 99374 - DNA, 20 bp, Artificial Sequence
  Description of Artificial Sequence: Synthetic oligonucleotide
  Target: SCN9A; (+) strand; PAM type: YTN; PAM sequence: TTC
actcaactaaatctatgtct

SEQ ID NO: 99375 - DNA, 20 bp, Artificial Sequence
  Description of Artificial Sequence: Synthetic oligonucleotide
  Target: SCN9A; (+) strand; PAM type: YTN; PAM sequence: CTC
aactaaatctatgtcttagt

SEQ ID NO: 99376 - DNA, 20 bp, Artificial Sequence
  Description of Artificial Sequence: Synthetic oligonucleotide
  Target: SCN9A; (+) strand; PAM type: YTN; PAM sequence: CTA
aatctatgtcttagtataaa

SEQ ID NO: 99377 - DNA, 20 bp, Artificial Sequence
  Description of Artificial Sequence: Synthetic oligonucleotide
  Target: SCN9A; (+) strand; PAM type: YTN; PAM sequence: CTA
tgtcttagtataaatcttat

SEQ ID NO: 99378 - DNA, 20 bp, Artificial Sequence
  Description of Artificial Sequence: Synthetic oligonucleotide
  Target: SCN9A; (+) strand; PAM type: YTN; PAM sequence: CTT
agtataaatcttattaaaaa

SEQ ID NO: 99379 - DNA, 20 bp, Artificial Sequence
  Description of Artificial Sequence: Synthetic oligonucleotide
  Target: SCN9A; (+) strand; PAM type: YTN; PAM sequence: TTA
gtataaatcttattaaaaaa

SEQ ID NO: 99380 - DNA, 20 bp, Artificial Sequence
  Description of Artificial Sequence: Synthetic oligonucleotide
  Target: SCN9A; (+) strand; PAM type: YTN; PAM sequence: CTT
attaaaaaacattttgaaga

SEQ ID NO: 99381 - DNA, 20 bp, Artificial Sequence
  Description of Artificial Sequence: Synthetic oligonucleotide
  Target: SCN9A; (+) strand; PAM type: YTN; PAM sequence: TTA
ttaaaaaacattttgaagac

SEQ ID NO: 99382 - DNA, 20 bp, Artificial Sequence
  Description of Artificial Sequence: Synthetic oligonucleotide
  Target: SCN9A; (+) strand; PAM type: YTN; PAM sequence: TTA
aaaaacattttgaagactca

SEQ ID NO: 99383 - DNA, 20 bp, Artificial Sequence
  Description of Artificial Sequence: Synthetic oligonucleotide
  Target: SCN9A; (+) strand; PAM type: YTN; PAM sequence: TTT
tgaagactcatgattttgag

SEQ ID NO: 99384 - DNA, 20 bp, Artificial Sequence
  Description of Artificial Sequence: Synthetic oligonucleotide
  Target: SCN9A; (+) strand; PAM type: YTN; PAM sequence: TTT
gaagactcatgattttgagt

SEQ ID NO: 99385 - DNA, 20 bp, Artificial Sequence
  Description of Artificial Sequence: Synthetic oligonucleotide
  Target: SCN9A; (+) strand; PAM type: YTN; PAM sequence: TTG
aagactcatgattttgagtt

SEQ ID NO: 99386 - DNA, 20 bp, Artificial Sequence
  Description of Artificial Sequence: Synthetic oligonucleotide
  Target: SCN9A; (+) strand; PAM type: YTN; PAM sequence: CTC
atgattttgagttggggcaa

SEQ ID NO: 99387 - DNA, 20 bp, Artificial Sequence
  Description of Artificial Sequence: Synthetic oligonucleotide
  Target: SCN9A; (+) strand; PAM type: YTN; PAM sequence: TTT
tgagttggggcaaattctca

SEQ ID NO: 99388 - DNA, 20 bp, Artificial Sequence
  Description of Artificial Sequence: Synthetic oligonucleotide
  Target: SCN9A; (+) strand; PAM type: YTN; PAM sequence: TTT
gagttggggcaaattctcaa

SEQ ID NO: 99389 - DNA, 20 bp, Artificial Sequence
  Description of Artificial Sequence: Synthetic oligonucleotide
  Target: SCN9A; (+) strand; PAM type: YTN; PAM sequence: TTG
agttggggcaaattctcaac

SEQ ID NO: 99390 - DNA, 20 bp, Artificial Sequence
  Description of Artificial Sequence: Synthetic oligonucleotide
  Target: SCN9A; (+) strand; PAM type: YTN; PAM sequence: TTG
gggcaaattctcaacaagat

SEQ ID NO: 99391 - DNA, 20 bp, Artificial Sequence
  Description of Artificial Sequence: Synthetic oligonucleotide
  Target: SCN9A; (+) strand; PAM type: YTN; PAM sequence: TTC
tcaacaagattgcttctgcc

SEQ ID NO: 99392 - DNA, 20 bp, Artificial Sequence
  Description of Artificial Sequence: Synthetic oligonucleotide
  Target: SCN9A; (+) strand; PAM type: YTN; PAM sequence: CTC
aacaagattgcttctgccct

SEQ ID NO: 99393 - DNA, 20 bp, Artificial Sequence
  Description of Artificial Sequence: Synthetic oligonucleotide
  Target: SCN9A; (+) strand; PAM type: YTN; PAM sequence: TTG
cttctgccctacaatttcta

SEQ ID NO: 99394 - DNA, 20 bp, Artificial Sequence
  Description of Artificial Sequence: Synthetic oligonucleotide
  Target: SCN9A; (+) strand; PAM type: YTN; PAM sequence: CTT
ctgccctacaatttctaaag

SEQ ID NO: 99395 - DNA, 20 bp, Artificial Sequence
  Description of Artificial Sequence: Synthetic oligonucleotide
  Target: SCN9A; (+) strand; PAM type: YTN; PAM sequence: TTC
tgccctacaatttctaaaga

SEQ ID NO: 99396 - DNA, 20 bp, Artificial Sequence
  Description of Artificial Sequence: Synthetic oligonucleotide
  Target: SCN9A; (+) strand; PAM type: YTN; PAM sequence: CTG
ccctacaatttctaaagatt

SEQ ID NO: 99397 - DNA, 20 bp, Artificial Sequence
  Description of Artificial Sequence: Synthetic oligonucleotide
  Target: SCN9A; (+) strand; PAM type: YTN; PAM sequence: CTA
caatttctaaagattagcac

SEQ ID NO: 99398 - DNA, 20 bp, Artificial Sequence
  Description of Artificial Sequence: Synthetic oligonucleotide
  Target: SCN9A; (+) strand; PAM type: YTN; PAM sequence: TTT
ctaaagattagcaccaaaga

SEQ ID NO: 99399 - DNA, 20 bp, Artificial Sequence
  Description of Artificial Sequence: Synthetic oligonucleotide
  Target: SCN9A; (+) strand; PAM type: YTN; PAM sequence: TTC
taaagattagcaccaaagat

SEQ ID NO: 99400 - DNA, 20 bp, Artificial Sequence
  Description of Artificial Sequence: Synthetic oligonucleotide
  Target: SCN9A; (+) strand; PAM type: YTN; PAM sequence: CTA
aagattagcaccaaagatct

SEQ ID NO: 99401 - DNA, 20 bp, Artificial Sequence
  Description of Artificial Sequence: Synthetic oligonucleotide
  Target: SCN9A; (+) strand; PAM type: YTN; PAM sequence: TTA
gcaccaaagatctaccaaat

SEQ ID NO: 99402 - DNA, 20 bp, Artificial Sequence
  Description of Artificial Sequence: Synthetic oligonucleotide
  Target: SCN9A; (+) strand; PAM type: YTN; PAM sequence: CTA
ccaaatagtttttcatggga

SEQ ID NO: 99403 - DNA, 20 bp, Artificial Sequence
  Description of Artificial Sequence: Synthetic oligonucleotide
  Target: SCN9A; (+) strand; PAM type: YTN; PAM sequence: TTT
ttcatgggagaaaaatcaca

SEQ ID NO: 99404 - DNA, 20 bp, Artificial Sequence
  Description of Artificial Sequence: Synthetic oligonucleotide
  Target: SCN9A; (+) strand; PAM type: YTN; PAM sequence: TTT
tcatgggagaaaaatcacaa

SEQ ID NO: 99405 - DNA, 20 bp, Artificial Sequence
  Description of Artificial Sequence: Synthetic oligonucleotide
  Target: SCN9A; (+) strand; PAM type: YTN; PAM sequence: TTT
catgggagaaaaatcacaat

SEQ ID NO: 99406 - DNA, 20 bp, Artificial Sequence
  Description of Artificial Sequence: Synthetic oligonucleotide
  Target: SCN9A; (+) strand; PAM type: YTN; PAM sequence: TTC
atgggagaaaaatcacaatt

SEQ ID NO: 99407 - DNA, 20 bp, Artificial Sequence
  Description of Artificial Sequence: Synthetic oligonucleotide
  Target: SCN9A; (+) strand; PAM type: YTN; PAM sequence: TTG
tactgaagagagaatgagag

SEQ ID NO: 99408 - DNA, 20 bp, Artificial Sequence
  Description of Artificial Sequence: Synthetic oligonucleotide
  Target: SCN9A; (+) strand; PAM type: YTN; PAM sequence: CTG
aagagagaatgagagtagct

SEQ ID NO: 99409 - DNA, 20 bp, Artificial Sequence
  Description of Artificial Sequence: Synthetic oligonucleotide
  Target: SCN9A; (+) strand; PAM type: YTN; PAM sequence: CTG
atctcattggcttcacaatc

SEQ ID NO: 99410 - DNA, 20 bp, Artificial Sequence
  Description of Artificial Sequence: Synthetic oligonucleotide
  Target: SCN9A; (+) strand; PAM type: YTN; PAM sequence: CTC
attggcttcacaatcaatat

SEQ ID NO: 99411 - DNA, 20 bp, Artificial Sequence
  Description of Artificial Sequence: Synthetic oligonucleotide
  Target: SCN9A; (+) strand; PAM type: YTN; PAM sequence: TTG
gcttcacaatcaatatagat

SEQ ID NO: 99412 - DNA, 20 bp, Artificial Sequence
  Description of Artificial Sequence: Synthetic oligonucleotide
  Target: SCN9A; (+) strand; PAM type: YTN; PAM sequence: CTT
cacaatcaatatagatataa

SEQ ID NO: 99413 - DNA, 20 bp, Artificial Sequence
  Description of Artificial Sequence: Synthetic oligonucleotide
  Target: SCN9A; (+) strand; PAM type: YTN; PAM sequence: TTC
acaatcaatatagatataat

SEQ ID NO: 99414 - DNA, 20 bp, Artificial Sequence
  Description of Artificial Sequence: Synthetic oligonucleotide
  Target: SCN9A; (+) strand; PAM type: YTN; PAM sequence: CTT
catcatgttagatagatcag

SEQ ID NO: 99415 - DNA, 20 bp, Artificial Sequence
  Description of Artificial Sequence: Synthetic oligonucleotide
  Target: SCN9A; (+) strand; PAM type: YTN; PAM sequence: TTC
atcatgttagatagatcagc

SEQ ID NO: 99416 - DNA, 20 bp, Artificial Sequence
  Description of Artificial Sequence: Synthetic oligonucleotide
  Target: SCN9A; (+) strand; PAM type: YTN; PAM sequence: TTA
gatagatcagccacaattac

SEQ ID NO: 99417 - DNA, 20 bp, Artificial Sequence
  Description of Artificial Sequence: Synthetic oligonucleotide
  Target: SCN9A; (+) strand; PAM type: YTN; PAM sequence: TTA
ccataaccagtatccaaaag

SEQ ID NO: 99418 - DNA, 20 bp, Artificial Sequence
  Description of Artificial Sequence: Synthetic oligonucleotide
  Target: SCN9A; (+) strand; PAM type: YTN; PAM sequence: TTT
gagttcttatcgtaaattat

SEQ ID NO: 99419 - DNA, 20 bp, Artificial Sequence
  Description of Artificial Sequence: Synthetic oligonucleotide
  Target: SCN9A; (+) strand; PAM type: YTN; PAM sequence: TTG
agttcttatcgtaaattatc

SEQ ID NO: 99420 - DNA, 20 bp, Artificial Sequence
  Description of Artificial Sequence: Synthetic oligonucleotide
  Target: SCN9A; (+) strand; PAM type: YTN; PAM sequence: TTC
ttatcgtaaattatcttaag

SEQ ID NO: 99421 - DNA, 20 bp, Artificial Sequence
  Description of Artificial Sequence: Synthetic oligonucleotide
  Target: SCN9A; (+) strand; PAM type: YTN; PAM sequence: CTT
atcgtaaattatcttaagaa

SEQ ID NO: 99422 - DNA, 20 bp, Artificial Sequence
  Description of Artificial Sequence: Synthetic oligonucleotide
  Target: SCN9A; (+) strand; PAM type: YTN; PAM sequence: TTA
tcgtaaattatcttaagaaa

SEQ ID NO: 99423 - DNA, 20 bp, Artificial Sequence
  Description of Artificial Sequence: Synthetic oligonucleotide
  Target: SCN9A; (+) strand; PAM type: YTN; PAM sequence: TTA
tcttaagaaagaacatgaac

SEQ ID NO: 99424 - DNA, 20 bp, Artificial Sequence
  Description of Artificial Sequence: Synthetic oligonucleotide
  Target: SCN9A; (+) strand; PAM type: YTN; PAM sequence: CTT
aagaaagaacatgaacagca

SEQ ID NO: 99425 - DNA, 20 bp, Artificial Sequence
  Description of Artificial Sequence: Synthetic oligonucleotide
  Target: SCN9A; (+) strand; PAM type: YTN; PAM sequence: TTA
agaaagaacatgaacagcaa

SEQ ID NO: 99426 - DNA, 20 bp, Artificial Sequence
  Description of Artificial Sequence: Synthetic oligonucleotide
  Target: SCN9A; (+) strand; PAM type: YTN; PAM sequence: TTT
tagttacaaagcaatgagct

SEQ ID NO: 99427 - DNA, 20 bp, Artificial Sequence
  Description of Artificial Sequence: Synthetic oligonucleotide
  Target: SCN9A; (+) strand; PAM type: YTN; PAM sequence: TTT
agttacaaagcaatgagctc

SEQ ID NO: 99428 - DNA, 20 bp, Artificial Sequence
  Description of Artificial Sequence: Synthetic oligonucleotide
  Target: SCN9A; (+) strand; PAM type: YTN; PAM sequence: TTA
gttacaaagcaatgagctcc

SEQ ID NO: 99429 - DNA, 20 bp, Artificial Sequence
  Description of Artificial Sequence: Synthetic oligonucleotide
  Target: SCN9A; (+) strand; PAM type: YTN; PAM sequence: TTA
caaagcaatgagctcctcca

SEQ ID NO: 99430 - DNA, 20 bp, Artificial Sequence
  Description of Artificial Sequence: Synthetic oligonucleotide
  Target: SCN9A; (+) strand; PAM type: YTN; PAM sequence: CTC
ctccatgaccttagatctgg

SEQ ID NO: 99431 - DNA, 20 bp, Artificial Sequence
  Description of Artificial Sequence: Synthetic oligonucleotide
  Target: SCN9A; (+) strand; PAM type: YTN; PAM sequence: CTC
catgaccttagatctggatc

SEQ ID NO: 99432 - DNA, 20 bp, Artificial Sequence
  Description of Artificial Sequence: Synthetic oligonucleotide
  Target: SCN9A; (+) strand; PAM type: YTN; PAM sequence: CTT
agatctggatctataaatat

SEQ ID NO: 99433 - DNA, 20 bp, Artificial Sequence
  Description of Artificial Sequence: Synthetic oligonucleotide
  Target: SCN9A; (+) strand; PAM type: YTN; PAM sequence: TTA
gatctggatctataaatatg

SEQ ID NO: 99434 - DNA, 20 bp, Artificial Sequence
  Description of Artificial Sequence: Synthetic oligonucleotide
  Target: SCN9A; (+) strand; PAM type: YTN; PAM sequence: CTG
gatctataaatatgtttact

SEQ ID NO: 99435 - DNA, 20 bp, Artificial Sequence
  Description of Artificial Sequence: Synthetic oligonucleotide
  Target: SCN9A; (+) strand; PAM type: YTN; PAM sequence: CTA
taaatatgtttactctctga

SEQ ID NO: 99436 - DNA, 20 bp, Artificial Sequence
  Description of Artificial Sequence: Synthetic oligonucleotide
  Target: SCN9A; (+) strand; PAM type: YTN; PAM sequence: TTT
actctctgaattagttccat

SEQ ID NO: 99437 - DNA, 20 bp, Artificial Sequence
  Description of Artificial Sequence: Synthetic oligonucleotide
  Target: SCN9A; (+) strand; PAM type: YTN; PAM sequence: TTA
ctctctgaattagttccatg

SEQ ID NO: 99438 - DNA, 20 bp, Artificial Sequence
  Description of Artificial Sequence: Synthetic oligonucleotide
  Target: SCN9A; (+) strand; PAM type: YTN; PAM sequence: CTC
tctgaattagttccatggaa

SEQ ID NO: 99439 - DNA, 20 bp, Artificial Sequence
  Description of Artificial Sequence: Synthetic oligonucleotide
  Target: SCN9A; (+) strand; PAM type: YTN; PAM sequence: CTC
tgaattagttccatggaaaa

SEQ ID NO: 99440 - DNA, 20 bp, Artificial Sequence
  Description of Artificial Sequence: Synthetic oligonucleotide
  Target: SCN9A; (+) strand; PAM type: YTN; PAM sequence: CTG
aattagttccatggaaaata

SEQ ID NO: 99441 - DNA, 20 bp, Artificial Sequence
  Description of Artificial Sequence: Synthetic oligonucleotide
  Target: SCN9A; (+) strand; PAM type: YTN; PAM sequence: TTA
gttccatggaaaatattcat

SEQ ID NO: 99442 - DNA, 20 bp, Artificial Sequence
  Description of Artificial Sequence: Synthetic oligonucleotide
  Target: SCN9A; (+) strand; PAM type: YTN; PAM sequence: TTC
catggaaaatattcatttgc

SEQ ID NO: 99443 - DNA, 20 bp, Artificial Sequence
  Description of Artificial Sequence: Synthetic oligonucleotide
  Target: SCN9A; (+) strand; PAM type: YTN; PAM sequence: TTC
atttgcctcacatcctgtgt

SEQ ID NO: 99444 - DNA, 20 bp, Artificial Sequence
  Description of Artificial Sequence: Synthetic oligonucleotide
  Target: SCN9A; (+) strand; PAM type: YTN; PAM sequence: TTT
gcctcacatcctgtgtagca

SEQ ID NO: 99445 - DNA, 20 bp, Artificial Sequence
  Description of Artificial Sequence: Synthetic oligonucleotide
  Target: SCN9A; (+) strand; PAM type: YTN; PAM sequence: TTG
cctcacatcctgtgtagcag

SEQ ID NO: 99446 - DNA, 20 bp, Artificial Sequence
  Description of Artificial Sequence: Synthetic oligonucleotide
  Target: SCN9A; (+) strand; PAM type: YTN; PAM sequence: CTC
acatcctgtgtagcaggaga

SEQ ID NO: 99447 - DNA, 20 bp, Artificial Sequence
  Description of Artificial Sequence: Synthetic oligonucleotide
  Target: SCN9A; (+) strand; PAM type: YTN; PAM sequence: CTG
tgtagcaggagacgatgtct

SEQ ID NO: 99448 - DNA, 20 bp, Artificial Sequence
  Description of Artificial Sequence: Synthetic oligonucleotide
  Target: SCN9A; (+) strand; PAM type: YTN; PAM sequence: CTA
agaaaaatgtctggaatgca

SEQ ID NO: 99449 - DNA, 20 bp, Artificial Sequence
  Description of Artificial Sequence: Synthetic oligonucleotide
  Target: SCN9A; (+) strand; PAM type: YTN; PAM sequence: CTG
gaatgcagttcttcattacg

SEQ ID NO: 99450 - DNA, 20 bp, Artificial Sequence
  Description of Artificial Sequence: Synthetic oligonucleotide
  Target: SCN9A; (+) strand; PAM type: YTN; PAM sequence: TTC
ttcattacgaataagttagt

SEQ ID NO: 99451 - DNA, 20 bp, Artificial Sequence
  Description of Artificial Sequence: Synthetic oligonucleotide
  Target: SCN9A; (+) strand; PAM type: YTN; PAM sequence: CTT
cattacgaataagttagtga

SEQ ID NO: 99452 - DNA, 20 bp, Artificial Sequence
  Description of Artificial Sequence: Synthetic oligonucleotide
  Target: SCN9A; (+) strand; PAM type: YTN; PAM sequence: TTC
attacgaataagttagtgac

SEQ ID NO: 99453 - DNA, 20 bp, Artificial Sequence
  Description of Artificial Sequence: Synthetic oligonucleotide
  Target: SCN9A; (+) strand; PAM type: YTN; PAM sequence: TTA
cgaataagttagtgactgag

SEQ ID NO: 99454 - DNA, 20 bp, Artificial Sequence
  Description of Artificial Sequence: Synthetic oligonucleotide
  Target: SCN9A; (+) strand; PAM type: YTN; PAM sequence: TTA
gtgactgagagattcaattt

SEQ ID NO: 99455 - DNA, 20 bp, Artificial Sequence
  Description of Artificial Sequence: Synthetic oligonucleotide
  Target: SCN9A; (+) strand; PAM type: YTN; PAM sequence: CTG
agagattcaatttttcgagg

SEQ ID NO: 99456 - DNA, 20 bp, Artificial Sequence
  Description of Artificial Sequence: Synthetic oligonucleotide
  Target: SCN9A; (+) strand; PAM type: YTN; PAM sequence: TTC
aatttttcgagggaagaata

SEQ ID NO: 99457 - DNA, 20 bp, Artificial Sequence
  Description of Artificial Sequence: Synthetic oligonucleotide
  Target: SCN9A; (+) strand; PAM type: YTN; PAM sequence: TTT
ttcgagggaagaataggaac

SEQ ID NO: 99458 - DNA, 20 bp, Artificial Sequence
  Description of Artificial Sequence: Synthetic oligonucleotide
  Target: SCN9A; (+) strand; PAM type: YTN; PAM sequence: TTT
tcgagggaagaataggaaca

SEQ ID NO: 99459 - DNA, 20 bp, Artificial Sequence
  Description of Artificial Sequence: Synthetic oligonucleotide
  Target: SCN9A; (+) strand; PAM type: YTN; PAM sequence: TTT
cgagggaagaataggaacag

SEQ ID NO: 99460 - DNA, 20 bp, Artificial Sequence
  Description of Artificial Sequence: Synthetic oligonucleotide
  Target: SCN9A; (+) strand; PAM type: YTN; PAM sequence: TTC
gagggaagaataggaacaga

SEQ ID NO: 99461 - DNA, 20 bp, Artificial Sequence
  Description of Artificial Sequence: Synthetic oligonucleotide
  Target: SCN9A; (+) strand; PAM type: YTN; PAM sequence: CTT
tatatatttatctatttcag

SEQ ID NO: 99462 - DNA, 20 bp, Artificial Sequence
  Description of Artificial Sequence: Synthetic oligonucleotide
  Target: SCN9A; (+) strand; PAM type: YTN; PAM sequence: TTT
atatatttatctatttcagg

SEQ ID NO: 99463 - DNA, 20 bp, Artificial Sequence
  Description of Artificial Sequence: Synthetic oligonucleotide
  Target: SCN9A; (+) strand; PAM type: YTN; PAM sequence: TTA
tatatttatctatttcaggc

SEQ ID NO: 99464 - DNA, 20 bp, Artificial Sequence
  Description of Artificial Sequence: Synthetic oligonucleotide
  Target: SCN9A; (+) strand; PAM type: YTN; PAM sequence: TTT
atctatttcaggcgtagaaa

SEQ ID NO: 99465 - DNA, 20 bp, Artificial Sequence
  Description of Artificial Sequence: Synthetic oligonucleotide
  Target: SCN9A; (+) strand; PAM type: YTN; PAM sequence: TTA
tctatttcaggcgtagaaaa

SEQ ID NO: 99466 - DNA, 20 bp, Artificial Sequence
  Description of Artificial Sequence: Synthetic oligonucleotide
  Target: SCN9A; (+) strand; PAM type: YTN; PAM sequence: CTA
tttcaggcgtagaaaaagtc

SEQ ID NO: 99467 - DNA, 20 bp, Artificial Sequence
  Description of Artificial Sequence: Synthetic oligonucleotide
  Target: SCN9A; (+) strand; PAM type: YTN; PAM sequence: TTT
caggcgtagaaaaagtcatt

SEQ ID NO: 99468 - DNA, 20 bp, Artificial Sequence
  Description of Artificial Sequence: Synthetic oligonucleotide
  Target: SCN9A; (+) strand; PAM type: YTN; PAM sequence: TTC
aggcgtagaaaaagtcattg

SEQ ID NO: 99469 - DNA, 20 bp, Artificial Sequence
  Description of Artificial Sequence: Synthetic oligonucleotide
  Target: SCN9A; (+) strand; PAM type: YTN; PAM sequence: TTG
ttcacaaaaagttcattgct

SEQ ID NO: 99470 - DNA, 20 bp, Artificial Sequence
  Description of Artificial Sequence: Synthetic oligonucleotide
  Target: SCN9A; (+) strand; PAM type: YTN; PAM sequence: TTC
acaaaaagttcattgctgtt

SEQ ID NO: 99471 - DNA, 20 bp, Artificial Sequence
  Description of Artificial Sequence: Synthetic oligonucleotide
  Target: SCN9A; (+) strand; PAM type: YTN; PAM sequence: TTC
attgctgttaccatcagaga

SEQ ID NO: 99472 - DNA, 20 bp, Artificial Sequence
  Description of Artificial Sequence: Synthetic oligonucleotide
  Target: SCN9A; (+) strand; PAM type: YTN; PAM sequence: TTG
ctgttaccatcagagacagg

SEQ ID NO: 99473 - DNA, 20 bp, Artificial Sequence
  Description of Artificial Sequence: Synthetic oligonucleotide
  Target: SCN9A; (+) strand; PAM type: YTN; PAM sequence: CTG
ttaccatcagagacaggtaa

SEQ ID NO: 99474 - DNA, 20 bp, Artificial Sequence
  Description of Artificial Sequence: Synthetic oligonucleotide
  Target: SCN9A; (+) strand; PAM type: YTN; PAM sequence: TTA
ccatcagagacaggtaaact

SEQ ID NO: 99475 - DNA, 20 bp, Artificial Sequence
  Description of Artificial Sequence: Synthetic oligonucleotide
  Target: SCN9A; (+) strand; PAM type: YTN; PAM sequence: CTG
actgatgaagcgggaagtgt

SEQ ID NO: 99476 - DNA, 20 bp, Artificial Sequence
  Description of Artificial Sequence: Synthetic oligonucleotide
  Target: SCN9A; (+) strand; PAM type: YTN; PAM sequence: CTG
atgaagcgggaagtgtttta

SEQ ID NO: 99477 - DNA, 20 bp, Artificial Sequence
  Description of Artificial Sequence: Synthetic oligonucleotide
  Target: SCN9A; (+) strand; PAM type: YTN; PAM sequence: TTT
taaagtgctcatcctcatgt

SEQ ID NO: 99478 - DNA, 20 bp, Artificial Sequence
  Description of Artificial Sequence: Synthetic oligonucleotide
  Target: SCN9A; (+) strand; PAM type: YTN; PAM sequence: TTT
aaagtgctcatcctcatgta

SEQ ID NO: 99479 - DNA, 20 bp, Artificial Sequence
  Description of Artificial Sequence: Synthetic oligonucleotide
  Target: SCN9A; (+) strand; PAM type: YTN; PAM sequence: TTA
aagtgctcatcctcatgtag

SEQ ID NO: 99480 - DNA, 20 bp, Artificial Sequence
  Description of Artificial Sequence: Synthetic oligonucleotide
  Target: SCN9A; (+) strand; PAM type: YTN; PAM sequence: CTC
atcctcatgtagtatttcca

SEQ ID NO: 99481 - DNA, 20 bp, Artificial Sequence
  Description of Artificial Sequence: Synthetic oligonucleotide
  Target: SCN9A; (+) strand; PAM type: YTN; PAM sequence: CTC
atgtagtatttccagatgtc

SEQ ID NO: 99482 - DNA, 20 bp, Artificial Sequence
  Description of Artificial Sequence: Synthetic oligonucleotide
  Target: SCN9A; (+) strand; PAM type: YTN; PAM sequence: TTT
ccagatgtctcactaaatgt

SEQ ID NO: 99483 - DNA, 20 bp, Artificial Sequence
  Description of Artificial Sequence: Synthetic oligonucleotide
  Target: SCN9A; (+) strand; PAM type: YTN; PAM sequence: TTC
cagatgtctcactaaatgta

SEQ ID NO: 99484 - DNA, 20 bp, Artificial Sequence
  Description of Artificial Sequence: Synthetic oligonucleotide
  Target: SCN9A; (+) strand; PAM type: YTN; PAM sequence: CTC
actaaatgtaacatggcttt

SEQ ID NO: 99485 - DNA, 20 bp, Artificial Sequence
  Description of Artificial Sequence: Synthetic oligonucleotide
  Target: SCN9A; (+) strand; PAM type: YTN; PAM sequence: CTA
aatgtaacatggcttttttt

SEQ ID NO: 99486 - DNA, 20 bp, Artificial Sequence
  Description of Artificial Sequence: Synthetic oligonucleotide
  Target: SCN9A; (+) strand; PAM type: YTN; PAM sequence: CTT
ttttttttaaattcctaaag

SEQ ID NO: 99487 - DNA, 20 bp, Artificial Sequence
  Description of Artificial Sequence: Synthetic oligonucleotide
  Target: SCN9A; (+) strand; PAM type: YTN; PAM sequence: TTT
tttttttaaattcctaaagc

SEQ ID NO: 99488 - DNA, 20 bp, Artificial Sequence
  Description of Artificial Sequence: Synthetic oligonucleotide
  Target: SCN9A; (+) strand; PAM type: YTN; PAM sequence: TTT
ttttttaaattcctaaagct

SEQ ID NO: 99489 - DNA, 20 bp, Artificial Sequence
  Description of Artificial Sequence: Synthetic oligonucleotide
  Target: SCN9A; (+) strand; PAM type: YTN; PAM sequence: TTT
tttttaaattcctaaagcta

SEQ ID NO: 99490 - DNA, 20 bp, Artificial Sequence
  Description of Artificial Sequence: Synthetic oligonucleotide
  Target: SCN9A; (+) strand; PAM type: YTN; PAM sequence: TTT
ttttaaattcctaaagctac

SEQ ID NO: 99491 - DNA, 20 bp, Artificial Sequence
  Description of Artificial Sequence: Synthetic oligonucleotide
  Target: SCN9A; (+) strand; PAM type: YTN; PAM sequence: TTT
tttaaattcctaaagctacg

SEQ ID NO: 99492 - DNA, 20 bp, Artificial Sequence
  Description of Artificial Sequence: Synthetic oligonucleotide
  Target: SCN9A; (+) strand; PAM type: YTN; PAM sequence: TTT
ttaaattcctaaagctacgt

SEQ ID NO: 99493 - DNA, 20 bp, Artificial Sequence
  Description of Artificial Sequence: Synthetic oligonucleotide
  Target: SCN9A; (+) strand; PAM type: YTN; PAM sequence: TTT
taaattcctaaagctacgta

SEQ ID NO: 99494 - DNA, 20 bp, Artificial Sequence
  Description of Artificial Sequence: Synthetic oligonucleotide
  Target: SCN9A; (+) strand; PAM type: YTN; PAM sequence: TTT
aaattcctaaagctacgtat

SEQ ID NO: 99495 - DNA, 20 bp, Artificial Sequence
  Description of Artificial Sequence: Synthetic oligonucleotide
  Target: SCN9A; (+) strand; PAM type: YTN; PAM sequence: TTA
aattcctaaagctacgtatt

SEQ ID NO: 99496 - DNA, 20 bp, Artificial Sequence
  Description of Artificial Sequence: Synthetic oligonucleotide
  Target: SCN9A; (+) strand; PAM type: YTN; PAM sequence: TTC
ctaaagctacgtatttagca

SEQ ID NO: 99497 - DNA, 20 bp, Artificial Sequence
  Description of Artificial Sequence: Synthetic oligonucleotide
  Target: SCN9A; (+) strand; PAM type: YTN; PAM sequence: CTA
aagctacgtatttagcagaa

SEQ ID NO: 99498 - DNA, 20 bp, Artificial Sequence
  Description of Artificial Sequence: Synthetic oligonucleotide
  Target: SCN9A; (+) strand; PAM type: YTN; PAM sequence: CTA
cgtatttagcagaataaatt

SEQ ID NO: 99499 - DNA, 20 bp, Artificial Sequence
  Description of Artificial Sequence: Synthetic oligonucleotide
  Target: SCN9A; (+) strand; PAM type: YTN; PAM sequence: TTT
agcagaataaattactcctc

SEQ ID NO: 99500 - DNA, 20 bp, Artificial Sequence
  Description of Artificial Sequence: Synthetic oligonucleotide
  Target: SCN9A; (+) strand; PAM type: YTN; PAM sequence: TTA
gcagaataaattactcctca

SEQ ID NO: 99501 - DNA, 20 bp, Artificial Sequence
  Description of Artificial Sequence: Synthetic oligonucleotide
  Target: SCN9A; (+) strand; PAM type: YTN; PAM sequence: TTA
ctcctcatgccactcttaaa

SEQ ID NO: 99502 - DNA, 20 bp, Artificial Sequence
  Description of Artificial Sequence: Synthetic oligonucleotide
  Target: SCN9A; (+) strand; PAM type: YTN; PAM sequence: CTC
ctcatgccactcttaaattt

SEQ ID NO: 99503 - DNA, 20 bp, Artificial Sequence
  Description of Artificial Sequence: Synthetic oligonucleotide
  Target: SCN9A; (+) strand; PAM type: YTN; PAM sequence: CTC
atgccactcttaaatttgcc

SEQ ID NO: 99504 - DNA, 20 bp, Artificial Sequence
  Description of Artificial Sequence: Synthetic oligonucleotide
  Target: SCN9A; (+) strand; PAM type: YTN; PAM sequence: CTC
ttaaatttgcccagtcattc

SEQ ID NO: 99505 - DNA, 20 bp, Artificial Sequence
  Description of Artificial Sequence: Synthetic oligonucleotide
  Target: SCN9A; (+) strand; PAM type: YTN; PAM sequence: CTT
aaatttgcccagtcattcac

SEQ ID NO: 99506 - DNA, 20 bp, Artificial Sequence
  Description of Artificial Sequence: Synthetic oligonucleotide
  Target: SCN9A; (+) strand; PAM type: YTN; PAM sequence: TTA
aatttgcccagtcattcaca

SEQ ID NO: 99507 - DNA, 20 bp, Artificial Sequence
  Description of Artificial Sequence: Synthetic oligonucleotide
  Target: SCN9A; (+) strand; PAM type: YTN; PAM sequence: TTT
gcccagtcattcacatccat

SEQ ID NO: 99508 - DNA, 20 bp, Artificial Sequence
  Description of Artificial Sequence: Synthetic oligonucleotide
  Target: SCN9A; (+) strand; PAM type: YTN; PAM sequence: TTG
cccagtcattcacatccatt

SEQ ID NO: 99509 - DNA, 20 bp, Artificial Sequence
  Description of Artificial Sequence: Synthetic oligonucleotide
  Target: SCN9A; (+) strand; PAM type: YTN; PAM sequence: TTC
acatccattattttccactt

SEQ ID NO: 99510 - DNA, 20 bp, Artificial Sequence
  Description of Artificial Sequence: Synthetic oligonucleotide
  Target: SCN9A; (+) strand; PAM type: YTN; PAM sequence: TTA
ttttccacttaagaacactt

SEQ ID NO: 99511 - DNA, 20 bp, Artificial Sequence
  Description of Artificial Sequence: Synthetic oligonucleotide
  Target: SCN9A; (+) strand; PAM type: YTN; PAM sequence: TTT
tccacttaagaacacttgaa

SEQ ID NO: 99512 - DNA, 20 bp, Artificial Sequence
  Description of Artificial Sequence: Synthetic oligonucleotide
  Target: SCN9A; (+) strand; PAM type: YTN; PAM sequence: TTT
ccacttaagaacacttgaaa

SEQ ID NO: 99513 - DNA, 20 bp, Artificial Sequence
  Description of Artificial Sequence: Synthetic oligonucleotide
  Target: SCN9A; (+) strand; PAM type: YTN; PAM sequence: TTC
cacttaagaacacttgaaaa

SEQ ID NO: 99514 - DNA, 20 bp, Artificial Sequence
  Description of Artificial Sequence: Synthetic oligonucleotide
  Target: SCN9A; (+) strand; PAM type: YTN; PAM sequence: CTT
aagaacacttgaaaatatgt

SEQ ID NO: 99515 - DNA, 20 bp, Artificial Sequence
  Description of Artificial Sequence: Synthetic oligonucleotide
  Target: SCN9A; (+) strand; PAM type: YTN; PAM sequence: TTA
agaacacttgaaaatatgta

SEQ ID NO: 99516 - DNA, 20 bp, Artificial Sequence
  Description of Artificial Sequence: Synthetic oligonucleotide
  Target: SCN9A; (+) strand; PAM type: YTN; PAM sequence: CTT
gaaaatatgtatgctccctc

SEQ ID NO: 99517 - DNA, 20 bp, Artificial Sequence
  Description of Artificial Sequence: Synthetic oligonucleotide
  Target: SCN9A; (+) strand; PAM type: YTN; PAM sequence: TTG
aaaatatgtatgctccctct

SEQ ID NO: 99518 - DNA, 20 bp, Artificial Sequence
  Description of Artificial Sequence: Synthetic oligonucleotide
  Target: SCN9A; (+) strand; PAM type: YTN; PAM sequence: CTC
cctctttaatcagaaaattt

SEQ ID NO: 99519 - DNA, 20 bp, Artificial Sequence
  Description of Artificial Sequence: Synthetic oligonucleotide
  Target: SCN9A; (+) strand; PAM type: YTN; PAM sequence: CTC
tttaatcagaaaattttttt

SEQ ID NO: 99520 - DNA, 20 bp, Artificial Sequence
  Description of Artificial Sequence: Synthetic oligonucleotide
  Target: SCN9A; (+) strand; PAM type: YTN; PAM sequence: CTT
taatcagaaaattttttttt

SEQ ID NO: 99521 - DNA, 20 bp, Artificial Sequence
  Description of Artificial Sequence: Synthetic oligonucleotide
  Target: SCN9A; (+) strand; PAM type: YTN; PAM sequence: TTT
aatcagaaaatttttttttt

SEQ ID NO: 99522 - DNA, 20 bp, Artificial Sequence
  Description of Artificial Sequence: Synthetic oligonucleotide
  Target: SCN9A; (+) strand; PAM type: YTN; PAM sequence: TTA
atcagaaaatttttttttta

SEQ ID NO: 99523 - DNA, 20 bp, Artificial Sequence
  Description of Artificial Sequence: Synthetic oligonucleotide
  Target: SCN9A; (+) strand; PAM type: YTN; PAM sequence: TTT
tttttttaatgttttgctgt

SEQ ID NO: 99524 - DNA, 20 bp, Artificial Sequence
  Description of Artificial Sequence: Synthetic oligonucleotide
  Target: SCN9A; (+) strand; PAM type: YTN; PAM sequence: TTT
ttttttaatgttttgctgtg

SEQ ID NO: 99525 - DNA, 20 bp, Artificial Sequence
  Description of Artificial Sequence: Synthetic oligonucleotide
  Target: SCN9A; (+) strand; PAM type: YTN; PAM sequence: TTT
tttttaatgttttgctgtgg

SEQ ID NO: 99526 - DNA, 20 bp, Artificial Sequence
  Description of Artificial Sequence: Synthetic oligonucleotide
  Target: SCN9A; (+) strand; PAM type: YTN; PAM sequence: TTT
ttttaatgttttgctgtggt

SEQ ID NO: 99527 - DNA, 20 bp, Artificial Sequence
  Description of Artificial Sequence: Synthetic oligonucleotide
  Target: SCN9A; (+) strand; PAM type: YTN; PAM sequence: TTT
tttaatgttttgctgtggtt

SEQ ID NO: 99528 - DNA, 20 bp, Artificial Sequence
  Description of Artificial Sequence: Synthetic oligonucleotide
  Target: SCN9A; (+) strand; PAM type: YTN; PAM sequence: TTT
ttaatgttttgctgtggttt

SEQ ID NO: 99529 - DNA, 20 bp, Artificial Sequence
  Description of Artificial Sequence: Synthetic oligonucleotide
  Target: SCN9A; (+) strand; PAM type: YTN; PAM sequence: TTT
taatgttttgctgtggtttg

SEQ ID NO: 99530 - DNA, 20 bp, Artificial Sequence
  Description of Artificial Sequence: Synthetic oligonucleotide
  Target: SCN9A; (+) strand; PAM type: YTN; PAM sequence: TTT
aatgttttgctgtggtttga

SEQ ID NO: 99531 - DNA, 20 bp, Artificial Sequence
  Description of Artificial Sequence: Synthetic oligonucleotide
  Target: SCN9A; (+) strand; PAM type: YTN; PAM sequence: TTA
atgttttgctgtggtttgaa

SEQ ID NO: 99532 - DNA, 20 bp, Artificial Sequence
  Description of Artificial Sequence: Synthetic oligonucleotide
  Target: SCN9A; (+) strand; PAM type: YTN; PAM sequence: TTT
tgctgtggtttgaatgtttg

SEQ ID NO: 99533 - DNA, 20 bp, Artificial Sequence
  Description of Artificial Sequence: Synthetic oligonucleotide
  Target: SCN9A; (+) strand; PAM type: YTN; PAM sequence: TTT
gctgtggtttgaatgtttgt

SEQ ID NO: 99534 - DNA, 20 bp, Artificial Sequence
  Description of Artificial Sequence: Synthetic oligonucleotide
  Target: SCN9A; (+) strand; PAM type: YTN; PAM sequence: TTG
ctgtggtttgaatgtttgtc

SEQ ID NO: 99535 - DNA, 20 bp, Artificial Sequence
  Description of Artificial Sequence: Synthetic oligonucleotide
  Target: SCN9A; (+) strand; PAM type: YTN; PAM sequence: CTG
tggtttgaatgtttgtccct

SEQ ID NO: 99536 - DNA, 20 bp, Artificial Sequence
  Description of Artificial Sequence: Synthetic oligonucleotide
  Target: SCN9A; (+) strand; PAM type: YTN; PAM sequence: TTT
gaatgtttgtcccttttgaa

SEQ ID NO: 99537 - DNA, 20 bp, Artificial Sequence
  Description of Artificial Sequence: Synthetic oligonucleotide
  Target: SCN9A; (+) strand; PAM type: YTN; PAM sequence: TTG
aatgtttgtcccttttgaaa

SEQ ID NO: 99538 - DNA, 20 bp, Artificial Sequence
  Description of Artificial Sequence: Synthetic oligonucleotide
  Target: SCN9A; (+) strand; PAM type: YTN; PAM sequence: TTT
gtcccttttgaaactcatgt

SEQ ID NO: 99539 - DNA, 20 bp, Artificial Sequence
  Description of Artificial Sequence: Synthetic oligonucleotide
  Target: SCN9A; (+) strand; PAM type: YTN; PAM sequence: TTG
tcccttttgaaactcatgtt

SEQ ID NO: 99540 - DNA, 20 bp, Artificial Sequence
  Description of Artificial Sequence: Synthetic oligonucleotide
  Target: SCN9A; (+) strand; PAM type: YTN; PAM sequence: CTT
ttgaaactcatgttggaact

SEQ ID NO: 99541 - DNA, 20 bp, Artificial Sequence
  Description of Artificial Sequence: Synthetic oligonucleotide
  Target: SCN9A; (+) strand; PAM type: YTN; PAM sequence: TTT
tgaaactcatgttggaactt

SEQ ID NO: 99542 - DNA, 20 bp, Artificial Sequence
  Description of Artificial Sequence: Synthetic oligonucleotide
  Target: SCN9A; (+) strand; PAM type: YTN; PAM sequence: TTT
gaaactcatgttggaactta

SEQ ID NO: 99543 - DNA, 20 bp, Artificial Sequence
  Description of Artificial Sequence: Synthetic oligonucleotide
  Target: SCN9A; (+) strand; PAM type: YTN; PAM sequence: TTG
aaactcatgttggaacttaa

SEQ ID NO: 99544 - DNA, 20 bp, Artificial Sequence
  Description of Artificial Sequence: Synthetic oligonucleotide
  Target: SCN9A; (+) strand; PAM type: YTN; PAM sequence: CTC
atgttggaacttaattccca

SEQ ID NO: 99545 - DNA, 20 bp, Artificial Sequence
  Description of Artificial Sequence: Synthetic oligonucleotide
  Target: SCN9A; (+) strand; PAM type: YTN; PAM sequence: TTG
gaacttaattcccaatgtaa

SEQ ID NO: 99546 - DNA, 20 bp, Artificial Sequence
  Description of Artificial Sequence: Synthetic oligonucleotide
  Target: SCN9A; (+) strand; PAM type: YTN; PAM sequence: CTT
aattcccaatgtaacagtat

SEQ ID NO: 99547 - DNA, 20 bp, Artificial Sequence
  Description of Artificial Sequence: Synthetic oligonucleotide
  Target: SCN9A; (+) strand; PAM type: YTN; PAM sequence: TTA
attcccaatgtaacagtatt

SEQ ID NO: 99548 - DNA, 20 bp, Artificial Sequence
  Description of Artificial Sequence: Synthetic oligonucleotide
  Target: SCN9A; (+) strand; PAM type: YTN; PAM sequence: TTC
ccaatgtaacagtattaaga

SEQ ID NO: 99549 - DNA, 20 bp, Artificial Sequence
  Description of Artificial Sequence: Synthetic oligonucleotide
  Target: SCN9A; (+) strand; PAM type: YTN; PAM sequence: TTA
agaggcagagcctttaaaag

SEQ ID NO: 99550 - DNA, 20 bp, Artificial Sequence
  Description of Artificial Sequence: Synthetic oligonucleotide
  Target: SCN9A; (+) strand; PAM type: YTN; PAM sequence: CTT
taaaaggtgatgaggtcatg

SEQ ID NO: 99551 - DNA, 20 bp, Artificial Sequence
  Description of Artificial Sequence: Synthetic oligonucleotide
  Target: SCN9A; (+) strand; PAM type: YTN; PAM sequence: TTT
aaaaggtgatgaggtcatga

SEQ ID NO: 99552 - DNA, 20 bp, Artificial Sequence
  Description of Artificial Sequence: Synthetic oligonucleotide
  Target: SCN9A; (+) strand; PAM type: YTN; PAM sequence: TTA
aaaggtgatgaggtcatgaa

SEQ ID NO: 99553 - DNA, 20 bp, Artificial Sequence
  Description of Artificial Sequence: Synthetic oligonucleotide
  Target: SCN9A; (+) strand; PAM type: YTN; PAM sequence: TTC
tgccttcatgaatggaatat

SEQ ID NO: 99554 - DNA, 20 bp, Artificial Sequence
  Description of Artificial Sequence: Synthetic oligonucleotide
  Target: SCN9A; (+) strand; PAM type: YTN; PAM sequence: CTG
ccttcatgaatggaatatag

SEQ ID NO: 99555 - DNA, 20 bp, Artificial Sequence
  Description of Artificial Sequence: Synthetic oligonucleotide
  Target: SCN9A; (+) strand; PAM type: YTN; PAM sequence: CTT
catgaatggaatatagagta

SEQ ID NO: 99556 - DNA, 20 bp, Artificial Sequence
  Description of Artificial Sequence: Synthetic oligonucleotide
  Target: SCN9A; (+) strand; PAM type: YTN; PAM sequence: TTC
atgaatggaatatagagtaa

SEQ ID NO: 99557 - DNA, 20 bp, Artificial Sequence
  Description of Artificial Sequence: Synthetic oligonucleotide
  Target: SCN9A; (+) strand; PAM type: YTN; PAM sequence: CTT
aatgggttatcatgggagtg

SEQ ID NO: 99558 - DNA, 20 bp, Artificial Sequence
  Description of Artificial Sequence: Synthetic oligonucleotide
  Target: SCN9A; (+) strand; PAM type: YTN; PAM sequence: TTA
atgggttatcatgggagtga

SEQ ID NO: 99559 - DNA, 20 bp, Artificial Sequence
  Description of Artificial Sequence: Synthetic oligonucleotide
  Target: SCN9A; (+) strand; PAM type: YTN; PAM sequence: TTA
tcatgggagtgagttagata

SEQ ID NO: 99560 - DNA, 20 bp, Artificial Sequence
  Description of Artificial Sequence: Synthetic oligonucleotide
  Target: SCN9A; (+) strand; PAM type: YTN; PAM sequence: TTA
gatatcacaagagtgggttt

SEQ ID NO: 99561 - DNA, 20 bp, Artificial Sequence
  Description of Artificial Sequence: Synthetic oligonucleotide
  Target: SCN9A; (+) strand; PAM type: YTN; PAM sequence: TTT
attataaaacccagtttggc

SEQ ID NO: 99562 - DNA, 20 bp, Artificial Sequence
  Description of Artificial Sequence: Synthetic oligonucleotide
  Target: SCN9A; (+) strand; PAM type: YTN; PAM sequence: TTA
ttataaaacccagtttggct

SEQ ID NO: 99563 - DNA, 20 bp, Artificial Sequence
  Description of Artificial Sequence: Synthetic oligonucleotide
  Target: SCN9A; (+) strand; PAM type: YTN; PAM sequence: TTA
taaaacccagtttggctctc

SEQ ID NO: 99564 - DNA, 20 bp, Artificial Sequence
  Description of Artificial Sequence: Synthetic oligonucleotide
  Target: SCN9A; (+) strand; PAM type: YTN; PAM sequence: TTT
ggctctcagtgaacacccct

SEQ ID NO: 99565 - DNA, 20 bp, Artificial Sequence
  Description of Artificial Sequence: Synthetic oligonucleotide
  Target: SCN9A; (+) strand; PAM type: YTN; PAM sequence: TTG
gctctcagtgaacacccctc

SEQ ID NO: 99566 - DNA, 20 bp, Artificial Sequence
  Description of Artificial Sequence: Synthetic oligonucleotide
  Target: SCN9A; (+) strand; PAM type: YTN; PAM sequence: CTC
tcagtgaacacccctcgcca

SEQ ID NO: 99567 - DNA, 20 bp, Artificial Sequence
  Description of Artificial Sequence: Synthetic oligonucleotide
  Target: SCN9A; (+) strand; PAM type: YTN; PAM sequence: CTC
agtgaacacccctcgccatg

SEQ ID NO: 99568 - DNA, 20 bp, Artificial Sequence
  Description of Artificial Sequence: Synthetic oligonucleotide
  Target: SCN9A; (+) strand; PAM type: YTN; PAM sequence: CTC
gccatgtgatgccatgagct

SEQ ID NO: 99569 - DNA, 20 bp, Artificial Sequence
  Description of Artificial Sequence: Synthetic oligonucleotide
  Target: SCN9A; (+) strand; PAM type: YTN; PAM sequence: CTG
ccttgggactctctggtgtg

SEQ ID NO: 99570 - DNA, 20 bp, Artificial Sequence
  Description of Artificial Sequence: Synthetic oligonucleotide
  Target: SCN9A; (+) strand; PAM type: YTN; PAM sequence: CTT
gggactctctggtgtgccca

SEQ ID NO: 99571 - DNA, 20 bp, Artificial Sequence
  Description of Artificial Sequence: Synthetic oligonucleotide
  Target: SCN9A; (+) strand; PAM type: YTN; PAM sequence: TTG
ggactctctggtgtgcccac

SEQ ID NO: 99572 - DNA, 20 bp, Artificial Sequence
  Description of Artificial Sequence: Synthetic oligonucleotide
  Target: SCN9A; (+) strand; PAM type: YTN; PAM sequence: CTC
tctggtgtgcccaccagcaa

SEQ ID NO: 99573 - DNA, 20 bp, Artificial Sequence
  Description of Artificial Sequence: Synthetic oligonucleotide
  Target: SCN9A; (+) strand; PAM type: YTN; PAM sequence: CTC
tggtgtgcccaccagcaaga

SEQ ID NO: 99574 - DNA, 20 bp, Artificial Sequence
  Description of Artificial Sequence: Synthetic oligonucleotide
  Target: SCN9A; (+) strand; PAM type: YTN; PAM sequence: CTG
gtgtgcccaccagcaagaaa

SEQ ID NO: 99575 - DNA, 20 bp, Artificial Sequence
  Description of Artificial Sequence: Synthetic oligonucleotide
  Target: SCN9A; (+) strand; PAM type: YTN; PAM sequence: TTC
ccaccagatgtggacccttc

SEQ ID NO: 99576 - DNA, 20 bp, Artificial Sequence
  Description of Artificial Sequence: Synthetic oligonucleotide
  Target: SCN9A; (+) strand; PAM type: YTN; PAM sequence: CTT
caccttagacttcccagctt

SEQ ID NO: 99577 - DNA, 20 bp, Artificial Sequence
  Description of Artificial Sequence: Synthetic oligonucleotide
  Target: SCN9A; (+) strand; PAM type: YTN; PAM sequence: TTC
accttagacttcccagcttc

SEQ ID NO: 99578 - DNA, 20 bp, Artificial Sequence
  Description of Artificial Sequence: Synthetic oligonucleotide
  Target: SCN9A; (+) strand; PAM type: YTN; PAM sequence: CTT
agacttcccagcttccagaa

SEQ ID NO: 99579 - DNA, 20 bp, Artificial Sequence
  Description of Artificial Sequence: Synthetic oligonucleotide
  Target: SCN9A; (+) strand; PAM type: YTN; PAM sequence: TTA
gacttcccagcttccagaac

SEQ ID NO: 99580 - DNA, 20 bp, Artificial Sequence
  Description of Artificial Sequence: Synthetic oligonucleotide
  Target: SCN9A; (+) strand; PAM type: YTN; PAM sequence: CTT
cccagcttccagaactttaa

SEQ ID NO: 99581 - DNA, 20 bp, Artificial Sequence
  Description of Artificial Sequence: Synthetic oligonucleotide
  Target: SCN9A; (+) strand; PAM type: YTN; PAM sequence: TTC
ccagcttccagaactttaag

SEQ ID NO: 99582 - DNA, 20 bp, Artificial Sequence
  Description of Artificial Sequence: Synthetic oligonucleotide
  Target: SCN9A; (+) strand; PAM type: YTN; PAM sequence: CTT
ccagaactttaagaaataaa

SEQ ID NO: 99583 - DNA, 20 bp, Artificial Sequence
  Description of Artificial Sequence: Synthetic oligonucleotide
  Target: SCN9A; (+) strand; PAM type: YTN; PAM sequence: TTC
cagaactttaagaaataaat

SEQ ID NO: 99584 - DNA, 20 bp, Artificial Sequence
  Description of Artificial Sequence: Synthetic oligonucleotide
  Target: SCN9A; (+) strand; PAM type: YTN; PAM sequence: CTT
taagaaataaatttctttat

SEQ ID NO: 99585 - DNA, 20 bp, Artificial Sequence
  Description of Artificial Sequence: Synthetic oligonucleotide
  Target: SCN9A; (+) strand; PAM type: YTN; PAM sequence: TTT
aagaaataaatttctttatt

SEQ ID NO: 99586 - DNA, 20 bp, Artificial Sequence
  Description of Artificial Sequence: Synthetic oligonucleotide
  Target: SCN9A; (+) strand; PAM type: YTN; PAM sequence: TTA
agaaataaatttctttattg

SEQ ID NO: 99587 - DNA, 20 bp, Artificial Sequence
  Description of Artificial Sequence: Synthetic oligonucleotide
  Target: SCN9A; (+) strand; PAM type: YTN; PAM sequence: TTT
ctttattgaatactttaacc

SEQ ID NO: 99588 - DNA, 20 bp, Artificial Sequence
  Description of Artificial Sequence: Synthetic oligonucleotide
  Target: SCN9A; (+) strand; PAM type: YTN; PAM sequence: TTC
tttattgaatactttaacca

SEQ ID NO: 99589 - DNA, 20 bp, Artificial Sequence
  Description of Artificial Sequence: Synthetic oligonucleotide
  Target: SCN9A; (+) strand; PAM type: YTN; PAM sequence: CTT
tattgaatactttaaccagt

SEQ ID NO: 99590 - DNA, 20 bp, Artificial Sequence
  Description of Artificial Sequence: Synthetic oligonucleotide
  Target: SCN9A; (+) strand; PAM type: YTN; PAM sequence: TTT
attgaatactttaaccagtc

SEQ ID NO: 99591 - DNA, 20 bp, Artificial Sequence
  Description of Artificial Sequence: Synthetic oligonucleotide
  Target: SCN9A; (+) strand; PAM type: YTN; PAM sequence: TTA
ttgaatactttaaccagtct

SEQ ID NO: 99592 - DNA, 20 bp, Artificial Sequence
  Description of Artificial Sequence: Synthetic oligonucleotide
  Target: SCN9A; (+) strand; PAM type: YTN; PAM sequence: TTG
aatactttaaccagtctcag

SEQ ID NO: 99593 - DNA, 20 bp, Artificial Sequence
  Description of Artificial Sequence: Synthetic oligonucleotide
  Target: SCN9A; (+) strand; PAM type: YTN; PAM sequence: CTT
taaccagtctcaggtattca

SEQ ID NO: 99594 - DNA, 20 bp, Artificial Sequence
  Description of Artificial Sequence: Synthetic oligonucleotide
  Target: SCN9A; (+) strand; PAM type: YTN; PAM sequence: TTT
aaccagtctcaggtattcag

SEQ ID NO: 99595 - DNA, 20 bp, Artificial Sequence
  Description of Artificial Sequence: Synthetic oligonucleotide
  Target: SCN9A; (+) strand; PAM type: YTN; PAM sequence: TTA
accagtctcaggtattcagt

SEQ ID NO: 99596 - DNA, 20 bp, Artificial Sequence
  Description of Artificial Sequence: Synthetic oligonucleotide
  Target: SCN9A; (+) strand; PAM type: YTN; PAM sequence: CTC
aggtattcagttacagcaat

SEQ ID NO: 99597 - DNA, 20 bp, Artificial Sequence
  Description of Artificial Sequence: Synthetic oligonucleotide
  Target: SCN9A; (+) strand; PAM type: YTN; PAM sequence: TTC
agttacagcaataaaaggta

SEQ ID NO: 99598 - DNA, 20 bp, Artificial Sequence
  Description of Artificial Sequence: Synthetic oligonucleotide
  Target: SCN9A; (+) strand; PAM type: YTN; PAM sequence: TTA
cagcaataaaaggtagacta

SEQ ID NO: 99599 - DNA, 20 bp, Artificial Sequence
  Description of Artificial Sequence: Synthetic oligonucleotide
  Target: SCN9A; (+) strand; PAM type: YTN; PAM sequence: CTA
agacatgtctgttataattg

SEQ ID NO: 99600 - DNA, 20 bp, Artificial Sequence
  Description of Artificial Sequence: Synthetic oligonucleotide
  Target: SCN9A; (+) strand; PAM type: YTN; PAM sequence: CTG
ttataattgatacagcccct

SEQ ID NO: 99601 - DNA, 20 bp, Artificial Sequence
  Description of Artificial Sequence: Synthetic oligonucleotide
  Target: SCN9A; (+) strand; PAM type: YTN; PAM sequence: TTA
taattgatacagcccctaaa

SEQ ID NO: 99602 - DNA, 20 bp, Artificial Sequence
  Description of Artificial Sequence: Synthetic oligonucleotide
  Target: SCN9A; (+) strand; PAM type: YTN; PAM sequence: TTG
atacagcccctaaaatacta

SEQ ID NO: 99603 - DNA, 20 bp, Artificial Sequence
  Description of Artificial Sequence: Synthetic oligonucleotide
  Target: SCN9A; (+) strand; PAM type: YTN; PAM sequence: CTA
aaatactaataggtctgttc

SEQ ID NO: 99604 - DNA, 20 bp, Artificial Sequence
  Description of Artificial Sequence: Synthetic oligonucleotide
  Target: SCN9A; (+) strand; PAM type: YTN; PAM sequence: CTA
ataggtctgttctccaagcc

SEQ ID NO: 99605 - DNA, 20 bp, Artificial Sequence
  Description of Artificial Sequence: Synthetic oligonucleotide
  Target: SCN9A; (+) strand; PAM type: YTN; PAM sequence: CTG
ttctccaagccactgttaag

SEQ ID NO: 99606 - DNA, 20 bp, Artificial Sequence
  Description of Artificial Sequence: Synthetic oligonucleotide
  Target: SCN9A; (+) strand; PAM type: YTN; PAM sequence: TTC
tccaagccactgttaagtga

SEQ ID NO: 99607 - DNA, 20 bp, Artificial Sequence
  Description of Artificial Sequence: Synthetic oligonucleotide
  Target: SCN9A; (+) strand; PAM type: YTN; PAM sequence: CTC
caagccactgttaagtgagt

SEQ ID NO: 99608 - DNA, 20 bp, Artificial Sequence
  Description of Artificial Sequence: Synthetic oligonucleotide
  Target: SCN9A; (+) strand; PAM type: YTN; PAM sequence: CTG
ttaagtgagttttatgacac

SEQ ID NO: 99609 - DNA, 20 bp, Artificial Sequence
  Description of Artificial Sequence: Synthetic oligonucleotide
  Target: SCN9A; (+) strand; PAM type: YTN; PAM sequence: TTA
agtgagttttatgacacgga

SEQ ID NO: 99610 - DNA, 20 bp, Artificial Sequence
  Description of Artificial Sequence: Synthetic oligonucleotide
  Target: SCN9A; (+) strand; PAM type: YTN; PAM sequence: TTT
tatgacacggaatatatgca

SEQ ID NO: 99611 - DNA, 20 bp, Artificial Sequence
  Description of Artificial Sequence: Synthetic oligonucleotide
  Target: SCN9A; (+) strand; PAM type: YTN; PAM sequence: TTT
atgacacggaatatatgcat

SEQ ID NO: 99612 - DNA, 20 bp, Artificial Sequence
  Description of Artificial Sequence: Synthetic oligonucleotide
  Target: SCN9A; (+) strand; PAM type: YTN; PAM sequence: TTA
tgacacggaatatatgcata

SEQ ID NO: 99613 - DNA, 20 bp, Artificial Sequence
  Description of Artificial Sequence: Synthetic oligonucleotide
  Target: SCN9A; (+) strand; PAM type: YTN; PAM sequence: TTA
ttaagactatggtatagttt

SEQ ID NO: 99614 - DNA, 20 bp, Artificial Sequence
  Description of Artificial Sequence: Synthetic oligonucleotide
  Target: SCN9A; (+) strand; PAM type: YTN; PAM sequence: TTA
agactatggtatagtttgta

SEQ ID NO: 99615 - DNA, 20 bp, Artificial Sequence
  Description of Artificial Sequence: Synthetic oligonucleotide
  Target: SCN9A; (+) strand; PAM type: YTN; PAM sequence: CTA
tggtatagtttgtaactgag

SEQ ID NO: 99616 - DNA, 20 bp, Artificial Sequence
  Description of Artificial Sequence: Synthetic oligonucleotide
  Target: SCN9A; (+) strand; PAM type: YTN; PAM sequence: TTT
gtaactgagaatatatatgc

SEQ ID NO: 99617 - DNA, 20 bp, Artificial Sequence
  Description of Artificial Sequence: Synthetic oligonucleotide
  Target: SCN9A; (+) strand; PAM type: YTN; PAM sequence: TTG
taactgagaatatatatgca

SEQ ID NO: 99618 - DNA, 20 bp, Artificial Sequence
  Description of Artificial Sequence: Synthetic oligonucleotide
  Target: SCN9A; (+) strand; PAM type: YTN; PAM sequence: CTG
agaatatatatgcatatata

SEQ ID NO: 99619 - DNA, 20 bp, Artificial Sequence
  Description of Artificial Sequence: Synthetic oligonucleotide
  Target: SCN9A; (+) strand; PAM type: YTN; PAM sequence: TTC
acatctttctataaacacac

SEQ ID NO: 99620 - DNA, 20 bp, Artificial Sequence
  Description of Artificial Sequence: Synthetic oligonucleotide
  Target: SCN9A; (+) strand; PAM type: YTN; PAM sequence: CTT
tctataaacacacacgtata

SEQ ID NO: 99621 - DNA, 20 bp, Artificial Sequence
  Description of Artificial Sequence: Synthetic oligonucleotide
  Target: SCN9A; (+) strand; PAM type: YTN; PAM sequence: TTT
ctataaacacacacgtatat

SEQ ID NO: 99622 - DNA, 20 bp, Artificial Sequence
  Description of Artificial Sequence: Synthetic oligonucleotide
  Target: SCN9A; (+) strand; PAM type: YTN; PAM sequence: TTC
tataaacacacacgtatata

SEQ ID NO: 99623 - DNA, 20 bp, Artificial Sequence
  Description of Artificial Sequence: Synthetic oligonucleotide
  Target: SCN9A; (+) strand; PAM type: YTN; PAM sequence: CTA
taaacacacacgtatatata

SEQ ID NO: 99624 - DNA, 20 bp, Artificial Sequence
  Description of Artificial Sequence: Synthetic oligonucleotide
  Target: SCN9A; (+) strand; PAM type: YTN; PAM sequence: CTG
tactgaagaacactgtttaa

SEQ ID NO: 99625 - DNA, 20 bp, Artificial Sequence
  Description of Artificial Sequence: Synthetic oligonucleotide
  Target: SCN9A; (+) strand; PAM type: YTN; PAM sequence: CTG
aagaacactgtttaatcaag

SEQ ID NO: 99626 - DNA, 20 bp, Artificial Sequence
  Description of Artificial Sequence: Synthetic oligonucleotide
  Target: SCN9A; (+) strand; PAM type: YTN; PAM sequence: CTG
tttaatcaagtaagtttcaa

SEQ ID NO: 99627 - DNA, 20 bp, Artificial Sequence
  Description of Artificial Sequence: Synthetic oligonucleotide
  Target: SCN9A; (+) strand; PAM type: YTN; PAM sequence: TTT
aatcaagtaagtttcaaata

SEQ ID NO: 99628 - DNA, 20 bp, Artificial Sequence
  Description of Artificial Sequence: Synthetic oligonucleotide
  Target: SCN9A; (+) strand; PAM type: YTN; PAM sequence: TTA
atcaagtaagtttcaaataa

SEQ ID NO: 99629 - DNA, 20 bp, Artificial Sequence
  Description of Artificial Sequence: Synthetic oligonucleotide
  Target: SCN9A; (+) strand; PAM type: YTN; PAM sequence: TTT
caaataacccagaagcctgc

SEQ ID NO: 99630 - DNA, 20 bp, Artificial Sequence
  Description of Artificial Sequence: Synthetic oligonucleotide
  Target: SCN9A; (+) strand; PAM type: YTN; PAM sequence: TTC
aaataacccagaagcctgca

SEQ ID NO: 99631 - DNA, 20 bp, Artificial Sequence
  Description of Artificial Sequence: Synthetic oligonucleotide
  Target: SCN9A; (+) strand; PAM type: YTN; PAM sequence: CTG
cagaaatcagacaagtccat

SEQ ID NO: 99632 - DNA, 20 bp, Artificial Sequence
  Description of Artificial Sequence: Synthetic oligonucleotide
  Target: SCN9A; (+) strand; PAM type: YTN; PAM sequence: TTC
tctgagtagcaaataatata

SEQ ID NO: 99633 - DNA, 20 bp, Artificial Sequence
  Description of Artificial Sequence: Synthetic oligonucleotide
  Target: SCN9A; (+) strand; PAM type: YTN; PAM sequence: CTC
tgagtagcaaataatataag

SEQ ID NO: 99634 - DNA, 20 bp, Artificial Sequence
  Description of Artificial Sequence: Synthetic oligonucleotide
  Target: SCN9A; (+) strand; PAM type: YTN; PAM sequence: CTG
agtagcaaataatataagta

SEQ ID NO: 99635 - DNA, 20 bp, Artificial Sequence
  Description of Artificial Sequence: Synthetic oligonucleotide
  Target: SCN9A; (+) strand; PAM type: YTN; PAM sequence: TTC
tgaaatctgaatatacaaca

SEQ ID NO: 99636 - DNA, 20 bp, Artificial Sequence
  Description of Artificial Sequence: Synthetic oligonucleotide
  Target: SCN9A; (+) strand; PAM type: YTN; PAM sequence: CTG
aaatctgaatatacaacaga

SEQ ID NO: 99637 - DNA, 20 bp, Artificial Sequence
  Description of Artificial Sequence: Synthetic oligonucleotide
  Target: SCN9A; (+) strand; PAM type: YTN; PAM sequence: CTG
aatatacaacagaatcatct

SEQ ID NO: 99638 - DNA, 20 bp, Artificial Sequence
  Description of Artificial Sequence: Synthetic oligonucleotide
  Target: SCN9A; (+) strand; PAM type: YTN; PAM sequence: CTG
tagggcttgttacaatgatt

SEQ ID NO: 99639 - DNA, 20 bp, Artificial Sequence
  Description of Artificial Sequence: Synthetic oligonucleotide
  Target: SCN9A; (+) strand; PAM type: YTN; PAM sequence: CTT
gttacaatgatttgccacat

SEQ ID NO: 99640 - DNA, 20 bp, Artificial Sequence
  Description of Artificial Sequence: Synthetic oligonucleotide
  Target: SCN9A; (+) strand; PAM type: YTN; PAM sequence: TTG
ttacaatgatttgccacatc

SEQ ID NO: 99641 - DNA, 20 bp, Artificial Sequence
  Description of Artificial Sequence: Synthetic oligonucleotide
  Target: SCN9A; (+) strand; PAM type: YTN; PAM sequence: TTA
caatgatttgccacatccaa

SEQ ID NO: 99642 - DNA, 20 bp, Artificial Sequence
  Description of Artificial Sequence: Synthetic oligonucleotide
  Target: SCN9A; (+) strand; PAM type: YTN; PAM sequence: TTT
gccacatccaaccccagagt

SEQ ID NO: 99643 - DNA, 20 bp, Artificial Sequence
  Description of Artificial Sequence: Synthetic oligonucleotide
  Target: SCN9A; (+) strand; PAM type: YTN; PAM sequence: TTG
ccacatccaaccccagagtt

SEQ ID NO: 99644 - DNA, 20 bp, Artificial Sequence
  Description of Artificial Sequence: Synthetic oligonucleotide
  Target: SCN9A; (+) strand; PAM type: YTN; PAM sequence: TTT
ctgattcagtatgtcttggg

SEQ ID NO: 99645 - DNA, 20 bp, Artificial Sequence
  Description of Artificial Sequence: Synthetic oligonucleotide
  Target: SCN9A; (+) strand; PAM type: YTN; PAM sequence: TTC
tgattcagtatgtcttgggg

SEQ ID NO: 99646 - DNA, 20 bp, Artificial Sequence
  Description of Artificial Sequence: Synthetic oligonucleotide
  Target: SCN9A; (+) strand; PAM type: YTN; PAM sequence: CTG
attcagtatgtcttggggtt

SEQ ID NO: 99647 - DNA, 20 bp, Artificial Sequence
  Description of Artificial Sequence: Synthetic oligonucleotide
  Target: SCN9A; (+) strand; PAM type: YTN; PAM sequence: TTC
agtatgtcttggggttgggg

SEQ ID NO: 99648 - DNA, 20 bp, Artificial Sequence
  Description of Artificial Sequence: Synthetic oligonucleotide
  Target: SCN9A; (+) strand; PAM type: YTN; PAM sequence: CTT
ggggttgggggcagaatttg

SEQ ID NO: 99649 - DNA, 20 bp, Artificial Sequence
  Description of Artificial Sequence: Synthetic oligonucleotide
  Target: SCN9A; (+) strand; PAM type: YTN; PAM sequence: TTG
gggttgggggcagaatttgc

SEQ ID NO: 99650 - DNA, 20 bp, Artificial Sequence
  Description of Artificial Sequence: Synthetic oligonucleotide
  Target: SCN9A; (+) strand; PAM type: YTN; PAM sequence: TTG
ggggcagaatttgcatctct

SEQ ID NO: 99651 - DNA, 20 bp, Artificial Sequence
  Description of Artificial Sequence: Synthetic oligonucleotide
  Target: SCN9A; (+) strand; PAM type: YTN; PAM sequence: TTT
gcatctcttatgagttctca

SEQ ID NO: 99652 - DNA, 20 bp, Artificial Sequence
  Description of Artificial Sequence: Synthetic oligonucleotide
  Target: SCN9A; (+) strand; PAM type: YTN; PAM sequence: TTG
catctcttatgagttctcac

SEQ ID NO: 99653 - DNA, 20 bp, Artificial Sequence
  Description of Artificial Sequence: Synthetic oligonucleotide
  Target: SCN9A; (+) strand; PAM type: YTN; PAM sequence: CTC
ttatgagttctcacctacat

SEQ ID NO: 99654 - DNA, 20 bp, Artificial Sequence
  Description of Artificial Sequence: Synthetic oligonucleotide
  Target: SCN9A; (+) strand; PAM type: YTN; PAM sequence: CTT
atgagttctcacctacatgt

SEQ ID NO: 99655 - DNA, 20 bp, Artificial Sequence
  Description of Artificial Sequence: Synthetic oligonucleotide
  Target: SCN9A; (+) strand; PAM type: YTN; PAM sequence: TTA
tgagttctcacctacatgtg

SEQ ID NO: 99656 - DNA, 20 bp, Artificial Sequence
  Description of Artificial Sequence: Synthetic oligonucleotide
  Target: SCN9A; (+) strand; PAM type: YTN; PAM sequence: TTC
tcacctacatgtgccaacgt

SEQ ID NO: 99657 - DNA, 20 bp, Artificial Sequence
  Description of Artificial Sequence: Synthetic oligonucleotide
  Target: SCN9A; (+) strand; PAM type: YTN; PAM sequence: CTC
acctacatgtgccaacgttt

SEQ ID NO: 99658 - DNA, 20 bp, Artificial Sequence
  Description of Artificial Sequence: Synthetic oligonucleotide
  Target: SCN9A; (+) strand; PAM type: YTN; PAM sequence: CTA
catgtgccaacgttttcagt

SEQ ID NO: 99659 - DNA, 20 bp, Artificial Sequence
  Description of Artificial Sequence: Synthetic oligonucleotide
  Target: SCN9A; (+) strand; PAM type: YTN; PAM sequence: TTT
tcagttttgagaccatcctt

SEQ ID NO: 99660 - DNA, 20 bp, Artificial Sequence
  Description of Artificial Sequence: Synthetic oligonucleotide
  Target: SCN9A; (+) strand; PAM type: YTN; PAM sequence: TTT
cagttttgagaccatccttc

SEQ ID NO: 99661 - DNA, 20 bp, Artificial Sequence
  Description of Artificial Sequence: Synthetic oligonucleotide
  Target: SCN9A; (+) strand; PAM type: YTN; PAM sequence: TTC
agttttgagaccatccttca

SEQ ID NO: 99662 - DNA, 20 bp, Artificial Sequence
  Description of Artificial Sequence: Synthetic oligonucleotide
  Target: SCN9A; (+) strand; PAM type: YTN; PAM sequence: TTT
tgagaccatccttcaagaac

SEQ ID NO: 99663 - DNA, 20 bp, Artificial Sequence
  Description of Artificial Sequence: Synthetic oligonucleotide
  Target: SCN9A; (+) strand; PAM type: YTN; PAM sequence: TTT
gagaccatccttcaagaaca

SEQ ID NO: 99664 - DNA, 20 bp, Artificial Sequence
  Description of Artificial Sequence: Synthetic oligonucleotide
  Target: SCN9A; (+) strand; PAM type: YTN; PAM sequence: TTG
agaccatccttcaagaacaa

SEQ ID NO: 99665 - DNA, 20 bp, Artificial Sequence
  Description of Artificial Sequence: Synthetic oligonucleotide
  Target: SCN9A; (+) strand; PAM type: YTN; PAM sequence: CTT
caagaacaactgctgtagat

SEQ ID NO: 99666 - DNA, 20 bp, Artificial Sequence
  Description of Artificial Sequence: Synthetic oligonucleotide
  Target: SCN9A; (+) strand; PAM type: YTN; PAM sequence: TTC
aagaacaactgctgtagata

SEQ ID NO: 99667 - DNA, 20 bp, Artificial Sequence
  Description of Artificial Sequence: Synthetic oligonucleotide
  Target: SCN9A; (+) strand; PAM type: YTN; PAM sequence: CTG
ctgtagataagtttctatac

SEQ ID NO: 99668 - DNA, 20 bp, Artificial Sequence
  Description of Artificial Sequence: Synthetic oligonucleotide
  Target: SCN9A; (+) strand; PAM type: YTN; PAM sequence: CTG
tagataagtttctatacttt

SEQ ID NO: 99669 - DNA, 20 bp, Artificial Sequence
  Description of Artificial Sequence: Synthetic oligonucleotide
  Target: SCN9A; (+) strand; PAM type: YTN; PAM sequence: TTT
ctatacttttcagaaaaaaa

SEQ ID NO: 99670 - DNA, 20 bp, Artificial Sequence
  Description of Artificial Sequence: Synthetic oligonucleotide
  Target: SCN9A; (+) strand; PAM type: YTN; PAM sequence: TTC
tatacttttcagaaaaaaaa

SEQ ID NO: 99671 - DNA, 20 bp, Artificial Sequence
  Description of Artificial Sequence: Synthetic oligonucleotide
  Target: SCN9A; (+) strand; PAM type: YTN; PAM sequence: CTA
tacttttcagaaaaaaaaaa

SEQ ID NO: 99672 - DNA, 20 bp, Artificial Sequence
  Description of Artificial Sequence: Synthetic oligonucleotide
  Target: SCN9A; (+) strand; PAM type: YTN; PAM sequence: CTT
ttcagaaaaaaaaaaaatca

SEQ ID NO: 99673 - DNA, 20 bp, Artificial Sequence
  Description of Artificial Sequence: Synthetic oligonucleotide
  Target: SCN9A; (+) strand; PAM type: YTN; PAM sequence: TTT
tcagaaaaaaaaaaaatcag

SEQ ID NO: 99674 - DNA, 20 bp, Artificial Sequence
  Description of Artificial Sequence: Synthetic oligonucleotide
  Target: SCN9A; (+) strand; PAM type: YTN; PAM sequence: TTT
cagaaaaaaaaaaaatcagc

SEQ ID NO: 99675 - DNA, 20 bp, Artificial Sequence
  Description of Artificial Sequence: Synthetic oligonucleotide
  Target: SCN9A; (+) strand; PAM type: YTN; PAM sequence: TTC
agaaaaaaaaaaaatcagcc

SEQ ID NO: 99676 - DNA, 20 bp, Artificial Sequence
  Description of Artificial Sequence: Synthetic oligonucleotide
  Target: SCN9A; (+) strand; PAM type: YTN; PAM sequence: CTC
ccccaaatctgtgtcccaaa

SEQ ID NO: 99677 - DNA, 20 bp, Artificial Sequence
  Description of Artificial Sequence: Synthetic oligonucleotide
  Target: SCN9A; (+) strand; PAM type: YTN; PAM sequence: CTG
tgtcccaaaatttgcatctc

SEQ ID NO: 99678 - DNA, 20 bp, Artificial Sequence
  Description of Artificial Sequence: Synthetic oligonucleotide
  Target: SCN9A; (+) strand; PAM type: YTN; PAM sequence: TTT
gcatctctgtcagcaagaat

SEQ ID NO: 99679 - DNA, 20 bp, Artificial Sequence
  Description of Artificial Sequence: Synthetic oligonucleotide
  Target: SCN9A; (+) strand; PAM type: YTN; PAM sequence: TTG
catctctgtcagcaagaata

SEQ ID NO: 99680 - DNA, 20 bp, Artificial Sequence
  Description of Artificial Sequence: Synthetic oligonucleotide
  Target: SCN9A; (+) strand; PAM type: YTN; PAM sequence: CTC
tgtcagcaagaatattgtgt

SEQ ID NO: 99681 - DNA, 20 bp, Artificial Sequence
  Description of Artificial Sequence: Synthetic oligonucleotide
  Target: SCN9A; (+) strand; PAM type: YTN; PAM sequence: CTG
tcagcaagaatattgtgtgg

SEQ ID NO: 99682 - DNA, 20 bp, Artificial Sequence
  Description of Artificial Sequence: Synthetic oligonucleotide
  Target: SCN9A; (+) strand; PAM type: YTN; PAM sequence: TTG
tgtggagctttactctctgt

SEQ ID NO: 99683 - DNA, 20 bp, Artificial Sequence
  Description of Artificial Sequence: Synthetic oligonucleotide
  Target: SCN9A; (+) strand; PAM type: YTN; PAM sequence: CTT
tactctctgtgctttgcatt

SEQ ID NO: 99684 - DNA, 20 bp, Artificial Sequence
  Description of Artificial Sequence: Synthetic oligonucleotide
  Target: SCN9A; (+) strand; PAM type: YTN; PAM sequence: TTT
actctctgtgctttgcatta

SEQ ID NO: 99685 - DNA, 20 bp, Artificial Sequence
  Description of Artificial Sequence: Synthetic oligonucleotide
  Target: SCN9A; (+) strand; PAM type: YTN; PAM sequence: TTA
ctctctgtgctttgcattat

SEQ ID NO: 99686 - DNA, 20 bp, Artificial Sequence
  Description of Artificial Sequence: Synthetic oligonucleotide
  Target: SCN9A; (+) strand; PAM type: YTN; PAM sequence: CTC
tctgtgctttgcattatatt

SEQ ID NO: 99687 - DNA, 20 bp, Artificial Sequence
  Description of Artificial Sequence: Synthetic oligonucleotide
  Target: SCN9A; (+) strand; PAM type: YTN; PAM sequence: CTC
tgtgctttgcattatatttg

SEQ ID NO: 99688 - DNA, 20 bp, Artificial Sequence
  Description of Artificial Sequence: Synthetic oligonucleotide
  Target: SCN9A; (+) strand; PAM type: YTN; PAM sequence: CTG
tgctttgcattatatttgtt

SEQ ID NO: 99689 - DNA, 20 bp, Artificial Sequence
  Description of Artificial Sequence: Synthetic oligonucleotide
  Target: SCN9A; (+) strand; PAM type: YTN; PAM sequence: CTT
tgcattatatttgttcgttt

SEQ ID NO: 99690 - DNA, 20 bp, Artificial Sequence
  Description of Artificial Sequence: Synthetic oligonucleotide
  Target: SCN9A; (+) strand; PAM type: YTN; PAM sequence: TTT
gcattatatttgttcgtttc

SEQ ID NO: 99691 - DNA, 20 bp, Artificial Sequence
  Description of Artificial Sequence: Synthetic oligonucleotide
  Target: SCN9A; (+) strand; PAM type: YTN; PAM sequence: TTG
cattatatttgttcgtttcc

SEQ ID NO: 99692 - DNA, 20 bp, Artificial Sequence
  Description of Artificial Sequence: Synthetic oligonucleotide
  Target: SCN9A; (+) strand; PAM type: YTN; PAM sequence: TTA
tatttgttcgtttccaaaat

SEQ ID NO: 99693 - DNA, 20 bp, Artificial Sequence
  Description of Artificial Sequence: Synthetic oligonucleotide
  Target: SCN9A; (+) strand; PAM type: YTN; PAM sequence: TTT
gttcgtttccaaaatattaa

SEQ ID NO: 99694 - DNA, 20 bp, Artificial Sequence
  Description of Artificial Sequence: Synthetic oligonucleotide
  Target: SCN9A; (+) strand; PAM type: YTN; PAM sequence: TTG
ttcgtttccaaaatattaaa

SEQ ID NO: 99695 - DNA, 20 bp, Artificial Sequence
  Description of Artificial Sequence: Synthetic oligonucleotide
  Target: SCN9A; (+) strand; PAM type: YTN; PAM sequence: TTC
gtttccaaaatattaaataa

SEQ ID NO: 99696 - DNA, 20 bp, Artificial Sequence
  Description of Artificial Sequence: Synthetic oligonucleotide
  Target: SCN9A; (+) strand; PAM type: YTN; PAM sequence: TTT
ccaaaatattaaataatatt

SEQ ID NO: 99697 - DNA, 20 bp, Artificial Sequence
  Description of Artificial Sequence: Synthetic oligonucleotide
  Target: SCN9A; (+) strand; PAM type: YTN; PAM sequence: TTC
caaaatattaaataatattt

SEQ ID NO: 99698 - DNA, 20 bp, Artificial Sequence
  Description of Artificial Sequence: Synthetic oligonucleotide
  Target: SCN9A; (+) strand; PAM type: YTN; PAM sequence: TTA
aataatatttcaaattggag

SEQ ID NO: 99699 - DNA, 20 bp, Artificial Sequence
  Description of Artificial Sequence: Synthetic oligonucleotide
  Target: SCN9A; (+) strand; PAM type: YTN; PAM sequence: TTT
caaattggagttgtttatct

SEQ ID NO: 99700 - DNA, 20 bp, Artificial Sequence
  Description of Artificial Sequence: Synthetic oligonucleotide
  Target: SCN9A; (+) strand; PAM type: YTN; PAM sequence: TTC
aaattggagttgtttatctc

SEQ ID NO: 99701 - DNA, 20 bp, Artificial Sequence
  Description of Artificial Sequence: Synthetic oligonucleotide
  Target: SCN9A; (+) strand; PAM type: YTN; PAM sequence: TTG
gagttgtttatctccctgat

SEQ ID NO: 99702 - DNA, 20 bp, Artificial Sequence
  Description of Artificial Sequence: Synthetic oligonucleotide
  Target: SCN9A; (+) strand; PAM type: YTN; PAM sequence: TTG
tttatctccctgatttctgc

SEQ ID NO: 99703 - DNA, 20 bp, Artificial Sequence
  Description of Artificial Sequence: Synthetic oligonucleotide
  Target: SCN9A; (+) strand; PAM type: YTN; PAM sequence: TTT
atctccctgatttctgcaca

SEQ ID NO: 99704 - DNA, 20 bp, Artificial Sequence
  Description of Artificial Sequence: Synthetic oligonucleotide
  Target: SCN9A; (+) strand; PAM type: YTN; PAM sequence: TTA
tctccctgatttctgcacat

SEQ ID NO: 99705 - DNA, 20 bp, Artificial Sequence
  Description of Artificial Sequence: Synthetic oligonucleotide
  Target: SCN9A; (+) strand; PAM type: YTN; PAM sequence: CTC
cctgatttctgcacattaca

SEQ ID NO: 99706 - DNA, 20 bp, Artificial Sequence
  Description of Artificial Sequence: Synthetic oligonucleotide
  Target: SCN9A; (+) strand; PAM type: YTN; PAM sequence: CTG
atttctgcacattacatacc

SEQ ID NO: 99707 - DNA, 20 bp, Artificial Sequence
  Description of Artificial Sequence: Synthetic oligonucleotide
  Target: SCN9A; (+) strand; PAM type: YTN; PAM sequence: TTT
ctgcacattacatacccctg

SEQ ID NO: 99708 - DNA, 20 bp, Artificial Sequence
  Description of Artificial Sequence: Synthetic oligonucleotide
  Target: SCN9A; (+) strand; PAM type: YTN; PAM sequence: TTC
tgcacattacatacccctga

SEQ ID NO: 99709 - DNA, 20 bp, Artificial Sequence
  Description of Artificial Sequence: Synthetic oligonucleotide
  Target: SCN9A; (+) strand; PAM type: YTN; PAM sequence: CTG
cacattacatacccctgaac

SEQ ID NO: 99710 - DNA, 20 bp, Artificial Sequence
  Description of Artificial Sequence: Synthetic oligonucleotide
  Target: SCN9A; (+) strand; PAM type: YTN; PAM sequence: TTA
catacccctgaacaggaggt

SEQ ID NO: 99711 - DNA, 20 bp, Artificial Sequence
  Description of Artificial Sequence: Synthetic oligonucleotide
  Target: SCN9A; (+) strand; PAM type: YTN; PAM sequence: CTG
aacaggaggttatactcact

SEQ ID NO: 99712 - DNA, 20 bp, Artificial Sequence
  Description of Artificial Sequence: Synthetic oligonucleotide
  Target: SCN9A; (+) strand; PAM type: YTN; PAM sequence: TTA
tactcactgagaatcatcac

SEQ ID NO: 99713 - DNA, 20 bp, Artificial Sequence
  Description of Artificial Sequence: Synthetic oligonucleotide
  Target: SCN9A; (+) strand; PAM type: YTN; PAM sequence: CTC
actgagaatcatcactttaa

SEQ ID NO: 99714 - DNA, 20 bp, Artificial Sequence
  Description of Artificial Sequence: Synthetic oligonucleotide
  Target: SCN9A; (+) strand; PAM type: YTN; PAM sequence: CTG
agaatcatcactttaaattt

SEQ ID NO: 99715 - DNA, 20 bp, Artificial Sequence
  Description of Artificial Sequence: Synthetic oligonucleotide
  Target: SCN9A; (+) strand; PAM type: YTN; PAM sequence: CTT
taaattttcaaataaaacaa

SEQ ID NO: 99716 - DNA, 20 bp, Artificial Sequence
  Description of Artificial Sequence: Synthetic oligonucleotide
  Target: SCN9A; (+) strand; PAM type: YTN; PAM sequence: TTT
aaattttcaaataaaacaat

SEQ ID NO: 99717 - DNA, 20 bp, Artificial Sequence
  Description of Artificial Sequence: Synthetic oligonucleotide
  Target: SCN9A; (+) strand; PAM type: YTN; PAM sequence: TTA
aattttcaaataaaacaatt

SEQ ID NO: 99718 - DNA, 20 bp, Artificial Sequence
  Description of Artificial Sequence: Synthetic oligonucleotide
  Target: SCN9A; (+) strand; PAM type: YTN; PAM sequence: TTT
tcaaataaaacaatttccat

SEQ ID NO: 99719 - DNA, 20 bp, Artificial Sequence
  Description of Artificial Sequence: Synthetic oligonucleotide
  Target: SCN9A; (+) strand; PAM type: YTN; PAM sequence: TTT
caaataaaacaatttccatt

SEQ ID NO: 99720 - DNA, 20 bp, Artificial Sequence
  Description of Artificial Sequence: Synthetic oligonucleotide
  Target: SCN9A; (+) strand; PAM type: YTN; PAM sequence: TTC
aaataaaacaatttccatta

SEQ ID NO: 99721 - DNA, 20 bp, Artificial Sequence
  Description of Artificial Sequence: Synthetic oligonucleotide
  Target: SCN9A; (+) strand; PAM type: YTN; PAM sequence: TTT
ccattattaaacagccatat

SEQ ID NO: 99722 - DNA, 20 bp, Artificial Sequence
  Description of Artificial Sequence: Synthetic oligonucleotide
  Target: SCN9A; (+) strand; PAM type: YTN; PAM sequence: TTC
cattattaaacagccatatc

SEQ ID NO: 99723 - DNA, 20 bp, Artificial Sequence
  Description of Artificial Sequence: Synthetic oligonucleotide
  Target: SCN9A; (+) strand; PAM type: YTN; PAM sequence: TTA
ttaaacagccatatctctta

SEQ ID NO: 99724 - DNA, 20 bp, Artificial Sequence
  Description of Artificial Sequence: Synthetic oligonucleotide
  Target: SCN9A; (+) strand; PAM type: YTN; PAM sequence: TTA
aacagccatatctcttaatt

SEQ ID NO: 99725 - DNA, 20 bp, Artificial Sequence
  Description of Artificial Sequence: Synthetic oligonucleotide
  Target: SCN9A; (+) strand; PAM type: YTN; PAM sequence: CTC
ttaatttaaaataagttcaa

SEQ ID NO: 99726 - DNA, 20 bp, Artificial Sequence
  Description of Artificial Sequence: Synthetic oligonucleotide
  Target: SCN9A; (+) strand; PAM type: YTN; PAM sequence: CTT
aatttaaaataagttcaatt

SEQ ID NO: 99727 - DNA, 20 bp, Artificial Sequence
  Description of Artificial Sequence: Synthetic oligonucleotide
  Target: SCN9A; (+) strand; PAM type: YTN; PAM sequence: TTA
atttaaaataagttcaattt

SEQ ID NO: 99728 - DNA, 20 bp, Artificial Sequence
  Description of Artificial Sequence: Synthetic oligonucleotide
  Target: SCN9A; (+) strand; PAM type: YTN; PAM sequence: TTT
aaaataagttcaattttact

SEQ ID NO: 99729 - DNA, 20 bp, Artificial Sequence
  Description of Artificial Sequence: Synthetic oligonucleotide
  Target: SCN9A; (+) strand; PAM type: YTN; PAM sequence: TTA
aaataagttcaattttactt

SEQ ID NO: 99730 - DNA, 20 bp, Artificial Sequence
  Description of Artificial Sequence: Synthetic oligonucleotide
  Target: SCN9A; (+) strand; PAM type: YTN; PAM sequence: TTC
aattttacttgtaaaccttc

SEQ ID NO: 99731 - DNA, 20 bp, Artificial Sequence
  Description of Artificial Sequence: Synthetic oligonucleotide
  Target: SCN9A; (+) strand; PAM type: YTN; PAM sequence: TTT
tacttgtaaaccttcatttc

SEQ ID NO: 99732 - DNA, 20 bp, Artificial Sequence
  Description of Artificial Sequence: Synthetic oligonucleotide
  Target: SCN9A; (+) strand; PAM type: YTN; PAM sequence: TTT
acttgtaaaccttcatttct

SEQ ID NO: 99733 - DNA, 20 bp, Artificial Sequence
  Description of Artificial Sequence: Synthetic oligonucleotide
  Target: SCN9A; (+) strand; PAM type: YTN; PAM sequence: TTA
cttgtaaaccttcatttctt

SEQ ID NO: 99734 - DNA, 20 bp, Artificial Sequence
  Description of Artificial Sequence: Synthetic oligonucleotide
  Target: SCN9A; (+) strand; PAM type: YTN; PAM sequence: CTT
gtaaaccttcatttcttaca

SEQ ID NO: 99735 - DNA, 20 bp, Artificial Sequence
  Description of Artificial Sequence: Synthetic oligonucleotide
  Target: SCN9A; (+) strand; PAM type: YTN; PAM sequence: TTG
taaaccttcatttcttacac

SEQ ID NO: 99736 - DNA, 20 bp, Artificial Sequence
  Description of Artificial Sequence: Synthetic oligonucleotide
  Target: SCN9A; (+) strand; PAM type: YTN; PAM sequence: CTT
catttcttacactgaatgat

SEQ ID NO: 99737 - DNA, 20 bp, Artificial Sequence
  Description of Artificial Sequence: Synthetic oligonucleotide
  Target: SCN9A; (+) strand; PAM type: YTN; PAM sequence: TTC
atttcttacactgaatgatg

SEQ ID NO: 99738 - DNA, 20 bp, Artificial Sequence
  Description of Artificial Sequence: Synthetic oligonucleotide
  Target: SCN9A; (+) strand; PAM type: YTN; PAM sequence: TTT
cttacactgaatgatgaaaa

SEQ ID NO: 99739 - DNA, 20 bp, Artificial Sequence
  Description of Artificial Sequence: Synthetic oligonucleotide
  Target: SCN9A; (+) strand; PAM type: YTN; PAM sequence: TTC
ttacactgaatgatgaaaat

SEQ ID NO: 99740 - DNA, 20 bp, Artificial Sequence
  Description of Artificial Sequence: Synthetic oligonucleotide
  Target: SCN9A; (+) strand; PAM type: YTN; PAM sequence: CTT
acactgaatgatgaaaatga

SEQ ID NO: 99741 - DNA, 20 bp, Artificial Sequence
  Description of Artificial Sequence: Synthetic oligonucleotide
  Target: SCN9A; (+) strand; PAM type: YTN; PAM sequence: TTA
cactgaatgatgaaaatgag

SEQ ID NO: 99742 - DNA, 20 bp, Artificial Sequence
  Description of Artificial Sequence: Synthetic oligonucleotide
  Target: SCN9A; (+) strand; PAM type: YTN; PAM sequence: CTG
aatgatgaaaatgagtgtat

SEQ ID NO: 99743 - DNA, 20 bp, Artificial Sequence
  Description of Artificial Sequence: Synthetic oligonucleotide
  Target: SCN9A; (+) strand; PAM type: YTN; PAM sequence: TTT
gtgataatattttaaagatt

SEQ ID NO: 99744 - DNA, 20 bp, Artificial Sequence
  Description of Artificial Sequence: Synthetic oligonucleotide
  Target: SCN9A; (+) strand; PAM type: YTN; PAM sequence: TTG
tgataatattttaaagattt

SEQ ID NO: 99745 - DNA, 20 bp, Artificial Sequence
  Description of Artificial Sequence: Synthetic oligonucleotide
  Target: SCN9A; (+) strand; PAM type: YTN; PAM sequence: TTT
taaagattttaaaatatcta

SEQ ID NO: 99746 - DNA, 20 bp, Artificial Sequence
  Description of Artificial Sequence: Synthetic oligonucleotide
  Target: SCN9A; (+) strand; PAM type: YTN; PAM sequence: TTT
aaagattttaaaatatctaa

SEQ ID NO: 99747 - DNA, 20 bp, Artificial Sequence
  Description of Artificial Sequence: Synthetic oligonucleotide
  Target: SCN9A; (+) strand; PAM type: YTN; PAM sequence: TTA
aagattttaaaatatctaaa

SEQ ID NO: 99748 - DNA, 20 bp, Artificial Sequence
  Description of Artificial Sequence: Synthetic oligonucleotide
  Target: SCN9A; (+) strand; PAM type: YTN; PAM sequence: TTT
taaaatatctaaaatattgt

SEQ ID NO: 99749 - DNA, 20 bp, Artificial Sequence
  Description of Artificial Sequence: Synthetic oligonucleotide
  Target: SCN9A; (+) strand; PAM type: YTN; PAM sequence: TTT
aaaatatctaaaatattgta

SEQ ID NO: 99750 - DNA, 20 bp, Artificial Sequence
  Description of Artificial Sequence: Synthetic oligonucleotide
  Target: SCN9A; (+) strand; PAM type: YTN; PAM sequence: TTA
aaatatctaaaatattgtat

SEQ ID NO: 99751 - DNA, 20 bp, Artificial Sequence
  Description of Artificial Sequence: Synthetic oligonucleotide
  Target: SCN9A; (+) strand; PAM type: YTN; PAM sequence: CTA
aaatattgtataatttttta

SEQ ID NO: 99752 - DNA, 20 bp, Artificial Sequence
  Description of Artificial Sequence: Synthetic oligonucleotide
  Target: SCN9A; (+) strand; PAM type: YTN; PAM sequence: TTG
tataattttttaagagagag

SEQ ID NO: 99753 - DNA, 20 bp, Artificial Sequence
  Description of Artificial Sequence: Synthetic oligonucleotide
  Target: SCN9A; (+) strand; PAM type: YTN; PAM sequence: TTT
tttaagagagagaccccgtc

SEQ ID NO: 99754 - DNA, 20 bp, Artificial Sequence
  Description of Artificial Sequence: Synthetic oligonucleotide
  Target: SCN9A; (+) strand; PAM type: YTN; PAM sequence: TTT
ttaagagagagaccccgtca

SEQ ID NO: 99755 - DNA, 20 bp, Artificial Sequence
  Description of Artificial Sequence: Synthetic oligonucleotide
  Target: SCN9A; (+) strand; PAM type: YTN; PAM sequence: TTT
taagagagagaccccgtcat

SEQ ID NO: 99756 - DNA, 20 bp, Artificial Sequence
  Description of Artificial Sequence: Synthetic oligonucleotide
  Target: SCN9A; (+) strand; PAM type: YTN; PAM sequence: TTT
aagagagagaccccgtcata

SEQ ID NO: 99757 - DNA, 20 bp, Artificial Sequence
  Description of Artificial Sequence: Synthetic oligonucleotide
  Target: SCN9A; (+) strand; PAM type: YTN; PAM sequence: TTA
agagagagaccccgtcatat

SEQ ID NO: 99758 - DNA, 20 bp, Artificial Sequence
  Description of Artificial Sequence: Synthetic oligonucleotide
  Target: SCN9A; (+) strand; PAM type: YTN; PAM sequence: TTT
acagtttaagagaaaagaaa

SEQ ID NO: 99759 - DNA, 20 bp, Artificial Sequence
  Description of Artificial Sequence: Synthetic oligonucleotide
  Target: SCN9A; (+) strand; PAM type: YTN; PAM sequence: TTA
cagtttaagagaaaagaaaa

SEQ ID NO: 99760 - DNA, 20 bp, Artificial Sequence
  Description of Artificial Sequence: Synthetic oligonucleotide
  Target: SCN9A; (+) strand; PAM type: YTN; PAM sequence: TTT
aagagaaaagaaaatctaca

SEQ ID NO: 99761 - DNA, 20 bp, Artificial Sequence
  Description of Artificial Sequence: Synthetic oligonucleotide
  Target: SCN9A; (+) strand; PAM type: YTN; PAM sequence: TTA
agagaaaagaaaatctacat

SEQ ID NO: 99762 - DNA, 20 bp, Artificial Sequence
  Description of Artificial Sequence: Synthetic oligonucleotide
  Target: SCN9A; (+) strand; PAM type: YTN; PAM sequence: CTA
cattccttctataatttctt

SEQ ID NO: 99763 - DNA, 20 bp, Artificial Sequence
  Description of Artificial Sequence: Synthetic oligonucleotide
  Target: SCN9A; (+) strand; PAM type: YTN; PAM sequence: TTC
cttctataatttcttcttat

SEQ ID NO: 99764 - DNA, 20 bp, Artificial Sequence
  Description of Artificial Sequence: Synthetic oligonucleotide
  Target: SCN9A; (+) strand; PAM type: YTN; PAM sequence: CTT
ctataatttcttcttatttg

SEQ ID NO: 99765 - DNA, 20 bp, Artificial Sequence
  Description of Artificial Sequence: Synthetic oligonucleotide
  Target: SCN9A; (+) strand; PAM type: YTN; PAM sequence: TTC
tataatttcttcttatttgg

SEQ ID NO: 99766 - DNA, 20 bp, Artificial Sequence
  Description of Artificial Sequence: Synthetic oligonucleotide
  Target: SCN9A; (+) strand; PAM type: YTN; PAM sequence: CTA
taatttcttcttatttgggg

SEQ ID NO: 99767 - DNA, 20 bp, Artificial Sequence
  Description of Artificial Sequence: Synthetic oligonucleotide
  Target: SCN9A; (+) strand; PAM type: YTN; PAM sequence: TTT
cttcttatttggggcagcct

SEQ ID NO: 99768 - DNA, 20 bp, Artificial Sequence
  Description of Artificial Sequence: Synthetic oligonucleotide
  Target: SCN9A; (+) strand; PAM type: YTN; PAM sequence: TTC
ttcttatttggggcagcctt

SEQ ID NO: 99769 - DNA, 20 bp, Artificial Sequence
  Description of Artificial Sequence: Synthetic oligonucleotide
  Target: SCN9A; (+) strand; PAM type: YTN; PAM sequence: CTT
cttatttggggcagcctttc

SEQ ID NO: 99770 - DNA, 20 bp, Artificial Sequence
  Description of Artificial Sequence: Synthetic oligonucleotide
  Target: SCN9A; (+) strand; PAM type: YTN; PAM sequence: TTC
ttatttggggcagcctttct

SEQ ID NO: 99771 - DNA, 20 bp, Artificial Sequence
  Description of Artificial Sequence: Synthetic oligonucleotide
  Target: SCN9A; (+) strand; PAM type: YTN; PAM sequence: CTT
atttggggcagcctttcttc

SEQ ID NO: 99772 - DNA, 20 bp, Artificial Sequence
  Description of Artificial Sequence: Synthetic oligonucleotide
  Target: SCN9A; (+) strand; PAM type: YTN; PAM sequence: TTA
tttggggcagcctttcttca

SEQ ID NO: 99773 - DNA, 20 bp, Artificial Sequence
  Description of Artificial Sequence: Synthetic oligonucleotide
  Target: SCN9A; (+) strand; PAM type: YTN; PAM sequence: TTT
ggggcagcctttcttcaaaa

SEQ ID NO: 99774 - DNA, 20 bp, Artificial Sequence
  Description of Artificial Sequence: Synthetic oligonucleotide
  Target: SCN9A; (+) strand; PAM type: YTN; PAM sequence: TTG
gggcagcctttcttcaaaac

SEQ ID NO: 99775 - DNA, 20 bp, Artificial Sequence
  Description of Artificial Sequence: Synthetic oligonucleotide
  Target: SCN9A; (+) strand; PAM type: YTN; PAM sequence: CTT
tcttcaaaactactatatta

SEQ ID NO: 99776 - DNA, 20 bp, Artificial Sequence
  Description of Artificial Sequence: Synthetic oligonucleotide
  Target: SCN9A; (+) strand; PAM type: YTN; PAM sequence: TTT
cttcaaaactactatattac

SEQ ID NO: 99777 - DNA, 20 bp, Artificial Sequence
  Description of Artificial Sequence: Synthetic oligonucleotide
  Target: SCN9A; (+) strand; PAM type: YTN; PAM sequence: TTC
ttcaaaactactatattaca

SEQ ID NO: 99778 - DNA, 20 bp, Artificial Sequence
  Description of Artificial Sequence: Synthetic oligonucleotide
  Target: SCN9A; (+) strand; PAM type: YTN; PAM sequence: CTT
caaaactactatattacaaa

SEQ ID NO: 99779 - DNA, 20 bp, Artificial Sequence
  Description of Artificial Sequence: Synthetic oligonucleotide
  Target: SCN9A; (+) strand; PAM type: YTN; PAM sequence: TTC
aaaactactatattacaaaa

SEQ ID NO: 99780 - DNA, 20 bp, Artificial Sequence
  Description of Artificial Sequence: Synthetic oligonucleotide
  Target: SCN9A; (+) strand; PAM type: YTN; PAM sequence: CTA
ctatattacaaaaataccca

SEQ ID NO: 99781 - DNA, 20 bp, Artificial Sequence
  Description of Artificial Sequence: Synthetic oligonucleotide
  Target: SCN9A; (+) strand; PAM type: YTN; PAM sequence: CTA
tattacaaaaatacccattt

SEQ ID NO: 99782 - DNA, 20 bp, Artificial Sequence
  Description of Artificial Sequence: Synthetic oligonucleotide
  Target: SCN9A; (+) strand; PAM type: YTN; PAM sequence: TTA
caaaaatacccattttatca

SEQ ID NO: 99783 - DNA, 20 bp, Artificial Sequence
  Description of Artificial Sequence: Synthetic oligonucleotide
  Target: SCN9A; (+) strand; PAM type: YTN; PAM sequence: TTT
tatcatttttcattttttag

SEQ ID NO: 99784 - DNA, 20 bp, Artificial Sequence
  Description of Artificial Sequence: Synthetic oligonucleotide
  Target: SCN9A; (+) strand; PAM type: YTN; PAM sequence: TTT
atcatttttcattttttagg

SEQ ID NO: 99785 - DNA, 20 bp, Artificial Sequence
  Description of Artificial Sequence: Synthetic oligonucleotide
  Target: SCN9A; (+) strand; PAM type: YTN; PAM sequence: TTA
tcatttttcattttttaggc

SEQ ID NO: 99786 - DNA, 20 bp, Artificial Sequence
  Description of Artificial Sequence: Synthetic oligonucleotide
  Target: SCN9A; (+) strand; PAM type: YTN; PAM sequence: TTT
ttcattttttaggcagtaac

SEQ ID NO: 99787 - DNA, 20 bp, Artificial Sequence
  Description of Artificial Sequence: Synthetic oligonucleotide
  Target: SCN9A; (+) strand; PAM type: YTN; PAM sequence: TTT
tcattttttaggcagtaact

SEQ ID NO: 99788 - DNA, 20 bp, Artificial Sequence
  Description of Artificial Sequence: Synthetic oligonucleotide
  Target: SCN9A; (+) strand; PAM type: YTN; PAM sequence: TTT
cattttttaggcagtaacta

SEQ ID NO: 99789 - DNA, 20 bp, Artificial Sequence
  Description of Artificial Sequence: Synthetic oligonucleotide
  Target: SCN9A; (+) strand; PAM type: YTN; PAM sequence: TTC
attttttaggcagtaactag

SEQ ID NO: 99790 - DNA, 20 bp, Artificial Sequence
  Description of Artificial Sequence: Synthetic oligonucleotide
  Target: SCN9A; (+) strand; PAM type: YTN; PAM sequence: TTT
tttaggcagtaactagataa

SEQ ID NO: 99791 - DNA, 20 bp, Artificial Sequence
  Description of Artificial Sequence: Synthetic oligonucleotide
  Target: SCN9A; (+) strand; PAM type: YTN; PAM sequence: TTT
ttaggcagtaactagataac

SEQ ID NO: 99792 - DNA, 20 bp, Artificial Sequence
  Description of Artificial Sequence: Synthetic oligonucleotide
  Target: SCN9A; (+) strand; PAM type: YTN; PAM sequence: TTT
taggcagtaactagataact

SEQ ID NO: 99793 - DNA, 20 bp, Artificial Sequence
  Description of Artificial Sequence: Synthetic oligonucleotide
  Target: SCN9A; (+) strand; PAM type: YTN; PAM sequence: TTT
aggcagtaactagataactt

SEQ ID NO: 99794 - DNA, 20 bp, Artificial Sequence
  Description of Artificial Sequence: Synthetic oligonucleotide
  Target: SCN9A; (+) strand; PAM type: YTN; PAM sequence: TTA
ggcagtaactagataacttg

SEQ ID NO: 99795 - DNA, 20 bp, Artificial Sequence
  Description of Artificial Sequence: Synthetic oligonucleotide
  Target: SCN9A; (+) strand; PAM type: YTN; PAM sequence: CTA
gataacttgatatatgaatg

SEQ ID NO: 99796 - DNA, 20 bp, Artificial Sequence
  Description of Artificial Sequence: Synthetic oligonucleotide
  Target: SCN9A; (+) strand; PAM type: YTN; PAM sequence: CTT
gatatatgaatgattaattg

SEQ ID NO: 99797 - DNA, 20 bp, Artificial Sequence
  Description of Artificial Sequence: Synthetic oligonucleotide
  Target: SCN9A; (+) strand; PAM type: YTN; PAM sequence: TTG
atatatgaatgattaattga

SEQ ID NO: 99798 - DNA, 20 bp, Artificial Sequence
  Description of Artificial Sequence: Synthetic oligonucleotide
  Target: SCN9A; (+) strand; PAM type: YTN; PAM sequence: TTA
attgaaaaatagcaagaaat

SEQ ID NO: 99799 - DNA, 20 bp, Artificial Sequence
  Description of Artificial Sequence: Synthetic oligonucleotide
  Target: SCN9A; (+) strand; PAM type: YTN; PAM sequence: TTG
aaaaatagcaagaaatcatt

SEQ ID NO: 99800 - DNA, 20 bp, Artificial Sequence
  Description of Artificial Sequence: Synthetic oligonucleotide
  Target: SCN9A; (+) strand; PAM type: YTN; PAM sequence: TTA
ctatatccgaagttagaatt

SEQ ID NO: 99801 - DNA, 20 bp, Artificial Sequence
  Description of Artificial Sequence: Synthetic oligonucleotide
  Target: SCN9A; (+) strand; PAM type: YTN; PAM sequence: CTA
tatccgaagttagaattctc

SEQ ID NO: 99802 - DNA, 20 bp, Artificial Sequence
  Description of Artificial Sequence: Synthetic oligonucleotide
  Target: SCN9A; (+) strand; PAM type: YTN; PAM sequence: TTA
gaattctcatagaggaaacc

SEQ ID NO: 99803 - DNA, 20 bp, Artificial Sequence
  Description of Artificial Sequence: Synthetic oligonucleotide
  Target: SCN9A; (+) strand; PAM type: YTN; PAM sequence: TTC
tcatagaggaaacctaagat

SEQ ID NO: 99804 - DNA, 20 bp, Artificial Sequence
  Description of Artificial Sequence: Synthetic oligonucleotide
  Target: SCN9A; (+) strand; PAM type: YTN; PAM sequence: CTC
atagaggaaacctaagataa

SEQ ID NO: 99805 - DNA, 20 bp, Artificial Sequence
  Description of Artificial Sequence: Synthetic oligonucleotide
  Target: SCN9A; (+) strand; PAM type: YTN; PAM sequence: CTA
agataacacatataaggtgt

SEQ ID NO: 99806 - DNA, 20 bp, Artificial Sequence
  Description of Artificial Sequence: Synthetic oligonucleotide
  Target: SCN9A; (+) strand; PAM type: YTN; PAM sequence: CTA
tgttaaaaattttttcacat

SEQ ID NO: 99807 - DNA, 20 bp, Artificial Sequence
  Description of Artificial Sequence: Synthetic oligonucleotide
  Target: SCN9A; (+) strand; PAM type: YTN; PAM sequence: TTA
aaaattttttcacattacat

SEQ ID NO: 99808 - DNA, 20 bp, Artificial Sequence
  Description of Artificial Sequence: Synthetic oligonucleotide
  Target: SCN9A; (+) strand; PAM type: YTN; PAM sequence: TTT
tttcacattacatattatag

SEQ ID NO: 99809 - DNA, 20 bp, Artificial Sequence
  Description of Artificial Sequence: Synthetic oligonucleotide
  Target: SCN9A; (+) strand; PAM type: YTN; PAM sequence: TTT
ttcacattacatattataga

SEQ ID NO: 99810 - DNA, 20 bp, Artificial Sequence
  Description of Artificial Sequence: Synthetic oligonucleotide
  Target: SCN9A; (+) strand; PAM type: YTN; PAM sequence: TTT
tcacattacatattatagaa

SEQ ID NO: 99811 - DNA, 20 bp, Artificial Sequence
  Description of Artificial Sequence: Synthetic oligonucleotide
  Target: SCN9A; (+) strand; PAM type: YTN; PAM sequence: TTT
cacattacatattatagaaa

SEQ ID NO: 99812 - DNA, 20 bp, Artificial Sequence
  Description of Artificial Sequence: Synthetic oligonucleotide
  Target: SCN9A; (+) strand; PAM type: YTN; PAM sequence: TTC
acattacatattatagaaaa

SEQ ID NO: 99813 - DNA, 20 bp, Artificial Sequence
  Description of Artificial Sequence: Synthetic oligonucleotide
  Target: SCN9A; (+) strand; PAM type: YTN; PAM sequence: TTA
catattatagaaaaaagtta

SEQ ID NO: 99814 - DNA, 20 bp, Artificial Sequence
  Description of Artificial Sequence: Synthetic oligonucleotide
  Target: SCN9A; (+) strand; PAM type: YTN; PAM sequence: TTA
tagaaaaaagttattgtttt

SEQ ID NO: 99815 - DNA, 20 bp, Artificial Sequence
  Description of Artificial Sequence: Synthetic oligonucleotide
  Target: SCN9A; (+) strand; PAM type: YTN; PAM sequence: TTA
ttgtttttaacatttaatat

SEQ ID NO: 99816 - DNA, 20 bp, Artificial Sequence
  Description of Artificial Sequence: Synthetic oligonucleotide
  Target: SCN9A; (+) strand; PAM type: YTN; PAM sequence: TTG
tttttaacatttaatatgtt

SEQ ID NO: 99817 - DNA, 20 bp, Artificial Sequence
  Description of Artificial Sequence: Synthetic oligonucleotide
  Target: SCN9A; (+) strand; PAM type: YTN; PAM sequence: TTT
ttaacatttaatatgttgtg

SEQ ID NO: 99818 - DNA, 20 bp, Artificial Sequence
  Description of Artificial Sequence: Synthetic oligonucleotide
  Target: SCN9A; (+) strand; PAM type: YTN; PAM sequence: TTT
taacatttaatatgttgtgt

SEQ ID NO: 99819 - DNA, 20 bp, Artificial Sequence
  Description of Artificial Sequence: Synthetic oligonucleotide
  Target: SCN9A; (+) strand; PAM type: YTN; PAM sequence: TTT
aacatttaatatgttgtgtg

SEQ ID NO: 99820 - DNA, 20 bp, Artificial Sequence
  Description of Artificial Sequence: Synthetic oligonucleotide
  Target: SCN9A; (+) strand; PAM type: YTN; PAM sequence: TTA
acatttaatatgttgtgtga

SEQ ID NO: 99821 - DNA, 20 bp, Artificial Sequence
  Description of Artificial Sequence: Synthetic oligonucleotide
  Target: SCN9A; (+) strand; PAM type: YTN; PAM sequence: TTT
aatatgttgtgtgattaaga

SEQ ID NO: 99822 - DNA, 20 bp, Artificial Sequence
  Description of Artificial Sequence: Synthetic oligonucleotide
  Target: SCN9A; (+) strand; PAM type: YTN; PAM sequence: TTA
atatgttgtgtgattaagaa

SEQ ID NO: 99823 - DNA, 20 bp, Artificial Sequence
  Description of Artificial Sequence: Synthetic oligonucleotide
  Target: SCN9A; (+) strand; PAM type: YTN; PAM sequence: TTG
tgtgattaagaaaacgaaaa

SEQ ID NO: 99824 - DNA, 20 bp, Artificial Sequence
  Description of Artificial Sequence: Synthetic oligonucleotide
  Target: SCN9A; (+) strand; PAM type: YTN; PAM sequence: TTA
agaaaacgaaaattattatt

SEQ ID NO: 99825 - DNA, 20 bp, Artificial Sequence
  Description of Artificial Sequence: Synthetic oligonucleotide
  Target: SCN9A; (+) strand; PAM type: YTN; PAM sequence: TTA
ttattattttttttgagatg

SEQ ID NO: 99826 - DNA, 20 bp, Artificial Sequence
  Description of Artificial Sequence: Synthetic oligonucleotide
  Target: SCN9A; (+) strand; PAM type: YTN; PAM sequence: TTA
ttattttttttgagatggag

SEQ ID NO: 99827 - DNA, 20 bp, Artificial Sequence
  Description of Artificial Sequence: Synthetic oligonucleotide
  Target: SCN9A; (+) strand; PAM type: YTN; PAM sequence: TTA
ttttttttgagatggagtct

SEQ ID NO: 99828 - DNA, 20 bp, Artificial Sequence
  Description of Artificial Sequence: Synthetic oligonucleotide
  Target: SCN9A; (+) strand; PAM type: YTN; PAM sequence: TTT
tttttgagatggagtctcac

SEQ ID NO: 99829 - DNA, 20 bp, Artificial Sequence
  Description of Artificial Sequence: Synthetic oligonucleotide
  Target: SCN9A; (+) strand; PAM type: YTN; PAM sequence: TTT
ttttgagatggagtctcacc

SEQ ID NO: 99830 - DNA, 20 bp, Artificial Sequence
  Description of Artificial Sequence: Synthetic oligonucleotide
  Target: SCN9A; (+) strand; PAM type: YTN; PAM sequence: TTT
tttgagatggagtctcaccc

SEQ ID NO: 99831 - DNA, 20 bp, Artificial Sequence
  Description of Artificial Sequence: Synthetic oligonucleotide
  Target: SCN9A; (+) strand; PAM type: YTN; PAM sequence: TTT
ttgagatggagtctcaccct

SEQ ID NO: 99832 - DNA, 20 bp, Artificial Sequence
  Description of Artificial Sequence: Synthetic oligonucleotide
  Target: SCN9A; (+) strand; PAM type: YTN; PAM sequence: TTT
tgagatggagtctcaccctg

SEQ ID NO: 99833 - DNA, 20 bp, Artificial Sequence
  Description of Artificial Sequence: Synthetic oligonucleotide
  Target: SCN9A; (+) strand; PAM type: YTN; PAM sequence: TTT
gagatggagtctcaccctgt

SEQ ID NO: 99834 - DNA, 20 bp, Artificial Sequence
  Description of Artificial Sequence: Synthetic oligonucleotide
  Target: SCN9A; (+) strand; PAM type: YTN; PAM sequence: TTG
agatggagtctcaccctgtc

SEQ ID NO: 99835 - DNA, 20 bp, Artificial Sequence
  Description of Artificial Sequence: Synthetic oligonucleotide
  Target: SCN9A; (+) strand; PAM type: YTN; PAM sequence: CTC
accctgtcgcccaagctgga

SEQ ID NO: 99836 - DNA, 20 bp, Artificial Sequence
  Description of Artificial Sequence: Synthetic oligonucleotide
  Target: SCN9A; (+) strand; PAM type: YTN; PAM sequence: CTG
tcgcccaagctggagtgcag

SEQ ID NO: 99837 - DNA, 20 bp, Artificial Sequence
  Description of Artificial Sequence: Synthetic oligonucleotide
  Target: SCN9A; (+) strand; PAM type: YTN; PAM sequence: CTG
gagtgcagtggcacgatctc

SEQ ID NO: 99838 - DNA, 20 bp, Artificial Sequence
  Description of Artificial Sequence: Synthetic oligonucleotide
  Target: SCN9A; (+) strand; PAM type: YTN; PAM sequence: CTC
gactcactgaaacctctgcc

SEQ ID NO: 99839 - DNA, 20 bp, Artificial Sequence
  Description of Artificial Sequence: Synthetic oligonucleotide
  Target: SCN9A; (+) strand; PAM type: YTN; PAM sequence: CTC
actgaaacctctgcctaccg

SEQ ID NO: 99840 - DNA, 20 bp, Artificial Sequence
  Description of Artificial Sequence: Synthetic oligonucleotide
  Target: SCN9A; (+) strand; PAM type: YTN; PAM sequence: CTG
aaacctctgcctaccgggtt

SEQ ID NO: 99841 - DNA, 20 bp, Artificial Sequence
  Description of Artificial Sequence: Synthetic oligonucleotide
  Target: SCN9A; (+) strand; PAM type: YTN; PAM sequence: CTC
tgcctaccgggttcaagcga

SEQ ID NO: 99842 - DNA, 20 bp, Artificial Sequence
  Description of Artificial Sequence: Synthetic oligonucleotide
  Target: SCN9A; (+) strand; PAM type: YTN; PAM sequence: CTG
cctaccgggttcaagcgatt

SEQ ID NO: 99843 - DNA, 20 bp, Artificial Sequence
  Description of Artificial Sequence: Synthetic oligonucleotide
  Target: SCN9A; (+) strand; PAM type: YTN; PAM sequence: CTA
ccgggttcaagcgattcttc

SEQ ID NO: 99844 - DNA, 20 bp, Artificial Sequence
  Description of Artificial Sequence: Synthetic oligonucleotide
  Target: SCN9A; (+) strand; PAM type: YTN; PAM sequence: TTC
aagcgattcttctgcctcag

SEQ ID NO: 99845 - DNA, 20 bp, Artificial Sequence
  Description of Artificial Sequence: Synthetic oligonucleotide
  Target: SCN9A; (+) strand; PAM type: YTN; PAM sequence: TTC
ttctgcctcagcctcctgag

SEQ ID NO: 99846 - DNA, 20 bp, Artificial Sequence
  Description of Artificial Sequence: Synthetic oligonucleotide
  Target: SCN9A; (+) strand; PAM type: YTN; PAM sequence: CTT
ctgcctcagcctcctgagta

SEQ ID NO: 99847 - DNA, 20 bp, Artificial Sequence
  Description of Artificial Sequence: Synthetic oligonucleotide
  Target: SCN9A; (+) strand; PAM type: YTN; PAM sequence: TTC
tgcctcagcctcctgagtag

SEQ ID NO: 99848 - DNA, 20 bp, Artificial Sequence
  Description of Artificial Sequence: Synthetic oligonucleotide
  Target: SCN9A; (+) strand; PAM type: YTN; PAM sequence: CTG
cctcagcctcctgagtagct

SEQ ID NO: 99849 - DNA, 20 bp, Artificial Sequence
  Description of Artificial Sequence: Synthetic oligonucleotide
  Target: SCN9A; (+) strand; PAM type: YTN; PAM sequence: CTC
agcctcctgagtagctggga

SEQ ID NO: 99850 - DNA, 20 bp, Artificial Sequence
  Description of Artificial Sequence: Synthetic oligonucleotide
  Target: SCN9A; (+) strand; PAM type: YTN; PAM sequence: CTC
ctgagtagctgggattacag

SEQ ID NO: 99851 - DNA, 20 bp, Artificial Sequence
  Description of Artificial Sequence: Synthetic oligonucleotide
  Target: SCN9A; (+) strand; PAM type: YTN; PAM sequence: CTG
agtagctgggattacaggca

SEQ ID NO: 99852 - DNA, 20 bp, Artificial Sequence
  Description of Artificial Sequence: Synthetic oligonucleotide
  Target: SCN9A; (+) strand; PAM type: YTN; PAM sequence: CTG
ggattacaggcacctgccac

SEQ ID NO: 99853 - DNA, 20 bp, Artificial Sequence
  Description of Artificial Sequence: Synthetic oligonucleotide
  Target: SCN9A; (+) strand; PAM type: YTN; PAM sequence: TTA
caggcacctgccaccatgtc

SEQ ID NO: 99854 - DNA, 20 bp, Artificial Sequence
  Description of Artificial Sequence: Synthetic oligonucleotide
  Target: SCN9A; (+) strand; PAM type: YTN; PAM sequence: CTG
ccaccatgtctggctaattt

SEQ ID NO: 99855 - DNA, 20 bp, Artificial Sequence
  Description of Artificial Sequence: Synthetic oligonucleotide
  Target: SCN9A; (+) strand; PAM type: YTN; PAM sequence: CTG
gctaattttttgtatttttt

SEQ ID NO: 99856 - DNA, 20 bp, Artificial Sequence
  Description of Artificial Sequence: Synthetic oligonucleotide
  Target: SCN9A; (+) strand; PAM type: YTN; PAM sequence: CTA
attttttgtattttttagta

SEQ ID NO: 99857 - DNA, 20 bp, Artificial Sequence
  Description of Artificial Sequence: Synthetic oligonucleotide
  Target: SCN9A; (+) strand; PAM type: YTN; PAM sequence: TTT
tttgtattttttagtagaga

SEQ ID NO: 99858 - DNA, 20 bp, Artificial Sequence
  Description of Artificial Sequence: Synthetic oligonucleotide
  Target: SCN9A; (+) strand; PAM type: YTN; PAM sequence: TTT
ttgtattttttagtagagac

SEQ ID NO: 99859 - DNA, 20 bp, Artificial Sequence
  Description of Artificial Sequence: Synthetic oligonucleotide
  Target: SCN9A; (+) strand; PAM type: YTN; PAM sequence: TTT
tgtattttttagtagagacg

SEQ ID NO: 99860 - DNA, 20 bp, Artificial Sequence
  Description of Artificial Sequence: Synthetic oligonucleotide
  Target: SCN9A; (+) strand; PAM type: YTN; PAM sequence: TTT
gtattttttagtagagacgg

SEQ ID NO: 99861 - DNA, 20 bp, Artificial Sequence
  Description of Artificial Sequence: Synthetic oligonucleotide
  Target: SCN9A; (+) strand; PAM type: YTN; PAM sequence: TTG
tattttttagtagagacggg

SEQ ID NO: 99862 - DNA, 20 bp, Artificial Sequence
  Description of Artificial Sequence: Synthetic oligonucleotide
  Target: SCN9A; (+) strand; PAM type: YTN; PAM sequence: TTT
tttagtagagacggggtttc

SEQ ID NO: 99863 - DNA, 20 bp, Artificial Sequence
  Description of Artificial Sequence: Synthetic oligonucleotide
  Target: SCN9A; (+) strand; PAM type: YTN; PAM sequence: TTT
ttagtagagacggggtttca

SEQ ID NO: 99864 - DNA, 20 bp, Artificial Sequence
  Description of Artificial Sequence: Synthetic oligonucleotide
  Target: SCN9A; (+) strand; PAM type: YTN; PAM sequence: TTT
tagtagagacggggtttcac

SEQ ID NO: 99865 - DNA, 20 bp, Artificial Sequence
  Description of Artificial Sequence: Synthetic oligonucleotide
  Target: SCN9A; (+) strand; PAM type: YTN; PAM sequence: TTT
agtagagacggggtttcacc

SEQ ID NO: 99866 - DNA, 20 bp, Artificial Sequence
  Description of Artificial Sequence: Synthetic oligonucleotide
  Target: SCN9A; (+) strand; PAM type: YTN; PAM sequence: TTA
gtagagacggggtttcacca

SEQ ID NO: 99867 - DNA, 20 bp, Artificial Sequence
  Description of Artificial Sequence: Synthetic oligonucleotide
  Target: SCN9A; (+) strand; PAM type: YTN; PAM sequence: TTT
caccatgttggccaggctgg

SEQ ID NO: 99868 - DNA, 20 bp, Artificial Sequence
  Description of Artificial Sequence: Synthetic oligonucleotide
  Target: SCN9A; (+) strand; PAM type: YTN; PAM sequence: TTC
accatgttggccaggctggt

SEQ ID NO: 99869 - DNA, 20 bp, Artificial Sequence
  Description of Artificial Sequence: Synthetic oligonucleotide
  Target: SCN9A; (+) strand; PAM type: YTN; PAM sequence: TTG
gccaggctggtctcaaactc

SEQ ID NO: 99870 - DNA, 20 bp, Artificial Sequence
  Description of Artificial Sequence: Synthetic oligonucleotide
  Target: SCN9A; (+) strand; PAM type: YTN; PAM sequence: CTG
gtctcaaactcctgacctca

SEQ ID NO: 99871 - DNA, 20 bp, Artificial Sequence
  Description of Artificial Sequence: Synthetic oligonucleotide
  Target: SCN9A; (+) strand; PAM type: YTN; PAM sequence: CTC
aaactcctgacctcaggtga

SEQ ID NO: 99872 - DNA, 20 bp, Artificial Sequence
  Description of Artificial Sequence: Synthetic oligonucleotide
  Target: SCN9A; (+) strand; PAM type: YTN; PAM sequence: CTC
ctgacctcaggtgatccacc

SEQ ID NO: 99873 - DNA, 20 bp, Artificial Sequence
  Description of Artificial Sequence: Synthetic oligonucleotide
  Target: SCN9A; (+) strand; PAM type: YTN; PAM sequence: CTG
acctcaggtgatccacctgc

SEQ ID NO: 99874 - DNA, 20 bp, Artificial Sequence
  Description of Artificial Sequence: Synthetic oligonucleotide
  Target: SCN9A; (+) strand; PAM type: YTN; PAM sequence: CTC
aggtgatccacctgcctcgg

SEQ ID NO: 99875 - DNA, 20 bp, Artificial Sequence
  Description of Artificial Sequence: Synthetic oligonucleotide
  Target: SCN9A; (+) strand; PAM type: YTN; PAM sequence: CTG
cctcggactctcaaagtgct

SEQ ID NO: 99876 - DNA, 20 bp, Artificial Sequence
  Description of Artificial Sequence: Synthetic oligonucleotide
  Target: SCN9A; (+) strand; PAM type: YTN; PAM sequence: CTC
ggactctcaaagtgctggga

SEQ ID NO: 99877 - DNA, 20 bp, Artificial Sequence
  Description of Artificial Sequence: Synthetic oligonucleotide
  Target: SCN9A; (+) strand; PAM type: YTN; PAM sequence: CTC
tcaaagtgctgggattacag

SEQ ID NO: 99878 - DNA, 20 bp, Artificial Sequence
  Description of Artificial Sequence: Synthetic oligonucleotide
  Target: SCN9A; (+) strand; PAM type: YTN; PAM sequence: CTC
aaagtgctgggattacaggc

SEQ ID NO: 99879 - DNA, 20 bp, Artificial Sequence
  Description of Artificial Sequence: Synthetic oligonucleotide
  Target: SCN9A; (+) strand; PAM type: YTN; PAM sequence: CTG
ggattacaggcgtgagctac

SEQ ID NO: 99880 - DNA, 20 bp, Artificial Sequence
  Description of Artificial Sequence: Synthetic oligonucleotide
  Target: SCN9A; (+) strand; PAM type: YTN; PAM sequence: TTA
caggcgtgagctaccgcgcc

SEQ ID NO: 99881 - DNA, 20 bp, Artificial Sequence
  Description of Artificial Sequence: Synthetic oligonucleotide
  Target: SCN9A; (+) strand; PAM type: YTN; PAM sequence: CTA
ccgcgcctggccagaagcca

SEQ ID NO: 99882 - DNA, 20 bp, Artificial Sequence
  Description of Artificial Sequence: Synthetic oligonucleotide
  Target: SCN9A; (+) strand; PAM type: YTN; PAM sequence: CTG
gccagaagccaaaagtttat

SEQ ID NO: 99883 - DNA, 20 bp, Artificial Sequence
  Description of Artificial Sequence: Synthetic oligonucleotide
  Target: SCN9A; (+) strand; PAM type: YTN; PAM sequence: TTT
atgaagctttgaataacagt

SEQ ID NO: 99884 - DNA, 20 bp, Artificial Sequence
  Description of Artificial Sequence: Synthetic oligonucleotide
  Target: SCN9A; (+) strand; PAM type: YTN; PAM sequence: TTA
tgaagctttgaataacagtt

SEQ ID NO: 99885 - DNA, 20 bp, Artificial Sequence
  Description of Artificial Sequence: Synthetic oligonucleotide
  Target: SCN9A; (+) strand; PAM type: YTN; PAM sequence: CTT
tgaataacagttgagaaatt

SEQ ID NO: 99886 - DNA, 20 bp, Artificial Sequence
  Description of Artificial Sequence: Synthetic oligonucleotide
  Target: SCN9A; (+) strand; PAM type: YTN; PAM sequence: TTT
gaataacagttgagaaattg

SEQ ID NO: 99887 - DNA, 20 bp, Artificial Sequence
  Description of Artificial Sequence: Synthetic oligonucleotide
  Target: SCN9A; (+) strand; PAM type: YTN; PAM sequence: TTG
aataacagttgagaaattga

SEQ ID NO: 99888 - DNA, 20 bp, Artificial Sequence
  Description of Artificial Sequence: Synthetic oligonucleotide
  Target: SCN9A; (+) strand; PAM type: YTN; PAM sequence: TTG
agaaattgaacttttgagta

SEQ ID NO: 99889 - DNA, 20 bp, Artificial Sequence
  Description of Artificial Sequence: Synthetic oligonucleotide
  Target: SCN9A; (+) strand; PAM type: YTN; PAM sequence: TTG
aacttttgagtaaatatgac

SEQ ID NO: 99890 - DNA, 20 bp, Artificial Sequence
  Description of Artificial Sequence: Synthetic oligonucleotide
  Target: SCN9A; (+) strand; PAM type: YTN; PAM sequence: CTT
ttgagtaaatatgactaatt

SEQ ID NO: 99891 - DNA, 20 bp, Artificial Sequence
  Description of Artificial Sequence: Synthetic oligonucleotide
  Target: SCN9A; (+) strand; PAM type: YTN; PAM sequence: TTT
tgagtaaatatgactaattt

SEQ ID NO: 99892 - DNA, 20 bp, Artificial Sequence
  Description of Artificial Sequence: Synthetic oligonucleotide
  Target: SCN9A; (+) strand; PAM type: YTN; PAM sequence: TTT
gagtaaatatgactaatttg

SEQ ID NO: 99893 - DNA, 20 bp, Artificial Sequence
  Description of Artificial Sequence: Synthetic oligonucleotide
  Target: SCN9A; (+) strand; PAM type: YTN; PAM sequence: TTG
agtaaatatgactaatttgg

SEQ ID NO: 99894 - DNA, 20 bp, Artificial Sequence
  Description of Artificial Sequence: Synthetic oligonucleotide
  Target: SCN9A; (+) strand; PAM type: YTN; PAM sequence: CTA
atttggtaacattttgcagt

SEQ ID NO: 99895 - DNA, 20 bp, Artificial Sequence
  Description of Artificial Sequence: Synthetic oligonucleotide
  Target: SCN9A; (+) strand; PAM type: YTN; PAM sequence: TTT
ggtaacattttgcagtcaga

SEQ ID NO: 99896 - DNA, 20 bp, Artificial Sequence
  Description of Artificial Sequence: Synthetic oligonucleotide
  Target: SCN9A; (+) strand; PAM type: YTN; PAM sequence: TTG
gtaacattttgcagtcagat

SEQ ID NO: 99897 - DNA, 20 bp, Artificial Sequence
  Description of Artificial Sequence: Synthetic oligonucleotide
  Target: SCN9A; (+) strand; PAM type: YTN; PAM sequence: TTT
tgcagtcagattttactatg

SEQ ID NO: 99898 - DNA, 20 bp, Artificial Sequence
  Description of Artificial Sequence: Synthetic oligonucleotide
  Target: SCN9A; (+) strand; PAM type: YTN; PAM sequence: TTT
gcagtcagattttactatgt

SEQ ID NO: 99899 - DNA, 20 bp, Artificial Sequence
  Description of Artificial Sequence: Synthetic oligonucleotide
  Target: SCN9A; (+) strand; PAM type: YTN; PAM sequence: TTG
cagtcagattttactatgta

SEQ ID NO: 99900 - DNA, 20 bp, Artificial Sequence
  Description of Artificial Sequence: Synthetic oligonucleotide
  Target: SCN9A; (+) strand; PAM type: YTN; PAM sequence: TTT
tactatgtatgatcatgctt

SEQ ID NO: 99901 - DNA, 20 bp, Artificial Sequence
  Description of Artificial Sequence: Synthetic oligonucleotide
  Target: SCN9A; (+) strand; PAM type: YTN; PAM sequence: TTT
actatgtatgatcatgctta

SEQ ID NO: 99902 - DNA, 20 bp, Artificial Sequence
  Description of Artificial Sequence: Synthetic oligonucleotide
  Target: SCN9A; (+) strand; PAM type: YTN; PAM sequence: TTA
ctatgtatgatcatgcttac

SEQ ID NO: 99903 - DNA, 20 bp, Artificial Sequence
  Description of Artificial Sequence: Synthetic oligonucleotide
  Target: SCN9A; (+) strand; PAM type: YTN; PAM sequence: CTA
tgtatgatcatgcttacttg

SEQ ID NO: 99904 - DNA, 20 bp, Artificial Sequence
  Description of Artificial Sequence: Synthetic oligonucleotide
  Target: SCN9A; (+) strand; PAM type: YTN; PAM sequence: CTT
acttgtgattttctaatcca

SEQ ID NO: 99905 - DNA, 20 bp, Artificial Sequence
  Description of Artificial Sequence: Synthetic oligonucleotide
  Target: SCN9A; (+) strand; PAM type: YTN; PAM sequence: TTA
cttgtgattttctaatccac

SEQ ID NO: 99906 - DNA, 20 bp, Artificial Sequence
  Description of Artificial Sequence: Synthetic oligonucleotide
  Target: SCN9A; (+) strand; PAM type: YTN; PAM sequence: CTT
gtgattttctaatccacata

SEQ ID NO: 99907 - DNA, 20 bp, Artificial Sequence
  Description of Artificial Sequence: Synthetic oligonucleotide
  Target: SCN9A; (+) strand; PAM type: YTN; PAM sequence: TTG
tgattttctaatccacatat

SEQ ID NO: 99908 - DNA, 20 bp, Artificial Sequence
  Description of Artificial Sequence: Synthetic oligonucleotide
  Target: SCN9A; (+) strand; PAM type: YTN; PAM sequence: TTT
tctaatccacatatgatgct

SEQ ID NO: 99909 - DNA, 20 bp, Artificial Sequence
  Description of Artificial Sequence: Synthetic oligonucleotide
  Target: SCN9A; (+) strand; PAM type: YTN; PAM sequence: TTT
ctaatccacatatgatgctg

SEQ ID NO: 99910 - DNA, 20 bp, Artificial Sequence
  Description of Artificial Sequence: Synthetic oligonucleotide
  Target: SCN9A; (+) strand; PAM type: YTN; PAM sequence: TTC
taatccacatatgatgctgt

SEQ ID NO: 99911 - DNA, 20 bp, Artificial Sequence
  Description of Artificial Sequence: Synthetic oligonucleotide
  Target: SCN9A; (+) strand; PAM type: YTN; PAM sequence: CTA
atccacatatgatgctgtat

SEQ ID NO: 99912 - DNA, 20 bp, Artificial Sequence
  Description of Artificial Sequence: Synthetic oligonucleotide
  Target: SCN9A; (+) strand; PAM type: YTN; PAM sequence: CTG
tatgaattcaacttttctta

SEQ ID NO: 99913 - DNA, 20 bp, Artificial Sequence
  Description of Artificial Sequence: Synthetic oligonucleotide
  Target: SCN9A; (+) strand; PAM type: YTN; PAM sequence: TTC
aacttttcttaaaagctcga

SEQ ID NO: 99914 - DNA, 20 bp, Artificial Sequence
  Description of Artificial Sequence: Synthetic oligonucleotide
  Target: SCN9A; (+) strand; PAM type: YTN; PAM sequence: CTT
ttcttaaaagctcgataatg

SEQ ID NO: 99915 - DNA, 20 bp, Artificial Sequence
  Description of Artificial Sequence: Synthetic oligonucleotide
  Target: SCN9A; (+) strand; PAM type: YTN; PAM sequence: TTT
tcttaaaagctcgataatgc

SEQ ID NO: 99916 - DNA, 20 bp, Artificial Sequence
  Description of Artificial Sequence: Synthetic oligonucleotide
  Target: SCN9A; (+) strand; PAM type: YTN; PAM sequence: TTT
cttaaaagctcgataatgca

SEQ ID NO: 99917 - DNA, 20 bp, Artificial Sequence
  Description of Artificial Sequence: Synthetic oligonucleotide
  Target: SCN9A; (+) strand; PAM type: YTN; PAM sequence: TTC
ttaaaagctcgataatgcaa

SEQ ID NO: 99918 - DNA, 20 bp, Artificial Sequence
  Description of Artificial Sequence: Synthetic oligonucleotide
  Target: SCN9A; (+) strand; PAM type: YTN; PAM sequence: CTT
aaaagctcgataatgcaaac

SEQ ID NO: 99919 - DNA, 20 bp, Artificial Sequence
  Description of Artificial Sequence: Synthetic oligonucleotide
  Target: SCN9A; (+) strand; PAM type: YTN; PAM sequence: TTA
aaagctcgataatgcaaacc

SEQ ID NO: 99920 - DNA, 20 bp, Artificial Sequence
  Description of Artificial Sequence: Synthetic oligonucleotide
  Target: SCN9A; (+) strand; PAM type: YTN; PAM sequence: CTC
gataatgcaaacccttggtt

SEQ ID NO: 99921 - DNA, 20 bp, Artificial Sequence
  Description of Artificial Sequence: Synthetic oligonucleotide
  Target: SCN9A; (+) strand; PAM type: YTN; PAM sequence: CTT
ggttaaattttaaagcactt

SEQ ID NO: 99922 - DNA, 20 bp, Artificial Sequence
  Description of Artificial Sequence: Synthetic oligonucleotide
  Target: SCN9A; (+) strand; PAM type: YTN; PAM sequence: TTG
gttaaattttaaagcactta

SEQ ID NO: 99923 - DNA, 20 bp, Artificial Sequence
  Description of Artificial Sequence: Synthetic oligonucleotide
  Target: SCN9A; (+) strand; PAM type: YTN; PAM sequence: TTA
aattttaaagcacttattgg

SEQ ID NO: 99924 - DNA, 20 bp, Artificial Sequence
  Description of Artificial Sequence: Synthetic oligonucleotide
  Target: SCN9A; (+) strand; PAM type: YTN; PAM sequence: TTT
taaagcacttattggcatat

SEQ ID NO: 99925 - DNA, 20 bp, Artificial Sequence
  Description of Artificial Sequence: Synthetic oligonucleotide
  Target: SCN9A; (+) strand; PAM type: YTN; PAM sequence: TTT
aaagcacttattggcatata

SEQ ID NO: 99926 - DNA, 20 bp, Artificial Sequence
  Description of Artificial Sequence: Synthetic oligonucleotide
  Target: SCN9A; (+) strand; PAM type: YTN; PAM sequence: TTA
aagcacttattggcatatac

SEQ ID NO: 99927 - DNA, 20 bp, Artificial Sequence
  Description of Artificial Sequence: Synthetic oligonucleotide
  Target: SCN9A; (+) strand; PAM type: YTN; PAM sequence: CTT
attggcatatacaaatttgc

SEQ ID NO: 99928 - DNA, 20 bp, Artificial Sequence
  Description of Artificial Sequence: Synthetic oligonucleotide
  Target: SCN9A; (+) strand; PAM type: YTN; PAM sequence: TTA
ttggcatatacaaatttgcg

SEQ ID NO: 99929 - DNA, 20 bp, Artificial Sequence
  Description of Artificial Sequence: Synthetic oligonucleotide
  Target: SCN9A; (+) strand; PAM type: YTN; PAM sequence: TTG
gcatatacaaatttgcgtgt

SEQ ID NO: 99930 - DNA, 20 bp, Artificial Sequence
  Description of Artificial Sequence: Synthetic oligonucleotide
  Target: SCN9A; (+) strand; PAM type: YTN; PAM sequence: TTT
gcgtgttgacctctaattat

SEQ ID NO: 99931 - DNA, 20 bp, Artificial Sequence
  Description of Artificial Sequence: Synthetic oligonucleotide
  Target: SCN9A; (+) strand; PAM type: YTN; PAM sequence: TTG
cgtgttgacctctaattatg

SEQ ID NO: 99932 - DNA, 20 bp, Artificial Sequence
  Description of Artificial Sequence: Synthetic oligonucleotide
  Target: SCN9A; (+) strand; PAM type: YTN; PAM sequence: TTG
acctctaattatgtcaggca

SEQ ID NO: 99933 - DNA, 20 bp, Artificial Sequence
  Description of Artificial Sequence: Synthetic oligonucleotide
  Target: SCN9A; (+) strand; PAM type: YTN; PAM sequence: CTC
taattatgtcaggcatcata

SEQ ID NO: 99934 - DNA, 20 bp, Artificial Sequence
  Description of Artificial Sequence: Synthetic oligonucleotide
  Target: SCN9A; (+) strand; PAM type: YTN; PAM sequence: CTA
attatgtcaggcatcatatg

SEQ ID NO: 99935 - DNA, 20 bp, Artificial Sequence
  Description of Artificial Sequence: Synthetic oligonucleotide
  Target: SCN9A; (+) strand; PAM type: YTN; PAM sequence: TTA
tgtcaggcatcatatggaaa

SEQ ID NO: 99936 - DNA, 20 bp, Artificial Sequence
  Description of Artificial Sequence: Synthetic oligonucleotide
  Target: SCN9A; (+) strand; PAM type: YTN; PAM sequence: CTC
taaaaactatgactgattat

SEQ ID NO: 99937 - DNA, 20 bp, Artificial Sequence
  Description of Artificial Sequence: Synthetic oligonucleotide
  Target: SCN9A; (+) strand; PAM type: YTN; PAM sequence: CTA
aaaactatgactgattatag

SEQ ID NO: 99938 - DNA, 20 bp, Artificial Sequence
  Description of Artificial Sequence: Synthetic oligonucleotide
  Target: SCN9A; (+) strand; PAM type: YTN; PAM sequence: CTA
tgactgattataggatgttt

SEQ ID NO: 99939 - DNA, 20 bp, Artificial Sequence
  Description of Artificial Sequence: Synthetic oligonucleotide
  Target: SCN9A; (+) strand; PAM type: YTN; PAM sequence: CTG
attataggatgtttcttccc

SEQ ID NO: 99940 - DNA, 20 bp, Artificial Sequence
  Description of Artificial Sequence: Synthetic oligonucleotide
  Target: SCN9A; (+) strand; PAM type: YTN; PAM sequence: TTA
taggatgtttcttccctaaa

SEQ ID NO: 99941 - DNA, 20 bp, Artificial Sequence
  Description of Artificial Sequence: Synthetic oligonucleotide
  Target: SCN9A; (+) strand; PAM type: YTN; PAM sequence: TTT
cttccctaaacacaaaggtt

SEQ ID NO: 99942 - DNA, 20 bp, Artificial Sequence
  Description of Artificial Sequence: Synthetic oligonucleotide
  Target: SCN9A; (+) strand; PAM type: YTN; PAM sequence: TTC
ttccctaaacacaaaggtta

SEQ ID NO: 99943 - DNA, 20 bp, Artificial Sequence
  Description of Artificial Sequence: Synthetic oligonucleotide
  Target: SCN9A; (+) strand; PAM type: YTN; PAM sequence: CTT
ccctaaacacaaaggttagg

SEQ ID NO: 99944 - DNA, 20 bp, Artificial Sequence
  Description of Artificial Sequence: Synthetic oligonucleotide
  Target: SCN9A; (+) strand; PAM type: YTN; PAM sequence: TTC
cctaaacacaaaggttaggt

SEQ ID NO: 99945 - DNA, 20 bp, Artificial Sequence
  Description of Artificial Sequence: Synthetic oligonucleotide
  Target: SCN9A; (+) strand; PAM type: YTN; PAM sequence: CTA
aacacaaaggttaggtttct

SEQ ID NO: 99946 - DNA, 20 bp, Artificial Sequence
  Description of Artificial Sequence: Synthetic oligonucleotide
  Target: SCN9A; (+) strand; PAM type: YTN; PAM sequence: TTA
ggtttctgaaaatctagaag

SEQ ID NO: 99947 - DNA, 20 bp, Artificial Sequence
  Description of Artificial Sequence: Synthetic oligonucleotide
  Target: SCN9A; (+) strand; PAM type: YTN; PAM sequence: TTT
ctgaaaatctagaagaatta

SEQ ID NO: 99948 - DNA, 20 bp, Artificial Sequence
  Description of Artificial Sequence: Synthetic oligonucleotide
  Target: SCN9A; (+) strand; PAM type: YTN; PAM sequence: TTC
tgaaaatctagaagaattag

SEQ ID NO: 99949 - DNA, 20 bp, Artificial Sequence
  Description of Artificial Sequence: Synthetic oligonucleotide
  Target: SCN9A; (+) strand; PAM type: YTN; PAM sequence: CTG
aaaatctagaagaattagta

SEQ ID NO: 99950 - DNA, 20 bp, Artificial Sequence
  Description of Artificial Sequence: Synthetic oligonucleotide
  Target: SCN9A; (+) strand; PAM type: YTN; PAM sequence: CTA
gaagaattagtaaaagataa

SEQ ID NO: 99951 - DNA, 20 bp, Artificial Sequence
  Description of Artificial Sequence: Synthetic oligonucleotide
  Target: SCN9A; (+) strand; PAM type: YTN; PAM sequence: TTA
gtaaaagataaagaacatat

SEQ ID NO: 99952 - DNA, 20 bp, Artificial Sequence
  Description of Artificial Sequence: Synthetic oligonucleotide
  Target: SCN9A; (+) strand; PAM type: YTN; PAM sequence: TTC
tgagaaaaataagactggga

SEQ ID NO: 99953 - DNA, 20 bp, Artificial Sequence
  Description of Artificial Sequence: Synthetic oligonucleotide
  Target: SCN9A; (+) strand; PAM type: YTN; PAM sequence: CTG
agaaaaataagactgggaga

SEQ ID NO: 99954 - DNA, 20 bp, Artificial Sequence
  Description of Artificial Sequence: Synthetic oligonucleotide
  Target: SCN9A; (+) strand; PAM type: YTN; PAM sequence: CTG
ggagattgaggttataaaat

SEQ ID NO: 99955 - DNA, 20 bp, Artificial Sequence
  Description of Artificial Sequence: Synthetic oligonucleotide
  Target: SCN9A; (+) strand; PAM type: YTN; PAM sequence: TTG
aggttataaaataatgtaag

SEQ ID NO: 99956 - DNA, 20 bp, Artificial Sequence
  Description of Artificial Sequence: Synthetic oligonucleotide
  Target: SCN9A; (+) strand; PAM type: YTN; PAM sequence: TTA
taaaataatgtaagaaagcc

SEQ ID NO: 99957 - DNA, 20 bp, Artificial Sequence
  Description of Artificial Sequence: Synthetic oligonucleotide
  Target: SCN9A; (+) strand; PAM type: YTN; PAM sequence: TTT
taattaatacaaaatatgtc

SEQ ID NO: 99958 - DNA, 20 bp, Artificial Sequence
  Description of Artificial Sequence: Synthetic oligonucleotide
  Target: SCN9A; (+) strand; PAM type: YTN; PAM sequence: TTT
aattaatacaaaatatgtca

SEQ ID NO: 99959 - DNA, 20 bp, Artificial Sequence
  Description of Artificial Sequence: Synthetic oligonucleotide
  Target: SCN9A; (+) strand; PAM type: YTN; PAM sequence: TTA
attaatacaaaatatgtcat

SEQ ID NO: 99960 - DNA, 20 bp, Artificial Sequence
  Description of Artificial Sequence: Synthetic oligonucleotide
  Target: SCN9A; (+) strand; PAM type: YTN; PAM sequence: TTA
atacaaaatatgtcatatat

SEQ ID NO: 99961 - DNA, 20 bp, Artificial Sequence
  Description of Artificial Sequence: Synthetic oligonucleotide
  Target: SCN9A; (+) strand; PAM type: YTN; PAM sequence: TTA
ttaagttatattattaaaat

SEQ ID NO: 99962 - DNA, 20 bp, Artificial Sequence
  Description of Artificial Sequence: Synthetic oligonucleotide
  Target: SCN9A; (+) strand; PAM type: YTN; PAM sequence: TTA
agttatattattaaaatata

SEQ ID NO: 99963 - DNA, 20 bp, Artificial Sequence
  Description of Artificial Sequence: Synthetic oligonucleotide
  Target: SCN9A; (+) strand; PAM type: YTN; PAM sequence: TTA
tattattaaaatataaaata

SEQ ID NO: 99964 - DNA, 20 bp, Artificial Sequence
  Description of Artificial Sequence: Synthetic oligonucleotide
  Target: SCN9A; (+) strand; PAM type: YTN; PAM sequence: TTA
ttaaaatataaaataattag

SEQ ID NO: 99965 - DNA, 20 bp, Artificial Sequence
  Description of Artificial Sequence: Synthetic oligonucleotide
  Target: SCN9A; (+) strand; PAM type: YTN; PAM sequence: TTA
aaatataaaataattagagt

SEQ ID NO: 99966 - DNA, 20 bp, Artificial Sequence
  Description of Artificial Sequence: Synthetic oligonucleotide
  Target: SCN9A; (+) strand; PAM type: YTN; PAM sequence: TTA
gagtacattcaatgaaatga

SEQ ID NO: 99967 - DNA, 20 bp, Artificial Sequence
  Description of Artificial Sequence: Synthetic oligonucleotide
  Target: SCN9A; (+) strand; PAM type: YTN; PAM sequence: TTC
aatgaaatgataataatggg

SEQ ID NO: 99968 - DNA, 20 bp, Artificial Sequence
  Description of Artificial Sequence: Synthetic oligonucleotide
  Target: SCN9A; (+) strand; PAM type: YTN; PAM sequence: TTG
taccgttagtttctatttga

SEQ ID NO: 99969 - DNA, 20 bp, Artificial Sequence
  Description of Artificial Sequence: Synthetic oligonucleotide
  Target: SCN9A; (+) strand; PAM type: YTN; PAM sequence: TTA
gtttctatttgagagtcctt

SEQ ID NO: 99970 - DNA, 20 bp, Artificial Sequence
  Description of Artificial Sequence: Synthetic oligonucleotide
  Target: SCN9A; (+) strand; PAM type: YTN; PAM sequence: TTT
ctatttgagagtccttgatc

SEQ ID NO: 99971 - DNA, 20 bp, Artificial Sequence
  Description of Artificial Sequence: Synthetic oligonucleotide
  Target: SCN9A; (+) strand; PAM type: YTN; PAM sequence: TTC
tatttgagagtccttgatct

SEQ ID NO: 99972 - DNA, 20 bp, Artificial Sequence
  Description of Artificial Sequence: Synthetic oligonucleotide
  Target: SCN9A; (+) strand; PAM type: YTN; PAM sequence: CTA
tttgagagtccttgatctca

SEQ ID NO: 99973 - DNA, 20 bp, Artificial Sequence
  Description of Artificial Sequence: Synthetic oligonucleotide
  Target: SCN9A; (+) strand; PAM type: YTN; PAM sequence: TTT
gagagtccttgatctcaccg

SEQ ID NO: 99974 - DNA, 20 bp, Artificial Sequence
  Description of Artificial Sequence: Synthetic oligonucleotide
  Target: SCN9A; (+) strand; PAM type: YTN; PAM sequence: TTG
agagtccttgatctcaccga

SEQ ID NO: 99975 - DNA, 20 bp, Artificial Sequence
  Description of Artificial Sequence: Synthetic oligonucleotide
  Target: SCN9A; (+) strand; PAM type: YTN; PAM sequence: CTT
gatctcaccgactattttaa

SEQ ID NO: 99976 - DNA, 20 bp, Artificial Sequence
  Description of Artificial Sequence: Synthetic oligonucleotide
  Target: SCN9A; (+) strand; PAM type: YTN; PAM sequence: TTG
atctcaccgactattttaag

SEQ ID NO: 99977 - DNA, 20 bp, Artificial Sequence
  Description of Artificial Sequence: Synthetic oligonucleotide
  Target: SCN9A; (+) strand; PAM type: YTN; PAM sequence: CTC
accgactattttaagatttc

SEQ ID NO: 99978 - DNA, 20 bp, Artificial Sequence
  Description of Artificial Sequence: Synthetic oligonucleotide
  Target: SCN9A; (+) strand; PAM type: YTN; PAM sequence: CTA
ttttaagatttcttctctat

SEQ ID NO: 99979 - DNA, 20 bp, Artificial Sequence
  Description of Artificial Sequence: Synthetic oligonucleotide
  Target: SCN9A; (+) strand; PAM type: YTN; PAM sequence: TTT
taagatttcttctctatctc

SEQ ID NO: 99980 - DNA, 20 bp, Artificial Sequence
  Description of Artificial Sequence: Synthetic oligonucleotide
  Target: SCN9A; (+) strand; PAM type: YTN; PAM sequence: TTT
aagatttcttctctatctca

SEQ ID NO: 99981 - DNA, 20 bp, Artificial Sequence
  Description of Artificial Sequence: Synthetic oligonucleotide
  Target: SCN9A; (+) strand; PAM type: YTN; PAM sequence: TTA
agatttcttctctatctcaa

SEQ ID NO: 99982 - DNA, 20 bp, Artificial Sequence
  Description of Artificial Sequence: Synthetic oligonucleotide
  Target: SCN9A; (+) strand; PAM type: YTN; PAM sequence: TTT
cttctctatctcaatcagaa

SEQ ID NO: 99983 - DNA, 20 bp, Artificial Sequence
  Description of Artificial Sequence: Synthetic oligonucleotide
  Target: SCN9A; (+) strand; PAM type: YTN; PAM sequence: TTC
ttctctatctcaatcagaag

SEQ ID NO: 99984 - DNA, 20 bp, Artificial Sequence
  Description of Artificial Sequence: Synthetic oligonucleotide
  Target: SCN9A; (+) strand; PAM type: YTN; PAM sequence: CTT
ctctatctcaatcagaagcc

SEQ ID NO: 99985 - DNA, 20 bp, Artificial Sequence
  Description of Artificial Sequence: Synthetic oligonucleotide
  Target: SCN9A; (+) strand; PAM type: YTN; PAM sequence: TTC
tctatctcaatcagaagcct

SEQ ID NO: 99986 - DNA, 20 bp, Artificial Sequence
  Description of Artificial Sequence: Synthetic oligonucleotide
  Target: SCN9A; (+) strand; PAM type: YTN; PAM sequence: CTC
tatctcaatcagaagcctgt

SEQ ID NO: 99987 - DNA, 20 bp, Artificial Sequence
  Description of Artificial Sequence: Synthetic oligonucleotide
  Target: SCN9A; (+) strand; PAM type: YTN; PAM sequence: CTA
tctcaatcagaagcctgtaa

SEQ ID NO: 99988 - DNA, 20 bp, Artificial Sequence
  Description of Artificial Sequence: Synthetic oligonucleotide
  Target: SCN9A; (+) strand; PAM type: YTN; PAM sequence: CTC
aatcagaagcctgtaaaaat

SEQ ID NO: 99989 - DNA, 20 bp, Artificial Sequence
  Description of Artificial Sequence: Synthetic oligonucleotide
  Target: SCN9A; (+) strand; PAM type: YTN; PAM sequence: CTG
taaaaatatttctacttcgt

SEQ ID NO: 99990 - DNA, 20 bp, Artificial Sequence
  Description of Artificial Sequence: Synthetic oligonucleotide
  Target: SCN9A; (+) strand; PAM type: YTN; PAM sequence: TTT
ctacttcgttaaaataatat

SEQ ID NO: 99991 - DNA, 20 bp, Artificial Sequence
  Description of Artificial Sequence: Synthetic oligonucleotide
  Target: SCN9A; (+) strand; PAM type: YTN; PAM sequence: TTC
tacttcgttaaaataatatg

SEQ ID NO: 99992 - DNA, 20 bp, Artificial Sequence
  Description of Artificial Sequence: Synthetic oligonucleotide
  Target: SCN9A; (+) strand; PAM type: YTN; PAM sequence: CTA
cttcgttaaaataatatgta

SEQ ID NO: 99993 - DNA, 20 bp, Artificial Sequence
  Description of Artificial Sequence: Synthetic oligonucleotide
  Target: SCN9A; (+) strand; PAM type: YTN; PAM sequence: CTT
cgttaaaataatatgtaaac

SEQ ID NO: 99994 - DNA, 20 bp, Artificial Sequence
  Description of Artificial Sequence: Synthetic oligonucleotide
  Target: SCN9A; (+) strand; PAM type: YTN; PAM sequence: TTC
gttaaaataatatgtaaact

SEQ ID NO: 99995 - DNA, 20 bp, Artificial Sequence
  Description of Artificial Sequence: Synthetic oligonucleotide
  Target: SCN9A; (+) strand; PAM type: YTN; PAM sequence: TTA
aaataatatgtaaactaaag

SEQ ID NO: 99996 - DNA, 20 bp, Artificial Sequence
  Description of Artificial Sequence: Synthetic oligonucleotide
  Target: SCN9A; (+) strand; PAM type: YTN; PAM sequence: CTA
aagaattattatgtattttc

SEQ ID NO: 99997 - DNA, 20 bp, Artificial Sequence
  Description of Artificial Sequence: Synthetic oligonucleotide
  Target: SCN9A; (+) strand; PAM type: YTN; PAM sequence: TTA
ttatgtattttccatcatcc

SEQ ID NO: 99998 - DNA, 20 bp, Artificial Sequence
  Description of Artificial Sequence: Synthetic oligonucleotide
  Target: SCN9A; (+) strand; PAM type: YTN; PAM sequence: TTA
tgtattttccatcatccaag

SEQ ID NO: 99999 - DNA, 20 bp, Artificial Sequence
  Description of Artificial Sequence: Synthetic oligonucleotide
  Target: SCN9A; (+) strand; PAM type: YTN; PAM sequence: TTT
tccatcatccaagtattcaa

SEQ ID NO: 100000 - DNA, 20 bp, Artificial Sequence
  Description of Artificial Sequence: Synthetic oligonucleotide
  Target: SCN9A; (+) strand; PAM type: YTN; PAM sequence: TTT
ccatcatccaagtattcaac

SEQ ID NO: 100001 - DNA, 20 bp, Artificial Sequence
  Description of Artificial Sequence: Synthetic oligonucleotide
  Target: SCN9A; (+) strand; PAM type: YTN; PAM sequence: TTC
catcatccaagtattcaaca

SEQ ID NO: 100002 - DNA, 20 bp, Artificial Sequence
  Description of Artificial Sequence: Synthetic oligonucleotide
  Target: SCN9A; (+) strand; PAM type: YTN; PAM sequence: TTC
aacagttctttgaatttatt

SEQ ID NO: 100003 - DNA, 20 bp, Artificial Sequence
  Description of Artificial Sequence: Synthetic oligonucleotide
  Target: SCN9A; (+) strand; PAM type: YTN; PAM sequence: TTC
tttgaatttattatctaaaa

SEQ ID NO: 100004 - DNA, 20 bp, Artificial Sequence
  Description of Artificial Sequence: Synthetic oligonucleotide
  Target: SCN9A; (+) strand; PAM type: YTN; PAM sequence: CTT
tgaatttattatctaaaatt

SEQ ID NO: 100005 - DNA, 20 bp, Artificial Sequence
  Description of Artificial Sequence: Synthetic oligonucleotide
  Target: SCN9A; (+) strand; PAM type: YTN; PAM sequence: TTT
gaatttattatctaaaatta

SEQ ID NO: 100006 - DNA, 20 bp, Artificial Sequence
  Description of Artificial Sequence: Synthetic oligonucleotide
  Target: SCN9A; (+) strand; PAM type: YTN; PAM sequence: TTG
aatttattatctaaaattat

SEQ ID NO: 100007 - DNA, 20 bp, Artificial Sequence
  Description of Artificial Sequence: Synthetic oligonucleotide
  Target: SCN9A; (+) strand; PAM type: YTN; PAM sequence: TTT
attatctaaaattattacat

SEQ ID NO: 100008 - DNA, 20 bp, Artificial Sequence
  Description of Artificial Sequence: Synthetic oligonucleotide
  Target: SCN9A; (+) strand; PAM type: YTN; PAM sequence: TTA
ttatctaaaattattacatt

SEQ ID NO: 100009 - DNA, 20 bp, Artificial Sequence
  Description of Artificial Sequence: Synthetic oligonucleotide
  Target: SCN9A; (+) strand; PAM type: YTN; PAM sequence: TTA
tctaaaattattacattaat

SEQ ID NO: 100010 - DNA, 20 bp, Artificial Sequence
  Description of Artificial Sequence: Synthetic oligonucleotide
  Target: SCN9A; (+) strand; PAM type: YTN; PAM sequence: CTA
aaattattacattaataata

SEQ ID NO: 100011 - DNA, 20 bp, Artificial Sequence
  Description of Artificial Sequence: Synthetic oligonucleotide
  Target: SCN9A; (+) strand; PAM type: YTN; PAM sequence: TTA
ttacattaataataatgcct

SEQ ID NO: 100012 - DNA, 20 bp, Artificial Sequence
  Description of Artificial Sequence: Synthetic oligonucleotide
  Target: SCN9A; (+) strand; PAM type: YTN; PAM sequence: TTA
cattaataataatgcctact

SEQ ID NO: 100013 - DNA, 20 bp, Artificial Sequence
  Description of Artificial Sequence: Synthetic oligonucleotide
  Target: SCN9A; (+) strand; PAM type: YTN; PAM sequence: TTA
ataataatgcctactcctct

SEQ ID NO: 100014 - DNA, 20 bp, Artificial Sequence
  Description of Artificial Sequence: Synthetic oligonucleotide
  Target: SCN9A; (+) strand; PAM type: YTN; PAM sequence: CTA
ctcctctgccccactgccat

SEQ ID NO: 100015 - DNA, 20 bp, Artificial Sequence
  Description of Artificial Sequence: Synthetic oligonucleotide
  Target: SCN9A; (+) strand; PAM type: YTN; PAM sequence: CTC
ctctgccccactgccattct

SEQ ID NO: 100016 - DNA, 20 bp, Artificial Sequence
  Description of Artificial Sequence: Synthetic oligonucleotide
  Target: SCN9A; (+) strand; PAM type: YTN; PAM sequence: CTC
tgccccactgccattctgga

SEQ ID NO: 100017 - DNA, 20 bp, Artificial Sequence
  Description of Artificial Sequence: Synthetic oligonucleotide
  Target: SCN9A; (+) strand; PAM type: YTN; PAM sequence: CTG
ccccactgccattctggaga

SEQ ID NO: 100018 - DNA, 20 bp, Artificial Sequence
  Description of Artificial Sequence: Synthetic oligonucleotide
  Target: SCN9A; (+) strand; PAM type: YTN; PAM sequence: CTG
ccattctggagatgaagggc

SEQ ID NO: 100019 - DNA, 20 bp, Artificial Sequence
  Description of Artificial Sequence: Synthetic oligonucleotide
  Target: SCN9A; (+) strand; PAM type: YTN; PAM sequence: TTC
tggagatgaagggcaagtcg

SEQ ID NO: 100020 - DNA, 20 bp, Artificial Sequence
  Description of Artificial Sequence: Synthetic oligonucleotide
  Target: SCN9A; (+) strand; PAM type: YTN; PAM sequence: CTG
gagatgaagggcaagtcgca

SEQ ID NO: 100021 - DNA, 20 bp, Artificial Sequence
  Description of Artificial Sequence: Synthetic oligonucleotide
  Target: SCN9A; (+) strand; PAM type: YTN; PAM sequence: TTT
gagatagagacaattgtgtc

SEQ ID NO: 100022 - DNA, 20 bp, Artificial Sequence
  Description of Artificial Sequence: Synthetic oligonucleotide
  Target: SCN9A; (+) strand; PAM type: YTN; PAM sequence: TTG
agatagagacaattgtgtct

SEQ ID NO: 100023 - DNA, 20 bp, Artificial Sequence
  Description of Artificial Sequence: Synthetic oligonucleotide
  Target: SCN9A; (+) strand; PAM type: YTN; PAM sequence: TTG
tgtctcattttggtttttcc

SEQ ID NO: 100024 - DNA, 20 bp, Artificial Sequence
  Description of Artificial Sequence: Synthetic oligonucleotide
  Target: SCN9A; (+) strand; PAM type: YTN; PAM sequence: CTC
attttggtttttcctataat

SEQ ID NO: 100025 - DNA, 20 bp, Artificial Sequence
  Description of Artificial Sequence: Synthetic oligonucleotide
  Target: SCN9A; (+) strand; PAM type: YTN; PAM sequence: TTT
tggtttttcctataattggg

SEQ ID NO: 100026 - DNA, 20 bp, Artificial Sequence
  Description of Artificial Sequence: Synthetic oligonucleotide
  Target: SCN9A; (+) strand; PAM type: YTN; PAM sequence: TTT
ggtttttcctataattgggt

SEQ ID NO: 100027 - DNA, 20 bp, Artificial Sequence
  Description of Artificial Sequence: Synthetic oligonucleotide
  Target: SCN9A; (+) strand; PAM type: YTN; PAM sequence: TTG
gtttttcctataattgggtc

SEQ ID NO: 100028 - DNA, 20 bp, Artificial Sequence
  Description of Artificial Sequence: Synthetic oligonucleotide
  Target: SCN9A; (+) strand; PAM type: YTN; PAM sequence: TTT
ttcctataattgggtctgag

SEQ ID NO: 100029 - DNA, 20 bp, Artificial Sequence
  Description of Artificial Sequence: Synthetic oligonucleotide
  Target: SCN9A; (+) strand; PAM type: YTN; PAM sequence: TTT
tcctataattgggtctgaga

SEQ ID NO: 100030 - DNA, 20 bp, Artificial Sequence
  Description of Artificial Sequence: Synthetic oligonucleotide
  Target: SCN9A; (+) strand; PAM type: YTN; PAM sequence: TTT
cctataattgggtctgagat

SEQ ID NO: 100031 - DNA, 20 bp, Artificial Sequence
  Description of Artificial Sequence: Synthetic oligonucleotide
  Target: SCN9A; (+) strand; PAM type: YTN; PAM sequence: TTC
ctataattgggtctgagata

SEQ ID NO: 100032 - DNA, 20 bp, Artificial Sequence
  Description of Artificial Sequence: Synthetic oligonucleotide
  Target: SCN9A; (+) strand; PAM type: YTN; PAM sequence: CTA
taattgggtctgagatagat

SEQ ID NO: 100033 - DNA, 20 bp, Artificial Sequence
  Description of Artificial Sequence: Synthetic oligonucleotide
  Target: SCN9A; (+) strand; PAM type: YTN; PAM sequence: TTG
ggtctgagatagatatttta

SEQ ID NO: 100034 - DNA, 20 bp, Artificial Sequence
  Description of Artificial Sequence: Synthetic oligonucleotide
  Target: SCN9A; (+) strand; PAM type: YTN; PAM sequence: CTG
agatagatattttaaaattt

SEQ ID NO: 100035 - DNA, 20 bp, Artificial Sequence
  Description of Artificial Sequence: Synthetic oligonucleotide
  Target: SCN9A; (+) strand; PAM type: YTN; PAM sequence: TTT
taaaatttcatgacttctct

SEQ ID NO: 100036 - DNA, 20 bp, Artificial Sequence
  Description of Artificial Sequence: Synthetic oligonucleotide
  Target: SCN9A; (+) strand; PAM type: YTN; PAM sequence: TTT
aaaatttcatgacttctctc

SEQ ID NO: 100037 - DNA, 20 bp, Artificial Sequence
  Description of Artificial Sequence: Synthetic oligonucleotide
  Target: SCN9A; (+) strand; PAM type: YTN; PAM sequence: TTA
aaatttcatgacttctctct

SEQ ID NO: 100038 - DNA, 20 bp, Artificial Sequence
  Description of Artificial Sequence: Synthetic oligonucleotide
  Target: SCN9A; (+) strand; PAM type: YTN; PAM sequence: TTT
catgacttctctctccccaa

SEQ ID NO: 100039 - DNA, 20 bp, Artificial Sequence
  Description of Artificial Sequence: Synthetic oligonucleotide
  Target: SCN9A; (+) strand; PAM type: YTN; PAM sequence: TTC
atgacttctctctccccaaa

SEQ ID NO: 100040 - DNA, 20 bp, Artificial Sequence
  Description of Artificial Sequence: Synthetic oligonucleotide
  Target: SCN9A; (+) strand; PAM type: YTN; PAM sequence: CTT
ctctctccccaaatacaaag

SEQ ID NO: 100041 - DNA, 20 bp, Artificial Sequence
  Description of Artificial Sequence: Synthetic oligonucleotide
  Target: SCN9A; (+) strand; PAM type: YTN; PAM sequence: TTC
tctctccccaaatacaaagt

SEQ ID NO: 100042 - DNA, 20 bp, Artificial Sequence
  Description of Artificial Sequence: Synthetic oligonucleotide
  Target: SCN9A; (+) strand; PAM type: YTN; PAM sequence: CTC
tctccccaaatacaaagtta

SEQ ID NO: 100043 - DNA, 20 bp, Artificial Sequence
  Description of Artificial Sequence: Synthetic oligonucleotide
  Target: SCN9A; (+) strand; PAM type: YTN; PAM sequence: CTC
tccccaaatacaaagttaac

SEQ ID NO: 100044 - DNA, 20 bp, Artificial Sequence
  Description of Artificial Sequence: Synthetic oligonucleotide
  Target: SCN9A; (+) strand; PAM type: YTN; PAM sequence: CTC
cccaaatacaaagttaactt

SEQ ID NO: 100045 - DNA, 20 bp, Artificial Sequence
  Description of Artificial Sequence: Synthetic oligonucleotide
  Target: SCN9A; (+) strand; PAM type: YTN; PAM sequence: TTA
actttgtatttgtataatga

SEQ ID NO: 100046 - DNA, 20 bp, Artificial Sequence
  Description of Artificial Sequence: Synthetic oligonucleotide
  Target: SCN9A; (+) strand; PAM type: YTN; PAM sequence: CTT
tgtatttgtataatgatttt

SEQ ID NO: 100047 - DNA, 20 bp, Artificial Sequence
  Description of Artificial Sequence: Synthetic oligonucleotide
  Target: SCN9A; (+) strand; PAM type: YTN; PAM sequence: TTT
gtatttgtataatgattttt

SEQ ID NO: 100048 - DNA, 20 bp, Artificial Sequence
  Description of Artificial Sequence: Synthetic oligonucleotide
  Target: SCN9A; (+) strand; PAM type: YTN; PAM sequence: TTG
tatttgtataatgattttta

SEQ ID NO: 100049 - DNA, 20 bp, Artificial Sequence
  Description of Artificial Sequence: Synthetic oligonucleotide
  Target: SCN9A; (+) strand; PAM type: YTN; PAM sequence: TTT
gtataatgatttttagaaaa

SEQ ID NO: 100050 - DNA, 20 bp, Artificial Sequence
  Description of Artificial Sequence: Synthetic oligonucleotide
  Target: SCN9A; (+) strand; PAM type: YTN; PAM sequence: TTG
tataatgatttttagaaaaa

SEQ ID NO: 100051 - DNA, 20 bp, Artificial Sequence
  Description of Artificial Sequence: Synthetic oligonucleotide
  Target: SCN9A; (+) strand; PAM type: YTN; PAM sequence: TTT
ttagaaaaattttagctcac

SEQ ID NO: 100052 - DNA, 20 bp, Artificial Sequence
  Description of Artificial Sequence: Synthetic oligonucleotide
  Target: SCN9A; (+) strand; PAM type: YTN; PAM sequence: TTT
tagaaaaattttagctcaca

SEQ ID NO: 100053 - DNA, 20 bp, Artificial Sequence
  Description of Artificial Sequence: Synthetic oligonucleotide
  Target: SCN9A; (+) strand; PAM type: YTN; PAM sequence: TTT
agaaaaattttagctcacat

SEQ ID NO: 100054 - DNA, 20 bp, Artificial Sequence
  Description of Artificial Sequence: Synthetic oligonucleotide
  Target: SCN9A; (+) strand; PAM type: YTN; PAM sequence: TTA
gaaaaattttagctcacata

SEQ ID NO: 100055 - DNA, 20 bp, Artificial Sequence
  Description of Artificial Sequence: Synthetic oligonucleotide
  Target: SCN9A; (+) strand; PAM type: YTN; PAM sequence: TTT
tagctcacatatcagccaac

SEQ ID NO: 100056 - DNA, 20 bp, Artificial Sequence
  Description of Artificial Sequence: Synthetic oligonucleotide
  Target: SCN9A; (+) strand; PAM type: YTN; PAM sequence: TTT
agctcacatatcagccaact

SEQ ID NO: 100057 - DNA, 20 bp, Artificial Sequence
  Description of Artificial Sequence: Synthetic oligonucleotide
  Target: SCN9A; (+) strand; PAM type: YTN; PAM sequence: TTA
gctcacatatcagccaactt

SEQ ID NO: 100058 - DNA, 20 bp, Artificial Sequence
  Description of Artificial Sequence: Synthetic oligonucleotide
  Target: SCN9A; (+) strand; PAM type: YTN; PAM sequence: CTC
acatatcagccaacttgatg

SEQ ID NO: 100059 - DNA, 20 bp, Artificial Sequence
  Description of Artificial Sequence: Synthetic oligonucleotide
  Target: SCN9A; (+) strand; PAM type: YTN; PAM sequence: CTT
gatgtgcccctcatcctctc

SEQ ID NO: 100060 - DNA, 20 bp, Artificial Sequence
  Description of Artificial Sequence: Synthetic oligonucleotide
  Target: SCN9A; (+) strand; PAM type: YTN; PAM sequence: TTG
atgtgcccctcatcctctct

SEQ ID NO: 100061 - DNA, 20 bp, Artificial Sequence
  Description of Artificial Sequence: Synthetic oligonucleotide
  Target: SCN9A; (+) strand; PAM type: YTN; PAM sequence: CTC
atcctctcttatcttccaat

SEQ ID NO: 100062 - DNA, 20 bp, Artificial Sequence
  Description of Artificial Sequence: Synthetic oligonucleotide
  Target: SCN9A; (+) strand; PAM type: YTN; PAM sequence: CTC
tcttatcttccaattttaca

SEQ ID NO: 100063 - DNA, 20 bp, Artificial Sequence
  Description of Artificial Sequence: Synthetic oligonucleotide
  Target: SCN9A; (+) strand; PAM type: YTN; PAM sequence: CTC
ttatcttccaattttacatt

SEQ ID NO: 100064 - DNA, 20 bp, Artificial Sequence
  Description of Artificial Sequence: Synthetic oligonucleotide
  Target: SCN9A; (+) strand; PAM type: YTN; PAM sequence: CTT
atcttccaattttacattat

SEQ ID NO: 100065 - DNA, 20 bp, Artificial Sequence
  Description of Artificial Sequence: Synthetic oligonucleotide
  Target: SCN9A; (+) strand; PAM type: YTN; PAM sequence: TTA
tcttccaattttacattatg

SEQ ID NO: 100066 - DNA, 20 bp, Artificial Sequence
  Description of Artificial Sequence: Synthetic oligonucleotide
  Target: SCN9A; (+) strand; PAM type: YTN; PAM sequence: CTT
ccaattttacattatgaata

SEQ ID NO: 100067 - DNA, 20 bp, Artificial Sequence
  Description of Artificial Sequence: Synthetic oligonucleotide
  Target: SCN9A; (+) strand; PAM type: YTN; PAM sequence: TTC
caattttacattatgaataa

SEQ ID NO: 100068 - DNA, 20 bp, Artificial Sequence
  Description of Artificial Sequence: Synthetic oligonucleotide
  Target: SCN9A; (+) strand; PAM type: YTN; PAM sequence: TTT
tacattatgaataatcatca

SEQ ID NO: 100069 - DNA, 20 bp, Artificial Sequence
  Description of Artificial Sequence: Synthetic oligonucleotide
  Target: SCN9A; (+) strand; PAM type: YTN; PAM sequence: TTT
acattatgaataatcatcat

SEQ ID NO: 100070 - DNA, 20 bp, Artificial Sequence
  Description of Artificial Sequence: Synthetic oligonucleotide
  Target: SCN9A; (+) strand; PAM type: YTN; PAM sequence: TTA
cattatgaataatcatcatt

SEQ ID NO: 100071 - DNA, 20 bp, Artificial Sequence
  Description of Artificial Sequence: Synthetic oligonucleotide
  Target: SCN9A; (+) strand; PAM type: YTN; PAM sequence: TTA
tgaataatcatcatttcctc

SEQ ID NO: 100072 - DNA, 20 bp, Artificial Sequence
  Description of Artificial Sequence: Synthetic oligonucleotide
  Target: SCN9A; (+) strand; PAM type: YTN; PAM sequence: TTT
cctctctttaatctgtgtct

SEQ ID NO: 100073 - DNA, 20 bp, Artificial Sequence
  Description of Artificial Sequence: Synthetic oligonucleotide
  Target: SCN9A; (+) strand; PAM type: YTN; PAM sequence: TTC
ctctctttaatctgtgtctc

SEQ ID NO: 100074 - DNA, 20 bp, Artificial Sequence
  Description of Artificial Sequence: Synthetic oligonucleotide
  Target: SCN9A; (+) strand; PAM type: YTN; PAM sequence: CTC
tctttaatctgtgtctctgc

SEQ ID NO: 100075 - DNA, 20 bp, Artificial Sequence
  Description of Artificial Sequence: Synthetic oligonucleotide
  Target: SCN9A; (+) strand; PAM type: YTN; PAM sequence: CTC
tttaatctgtgtctctgccc

SEQ ID NO: 100076 - DNA, 20 bp, Artificial Sequence
  Description of Artificial Sequence: Synthetic oligonucleotide
  Target: SCN9A; (+) strand; PAM type: YTN; PAM sequence: CTT
taatctgtgtctctgccctt

SEQ ID NO: 100077 - DNA, 20 bp, Artificial Sequence
  Description of Artificial Sequence: Synthetic oligonucleotide
  Target: SCN9A; (+) strand; PAM type: YTN; PAM sequence: TTT
aatctgtgtctctgcccttt

SEQ ID NO: 100078 - DNA, 20 bp, Artificial Sequence
  Description of Artificial Sequence: Synthetic oligonucleotide
  Target: SCN9A; (+) strand; PAM type: YTN; PAM sequence: TTA
atctgtgtctctgccctttt

SEQ ID NO: 100079 - DNA, 20 bp, Artificial Sequence
  Description of Artificial Sequence: Synthetic oligonucleotide
  Target: SCN9A; (+) strand; PAM type: YTN; PAM sequence: CTG
tgtctctgcccttttatcat

SEQ ID NO: 100080 - DNA, 20 bp, Artificial Sequence
  Description of Artificial Sequence: Synthetic oligonucleotide
  Target: SCN9A; (+) strand; PAM type: YTN; PAM sequence: CTC
tgcccttttatcatctccta

SEQ ID NO: 100081 - DNA, 20 bp, Artificial Sequence
  Description of Artificial Sequence: Synthetic oligonucleotide
  Target: SCN9A; (+) strand; PAM type: YTN; PAM sequence: CTG
cccttttatcatctcctact

SEQ ID NO: 100082 - DNA, 20 bp, Artificial Sequence
  Description of Artificial Sequence: Synthetic oligonucleotide
  Target: SCN9A; (+) strand; PAM type: YTN; PAM sequence: CTT
ttatcatctcctacttctaa

SEQ ID NO: 100083 - DNA, 20 bp, Artificial Sequence
  Description of Artificial Sequence: Synthetic oligonucleotide
  Target: SCN9A; (+) strand; PAM type: YTN; PAM sequence: TTT
tatcatctcctacttctaaa

SEQ ID NO: 100084 - DNA, 20 bp, Artificial Sequence
  Description of Artificial Sequence: Synthetic oligonucleotide
  Target: SCN9A; (+) strand; PAM type: YTN; PAM sequence: TTT
atcatctcctacttctaaat

SEQ ID NO: 100085 - DNA, 20 bp, Artificial Sequence
  Description of Artificial Sequence: Synthetic oligonucleotide
  Target: SCN9A; (+) strand; PAM type: YTN; PAM sequence: TTA
tcatctcctacttctaaatt

SEQ ID NO: 100086 - DNA, 20 bp, Artificial Sequence
  Description of Artificial Sequence: Synthetic oligonucleotide
  Target: SCN9A; (+) strand; PAM type: YTN; PAM sequence: CTC
ctacttctaaattttgtttt

SEQ ID NO: 100087 - DNA, 20 bp, Artificial Sequence
  Description of Artificial Sequence: Synthetic oligonucleotide
  Target: SCN9A; (+) strand; PAM type: YTN; PAM sequence: CTA
cttctaaattttgttttatt

SEQ ID NO: 100088 - DNA, 20 bp, Artificial Sequence
  Description of Artificial Sequence: Synthetic oligonucleotide
  Target: SCN9A; (+) strand; PAM type: YTN; PAM sequence: CTT
ctaaattttgttttattctt

SEQ ID NO: 100089 - DNA, 20 bp, Artificial Sequence
  Description of Artificial Sequence: Synthetic oligonucleotide
  Target: SCN9A; (+) strand; PAM type: YTN; PAM sequence: TTC
taaattttgttttattctta

SEQ ID NO: 100090 - DNA, 20 bp, Artificial Sequence
  Description of Artificial Sequence: Synthetic oligonucleotide
  Target: SCN9A; (+) strand; PAM type: YTN; PAM sequence: CTA
aattttgttttattcttaac

SEQ ID NO: 100091 - DNA, 20 bp, Artificial Sequence
  Description of Artificial Sequence: Synthetic oligonucleotide
  Target: SCN9A; (+) strand; PAM type: YTN; PAM sequence: TTT
tgttttattcttaacaagaa

SEQ ID NO: 100092 - DNA, 20 bp, Artificial Sequence
  Description of Artificial Sequence: Synthetic oligonucleotide
  Target: SCN9A; (+) strand; PAM type: YTN; PAM sequence: TTT
gttttattcttaacaagaat

SEQ ID NO: 100093 - DNA, 20 bp, Artificial Sequence
  Description of Artificial Sequence: Synthetic oligonucleotide
  Target: SCN9A; (+) strand; PAM type: YTN; PAM sequence: TTG
ttttattcttaacaagaatg

SEQ ID NO: 100094 - DNA, 20 bp, Artificial Sequence
  Description of Artificial Sequence: Synthetic oligonucleotide
  Target: SCN9A; (+) strand; PAM type: YTN; PAM sequence: TTT
tattcttaacaagaatgaca

SEQ ID NO: 100095 - DNA, 20 bp, Artificial Sequence
  Description of Artificial Sequence: Synthetic oligonucleotide
  Target: SCN9A; (+) strand; PAM type: YTN; PAM sequence: TTT
attcttaacaagaatgacat

SEQ ID NO: 100096 - DNA, 20 bp, Artificial Sequence
  Description of Artificial Sequence: Synthetic oligonucleotide
  Target: SCN9A; (+) strand; PAM type: YTN; PAM sequence: TTA
ttcttaacaagaatgacatt

SEQ ID NO: 100097 - DNA, 20 bp, Artificial Sequence
  Description of Artificial Sequence: Synthetic oligonucleotide
  Target: SCN9A; (+) strand; PAM type: YTN; PAM sequence: TTC
ttaacaagaatgacattcaa

SEQ ID NO: 100098 - DNA, 20 bp, Artificial Sequence
  Description of Artificial Sequence: Synthetic oligonucleotide
  Target: SCN9A; (+) strand; PAM type: YTN; PAM sequence: CTT
aacaagaatgacattcaaat

SEQ ID NO: 100099 - DNA, 20 bp, Artificial Sequence
  Description of Artificial Sequence: Synthetic oligonucleotide
  Target: SCN9A; (+) strand; PAM type: YTN; PAM sequence: TTA
acaagaatgacattcaaatc

SEQ ID NO: 100100 - DNA, 20 bp, Artificial Sequence
  Description of Artificial Sequence: Synthetic oligonucleotide
  Target: SCN9A; (+) strand; PAM type: YTN; PAM sequence: TTC
aaatcatattttttaaaaaa

SEQ ID NO: 100101 - DNA, 20 bp, Artificial Sequence
  Description of Artificial Sequence: Synthetic oligonucleotide
  Target: SCN9A; (+) strand; PAM type: YTN; PAM sequence: TTT
tttaaaaaatcacatctcct

SEQ ID NO: 100102 - DNA, 20 bp, Artificial Sequence
  Description of Artificial Sequence: Synthetic oligonucleotide
  Target: SCN9A; (+) strand; PAM type: YTN; PAM sequence: TTT
ttaaaaaatcacatctcctt

SEQ ID NO: 100103 - DNA, 20 bp, Artificial Sequence
  Description of Artificial Sequence: Synthetic oligonucleotide
  Target: SCN9A; (+) strand; PAM type: YTN; PAM sequence: TTT
taaaaaatcacatctccttt

SEQ ID NO: 100104 - DNA, 20 bp, Artificial Sequence
  Description of Artificial Sequence: Synthetic oligonucleotide
  Target: SCN9A; (+) strand; PAM type: YTN; PAM sequence: TTT
aaaaaatcacatctcctttg

SEQ ID NO: 100105 - DNA, 20 bp, Artificial Sequence
  Description of Artificial Sequence: Synthetic oligonucleotide
  Target: SCN9A; (+) strand; PAM type: YTN; PAM sequence: TTA
aaaaatcacatctcctttgc

SEQ ID NO: 100106 - DNA, 20 bp, Artificial Sequence
  Description of Artificial Sequence: Synthetic oligonucleotide
  Target: SCN9A; (+) strand; PAM type: YTN; PAM sequence: CTC
ctttgcagaaaacataaaaa

SEQ ID NO: 100107 - DNA, 20 bp, Artificial Sequence
  Description of Artificial Sequence: Synthetic oligonucleotide
  Target: SCN9A; (+) strand; PAM type: YTN; PAM sequence: CTT
tgcagaaaacataaaaaact

SEQ ID NO: 100108 - DNA, 20 bp, Artificial Sequence
  Description of Artificial Sequence: Synthetic oligonucleotide
  Target: SCN9A; (+) strand; PAM type: YTN; PAM sequence: TTT
gcagaaaacataaaaaactc

SEQ ID NO: 100109 - DNA, 20 bp, Artificial Sequence
  Description of Artificial Sequence: Synthetic oligonucleotide
  Target: SCN9A; (+) strand; PAM type: YTN; PAM sequence: TTG
cagaaaacataaaaaactca

SEQ ID NO: 100110 - DNA, 20 bp, Artificial Sequence
  Description of Artificial Sequence: Synthetic oligonucleotide
  Target: SCN9A; (+) strand; PAM type: YTN; PAM sequence: CTC
aattataaatgttacaatgt

SEQ ID NO: 100111 - DNA, 20 bp, Artificial Sequence
  Description of Artificial Sequence: Synthetic oligonucleotide
  Target: SCN9A; (+) strand; PAM type: YTN; PAM sequence: TTA
taaatgttacaatgtcacag

SEQ ID NO: 100112 - DNA, 20 bp, Artificial Sequence
  Description of Artificial Sequence: Synthetic oligonucleotide
  Target: SCN9A; (+) strand; PAM type: YTN; PAM sequence: TTA
caatgtcacagaaataattt

SEQ ID NO: 100113 - DNA, 20 bp, Artificial Sequence
  Description of Artificial Sequence: Synthetic oligonucleotide
  Target: SCN9A; (+) strand; PAM type: YTN; PAM sequence: TTT
acatttgttgaacgatttct

SEQ ID NO: 100114 - DNA, 20 bp, Artificial Sequence
  Description of Artificial Sequence: Synthetic oligonucleotide
  Target: SCN9A; (+) strand; PAM type: YTN; PAM sequence: TTA
catttgttgaacgatttctg

SEQ ID NO: 100115 - DNA, 20 bp, Artificial Sequence
  Description of Artificial Sequence: Synthetic oligonucleotide
  Target: SCN9A; (+) strand; PAM type: YTN; PAM sequence: TTT
gttgaacgatttctgttcta

SEQ ID NO: 100116 - DNA, 20 bp, Artificial Sequence
  Description of Artificial Sequence: Synthetic oligonucleotide
  Target: SCN9A; (+) strand; PAM type: YTN; PAM sequence: TTG
ttgaacgatttctgttctaa

SEQ ID NO: 100117 - DNA, 20 bp, Artificial Sequence
  Description of Artificial Sequence: Synthetic oligonucleotide
  Target: SCN9A; (+) strand; PAM type: YTN; PAM sequence: TTG
aacgatttctgttctaatat

SEQ ID NO: 100118 - DNA, 20 bp, Artificial Sequence
  Description of Artificial Sequence: Synthetic oligonucleotide
  Target: SCN9A; (+) strand; PAM type: YTN; PAM sequence: TTT
ctgttctaatattcctcaca

SEQ ID NO: 100119 - DNA, 20 bp, Artificial Sequence
  Description of Artificial Sequence: Synthetic oligonucleotide
  Target: SCN9A; (+) strand; PAM type: YTN; PAM sequence: TTC
tgttctaatattcctcacag

SEQ ID NO: 100120 - DNA, 20 bp, Artificial Sequence
  Description of Artificial Sequence: Synthetic oligonucleotide
  Target: SCN9A; (+) strand; PAM type: YTN; PAM sequence: CTG
ttctaatattcctcacagat

SEQ ID NO: 100121 - DNA, 20 bp, Artificial Sequence
  Description of Artificial Sequence: Synthetic oligonucleotide
  Target: SCN9A; (+) strand; PAM type: YTN; PAM sequence: TTC
taatattcctcacagatata

SEQ ID NO: 100122 - DNA, 20 bp, Artificial Sequence
  Description of Artificial Sequence: Synthetic oligonucleotide
  Target: SCN9A; (+) strand; PAM type: YTN; PAM sequence: CTA
atattcctcacagatatatt

SEQ ID NO: 100123 - DNA, 20 bp, Artificial Sequence
  Description of Artificial Sequence: Synthetic oligonucleotide
  Target: SCN9A; (+) strand; PAM type: YTN; PAM sequence: TTC
ctcacagatatatttccact

SEQ ID NO: 100124 - DNA, 20 bp, Artificial Sequence
  Description of Artificial Sequence: Synthetic oligonucleotide
  Target: SCN9A; (+) strand; PAM type: YTN; PAM sequence: CTC
acagatatatttccactggc

SEQ ID NO: 100125 - DNA, 20 bp, Artificial Sequence
  Description of Artificial Sequence: Synthetic oligonucleotide
  Target: SCN9A; (+) strand; PAM type: YTN; PAM sequence: TTT
ccactggctgtgttaatatt

SEQ ID NO: 100126 - DNA, 20 bp, Artificial Sequence
  Description of Artificial Sequence: Synthetic oligonucleotide
  Target: SCN9A; (+) strand; PAM type: YTN; PAM sequence: TTC
cactggctgtgttaatattt

SEQ ID NO: 100127 - DNA, 20 bp, Artificial Sequence
  Description of Artificial Sequence: Synthetic oligonucleotide
  Target: SCN9A; (+) strand; PAM type: YTN; PAM sequence: CTG
gctgtgttaatatttctaaa

SEQ ID NO: 100128 - DNA, 20 bp, Artificial Sequence
  Description of Artificial Sequence: Synthetic oligonucleotide
  Target: SCN9A; (+) strand; PAM type: YTN; PAM sequence: CTG
tgttaatatttctaaaagaa

SEQ ID NO: 100129 - DNA, 20 bp, Artificial Sequence
  Description of Artificial Sequence: Synthetic oligonucleotide
  Target: SCN9A; (+) strand; PAM type: YTN; PAM sequence: TTA
atatttctaaaagaataaac

SEQ ID NO: 100130 - DNA, 20 bp, Artificial Sequence
  Description of Artificial Sequence: Synthetic oligonucleotide
  Target: SCN9A; (+) strand; PAM type: YTN; PAM sequence: TTT
ctaaaagaataaacctatag

SEQ ID NO: 100131 - DNA, 20 bp, Artificial Sequence
  Description of Artificial Sequence: Synthetic oligonucleotide
  Target: SCN9A; (+) strand; PAM type: YTN; PAM sequence: TTC
taaaagaataaacctatagc

SEQ ID NO: 100132 - DNA, 20 bp, Artificial Sequence
  Description of Artificial Sequence: Synthetic oligonucleotide
  Target: SCN9A; (+) strand; PAM type: YTN; PAM sequence: CTA
aaagaataaacctatagcct

SEQ ID NO: 100133 - DNA, 20 bp, Artificial Sequence
  Description of Artificial Sequence: Synthetic oligonucleotide
  Target: SCN9A; (+) strand; PAM type: YTN; PAM sequence: CTA
tagcctgaaaatatatgaag

SEQ ID NO: 100134 - DNA, 20 bp, Artificial Sequence
  Description of Artificial Sequence: Synthetic oligonucleotide
  Target: SCN9A; (+) strand; PAM type: YTN; PAM sequence: CTG
aaaatatatgaagcttaaca

SEQ ID NO: 100135 - DNA, 20 bp, Artificial Sequence
  Description of Artificial Sequence: Synthetic oligonucleotide
  Target: SCN9A; (+) strand; PAM type: YTN; PAM sequence: CTT
aacaaaattaaaatatgata

SEQ ID NO: 100136 - DNA, 20 bp, Artificial Sequence
  Description of Artificial Sequence: Synthetic oligonucleotide
  Target: SCN9A; (+) strand; PAM type: YTN; PAM sequence: TTA
acaaaattaaaatatgataa

SEQ ID NO: 100137 - DNA, 20 bp, Artificial Sequence
  Description of Artificial Sequence: Synthetic oligonucleotide
  Target: SCN9A; (+) strand; PAM type: YTN; PAM sequence: TTA
aaatatgataatatgcaata

SEQ ID NO: 100138 - DNA, 20 bp, Artificial Sequence
  Description of Artificial Sequence: Synthetic oligonucleotide
  Target: SCN9A; (+) strand; PAM type: YTN; PAM sequence: TTT
tttcacaacacacagtaaga

SEQ ID NO: 100139 - DNA, 20 bp, Artificial Sequence
  Description of Artificial Sequence: Synthetic oligonucleotide
  Target: SCN9A; (+) strand; PAM type: YTN; PAM sequence: TTT
ttcacaacacacagtaagaa

SEQ ID NO: 100140 - DNA, 20 bp, Artificial Sequence
  Description of Artificial Sequence: Synthetic oligonucleotide
  Target: SCN9A; (+) strand; PAM type: YTN; PAM sequence: TTT
tcacaacacacagtaagaat

SEQ ID NO: 100141 - DNA, 20 bp, Artificial Sequence
  Description of Artificial Sequence: Synthetic oligonucleotide
  Target: SCN9A; (+) strand; PAM type: YTN; PAM sequence: TTT
cacaacacacagtaagaata

SEQ ID NO: 100142 - DNA, 20 bp, Artificial Sequence
  Description of Artificial Sequence: Synthetic oligonucleotide
  Target: SCN9A; (+) strand; PAM type: YTN; PAM sequence: TTC
acaacacacagtaagaataa

SEQ ID NO: 100143 - DNA, 20 bp, Artificial Sequence
  Description of Artificial Sequence: Synthetic oligonucleotide
  Target: SCN9A; (+) strand; PAM type: YTN; PAM sequence: CTC
ttttaaaatgtactcaaaag

SEQ ID NO: 100144 - DNA, 20 bp, Artificial Sequence
  Description of Artificial Sequence: Synthetic oligonucleotide
  Target: SCN9A; (+) strand; PAM type: YTN; PAM sequence: CTT
ttaaaatgtactcaaaagta

SEQ ID NO: 100145 - DNA, 20 bp, Artificial Sequence
  Description of Artificial Sequence: Synthetic oligonucleotide
  Target: SCN9A; (+) strand; PAM type: YTN; PAM sequence: TTT
taaaatgtactcaaaagtac

SEQ ID NO: 100146 - DNA, 20 bp, Artificial Sequence
  Description of Artificial Sequence: Synthetic oligonucleotide
  Target: SCN9A; (+) strand; PAM type: YTN; PAM sequence: TTT
aaaatgtactcaaaagtacc

SEQ ID NO: 100147 - DNA, 20 bp, Artificial Sequence
  Description of Artificial Sequence: Synthetic oligonucleotide
  Target: SCN9A; (+) strand; PAM type: YTN; PAM sequence: TTA
aaatgtactcaaaagtacct

SEQ ID NO: 100148 - DNA, 20 bp, Artificial Sequence
  Description of Artificial Sequence: Synthetic oligonucleotide
  Target: SCN9A; (+) strand; PAM type: YTN; PAM sequence: CTC
aaaagtacctacatcaacaa

SEQ ID NO: 100149 - DNA, 20 bp, Artificial Sequence
  Description of Artificial Sequence: Synthetic oligonucleotide
  Target: SCN9A; (+) strand; PAM type: YTN; PAM sequence: CTA
catcaacaattaggaaatcc

SEQ ID NO: 100150 - DNA, 20 bp, Artificial Sequence
  Description of Artificial Sequence: Synthetic oligonucleotide
  Target: SCN9A; (+) strand; PAM type: YTN; PAM sequence: TTA
ggaaatccagccaacaccag

SEQ ID NO: 100151 - DNA, 20 bp, Artificial Sequence
  Description of Artificial Sequence: Synthetic oligonucleotide
  Target: SCN9A; (+) strand; PAM type: YTN; PAM sequence: TTG
gtgaaatatgttttataacc

SEQ ID NO: 100152 - DNA, 20 bp, Artificial Sequence
  Description of Artificial Sequence: Synthetic oligonucleotide
  Target: SCN9A; (+) strand; PAM type: YTN; PAM sequence: TTT
tataaccatatgctatccat

SEQ ID NO: 100153 - DNA, 20 bp, Artificial Sequence
  Description of Artificial Sequence: Synthetic oligonucleotide
  Target: SCN9A; (+) strand; PAM type: YTN; PAM sequence: TTT
ataaccatatgctatccatt

SEQ ID NO: 100154 - DNA, 20 bp, Artificial Sequence
  Description of Artificial Sequence: Synthetic oligonucleotide
  Target: SCN9A; (+) strand; PAM type: YTN; PAM sequence: TTA
taaccatatgctatccattt

SEQ ID NO: 100155 - DNA, 20 bp, Artificial Sequence
  Description of Artificial Sequence: Synthetic oligonucleotide
  Target: SCN9A; (+) strand; PAM type: YTN; PAM sequence: CTA
tccattttagaagcatttcc

SEQ ID NO: 100156 - DNA, 20 bp, Artificial Sequence
  Description of Artificial Sequence: Synthetic oligonucleotide
  Target: SCN9A; (+) strand; PAM type: YTN; PAM sequence: TTT
tagaagcatttccagaatga

SEQ ID NO: 100157 - DNA, 20 bp, Artificial Sequence
  Description of Artificial Sequence: Synthetic oligonucleotide
  Target: SCN9A; (+) strand; PAM type: YTN; PAM sequence: TTT
agaagcatttccagaatgaa

SEQ ID NO: 100158 - DNA, 20 bp, Artificial Sequence
  Description of Artificial Sequence: Synthetic oligonucleotide
  Target: SCN9A; (+) strand; PAM type: YTN; PAM sequence: TTA
gaagcatttccagaatgaag

SEQ ID NO: 100159 - DNA, 20 bp, Artificial Sequence
  Description of Artificial Sequence: Synthetic oligonucleotide
  Target: SCN9A; (+) strand; PAM type: YTN; PAM sequence: TTT
ccagaatgaagatgtaagtg

SEQ ID NO: 100160 - DNA, 20 bp, Artificial Sequence
  Description of Artificial Sequence: Synthetic oligonucleotide
  Target: SCN9A; (+) strand; PAM type: YTN; PAM sequence: TTC
cagaatgaagatgtaagtga

SEQ ID NO: 100161 - DNA, 20 bp, Artificial Sequence
  Description of Artificial Sequence: Synthetic oligonucleotide
  Target: SCN9A; (+) strand; PAM type: YTN; PAM sequence: CTT
gtctgcatactccaggataa

SEQ ID NO: 100162 - DNA, 20 bp, Artificial Sequence
  Description of Artificial Sequence: Synthetic oligonucleotide
  Target: SCN9A; (+) strand; PAM type: YTN; PAM sequence: TTG
tctgcatactccaggataat

SEQ ID NO: 100163 - DNA, 20 bp, Artificial Sequence
  Description of Artificial Sequence: Synthetic oligonucleotide
  Target: SCN9A; (+) strand; PAM type: YTN; PAM sequence: CTG
catactccaggataatctta

SEQ ID NO: 100164 - DNA, 20 bp, Artificial Sequence
  Description of Artificial Sequence: Synthetic oligonucleotide
  Target: SCN9A; (+) strand; PAM type: YTN; PAM sequence: CTC
caggataatcttaatggtct

SEQ ID NO: 100165 - DNA, 20 bp, Artificial Sequence
  Description of Artificial Sequence: Synthetic oligonucleotide
  Target: SCN9A; (+) strand; PAM type: YTN; PAM sequence: CTT
aatggtctttttcctttcaa

SEQ ID NO: 100166 - DNA, 20 bp, Artificial Sequence
  Description of Artificial Sequence: Synthetic oligonucleotide
  Target: SCN9A; (+) strand; PAM type: YTN; PAM sequence: TTA
atggtctttttcctttcaat

SEQ ID NO: 100167 - DNA, 20 bp, Artificial Sequence
  Description of Artificial Sequence: Synthetic oligonucleotide
  Target: SCN9A; (+) strand; PAM type: YTN; PAM sequence: CTT
tttcctttcaatataaatat

SEQ ID NO: 100168 - DNA, 20 bp, Artificial Sequence
  Description of Artificial Sequence: Synthetic oligonucleotide
  Target: SCN9A; (+) strand; PAM type: YTN; PAM sequence: TTT
ttcctttcaatataaatatc

SEQ ID NO: 100169 - DNA, 20 bp, Artificial Sequence
  Description of Artificial Sequence: Synthetic oligonucleotide
  Target: SCN9A; (+) strand; PAM type: YTN; PAM sequence: TTT
tcctttcaatataaatatct

SEQ ID NO: 100170 - DNA, 20 bp, Artificial Sequence
  Description of Artificial Sequence: Synthetic oligonucleotide
  Target: SCN9A; (+) strand; PAM type: YTN; PAM sequence: TTT
cctttcaatataaatatctt

SEQ ID NO: 100171 - DNA, 20 bp, Artificial Sequence
  Description of Artificial Sequence: Synthetic oligonucleotide
  Target: SCN9A; (+) strand; PAM type: YTN; PAM sequence: TTC
ctttcaatataaatatcttc

SEQ ID NO: 100172 - DNA, 20 bp, Artificial Sequence
  Description of Artificial Sequence: Synthetic oligonucleotide
  Target: SCN9A; (+) strand; PAM type: YTN; PAM sequence: CTT
tcaatataaatatcttcaaa

SEQ ID NO: 100173 - DNA, 20 bp, Artificial Sequence
  Description of Artificial Sequence: Synthetic oligonucleotide
  Target: SCN9A; (+) strand; PAM type: YTN; PAM sequence: TTT
caatataaatatcttcaaaa

SEQ ID NO: 100174 - DNA, 20 bp, Artificial Sequence
  Description of Artificial Sequence: Synthetic oligonucleotide
  Target: SCN9A; (+) strand; PAM type: YTN; PAM sequence: TTC
aatataaatatcttcaaaag

SEQ ID NO: 100175 - DNA, 20 bp, Artificial Sequence
  Description of Artificial Sequence: Synthetic oligonucleotide
  Target: SCN9A; (+) strand; PAM type: YTN; PAM sequence: CTT
caaaagcctgtggaaataat

SEQ ID NO: 100176 - DNA, 20 bp, Artificial Sequence
  Description of Artificial Sequence: Synthetic oligonucleotide
  Target: SCN9A; (+) strand; PAM type: YTN; PAM sequence: TTC
aaaagcctgtggaaataata

SEQ ID NO: 100177 - DNA, 20 bp, Artificial Sequence
  Description of Artificial Sequence: Synthetic oligonucleotide
  Target: SCN9A; (+) strand; PAM type: YTN; PAM sequence: CTG
tggaaataatattcaagttt

SEQ ID NO: 100178 - DNA, 20 bp, Artificial Sequence
  Description of Artificial Sequence: Synthetic oligonucleotide
  Target: SCN9A; (+) strand; PAM type: YTN; PAM sequence: TTC
aagtttcaatcatgcacaac

SEQ ID NO: 100179 - DNA, 20 bp, Artificial Sequence
  Description of Artificial Sequence: Synthetic oligonucleotide
  Target: SCN9A; (+) strand; PAM type: YTN; PAM sequence: TTT
caatcatgcacaacttaagc

SEQ ID NO: 100180 - DNA, 20 bp, Artificial Sequence
  Description of Artificial Sequence: Synthetic oligonucleotide
  Target: SCN9A; (+) strand; PAM type: YTN; PAM sequence: TTC
aatcatgcacaacttaagct

SEQ ID NO: 100181 - DNA, 20 bp, Artificial Sequence
  Description of Artificial Sequence: Synthetic oligonucleotide
  Target: SCN9A; (+) strand; PAM type: YTN; PAM sequence: CTT
aagcttcatgattcatttaa

SEQ ID NO: 100182 - DNA, 20 bp, Artificial Sequence
  Description of Artificial Sequence: Synthetic oligonucleotide
  Target: SCN9A; (+) strand; PAM type: YTN; PAM sequence: TTA
agcttcatgattcatttaaa

SEQ ID NO: 100183 - DNA, 20 bp, Artificial Sequence
  Description of Artificial Sequence: Synthetic oligonucleotide
  Target: SCN9A; (+) strand; PAM type: YTN; PAM sequence: CTT
catgattcatttaaaaaaaa

SEQ ID NO: 100184 - DNA, 20 bp, Artificial Sequence
  Description of Artificial Sequence: Synthetic oligonucleotide
  Target: SCN9A; (+) strand; PAM type: YTN; PAM sequence: TTC
atgattcatttaaaaaaaac

SEQ ID NO: 100185 - DNA, 20 bp, Artificial Sequence
  Description of Artificial Sequence: Synthetic oligonucleotide
  Target: SCN9A; (+) strand; PAM type: YTN; PAM sequence: TTC
atttaaaaaaaacaggaaaa

SEQ ID NO: 100186 - DNA, 20 bp, Artificial Sequence
  Description of Artificial Sequence: Synthetic oligonucleotide
  Target: SCN9A; (+) strand; PAM type: YTN; PAM sequence: TTT
aaaaaaaacaggaaaaatac

SEQ ID NO: 100187 - DNA, 20 bp, Artificial Sequence
  Description of Artificial Sequence: Synthetic oligonucleotide
  Target: SCN9A; (+) strand; PAM type: YTN; PAM sequence: TTA
aaaaaaacaggaaaaataca

SEQ ID NO: 100188 - DNA, 20 bp, Artificial Sequence
  Description of Artificial Sequence: Synthetic oligonucleotide
  Target: SCN9A; (+) strand; PAM type: YTN; PAM sequence: TTC
taatgctaagactgctgaaa

SEQ ID NO: 100189 - DNA, 20 bp, Artificial Sequence
  Description of Artificial Sequence: Synthetic oligonucleotide
  Target: SCN9A; (+) strand; PAM type: YTN; PAM sequence: CTA
atgctaagactgctgaaaca

SEQ ID NO: 100190 - DNA, 20 bp, Artificial Sequence
  Description of Artificial Sequence: Synthetic oligonucleotide
  Target: SCN9A; (+) strand; PAM type: YTN; PAM sequence: CTA
agactgctgaaacataatat

SEQ ID NO: 100191 - DNA, 20 bp, Artificial Sequence
  Description of Artificial Sequence: Synthetic oligonucleotide
  Target: SCN9A; (+) strand; PAM type: YTN; PAM sequence: CTG
ctgaaacataatattgacat

SEQ ID NO: 100192 - DNA, 20 bp, Artificial Sequence
  Description of Artificial Sequence: Synthetic oligonucleotide
  Target: SCN9A; (+) strand; PAM type: YTN; PAM sequence: CTG
aaacataatattgacatggg

SEQ ID NO: 100193 - DNA, 20 bp, Artificial Sequence
  Description of Artificial Sequence: Synthetic oligonucleotide
  Target: SCN9A; (+) strand; PAM type: YTN; PAM sequence: TTG
acatgggccagctgacattt

SEQ ID NO: 100194 - DNA, 20 bp, Artificial Sequence
  Description of Artificial Sequence: Synthetic oligonucleotide
  Target: SCN9A; (+) strand; PAM type: YTN; PAM sequence: CTG
acattttttctggtttacag

SEQ ID NO: 100195 - DNA, 20 bp, Artificial Sequence
  Description of Artificial Sequence: Synthetic oligonucleotide
  Target: SCN9A; (+) strand; PAM type: YTN; PAM sequence: TTT
tttctggtttacagttatca

SEQ ID NO: 100196 - DNA, 20 bp, Artificial Sequence
  Description of Artificial Sequence: Synthetic oligonucleotide
  Target: SCN9A; (+) strand; PAM type: YTN; PAM sequence: TTT
ttctggtttacagttatcat

SEQ ID NO: 100197 - DNA, 20 bp, Artificial Sequence
  Description of Artificial Sequence: Synthetic oligonucleotide
  Target: SCN9A; (+) strand; PAM type: YTN; PAM sequence: TTT
tctggtttacagttatcata

SEQ ID NO: 100198 - DNA, 20 bp, Artificial Sequence
  Description of Artificial Sequence: Synthetic oligonucleotide
  Target: SCN9A; (+) strand; PAM type: YTN; PAM sequence: TTT
ctggtttacagttatcatat

SEQ ID NO: 100199 - DNA, 20 bp, Artificial Sequence
  Description of Artificial Sequence: Synthetic oligonucleotide
  Target: SCN9A; (+) strand; PAM type: YTN; PAM sequence: TTC
tggtttacagttatcatata

SEQ ID NO: 100200 - DNA, 20 bp, Artificial Sequence
  Description of Artificial Sequence: Synthetic oligonucleotide
  Target: SCN9A; (+) strand; PAM type: YTN; PAM sequence: CTG
gtttacagttatcatataac

SEQ ID NO: 100201 - DNA, 20 bp, Artificial Sequence
  Description of Artificial Sequence: Synthetic oligonucleotide
  Target: SCN9A; (+) strand; PAM type: YTN; PAM sequence: TTT
acagttatcatataacagtt

SEQ ID NO: 100202 - DNA, 20 bp, Artificial Sequence
  Description of Artificial Sequence: Synthetic oligonucleotide
  Target: SCN9A; (+) strand; PAM type: YTN; PAM sequence: TTA
cagttatcatataacagtta

SEQ ID NO: 100203 - DNA, 20 bp, Artificial Sequence
  Description of Artificial Sequence: Synthetic oligonucleotide
  Target: SCN9A; (+) strand; PAM type: YTN; PAM sequence: TTA
tcatataacagttagttcta

SEQ ID NO: 100204 - DNA, 20 bp, Artificial Sequence
  Description of Artificial Sequence: Synthetic oligonucleotide
  Target: SCN9A; (+) strand; PAM type: YTN; PAM sequence: TTA
gttctagccttctcaccagt

SEQ ID NO: 100205 - DNA, 20 bp, Artificial Sequence
  Description of Artificial Sequence: Synthetic oligonucleotide
  Target: SCN9A; (+) strand; PAM type: YTN; PAM sequence: TTC
tagccttctcaccagtgctg

SEQ ID NO: 100206 - DNA, 20 bp, Artificial Sequence
  Description of Artificial Sequence: Synthetic oligonucleotide
  Target: SCN9A; (+) strand; PAM type: YTN; PAM sequence: CTA
gccttctcaccagtgctgct

SEQ ID NO: 100207 - DNA, 20 bp, Artificial Sequence
  Description of Artificial Sequence: Synthetic oligonucleotide
  Target: SCN9A; (+) strand; PAM type: YTN; PAM sequence: CTT
ctcaccagtgctgctgctgg

SEQ ID NO: 100208 - DNA, 20 bp, Artificial Sequence
  Description of Artificial Sequence: Synthetic oligonucleotide
  Target: SCN9A; (+) strand; PAM type: YTN; PAM sequence: TTC
tcaccagtgctgctgctggt

SEQ ID NO: 100209 - DNA, 20 bp, Artificial Sequence
  Description of Artificial Sequence: Synthetic oligonucleotide
  Target: SCN9A; (+) strand; PAM type: YTN; PAM sequence: CTC
accagtgctgctgctggtct

SEQ ID NO: 100210 - DNA, 20 bp, Artificial Sequence
  Description of Artificial Sequence: Synthetic oligonucleotide
  Target: SCN9A; (+) strand; PAM type: YTN; PAM sequence: CTG
ctgctggtcttcagaggtca

SEQ ID NO: 100211 - DNA, 20 bp, Artificial Sequence
  Description of Artificial Sequence: Synthetic oligonucleotide
  Target: SCN9A; (+) strand; PAM type: YTN; PAM sequence: CTG
ctggtcttcagaggtcaaga

SEQ ID NO: 100212 - DNA, 20 bp, Artificial Sequence
  Description of Artificial Sequence: Synthetic oligonucleotide
  Target: SCN9A; (+) strand; PAM type: YTN; PAM sequence: CTG
gtcttcagaggtcaagagaa

SEQ ID NO: 100213 - DNA, 20 bp, Artificial Sequence
  Description of Artificial Sequence: Synthetic oligonucleotide
  Target: SCN9A; (+) strand; PAM type: YTN; PAM sequence: CTT
cagaggtcaagagaaagtgc

SEQ ID NO: 100214 - DNA, 20 bp, Artificial Sequence
  Description of Artificial Sequence: Synthetic oligonucleotide
  Target: SCN9A; (+) strand; PAM type: YTN; PAM sequence: TTC
agaggtcaagagaaagtgca

SEQ ID NO: 100215 - DNA, 20 bp, Artificial Sequence
  Description of Artificial Sequence: Synthetic oligonucleotide
  Target: SCN9A; (+) strand; PAM type: YTN; PAM sequence: TTA
cttataatccacaaaaagac

SEQ ID NO: 100216 - DNA, 20 bp, Artificial Sequence
  Description of Artificial Sequence: Synthetic oligonucleotide
  Target: SCN9A; (+) strand; PAM type: YTN; PAM sequence: CTT
ataatccacaaaaagactca

SEQ ID NO: 100217 - DNA, 20 bp, Artificial Sequence
  Description of Artificial Sequence: Synthetic oligonucleotide
  Target: SCN9A; (+) strand; PAM type: YTN; PAM sequence: TTA
taatccacaaaaagactcat

SEQ ID NO: 100218 - DNA, 20 bp, Artificial Sequence
  Description of Artificial Sequence: Synthetic oligonucleotide
  Target: SCN9A; (+) strand; PAM type: YTN; PAM sequence: CTC
atgatctctgacacctgatc

SEQ ID NO: 100219 - DNA, 20 bp, Artificial Sequence
  Description of Artificial Sequence: Synthetic oligonucleotide
  Target: SCN9A; (+) strand; PAM type: YTN; PAM sequence: CTC
tgacacctgatcatttccac

SEQ ID NO: 100220 - DNA, 20 bp, Artificial Sequence
  Description of Artificial Sequence: Synthetic oligonucleotide
  Target: SCN9A; (+) strand; PAM type: YTN; PAM sequence: CTG
acacctgatcatttccacct

SEQ ID NO: 100221 - DNA, 20 bp, Artificial Sequence
  Description of Artificial Sequence: Synthetic oligonucleotide
  Target: SCN9A; (+) strand; PAM type: YTN; PAM sequence: CTG
atcatttccacctccatctg

SEQ ID NO: 100222 - DNA, 20 bp, Artificial Sequence
  Description of Artificial Sequence: Synthetic oligonucleotide
  Target: SCN9A; (+) strand; PAM type: YTN; PAM sequence: TTT
ccacctccatctgattcctc

SEQ ID NO: 100223 - DNA, 20 bp, Artificial Sequence
  Description of Artificial Sequence: Synthetic oligonucleotide
  Target: SCN9A; (+) strand; PAM type: YTN; PAM sequence: TTC
cacctccatctgattcctcc

SEQ ID NO: 100224 - DNA, 20 bp, Artificial Sequence
  Description of Artificial Sequence: Synthetic oligonucleotide
  Target: SCN9A; (+) strand; PAM type: YTN; PAM sequence: CTC
catctgattcctcctctttc

SEQ ID NO: 100225 - DNA, 20 bp, Artificial Sequence
  Description of Artificial Sequence: Synthetic oligonucleotide
  Target: SCN9A; (+) strand; PAM type: YTN; PAM sequence: CTG
attcctcctctttctccatt

SEQ ID NO: 100226 - DNA, 20 bp, Artificial Sequence
  Description of Artificial Sequence: Synthetic oligonucleotide
  Target: SCN9A; (+) strand; PAM type: YTN; PAM sequence: TTC
ctcctctttctccattaaaa

SEQ ID NO: 100227 - DNA, 20 bp, Artificial Sequence
  Description of Artificial Sequence: Synthetic oligonucleotide
  Target: SCN9A; (+) strand; PAM type: YTN; PAM sequence: CTC
ctctttctccattaaaattg

SEQ ID NO: 100228 - DNA, 20 bp, Artificial Sequence
  Description of Artificial Sequence: Synthetic oligonucleotide
  Target: SCN9A; (+) strand; PAM type: YTN; PAM sequence: CTC
tttctccattaaaattggat

SEQ ID NO: 100229 - DNA, 20 bp, Artificial Sequence
  Description of Artificial Sequence: Synthetic oligonucleotide
  Target: SCN9A; (+) strand; PAM type: YTN; PAM sequence: CTT
tctccattaaaattggataa

SEQ ID NO: 100230 - DNA, 20 bp, Artificial Sequence
  Description of Artificial Sequence: Synthetic oligonucleotide
  Target: SCN9A; (+) strand; PAM type: YTN; PAM sequence: TTT
ctccattaaaattggataag

SEQ ID NO: 100231 - DNA, 20 bp, Artificial Sequence
  Description of Artificial Sequence: Synthetic oligonucleotide
  Target: SCN9A; (+) strand; PAM type: YTN; PAM sequence: TTC
tccattaaaattggataagt

SEQ ID NO: 100232 - DNA, 20 bp, Artificial Sequence
  Description of Artificial Sequence: Synthetic oligonucleotide
  Target: SCN9A; (+) strand; PAM type: YTN; PAM sequence: CTC
cattaaaattggataagtcc

SEQ ID NO: 100233 - DNA, 20 bp, Artificial Sequence
  Description of Artificial Sequence: Synthetic oligonucleotide
  Target: SCN9A; (+) strand; PAM type: YTN; PAM sequence: TTA
aaattggataagtcctagca

SEQ ID NO: 100234 - DNA, 20 bp, Artificial Sequence
  Description of Artificial Sequence: Synthetic oligonucleotide
  Target: SCN9A; (+) strand; PAM type: YTN; PAM sequence: TTG
gataagtcctagcaatttaa

SEQ ID NO: 100235 - DNA, 20 bp, Artificial Sequence
  Description of Artificial Sequence: Synthetic oligonucleotide
  Target: SCN9A; (+) strand; PAM type: YTN; PAM sequence: CTA
gcaatttaagacatgatccc

SEQ ID NO: 100236 - DNA, 20 bp, Artificial Sequence
  Description of Artificial Sequence: Synthetic oligonucleotide
  Target: SCN9A; (+) strand; PAM type: YTN; PAM sequence: TTT
aagacatgatcccatggcca

SEQ ID NO: 100237 - DNA, 20 bp, Artificial Sequence
  Description of Artificial Sequence: Synthetic oligonucleotide
  Target: SCN9A; (+) strand; PAM type: YTN; PAM sequence: TTA
agacatgatcccatggccag

SEQ ID NO: 100238 - DNA, 20 bp, Artificial Sequence
  Description of Artificial Sequence: Synthetic oligonucleotide
  Target: SCN9A; (+) strand; PAM type: YTN; PAM sequence: CTG
ttataaacttttcacatcct

SEQ ID NO: 100239 - DNA, 20 bp, Artificial Sequence
  Description of Artificial Sequence: Synthetic oligonucleotide
  Target: SCN9A; (+) strand; PAM type: YTN; PAM sequence: TTA
taaacttttcacatcctaca

SEQ ID NO: 100240 - DNA, 20 bp, Artificial Sequence
  Description of Artificial Sequence: Synthetic oligonucleotide
  Target: SCN9A; (+) strand; PAM type: YTN; PAM sequence: CTT
ttcacatcctacactcccct

SEQ ID NO: 100241 - DNA, 20 bp, Artificial Sequence
  Description of Artificial Sequence: Synthetic oligonucleotide
  Target: SCN9A; (+) strand; PAM type: YTN; PAM sequence: TTT
tcacatcctacactcccctt

SEQ ID NO: 100242 - DNA, 20 bp, Artificial Sequence
  Description of Artificial Sequence: Synthetic oligonucleotide
  Target: SCN9A; (+) strand; PAM type: YTN; PAM sequence: TTT
cacatcctacactccccttt

SEQ ID NO: 100243 - DNA, 20 bp, Artificial Sequence
  Description of Artificial Sequence: Synthetic oligonucleotide
  Target: SCN9A; (+) strand; PAM type: YTN; PAM sequence: TTC
acatcctacactcccctttt

SEQ ID NO: 100244 - DNA, 20 bp, Artificial Sequence
  Description of Artificial Sequence: Synthetic oligonucleotide
  Target: SCN9A; (+) strand; PAM type: YTN; PAM sequence: CTA
cactcccctttttccccacc

SEQ ID NO: 100245 - DNA, 20 bp, Artificial Sequence
  Description of Artificial Sequence: Synthetic oligonucleotide
  Target: SCN9A; (+) strand; PAM type: YTN; PAM sequence: CTC
ccctttttccccaccagtag

SEQ ID NO: 100246 - DNA, 20 bp, Artificial Sequence
  Description of Artificial Sequence: Synthetic oligonucleotide
  Target: SCN9A; (+) strand; PAM type: YTN; PAM sequence: CTT
tttccccaccagtaggatgt

SEQ ID NO: 100247 - DNA, 20 bp, Artificial Sequence
  Description of Artificial Sequence: Synthetic oligonucleotide
  Target: SCN9A; (+) strand; PAM type: YTN; PAM sequence: TTT
ttccccaccagtaggatgtg

SEQ ID NO: 100248 - DNA, 20 bp, Artificial Sequence
  Description of Artificial Sequence: Synthetic oligonucleotide
  Target: SCN9A; (+) strand; PAM type: YTN; PAM sequence: TTT
tccccaccagtaggatgtgg

SEQ ID NO: 100249 - DNA, 20 bp, Artificial Sequence
  Description of Artificial Sequence: Synthetic oligonucleotide
  Target: SCN9A; (+) strand; PAM type: YTN; PAM sequence: TTT
ccccaccagtaggatgtgga

SEQ ID NO: 100250 - DNA, 20 bp, Artificial Sequence
  Description of Artificial Sequence: Synthetic oligonucleotide
  Target: SCN9A; (+) strand; PAM type: YTN; PAM sequence: TTC
cccaccagtaggatgtggag

SEQ ID NO: 100251 - DNA, 20 bp, Artificial Sequence
  Description of Artificial Sequence: Synthetic oligonucleotide
  Target: SCN9A; (+) strand; PAM type: YTN; PAM sequence: CTG
tctttcagctctcaaatgct

SEQ ID NO: 100252 - DNA, 20 bp, Artificial Sequence
  Description of Artificial Sequence: Synthetic oligonucleotide
  Target: SCN9A; (+) strand; PAM type: YTN; PAM sequence: CTT
tcagctctcaaatgcttgtg

SEQ ID NO: 100253 - DNA, 20 bp, Artificial Sequence
  Description of Artificial Sequence: Synthetic oligonucleotide
  Target: SCN9A; (+) strand; PAM type: YTN; PAM sequence: TTT
cagctctcaaatgcttgtgc

SEQ ID NO: 100254 - DNA, 20 bp, Artificial Sequence
  Description of Artificial Sequence: Synthetic oligonucleotide
  Target: SCN9A; (+) strand; PAM type: YTN; PAM sequence: TTC
agctctcaaatgcttgtgca

SEQ ID NO: 100255 - DNA, 20 bp, Artificial Sequence
  Description of Artificial Sequence: Synthetic oligonucleotide
  Target: SCN9A; (+) strand; PAM type: YTN; PAM sequence: CTC
tcaaatgcttgtgcatccca

SEQ ID NO: 100256 - DNA, 20 bp, Artificial Sequence
  Description of Artificial Sequence: Synthetic oligonucleotide
  Target: SCN9A; (+) strand; PAM type: YTN; PAM sequence: CTC
aaatgcttgtgcatcccagt

SEQ ID NO: 100257 - DNA, 20 bp, Artificial Sequence
  Description of Artificial Sequence: Synthetic oligonucleotide
  Target: SCN9A; (+) strand; PAM type: YTN; PAM sequence: CTT
gtgcatcccagtgcctagta

SEQ ID NO: 100258 - DNA, 20 bp, Artificial Sequence
  Description of Artificial Sequence: Synthetic oligonucleotide
  Target: SCN9A; (+) strand; PAM type: YTN; PAM sequence: TTG
tgcatcccagtgcctagtac

SEQ ID NO: 100259 - DNA, 20 bp, Artificial Sequence
  Description of Artificial Sequence: Synthetic oligonucleotide
  Target: SCN9A; (+) strand; PAM type: YTN; PAM sequence: CTA
gtaccatgttaataacagca

SEQ ID NO: 100260 - DNA, 20 bp, Artificial Sequence
  Description of Artificial Sequence: Synthetic oligonucleotide
  Target: SCN9A; (+) strand; PAM type: YTN; PAM sequence: TTA
ataacagcagcaggaaagga

SEQ ID NO: 100261 - DNA, 20 bp, Artificial Sequence
  Description of Artificial Sequence: Synthetic oligonucleotide
  Target: SCN9A; (+) strand; PAM type: YTN; PAM sequence: TTT
gctaaatgaatgactgcagt

SEQ ID NO: 100262 - DNA, 20 bp, Artificial Sequence
  Description of Artificial Sequence: Synthetic oligonucleotide
  Target: SCN9A; (+) strand; PAM type: YTN; PAM sequence: TTG
ctaaatgaatgactgcagta

SEQ ID NO: 100263 - DNA, 20 bp, Artificial Sequence
  Description of Artificial Sequence: Synthetic oligonucleotide
  Target: SCN9A; (+) strand; PAM type: YTN; PAM sequence: CTA
aatgaatgactgcagtagct

SEQ ID NO: 100264 - DNA, 20 bp, Artificial Sequence
  Description of Artificial Sequence: Synthetic oligonucleotide
  Target: SCN9A; (+) strand; PAM type: YTN; PAM sequence: CTG
cagtagcttaataggcctat

SEQ ID NO: 100265 - DNA, 20 bp, Artificial Sequence
  Description of Artificial Sequence: Synthetic oligonucleotide
  Target: SCN9A; (+) strand; PAM type: YTN; PAM sequence: CTT
aataggcctatagaacacag

SEQ ID NO: 100266 - DNA, 20 bp, Artificial Sequence
  Description of Artificial Sequence: Synthetic oligonucleotide
  Target: SCN9A; (+) strand; PAM type: YTN; PAM sequence: TTA
ataggcctatagaacacaga

SEQ ID NO: 100267 - DNA, 20 bp, Artificial Sequence
  Description of Artificial Sequence: Synthetic oligonucleotide
  Target: SCN9A; (+) strand; PAM type: YTN; PAM sequence: CTA
tagaacacagagggtgcttt

SEQ ID NO: 100268 - DNA, 20 bp, Artificial Sequence
  Description of Artificial Sequence: Synthetic oligonucleotide
  Target: SCN9A; (+) strand; PAM type: YTN; PAM sequence: CTT
tttcctttgactattcatcc

SEQ ID NO: 100269 - DNA, 20 bp, Artificial Sequence
  Description of Artificial Sequence: Synthetic oligonucleotide
  Target: SCN9A; (+) strand; PAM type: YTN; PAM sequence: TTT
ttcctttgactattcatcca

SEQ ID NO: 100270 - DNA, 20 bp, Artificial Sequence
  Description of Artificial Sequence: Synthetic oligonucleotide
  Target: SCN9A; (+) strand; PAM type: YTN; PAM sequence: TTT
tcctttgactattcatccat

SEQ ID NO: 100271 - DNA, 20 bp, Artificial Sequence
  Description of Artificial Sequence: Synthetic oligonucleotide
  Target: SCN9A; (+) strand; PAM type: YTN; PAM sequence: TTT
cctttgactattcatccata

SEQ ID NO: 100272 - DNA, 20 bp, Artificial Sequence
  Description of Artificial Sequence: Synthetic oligonucleotide
  Target: SCN9A; (+) strand; PAM type: YTN; PAM sequence: TTC
ctttgactattcatccatat

SEQ ID NO: 100273 - DNA, 20 bp, Artificial Sequence
  Description of Artificial Sequence: Synthetic oligonucleotide
  Target: SCN9A; (+) strand; PAM type: YTN; PAM sequence: CTT
tgactattcatccatatatt

SEQ ID NO: 100274 - DNA, 20 bp, Artificial Sequence
  Description of Artificial Sequence: Synthetic oligonucleotide
  Target: SCN9A; (+) strand; PAM type: YTN; PAM sequence: TTT
gactattcatccatatatta

SEQ ID NO: 100275 - DNA, 20 bp, Artificial Sequence
  Description of Artificial Sequence: Synthetic oligonucleotide
  Target: SCN9A; (+) strand; PAM type: YTN; PAM sequence: TTG
actattcatccatatattat

SEQ ID NO: 100276 - DNA, 20 bp, Artificial Sequence
  Description of Artificial Sequence: Synthetic oligonucleotide
  Target: SCN9A; (+) strand; PAM type: YTN; PAM sequence: CTA
ttcatccatatattatcctt

SEQ ID NO: 100277 - DNA, 20 bp, Artificial Sequence
  Description of Artificial Sequence: Synthetic oligonucleotide
  Target: SCN9A; (+) strand; PAM type: YTN; PAM sequence: TTC
atccatatattatccttcaa

SEQ ID NO: 100278 - DNA, 20 bp, Artificial Sequence
  Description of Artificial Sequence: Synthetic oligonucleotide
  Target: SCN9A; (+) strand; PAM type: YTN; PAM sequence: TTA
tccttcaaagcttcagctct

SEQ ID NO: 100279 - DNA, 20 bp, Artificial Sequence
  Description of Artificial Sequence: Synthetic oligonucleotide
  Target: SCN9A; (+) strand; PAM type: YTN; PAM sequence: CTT
caaagcttcagctctaaaaa

SEQ ID NO: 100280 - DNA, 20 bp, Artificial Sequence
  Description of Artificial Sequence: Synthetic oligonucleotide
  Target: SCN9A; (+) strand; PAM type: YTN; PAM sequence: TTC
aaagcttcagctctaaaaat

SEQ ID NO: 100281 - DNA, 20 bp, Artificial Sequence
  Description of Artificial Sequence: Synthetic oligonucleotide
  Target: SCN9A; (+) strand; PAM type: YTN; PAM sequence: CTT
cagctctaaaaatcactgtt

SEQ ID NO: 100282 - DNA, 20 bp, Artificial Sequence
  Description of Artificial Sequence: Synthetic oligonucleotide
  Target: SCN9A; (+) strand; PAM type: YTN; PAM sequence: TTC
agctctaaaaatcactgttc

SEQ ID NO: 100283 - DNA, 20 bp, Artificial Sequence
  Description of Artificial Sequence: Synthetic oligonucleotide
  Target: SCN9A; (+) strand; PAM type: YTN; PAM sequence: CTC
taaaaatcactgttctattc

SEQ ID NO: 100284 - DNA, 20 bp, Artificial Sequence
  Description of Artificial Sequence: Synthetic oligonucleotide
  Target: SCN9A; (+) strand; PAM type: YTN; PAM sequence: CTA
aaaatcactgttctattctc

SEQ ID NO: 100285 - DNA, 20 bp, Artificial Sequence
  Description of Artificial Sequence: Synthetic oligonucleotide
  Target: SCN9A; (+) strand; PAM type: YTN; PAM sequence: CTG
ttctattctctccattaatg

SEQ ID NO: 100286 - DNA, 20 bp, Artificial Sequence
  Description of Artificial Sequence: Synthetic oligonucleotide
  Target: SCN9A; (+) strand; PAM type: YTN; PAM sequence: TTC
tattctctccattaatgcgg

SEQ ID NO: 100287 - DNA, 20 bp, Artificial Sequence
  Description of Artificial Sequence: Synthetic oligonucleotide
  Target: SCN9A; (+) strand; PAM type: YTN; PAM sequence: CTA
ttctctccattaatgcggtg

SEQ ID NO: 100288 - DNA, 20 bp, Artificial Sequence
  Description of Artificial Sequence: Synthetic oligonucleotide
  Target: SCN9A; (+) strand; PAM type: YTN; PAM sequence: TTC
tctccattaatgcggtgctt

SEQ ID NO: 100289 - DNA, 20 bp, Artificial Sequence
  Description of Artificial Sequence: Synthetic oligonucleotide
  Target: SCN9A; (+) strand; PAM type: YTN; PAM sequence: CTC
tccattaatgcggtgcttcc

SEQ ID NO: 100290 - DNA, 20 bp, Artificial Sequence
  Description of Artificial Sequence: Synthetic oligonucleotide
  Target: SCN9A; (+) strand; PAM type: YTN; PAM sequence: CTC
cattaatgcggtgcttccta

SEQ ID NO: 100291 - DNA, 20 bp, Artificial Sequence
  Description of Artificial Sequence: Synthetic oligonucleotide
  Target: SCN9A; (+) strand; PAM type: YTN; PAM sequence: TTA
atgcggtgcttcctatgctt

SEQ ID NO: 100292 - DNA, 20 bp, Artificial Sequence
  Description of Artificial Sequence: Synthetic oligonucleotide
  Target: SCN9A; (+) strand; PAM type: YTN; PAM sequence: CTT
cctatgctttccaagaaatt

SEQ ID NO: 100293 - DNA, 20 bp, Artificial Sequence
  Description of Artificial Sequence: Synthetic oligonucleotide
  Target: SCN9A; (+) strand; PAM type: YTN; PAM sequence: TTC
ctatgctttccaagaaattt

SEQ ID NO: 100294 - DNA, 20 bp, Artificial Sequence
  Description of Artificial Sequence: Synthetic oligonucleotide
  Target: SCN9A; (+) strand; PAM type: YTN; PAM sequence: CTA
tgctttccaagaaattttag

SEQ ID NO: 100295 - DNA, 20 bp, Artificial Sequence
  Description of Artificial Sequence: Synthetic oligonucleotide
  Target: SCN9A; (+) strand; PAM type: YTN; PAM sequence: CTT
tccaagaaattttagtaagt

SEQ ID NO: 100296 - DNA, 20 bp, Artificial Sequence
  Description of Artificial Sequence: Synthetic oligonucleotide
  Target: SCN9A; (+) strand; PAM type: YTN; PAM sequence: TTT
ccaagaaattttagtaagtg

SEQ ID NO: 100297 - DNA, 20 bp, Artificial Sequence
  Description of Artificial Sequence: Synthetic oligonucleotide
  Target: SCN9A; (+) strand; PAM type: YTN; PAM sequence: TTC
caagaaattttagtaagtga

SEQ ID NO: 100298 - DNA, 20 bp, Artificial Sequence
  Description of Artificial Sequence: Synthetic oligonucleotide
  Target: SCN9A; (+) strand; PAM type: YTN; PAM sequence: TTT
tagtaagtgacacacaacat

SEQ ID NO: 100299 - DNA, 20 bp, Artificial Sequence
  Description of Artificial Sequence: Synthetic oligonucleotide
  Target: SCN9A; (+) strand; PAM type: YTN; PAM sequence: TTT
agtaagtgacacacaacatt

SEQ ID NO: 100300 - DNA, 20 bp, Artificial Sequence
  Description of Artificial Sequence: Synthetic oligonucleotide
  Target: SCN9A; (+) strand; PAM type: YTN; PAM sequence: TTA
gtaagtgacacacaacatta

SEQ ID NO: 100301 - DNA, 20 bp, Artificial Sequence
  Description of Artificial Sequence: Synthetic oligonucleotide
  Target: SCN9A; (+) strand; PAM type: YTN; PAM sequence: TTA
tgtgacaacattaggtgagc

SEQ ID NO: 100302 - DNA, 20 bp, Artificial Sequence
  Description of Artificial Sequence: Synthetic oligonucleotide
  Target: SCN9A; (+) strand; PAM type: YTN; PAM sequence: TTA
ggtgagctctatctaatgta

SEQ ID NO: 100303 - DNA, 20 bp, Artificial Sequence
  Description of Artificial Sequence: Synthetic oligonucleotide
  Target: SCN9A; (+) strand; PAM type: YTN; PAM sequence: CTC
tatctaatgtagggcttacg

SEQ ID NO: 100304 - DNA, 20 bp, Artificial Sequence
  Description of Artificial Sequence: Synthetic oligonucleotide
  Target: SCN9A; (+) strand; PAM type: YTN; PAM sequence: CTA
tctaatgtagggcttacgct

SEQ ID NO: 100305 - DNA, 20 bp, Artificial Sequence
  Description of Artificial Sequence: Synthetic oligonucleotide
  Target: SCN9A; (+) strand; PAM type: YTN; PAM sequence: CTA
atgtagggcttacgctttac

SEQ ID NO: 100306 - DNA, 20 bp, Artificial Sequence
  Description of Artificial Sequence: Synthetic oligonucleotide
  Target: SCN9A; (+) strand; PAM type: YTN; PAM sequence: CTT
acgctttactgttactaatt

SEQ ID NO: 100307 - DNA, 20 bp, Artificial Sequence
  Description of Artificial Sequence: Synthetic oligonucleotide
  Target: SCN9A; (+) strand; PAM type: YTN; PAM sequence: TTA
cgctttactgttactaattt

SEQ ID NO: 100308 - DNA, 20 bp, Artificial Sequence
  Description of Artificial Sequence: Synthetic oligonucleotide
  Target: SCN9A; (+) strand; PAM type: YTN; PAM sequence: CTT
tactgttactaattttggtt

SEQ ID NO: 100309 - DNA, 20 bp, Artificial Sequence
  Description of Artificial Sequence: Synthetic oligonucleotide
  Target: SCN9A; (+) strand; PAM type: YTN; PAM sequence: TTT
actgttactaattttggtta

SEQ ID NO: 100310 - DNA, 20 bp, Artificial Sequence
  Description of Artificial Sequence: Synthetic oligonucleotide
  Target: SCN9A; (+) strand; PAM type: YTN; PAM sequence: TTA
ctgttactaattttggttat

SEQ ID NO: 100311 - DNA, 20 bp, Artificial Sequence
  Description of Artificial Sequence: Synthetic oligonucleotide
  Target: SCN9A; (+) strand; PAM type: YTN; PAM sequence: CTG
ttactaattttggttatcac

SEQ ID NO: 100312 - DNA, 20 bp, Artificial Sequence
  Description of Artificial Sequence: Synthetic oligonucleotide
  Target: SCN9A; (+) strand; PAM type: YTN; PAM sequence: TTA
ctaattttggttatcactca

SEQ ID NO: 100313 - DNA, 20 bp, Artificial Sequence
  Description of Artificial Sequence: Synthetic oligonucleotide
  Target: SCN9A; (+) strand; PAM type: YTN; PAM sequence: CTA
attttggttatcactcattt

SEQ ID NO: 100314 - DNA, 20 bp, Artificial Sequence
  Description of Artificial Sequence: Synthetic oligonucleotide
  Target: SCN9A; (+) strand; PAM type: YTN; PAM sequence: TTT
tggttatcactcatttactc

SEQ ID NO: 100315 - DNA, 20 bp, Artificial Sequence
  Description of Artificial Sequence: Synthetic oligonucleotide
  Target: SCN9A; (+) strand; PAM type: YTN; PAM sequence: TTT
ggttatcactcatttactcc

SEQ ID NO: 100316 - DNA, 20 bp, Artificial Sequence
  Description of Artificial Sequence: Synthetic oligonucleotide
  Target: SCN9A; (+) strand; PAM type: YTN; PAM sequence: TTG
gttatcactcatttactcct

SEQ ID NO: 100317 - DNA, 20 bp, Artificial Sequence
  Description of Artificial Sequence: Synthetic oligonucleotide
  Target: SCN9A; (+) strand; PAM type: YTN; PAM sequence: TTA
tcactcatttactcctattt

SEQ ID NO: 100318 - DNA, 20 bp, Artificial Sequence
  Description of Artificial Sequence: Synthetic oligonucleotide
  Target: SCN9A; (+) strand; PAM type: YTN; PAM sequence: CTC
atttactcctattttgtgta

SEQ ID NO: 100319 - DNA, 20 bp, Artificial Sequence
  Description of Artificial Sequence: Synthetic oligonucleotide
  Target: SCN9A; (+) strand; PAM type: YTN; PAM sequence: TTT
actcctattttgtgtatgct

SEQ ID NO: 100320 - DNA, 20 bp, Artificial Sequence
  Description of Artificial Sequence: Synthetic oligonucleotide
  Target: SCN9A; (+) strand; PAM type: YTN; PAM sequence: TTA
ctcctattttgtgtatgctc

SEQ ID NO: 100321 - DNA, 20 bp, Artificial Sequence
  Description of Artificial Sequence: Synthetic oligonucleotide
  Target: SCN9A; (+) strand; PAM type: YTN; PAM sequence: CTC
ctattttgtgtatgctcttc

SEQ ID NO: 100322 - DNA, 20 bp, Artificial Sequence
  Description of Artificial Sequence: Synthetic oligonucleotide
  Target: SCN9A; (+) strand; PAM type: YTN; PAM sequence: CTA
ttttgtgtatgctcttctgt

SEQ ID NO: 100323 - DNA, 20 bp, Artificial Sequence
  Description of Artificial Sequence: Synthetic oligonucleotide
  Target: SCN9A; (+) strand; PAM type: YTN; PAM sequence: TTT
tgtgtatgctcttctgtctg

SEQ ID NO: 100324 - DNA, 20 bp, Artificial Sequence
  Description of Artificial Sequence: Synthetic oligonucleotide
  Target: SCN9A; (+) strand; PAM type: YTN; PAM sequence: TTT
gtgtatgctcttctgtctga

SEQ ID NO: 100325 - DNA, 20 bp, Artificial Sequence
  Description of Artificial Sequence: Synthetic oligonucleotide
  Target: SCN9A; (+) strand; PAM type: YTN; PAM sequence: TTG
tgtatgctcttctgtctgag

SEQ ID NO: 100326 - DNA, 20 bp, Artificial Sequence
  Description of Artificial Sequence: Synthetic oligonucleotide
  Target: SCN9A; (+) strand; PAM type: YTN; PAM sequence: CTC
ttctgtctgaggagccacaa

SEQ ID NO: 100327 - DNA, 20 bp, Artificial Sequence
  Description of Artificial Sequence: Synthetic oligonucleotide
  Target: SCN9A; (+) strand; PAM type: YTN; PAM sequence: CTT
ctgtctgaggagccacaaca

SEQ ID NO: 100328 - DNA, 20 bp, Artificial Sequence
  Description of Artificial Sequence: Synthetic oligonucleotide
  Target: SCN9A; (+) strand; PAM type: YTN; PAM sequence: TTC
tgtctgaggagccacaacac

SEQ ID NO: 100329 - DNA, 20 bp, Artificial Sequence
  Description of Artificial Sequence: Synthetic oligonucleotide
  Target: SCN9A; (+) strand; PAM type: YTN; PAM sequence: CTG
tctgaggagccacaacacag

SEQ ID NO: 100330 - DNA, 20 bp, Artificial Sequence
  Description of Artificial Sequence: Synthetic oligonucleotide
  Target: SCN9A; (+) strand; PAM type: YTN; PAM sequence: CTG
aggagccacaacacagtgaa

SEQ ID NO: 100331 - DNA, 20 bp, Artificial Sequence
  Description of Artificial Sequence: Synthetic oligonucleotide
  Target: SCN9A; (+) strand; PAM type: YTN; PAM sequence: CTT
tgactttagacttcagccac

SEQ ID NO: 100332 - DNA, 20 bp, Artificial Sequence
  Description of Artificial Sequence: Synthetic oligonucleotide
  Target: SCN9A; (+) strand; PAM type: YTN; PAM sequence: TTT
gactttagacttcagccaca

SEQ ID NO: 100333 - DNA, 20 bp, Artificial Sequence
  Description of Artificial Sequence: Synthetic oligonucleotide
  Target: SCN9A; (+) strand; PAM type: YTN; PAM sequence: TTG
actttagacttcagccacat

SEQ ID NO: 100334 - DNA, 20 bp, Artificial Sequence
  Description of Artificial Sequence: Synthetic oligonucleotide
  Target: SCN9A; (+) strand; PAM type: YTN; PAM sequence: CTT
tagacttcagccacatgtcc

SEQ ID NO: 100335 - DNA, 20 bp, Artificial Sequence
  Description of Artificial Sequence: Synthetic oligonucleotide
  Target: SCN9A; (+) strand; PAM type: YTN; PAM sequence: TTT
agacttcagccacatgtccc

SEQ ID NO: 100336 - DNA, 20 bp, Artificial Sequence
  Description of Artificial Sequence: Synthetic oligonucleotide
  Target: SCN9A; (+) strand; PAM type: YTN; PAM sequence: TTA
gacttcagccacatgtccct

SEQ ID NO: 100337 - DNA, 20 bp, Artificial Sequence
  Description of Artificial Sequence: Synthetic oligonucleotide
  Target: SCN9A; (+) strand; PAM type: YTN; PAM sequence: CTT
cagccacatgtcccttgaca

SEQ ID NO: 100338 - DNA, 20 bp, Artificial Sequence
  Description of Artificial Sequence: Synthetic oligonucleotide
  Target: SCN9A; (+) strand; PAM type: YTN; PAM sequence: TTC
agccacatgtcccttgacaa

SEQ ID NO: 100339 - DNA, 20 bp, Artificial Sequence
  Description of Artificial Sequence: Synthetic oligonucleotide
  Target: SCN9A; (+) strand; PAM type: YTN; PAM sequence: CTT
gacaaagaatttgaaaggac

SEQ ID NO: 100340 - DNA, 20 bp, Artificial Sequence
  Description of Artificial Sequence: Synthetic oligonucleotide
  Target: SCN9A; (+) strand; PAM type: YTN; PAM sequence: TTG
acaaagaatttgaaaggact

SEQ ID NO: 100341 - DNA, 20 bp, Artificial Sequence
  Description of Artificial Sequence: Synthetic oligonucleotide
  Target: SCN9A; (+) strand; PAM type: YTN; PAM sequence: TTT
gaaaggactgaaaaattggg

SEQ ID NO: 100342 - DNA, 20 bp, Artificial Sequence
  Description of Artificial Sequence: Synthetic oligonucleotide
  Target: SCN9A; (+) strand; PAM type: YTN; PAM sequence: TTG
aaaggactgaaaaattgggc

SEQ ID NO: 100343 - DNA, 20 bp, Artificial Sequence
  Description of Artificial Sequence: Synthetic oligonucleotide
  Target: SCN9A; (+) strand; PAM type: YTN; PAM sequence: CTG
aaaaattgggctcattgttg

SEQ ID NO: 100344 - DNA, 20 bp, Artificial Sequence
  Description of Artificial Sequence: Synthetic oligonucleotide
  Target: SCN9A; (+) strand; PAM type: YTN; PAM sequence: TTG
ggctcattgttgcagtgagc

SEQ ID NO: 100345 - DNA, 20 bp, Artificial Sequence
  Description of Artificial Sequence: Synthetic oligonucleotide
  Target: SCN9A; (+) strand; PAM type: YTN; PAM sequence: CTC
attgttgcagtgagccaaga

SEQ ID NO: 100346 - DNA, 20 bp, Artificial Sequence
  Description of Artificial Sequence: Synthetic oligonucleotide
  Target: SCN9A; (+) strand; PAM type: YTN; PAM sequence: TTG
ttgcagtgagccaagatcac

SEQ ID NO: 100347 - DNA, 20 bp, Artificial Sequence
  Description of Artificial Sequence: Synthetic oligonucleotide
  Target: SCN9A; (+) strand; PAM type: YTN; PAM sequence: TTG
cagtgagccaagatcacgcc

SEQ ID NO: 100348 - DNA, 20 bp, Artificial Sequence
  Description of Artificial Sequence: Synthetic oligonucleotide
  Target: SCN9A; (+) strand; PAM type: YTN; PAM sequence: CTG
cactccagcctgggcaacag

SEQ ID NO: 100349 - DNA, 20 bp, Artificial Sequence
  Description of Artificial Sequence: Synthetic oligonucleotide
  Target: SCN9A; (+) strand; PAM type: YTN; PAM sequence: CTC
cagcctgggcaacagagcaa

SEQ ID NO: 100350 - DNA, 20 bp, Artificial Sequence
  Description of Artificial Sequence: Synthetic oligonucleotide
  Target: SCN9A; (+) strand; PAM type: YTN; PAM sequence: CTG
ggcaacagagcaagactctg

SEQ ID NO: 100351 - DNA, 20 bp, Artificial Sequence
  Description of Artificial Sequence: Synthetic oligonucleotide
  Target: SCN9A; (+) strand; PAM type: YTN; PAM sequence: CTC
tgtctcaaaaaaaaaaaaaa

SEQ ID NO: 100352 - DNA, 20 bp, Artificial Sequence
  Description of Artificial Sequence: Synthetic oligonucleotide
  Target: SCN9A; (+) strand; PAM type: YTN; PAM sequence: CTG
tctcaaaaaaaaaaaaaaaa

SEQ ID NO: 100353 - DNA, 20 bp, Artificial Sequence
  Description of Artificial Sequence: Synthetic oligonucleotide
  Target: SCN9A; (+) strand; PAM type: YTN; PAM sequence: CTC
aaaaaaaaaaaaaaaaaaaa

SEQ ID NO: 100354 - DNA, 20 bp, Artificial Sequence
  Description of Artificial Sequence: Synthetic oligonucleotide
  Target: SCN9A; (+) strand; PAM type: YTN; PAM sequence: CTC
attgagacactgaaaatgat

SEQ ID NO: 100355 - DNA, 20 bp, Artificial Sequence
  Description of Artificial Sequence: Synthetic oligonucleotide
  Target: SCN9A; (+) strand; PAM type: YTN; PAM sequence: TTG
agacactgaaaatgattgct

SEQ ID NO: 100356 - DNA, 20 bp, Artificial Sequence
  Description of Artificial Sequence: Synthetic oligonucleotide
  Target: SCN9A; (+) strand; PAM type: YTN; PAM sequence: CTG
aaaatgattgctgatctcaa

SEQ ID NO: 100357 - DNA, 20 bp, Artificial Sequence
  Description of Artificial Sequence: Synthetic oligonucleotide
  Target: SCN9A; (+) strand; PAM type: YTN; PAM sequence: TTG
ctgatctcaacaggtctaaa

SEQ ID NO: 100358 - DNA, 20 bp, Artificial Sequence
  Description of Artificial Sequence: Synthetic oligonucleotide
  Target: SCN9A; (+) strand; PAM type: YTN; PAM sequence: CTG
atctcaacaggtctaaagtg

SEQ ID NO: 100359 - DNA, 20 bp, Artificial Sequence
  Description of Artificial Sequence: Synthetic oligonucleotide
  Target: SCN9A; (+) strand; PAM type: YTN; PAM sequence: CTC
aacaggtctaaagtgttaga

SEQ ID NO: 100360 - DNA, 20 bp, Artificial Sequence
  Description of Artificial Sequence: Synthetic oligonucleotide
  Target: SCN9A; (+) strand; PAM type: YTN; PAM sequence: CTA
aagtgttagaactttctctt

SEQ ID NO: 100361 - DNA, 20 bp, Artificial Sequence
  Description of Artificial Sequence: Synthetic oligonucleotide
  Target: SCN9A; (+) strand; PAM type: YTN; PAM sequence: TTA
gaactttctctttcagatcg

SEQ ID NO: 100362 - DNA, 20 bp, Artificial Sequence
  Description of Artificial Sequence: Synthetic oligonucleotide
  Target: SCN9A; (+) strand; PAM type: YTN; PAM sequence: CTT
tctctttcagatcgaaacac

SEQ ID NO: 100363 - DNA, 20 bp, Artificial Sequence
  Description of Artificial Sequence: Synthetic oligonucleotide
  Target: SCN9A; (+) strand; PAM type: YTN; PAM sequence: TTT
ctctttcagatcgaaacact

SEQ ID NO: 100364 - DNA, 20 bp, Artificial Sequence
  Description of Artificial Sequence: Synthetic oligonucleotide
  Target: SCN9A; (+) strand; PAM type: YTN; PAM sequence: TTC
tctttcagatcgaaacacta

SEQ ID NO: 100365 - DNA, 20 bp, Artificial Sequence
  Description of Artificial Sequence: Synthetic oligonucleotide
  Target: SCN9A; (+) strand; PAM type: YTN; PAM sequence: CTC
tttcagatcgaaacactatt

SEQ ID NO: 100366 - DNA, 20 bp, Artificial Sequence
  Description of Artificial Sequence: Synthetic oligonucleotide
  Target: SCN9A; (+) strand; PAM type: YTN; PAM sequence: CTT
tcagatcgaaacactattaa

SEQ ID NO: 100367 - DNA, 20 bp, Artificial Sequence
  Description of Artificial Sequence: Synthetic oligonucleotide
  Target: SCN9A; (+) strand; PAM type: YTN; PAM sequence: TTT
cagatcgaaacactattaac

SEQ ID NO: 100368 - DNA, 20 bp, Artificial Sequence
  Description of Artificial Sequence: Synthetic oligonucleotide
  Target: SCN9A; (+) strand; PAM type: YTN; PAM sequence: TTC
agatcgaaacactattaacc

SEQ ID NO: 100369 - DNA, 20 bp, Artificial Sequence
  Description of Artificial Sequence: Synthetic oligonucleotide
  Target: SCN9A; (+) strand; PAM type: YTN; PAM sequence: CTA
ttaaccctgttggataaaat

SEQ ID NO: 100370 - DNA, 20 bp, Artificial Sequence
  Description of Artificial Sequence: Synthetic oligonucleotide
  Target: SCN9A; (+) strand; PAM type: YTN; PAM sequence: TTA
accctgttggataaaatgaa

SEQ ID NO: 100371 - DNA, 20 bp, Artificial Sequence
  Description of Artificial Sequence: Synthetic oligonucleotide
  Target: SCN9A; (+) strand; PAM type: YTN; PAM sequence: CTG
ttggataaaatgaaagtcaa

SEQ ID NO: 100372 - DNA, 20 bp, Artificial Sequence
  Description of Artificial Sequence: Synthetic oligonucleotide
  Target: SCN9A; (+) strand; PAM type: YTN; PAM sequence: TTG
gataaaatgaaagtcaaaga

SEQ ID NO: 100373 - DNA, 20 bp, Artificial Sequence
  Description of Artificial Sequence: Synthetic oligonucleotide
  Target: SCN9A; (+) strand; PAM type: YTN; PAM sequence: CTG
tatccttcgtggttaatatt

SEQ ID NO: 100374 - DNA, 20 bp, Artificial Sequence
  Description of Artificial Sequence: Synthetic oligonucleotide
  Target: SCN9A; (+) strand; PAM type: YTN; PAM sequence: CTT
cgtggttaatattatattta

SEQ ID NO: 100375 - DNA, 20 bp, Artificial Sequence
  Description of Artificial Sequence: Synthetic oligonucleotide
  Target: SCN9A; (+) strand; PAM type: YTN; PAM sequence: TTC
gtggttaatattatatttat

SEQ ID NO: 100376 - DNA, 20 bp, Artificial Sequence
  Description of Artificial Sequence: Synthetic oligonucleotide
  Target: SCN9A; (+) strand; PAM type: YTN; PAM sequence: TTA
atattatatttattacctgt

SEQ ID NO: 100377 - DNA, 20 bp, Artificial Sequence
  Description of Artificial Sequence: Synthetic oligonucleotide
  Target: SCN9A; (+) strand; PAM type: YTN; PAM sequence: TTA
tatttattacctgtctacag

SEQ ID NO: 100378 - DNA, 20 bp, Artificial Sequence
  Description of Artificial Sequence: Synthetic oligonucleotide
  Target: SCN9A; (+) strand; PAM type: YTN; PAM sequence: TTT
attacctgtctacagtcatg

SEQ ID NO: 100379 - DNA, 20 bp, Artificial Sequence
  Description of Artificial Sequence: Synthetic oligonucleotide
  Target: SCN9A; (+) strand; PAM type: YTN; PAM sequence: TTA
ttacctgtctacagtcatga

SEQ ID NO: 100380 - DNA, 20 bp, Artificial Sequence
  Description of Artificial Sequence: Synthetic oligonucleotide
  Target: SCN9A; (+) strand; PAM type: YTN; PAM sequence: TTA
cctgtctacagtcatgaact

SEQ ID NO: 100381 - DNA, 20 bp, Artificial Sequence
  Description of Artificial Sequence: Synthetic oligonucleotide
  Target: SCN9A; (+) strand; PAM type: YTN; PAM sequence: CTG
tctacagtcatgaacttgtg

SEQ ID NO: 100382 - DNA, 20 bp, Artificial Sequence
  Description of Artificial Sequence: Synthetic oligonucleotide
  Target: SCN9A; (+) strand; PAM type: YTN; PAM sequence: CTA
cagtcatgaacttgtgccat

SEQ ID NO: 100383 - DNA, 20 bp, Artificial Sequence
  Description of Artificial Sequence: Synthetic oligonucleotide
  Target: SCN9A; (+) strand; PAM type: YTN; PAM sequence: CTT
gtgccattcagattcttctt

SEQ ID NO: 100384 - DNA, 20 bp, Artificial Sequence
  Description of Artificial Sequence: Synthetic oligonucleotide
  Target: SCN9A; (+) strand; PAM type: YTN; PAM sequence: TTG
tgccattcagattcttctta

SEQ ID NO: 100385 - DNA, 20 bp, Artificial Sequence
  Description of Artificial Sequence: Synthetic oligonucleotide
  Target: SCN9A; (+) strand; PAM type: YTN; PAM sequence: TTC
agattcttcttattctacgt

SEQ ID NO: 100386 - DNA, 20 bp, Artificial Sequence
  Description of Artificial Sequence: Synthetic oligonucleotide
  Target: SCN9A; (+) strand; PAM type: YTN; PAM sequence: TTC
ttcttattctacgttctgct

SEQ ID NO: 100387 - DNA, 20 bp, Artificial Sequence
  Description of Artificial Sequence: Synthetic oligonucleotide
  Target: SCN9A; (+) strand; PAM type: YTN; PAM sequence: CTT
cttattctacgttctgcttt

SEQ ID NO: 100388 - DNA, 20 bp, Artificial Sequence
  Description of Artificial Sequence: Synthetic oligonucleotide
  Target: SCN9A; (+) strand; PAM type: YTN; PAM sequence: TTC
ttattctacgttctgctttc

SEQ ID NO: 100389 - DNA, 20 bp, Artificial Sequence
  Description of Artificial Sequence: Synthetic oligonucleotide
  Target: SCN9A; (+) strand; PAM type: YTN; PAM sequence: CTT
attctacgttctgctttcaa

SEQ ID NO: 100390 - DNA, 20 bp, Artificial Sequence
  Description of Artificial Sequence: Synthetic oligonucleotide
  Target: SCN9A; (+) strand; PAM type: YTN; PAM sequence: TTA
ttctacgttctgctttcaat

SEQ ID NO: 100391 - DNA, 20 bp, Artificial Sequence
  Description of Artificial Sequence: Synthetic oligonucleotide
  Target: SCN9A; (+) strand; PAM type: YTN; PAM sequence: TTC
tacgttctgctttcaatact

SEQ ID NO: 100392 - DNA, 20 bp, Artificial Sequence
  Description of Artificial Sequence: Synthetic oligonucleotide
  Target: SCN9A; (+) strand; PAM type: YTN; PAM sequence: CTA
cgttctgctttcaatactct

SEQ ID NO: 100393 - DNA, 20 bp, Artificial Sequence
  Description of Artificial Sequence: Synthetic oligonucleotide
  Target: SCN9A; (+) strand; PAM type: YTN; PAM sequence: TTC
tgctttcaatactctaaaat

SEQ ID NO: 100394 - DNA, 20 bp, Artificial Sequence
  Description of Artificial Sequence: Synthetic oligonucleotide
  Target: SCN9A; (+) strand; PAM type: YTN; PAM sequence: CTG
ctttcaatactctaaaatta

SEQ ID NO: 100395 - DNA, 20 bp, Artificial Sequence
  Description of Artificial Sequence: Synthetic oligonucleotide
  Target: SCN9A; (+) strand; PAM type: YTN; PAM sequence: CTT
tcaatactctaaaattatcc

SEQ ID NO: 100396 - DNA, 20 bp, Artificial Sequence
  Description of Artificial Sequence: Synthetic oligonucleotide
  Target: SCN9A; (+) strand; PAM type: YTN; PAM sequence: TTT
caatactctaaaattatcct

SEQ ID NO: 100397 - DNA, 20 bp, Artificial Sequence
  Description of Artificial Sequence: Synthetic oligonucleotide
  Target: SCN9A; (+) strand; PAM type: YTN; PAM sequence: TTC
aatactctaaaattatcctt

SEQ ID NO: 100398 - DNA, 20 bp, Artificial Sequence
  Description of Artificial Sequence: Synthetic oligonucleotide
  Target: SCN9A; (+) strand; PAM type: YTN; PAM sequence: CTC
taaaattatccttagcagtt

SEQ ID NO: 100399 - DNA, 20 bp, Artificial Sequence
  Description of Artificial Sequence: Synthetic oligonucleotide
  Target: SCN9A; (+) strand; PAM type: YTN; PAM sequence: CTA
aaattatccttagcagtttt

SEQ ID NO: 100400 - DNA, 20 bp, Artificial Sequence
  Description of Artificial Sequence: Synthetic oligonucleotide
  Target: SCN9A; (+) strand; PAM type: YTN; PAM sequence: TTA
tccttagcagttttgggaaa

SEQ ID NO: 100401 - DNA, 20 bp, Artificial Sequence
  Description of Artificial Sequence: Synthetic oligonucleotide
  Target: SCN9A; (+) strand; PAM type: YTN; PAM sequence: CTT
agcagttttgggaaactgtt

SEQ ID NO: 100402 - DNA, 20 bp, Artificial Sequence
  Description of Artificial Sequence: Synthetic oligonucleotide
  Target: SCN9A; (+) strand; PAM type: YTN; PAM sequence: TTA
gcagttttgggaaactgttg

SEQ ID NO: 100403 - DNA, 20 bp, Artificial Sequence
  Description of Artificial Sequence: Synthetic oligonucleotide
  Target: SCN9A; (+) strand; PAM type: YTN; PAM sequence: TTT
tgggaaactgttggtatcaa

SEQ ID NO: 100404 - DNA, 20 bp, Artificial Sequence
  Description of Artificial Sequence: Synthetic oligonucleotide
  Target: SCN9A; (+) strand; PAM type: YTN; PAM sequence: TTT
gggaaactgttggtatcaat

SEQ ID NO: 100405 - DNA, 20 bp, Artificial Sequence
  Description of Artificial Sequence: Synthetic oligonucleotide
  Target: SCN9A; (+) strand; PAM type: YTN; PAM sequence: TTG
ggaaactgttggtatcaata

SEQ ID NO: 100406 - DNA, 20 bp, Artificial Sequence
  Description of Artificial Sequence: Synthetic oligonucleotide
  Target: SCN9A; (+) strand; PAM type: YTN; PAM sequence: CTG
ttggtatcaatattgaagaa

SEQ ID NO: 100407 - DNA, 20 bp, Artificial Sequence
  Description of Artificial Sequence: Synthetic oligonucleotide
  Target: SCN9A; (+) strand; PAM type: YTN; PAM sequence: TTG
gtatcaatattgaagaaaag

SEQ ID NO: 100408 - DNA, 20 bp, Artificial Sequence
  Description of Artificial Sequence: Synthetic oligonucleotide
  Target: SCN9A; (+) strand; PAM type: YTN; PAM sequence: TTG
aagaaaagagacaagttggg

SEQ ID NO: 100409 - DNA, 20 bp, Artificial Sequence
  Description of Artificial Sequence: Synthetic oligonucleotide
  Target: SCN9A; (+) strand; PAM type: YTN; PAM sequence: TTG
gggcagaaagactgaatgga

SEQ ID NO: 100410 - DNA, 20 bp, Artificial Sequence
  Description of Artificial Sequence: Synthetic oligonucleotide
  Target: SCN9A; (+) strand; PAM type: YTN; PAM sequence: CTG
aatggacctactaagatgca

SEQ ID NO: 100411 - DNA, 20 bp, Artificial Sequence
  Description of Artificial Sequence: Synthetic oligonucleotide
  Target: SCN9A; (+) strand; PAM type: YTN; PAM sequence: CTA
ctaagatgcaaaaagaaggt

SEQ ID NO: 100412 - DNA, 20 bp, Artificial Sequence
  Description of Artificial Sequence: Synthetic oligonucleotide
  Target: SCN9A; (+) strand; PAM type: YTN; PAM sequence: CTA
agatgcaaaaagaaggtccc

SEQ ID NO: 100413 - DNA, 20 bp, Artificial Sequence
  Description of Artificial Sequence: Synthetic oligonucleotide
  Target: SCN9A; (+) strand; PAM type: YTN; PAM sequence: TTG
gcagaggttctgaaattcaa

SEQ ID NO: 100414 - DNA, 20 bp, Artificial Sequence
  Description of Artificial Sequence: Synthetic oligonucleotide
  Target: SCN9A; (+) strand; PAM type: YTN; PAM sequence: TTC
tgaaattcaatggaattgaa

SEQ ID NO: 100415 - DNA, 20 bp, Artificial Sequence
  Description of Artificial Sequence: Synthetic oligonucleotide
  Target: SCN9A; (+) strand; PAM type: YTN; PAM sequence: CTG
aaattcaatggaattgaagt

SEQ ID NO: 100416 - DNA, 20 bp, Artificial Sequence
  Description of Artificial Sequence: Synthetic oligonucleotide
  Target: SCN9A; (+) strand; PAM type: YTN; PAM sequence: TTC
aatggaattgaagtgcagag

SEQ ID NO: 100417 - DNA, 20 bp, Artificial Sequence
  Description of Artificial Sequence: Synthetic oligonucleotide
  Target: SCN9A; (+) strand; PAM type: YTN; PAM sequence: TTG
aagtgcagagggaggcttct

SEQ ID NO: 100418 - DNA, 20 bp, Artificial Sequence
  Description of Artificial Sequence: Synthetic oligonucleotide
  Target: SCN9A; (+) strand; PAM type: YTN; PAM sequence: CTT
ctagccctcaggattttcct

SEQ ID NO: 100419 - DNA, 20 bp, Artificial Sequence
  Description of Artificial Sequence: Synthetic oligonucleotide
  Target: SCN9A; (+) strand; PAM type: YTN; PAM sequence: TTC
tagccctcaggattttcctc

SEQ ID NO: 100420 - DNA, 20 bp, Artificial Sequence
  Description of Artificial Sequence: Synthetic oligonucleotide
  Target: SCN9A; (+) strand; PAM type: YTN; PAM sequence: CTA
gccctcaggattttcctccc

SEQ ID NO: 100421 - DNA, 20 bp, Artificial Sequence
  Description of Artificial Sequence: Synthetic oligonucleotide
  Target: SCN9A; (+) strand; PAM type: YTN; PAM sequence: CTC
aggattttcctcccctccac

SEQ ID NO: 100422 - DNA, 20 bp, Artificial Sequence
  Description of Artificial Sequence: Synthetic oligonucleotide
  Target: SCN9A; (+) strand; PAM type: YTN; PAM sequence: TTT
tcctcccctccactccaccc

SEQ ID NO: 100423 - DNA, 20 bp, Artificial Sequence
  Description of Artificial Sequence: Synthetic oligonucleotide
  Target: SCN9A; (+) strand; PAM type: YTN; PAM sequence: TTT
cctcccctccactccacccc

SEQ ID NO: 100424 - DNA, 20 bp, Artificial Sequence
  Description of Artificial Sequence: Synthetic oligonucleotide
  Target: SCN9A; (+) strand; PAM type: YTN; PAM sequence: TTC
ctcccctccactccaccccc

SEQ ID NO: 100425 - DNA, 20 bp, Artificial Sequence
  Description of Artificial Sequence: Synthetic oligonucleotide
  Target: SCN9A; (+) strand; PAM type: YTN; PAM sequence: CTC
ccctccactccacccccaaa

SEQ ID NO: 100426 - DNA, 20 bp, Artificial Sequence
  Description of Artificial Sequence: Synthetic oligonucleotide
  Target: SCN9A; (+) strand; PAM type: YTN; PAM sequence: CTC
cactccacccccaaattctg

SEQ ID NO: 100427 - DNA, 20 bp, Artificial Sequence
  Description of Artificial Sequence: Synthetic oligonucleotide
  Target: SCN9A; (+) strand; PAM type: YTN; PAM sequence: CTC
cacccccaaattctggagga

SEQ ID NO: 100428 - DNA, 20 bp, Artificial Sequence
  Description of Artificial Sequence: Synthetic oligonucleotide
  Target: SCN9A; (+) strand; PAM type: YTN; PAM sequence: TTC
tggaggaatcaggcaagcca

SEQ ID NO: 100429 - DNA, 20 bp, Artificial Sequence
  Description of Artificial Sequence: Synthetic oligonucleotide
  Target: SCN9A; (+) strand; PAM type: YTN; PAM sequence: CTG
gaggaatcaggcaagccatc

SEQ ID NO: 100430 - DNA, 20 bp, Artificial Sequence
  Description of Artificial Sequence: Synthetic oligonucleotide
  Target: SCN9A; (+) strand; PAM type: YTN; PAM sequence: CTA
aaccgaaactatggcaatga

SEQ ID NO: 100431 - DNA, 20 bp, Artificial Sequence
  Description of Artificial Sequence: Synthetic oligonucleotide
  Target: SCN9A; (+) strand; PAM type: YTN; PAM sequence: CTA
tggcaatgactcagtccttg

SEQ ID NO: 100432 - DNA, 20 bp, Artificial Sequence
  Description of Artificial Sequence: Synthetic oligonucleotide
  Target: SCN9A; (+) strand; PAM type: YTN; PAM sequence: CTC
agtccttgaaatacaaagac

SEQ ID NO: 100433 - DNA, 20 bp, Artificial Sequence
  Description of Artificial Sequence: Synthetic oligonucleotide
  Target: SCN9A; (+) strand; PAM type: YTN; PAM sequence: CTT
gaaatacaaagacaaggaag

SEQ ID NO: 100434 - DNA, 20 bp, Artificial Sequence
  Description of Artificial Sequence: Synthetic oligonucleotide
  Target: SCN9A; (+) strand; PAM type: YTN; PAM sequence: TTG
aaatacaaagacaaggaagg

SEQ ID NO: 100435 - DNA, 20 bp, Artificial Sequence
  Description of Artificial Sequence: Synthetic oligonucleotide
  Target: SCN9A; (+) strand; PAM type: YTN; PAM sequence: CTT
agtcacaaggaaaacgaagc

SEQ ID NO: 100436 - DNA, 20 bp, Artificial Sequence
  Description of Artificial Sequence: Synthetic oligonucleotide
  Target: SCN9A; (+) strand; PAM type: YTN; PAM sequence: TTA
gtcacaaggaaaacgaagcc

SEQ ID NO: 100437 - DNA, 20 bp, Artificial Sequence
  Description of Artificial Sequence: Synthetic oligonucleotide
  Target: SCN9A; (+) strand; PAM type: YTN; PAM sequence: CTG
tttctagaactggtgtacag

SEQ ID NO: 100438 - DNA, 20 bp, Artificial Sequence
  Description of Artificial Sequence: Synthetic oligonucleotide
  Target: SCN9A; (+) strand; PAM type: YTN; PAM sequence: TTT
ctagaactggtgtacagggt

SEQ ID NO: 100439 - DNA, 20 bp, Artificial Sequence
  Description of Artificial Sequence: Synthetic oligonucleotide
  Target: SCN9A; (+) strand; PAM type: YTN; PAM sequence: TTC
tagaactggtgtacagggtc

SEQ ID NO: 100440 - DNA, 20 bp, Artificial Sequence
  Description of Artificial Sequence: Synthetic oligonucleotide
  Target: SCN9A; (+) strand; PAM type: YTN; PAM sequence: CTA
gaactggtgtacagggtcag

SEQ ID NO: 100441 - DNA, 20 bp, Artificial Sequence
  Description of Artificial Sequence: Synthetic oligonucleotide
  Target: SCN9A; (+) strand; PAM type: YTN; PAM sequence: CTG
gtgtacagggtcagagcaga

SEQ ID NO: 100442 - DNA, 20 bp, Artificial Sequence
  Description of Artificial Sequence: Synthetic oligonucleotide
  Target: SCN9A; (+) strand; PAM type: YTN; PAM sequence: CTT
gatgatgagaacctctctct

SEQ ID NO: 100443 - DNA, 20 bp, Artificial Sequence
  Description of Artificial Sequence: Synthetic oligonucleotide
  Target: SCN9A; (+) strand; PAM type: YTN; PAM sequence: TTG
atgatgagaacctctctctg

SEQ ID NO: 100444 - DNA, 20 bp, Artificial Sequence
  Description of Artificial Sequence: Synthetic oligonucleotide
  Target: SCN9A; (+) strand; PAM type: YTN; PAM sequence: CTC
tctctgactggtcccagagc

SEQ ID NO: 100445 - DNA, 20 bp, Artificial Sequence
  Description of Artificial Sequence: Synthetic oligonucleotide
  Target: SCN9A; (+) strand; PAM type: YTN; PAM sequence: CTC
tctgactggtcccagagcag

SEQ ID NO: 100446 - DNA, 20 bp, Artificial Sequence
  Description of Artificial Sequence: Synthetic oligonucleotide
  Target: SCN9A; (+) strand; PAM type: YTN; PAM sequence: CTC
tgactggtcccagagcagga

SEQ ID NO: 100447 - DNA, 20 bp, Artificial Sequence
  Description of Artificial Sequence: Synthetic oligonucleotide
  Target: SCN9A; (+) strand; PAM type: YTN; PAM sequence: CTG
actggtcccagagcaggaat

SEQ ID NO: 100448 - DNA, 20 bp, Artificial Sequence
  Description of Artificial Sequence: Synthetic oligonucleotide
  Target: SCN9A; (+) strand; PAM type: YTN; PAM sequence: CTG
gtcccagagcaggaattaga

SEQ ID NO: 100449 - DNA, 20 bp, Artificial Sequence
  Description of Artificial Sequence: Synthetic oligonucleotide
  Target: SCN9A; (+) strand; PAM type: YTN; PAM sequence: TTA
gaattcagcccacaggggtt

SEQ ID NO: 100450 - DNA, 20 bp, Artificial Sequence
  Description of Artificial Sequence: Synthetic oligonucleotide
  Target: SCN9A; (+) strand; PAM type: YTN; PAM sequence: TTC
agcccacaggggttctagct

SEQ ID NO: 100451 - DNA, 20 bp, Artificial Sequence
  Description of Artificial Sequence: Synthetic oligonucleotide
  Target: SCN9A; (+) strand; PAM type: YTN; PAM sequence: TTC
tagcttccagaaccaatttt

SEQ ID NO: 100452 - DNA, 20 bp, Artificial Sequence
  Description of Artificial Sequence: Synthetic oligonucleotide
  Target: SCN9A; (+) strand; PAM type: YTN; PAM sequence: CTA
gcttccagaaccaattttgt

SEQ ID NO: 100453 - DNA, 20 bp, Artificial Sequence
  Description of Artificial Sequence: Synthetic oligonucleotide
  Target: SCN9A; (+) strand; PAM type: YTN; PAM sequence: CTT
ccagaaccaattttgtggat

SEQ ID NO: 100454 - DNA, 20 bp, Artificial Sequence
  Description of Artificial Sequence: Synthetic oligonucleotide
  Target: SCN9A; (+) strand; PAM type: YTN; PAM sequence: TTC
cagaaccaattttgtggatg

SEQ ID NO: 100455 - DNA, 20 bp, Artificial Sequence
  Description of Artificial Sequence: Synthetic oligonucleotide
  Target: SCN9A; (+) strand; PAM type: YTN; PAM sequence: TTT
tgtggatgtaggagcaagga

SEQ ID NO: 100456 - DNA, 20 bp, Artificial Sequence
  Description of Artificial Sequence: Synthetic oligonucleotide
  Target: SCN9A; (+) strand; PAM type: YTN; PAM sequence: TTT
gtggatgtaggagcaaggag

SEQ ID NO: 100457 - DNA, 20 bp, Artificial Sequence
  Description of Artificial Sequence: Synthetic oligonucleotide
  Target: SCN9A; (+) strand; PAM type: YTN; PAM sequence: TTG
tggatgtaggagcaaggagg

SEQ ID NO: 100458 - DNA, 20 bp, Artificial Sequence
  Description of Artificial Sequence: Synthetic oligonucleotide
  Target: SCN9A; (+) strand; PAM type: YTN; PAM sequence: CTT
atgtgagctctatctgattt

SEQ ID NO: 100459 - DNA, 20 bp, Artificial Sequence
  Description of Artificial Sequence: Synthetic oligonucleotide
  Target: SCN9A; (+) strand; PAM type: YTN; PAM sequence: TTA
tgtgagctctatctgattta

SEQ ID NO: 100460 - DNA, 20 bp, Artificial Sequence
  Description of Artificial Sequence: Synthetic oligonucleotide
  Target: SCN9A; (+) strand; PAM type: YTN; PAM sequence: CTC
tatctgatttaggacttaac

SEQ ID NO: 100461 - DNA, 20 bp, Artificial Sequence
  Description of Artificial Sequence: Synthetic oligonucleotide
  Target: SCN9A; (+) strand; PAM type: YTN; PAM sequence: CTA
tctgatttaggacttaacgc

SEQ ID NO: 100462 - DNA, 20 bp, Artificial Sequence
  Description of Artificial Sequence: Synthetic oligonucleotide
  Target: SCN9A; (+) strand; PAM type: YTN; PAM sequence: CTG
atttaggacttaacgcttta

SEQ ID NO: 100463 - DNA, 20 bp, Artificial Sequence
  Description of Artificial Sequence: Synthetic oligonucleotide
  Target: SCN9A; (+) strand; PAM type: YTN; PAM sequence: TTT
aggacttaacgctttactgt

SEQ ID NO: 100464 - DNA, 20 bp, Artificial Sequence
  Description of Artificial Sequence: Synthetic oligonucleotide
  Target: SCN9A; (+) strand; PAM type: YTN; PAM sequence: TTA
ggacttaacgctttactgtt

SEQ ID NO: 100465 - DNA, 20 bp, Artificial Sequence
  Description of Artificial Sequence: Synthetic oligonucleotide
  Target: SCN9A; (+) strand; PAM type: YTN; PAM sequence: CTT
aacgctttactgttactaaa

SEQ ID NO: 100466 - DNA, 20 bp, Artificial Sequence
  Description of Artificial Sequence: Synthetic oligonucleotide
  Target: SCN9A; (+) strand; PAM type: YTN; PAM sequence: TTA
acgctttactgttactaaat

SEQ ID NO: 100467 - DNA, 20 bp, Artificial Sequence
  Description of Artificial Sequence: Synthetic oligonucleotide
  Target: SCN9A; (+) strand; PAM type: YTN; PAM sequence: CTT
tactgttactaaattcagtt

SEQ ID NO: 100468 - DNA, 20 bp, Artificial Sequence
  Description of Artificial Sequence: Synthetic oligonucleotide
  Target: SCN9A; (+) strand; PAM type: YTN; PAM sequence: TTT
actgttactaaattcagtta

SEQ ID NO: 100469 - DNA, 20 bp, Artificial Sequence
  Description of Artificial Sequence: Synthetic oligonucleotide
  Target: SCN9A; (+) strand; PAM type: YTN; PAM sequence: TTA
ctgttactaaattcagttac

SEQ ID NO: 100470 - DNA, 20 bp, Artificial Sequence
  Description of Artificial Sequence: Synthetic oligonucleotide
  Target: SCN9A; (+) strand; PAM type: YTN; PAM sequence: CTG
ttactaaattcagttaccac

SEQ ID NO: 100471 - DNA, 20 bp, Artificial Sequence
  Description of Artificial Sequence: Synthetic oligonucleotide
  Target: SCN9A; (+) strand; PAM type: YTN; PAM sequence: TTA
ctaaattcagttaccactca

SEQ ID NO: 100472 - DNA, 20 bp, Artificial Sequence
  Description of Artificial Sequence: Synthetic oligonucleotide
  Target: SCN9A; (+) strand; PAM type: YTN; PAM sequence: CTA
aattcagttaccactcattt

SEQ ID NO: 100473 - DNA, 20 bp, Artificial Sequence
  Description of Artificial Sequence: Synthetic oligonucleotide
  Target: SCN9A; (+) strand; PAM type: YTN; PAM sequence: TTC
agttaccactcatttatttc

SEQ ID NO: 100474 - DNA, 20 bp, Artificial Sequence
  Description of Artificial Sequence: Synthetic oligonucleotide
  Target: SCN9A; (+) strand; PAM type: YTN; PAM sequence: TTA
ccactcatttatttctgttt

SEQ ID NO: 100475 - DNA, 20 bp, Artificial Sequence
  Description of Artificial Sequence: Synthetic oligonucleotide
  Target: SCN9A; (+) strand; PAM type: YTN; PAM sequence: CTC
atttatttctgttttgtgta

SEQ ID NO: 100476 - DNA, 20 bp, Artificial Sequence
  Description of Artificial Sequence: Synthetic oligonucleotide
  Target: SCN9A; (+) strand; PAM type: YTN; PAM sequence: TTT
atttctgttttgtgtatact

SEQ ID NO: 100477 - DNA, 20 bp, Artificial Sequence
  Description of Artificial Sequence: Synthetic oligonucleotide
  Target: SCN9A; (+) strand; PAM type: YTN; PAM sequence: TTA
tttctgttttgtgtatactc

SEQ ID NO: 100478 - DNA, 20 bp, Artificial Sequence
  Description of Artificial Sequence: Synthetic oligonucleotide
  Target: SCN9A; (+) strand; PAM type: YTN; PAM sequence: TTT
ctgttttgtgtatactcttc

SEQ ID NO: 100479 - DNA, 20 bp, Artificial Sequence
  Description of Artificial Sequence: Synthetic oligonucleotide
  Target: SCN9A; (+) strand; PAM type: YTN; PAM sequence: TTC
tgttttgtgtatactcttct

SEQ ID NO: 100480 - DNA, 20 bp, Artificial Sequence
  Description of Artificial Sequence: Synthetic oligonucleotide
  Target: SCN9A; (+) strand; PAM type: YTN; PAM sequence: CTG
ttttgtgtatactcttcttt

SEQ ID NO: 100481 - DNA, 20 bp, Artificial Sequence
  Description of Artificial Sequence: Synthetic oligonucleotide
  Target: SCN9A; (+) strand; PAM type: YTN; PAM sequence: TTT
tgtgtatactcttctttctg

SEQ ID NO: 100482 - DNA, 20 bp, Artificial Sequence
  Description of Artificial Sequence: Synthetic oligonucleotide
  Target: SCN9A; (+) strand; PAM type: YTN; PAM sequence: TTT
gtgtatactcttctttctga

SEQ ID NO: 100483 - DNA, 20 bp, Artificial Sequence
  Description of Artificial Sequence: Synthetic oligonucleotide
  Target: SCN9A; (+) strand; PAM type: YTN; PAM sequence: TTG
tgtatactcttctttctgag

SEQ ID NO: 100484 - DNA, 20 bp, Artificial Sequence
  Description of Artificial Sequence: Synthetic oligonucleotide
  Target: SCN9A; (+) strand; PAM type: YTN; PAM sequence: CTC
ttctttctgaggagccacaa

SEQ ID NO: 100485 - DNA, 20 bp, Artificial Sequence
  Description of Artificial Sequence: Synthetic oligonucleotide
  Target: SCN9A; (+) strand; PAM type: YTN; PAM sequence: CTT
ctttctgaggagccacaaca

SEQ ID NO: 100486 - DNA, 20 bp, Artificial Sequence
  Description of Artificial Sequence: Synthetic oligonucleotide
  Target: SCN9A; (+) strand; PAM type: YTN; PAM sequence: TTC
tttctgaggagccacaacac

SEQ ID NO: 100487 - DNA, 20 bp, Artificial Sequence
  Description of Artificial Sequence: Synthetic oligonucleotide
  Target: SCN9A; (+) strand; PAM type: YTN; PAM sequence: CTT
tctgaggagccacaacacag

SEQ ID NO: 100488 - DNA, 20 bp, Artificial Sequence
  Description of Artificial Sequence: Synthetic oligonucleotide
  Target: SCN9A; (+) strand; PAM type: YTN; PAM sequence: TTT
ctgaggagccacaacacagt

SEQ ID NO: 100489 - DNA, 20 bp, Artificial Sequence
  Description of Artificial Sequence: Synthetic oligonucleotide
  Target: SCN9A; (+) strand; PAM type: YTN; PAM sequence: TTC
tgaggagccacaacacagtg

SEQ ID NO: 100490 - DNA, 20 bp, Artificial Sequence
  Description of Artificial Sequence: Synthetic oligonucleotide
  Target: SCN9A; (+) strand; PAM type: YTN; PAM sequence: CTG
aggagccacaacacagtgaa

SEQ ID NO: 100491 - DNA, 20 bp, Artificial Sequence
  Description of Artificial Sequence: Synthetic oligonucleotide
  Target: SCN9A; (+) strand; PAM type: YTN; PAM sequence: CTT
tgattttagatgtcaattca

SEQ ID NO: 100492 - DNA, 20 bp, Artificial Sequence
  Description of Artificial Sequence: Synthetic oligonucleotide
  Target: SCN9A; (+) strand; PAM type: YTN; PAM sequence: TTT
gattttagatgtcaattcag

SEQ ID NO: 100493 - DNA, 20 bp, Artificial Sequence
  Description of Artificial Sequence: Synthetic oligonucleotide
  Target: SCN9A; (+) strand; PAM type: YTN; PAM sequence: TTG
attttagatgtcaattcagt

SEQ ID NO: 100494 - DNA, 20 bp, Artificial Sequence
  Description of Artificial Sequence: Synthetic oligonucleotide
  Target: SCN9A; (+) strand; PAM type: YTN; PAM sequence: TTT
tagatgtcaattcagtgata

SEQ ID NO: 100495 - DNA, 20 bp, Artificial Sequence
  Description of Artificial Sequence: Synthetic oligonucleotide
  Target: SCN9A; (+) strand; PAM type: YTN; PAM sequence: TTT
agatgtcaattcagtgatag

SEQ ID NO: 100496 - DNA, 20 bp, Artificial Sequence
  Description of Artificial Sequence: Synthetic oligonucleotide
  Target: SCN9A; (+) strand; PAM type: YTN; PAM sequence: TTA
gatgtcaattcagtgatagc

SEQ ID NO: 100497 - DNA, 20 bp, Artificial Sequence
  Description of Artificial Sequence: Synthetic oligonucleotide
  Target: SCN9A; (+) strand; PAM type: YTN; PAM sequence: TTC
agtgatagctctgtcattta

SEQ ID NO: 100498 - DNA, 20 bp, Artificial Sequence
  Description of Artificial Sequence: Synthetic oligonucleotide
  Target: SCN9A; (+) strand; PAM type: YTN; PAM sequence: CTC
tgtcatttactagctttggg

SEQ ID NO: 100499 - DNA, 20 bp, Artificial Sequence
  Description of Artificial Sequence: Synthetic oligonucleotide
  Target: SCN9A; (+) strand; PAM type: YTN; PAM sequence: CTG
tcatttactagctttgggac

SEQ ID NO: 100500 - DNA, 20 bp, Artificial Sequence
  Description of Artificial Sequence: Synthetic oligonucleotide
  Target: SCN9A; (+) strand; PAM type: YTN; PAM sequence: TTT
actagctttgggacattaag

SEQ ID NO: 100501 - DNA, 20 bp, Artificial Sequence
  Description of Artificial Sequence: Synthetic oligonucleotide
  Target: SCN9A; (+) strand; PAM type: YTN; PAM sequence: TTA
ctagctttgggacattaagc

SEQ ID NO: 100502 - DNA, 20 bp, Artificial Sequence
  Description of Artificial Sequence: Synthetic oligonucleotide
  Target: SCN9A; (+) strand; PAM type: YTN; PAM sequence: CTA
gctttgggacattaagcaac

SEQ ID NO: 100503 - DNA, 20 bp, Artificial Sequence
  Description of Artificial Sequence: Synthetic oligonucleotide
  Target: SCN9A; (+) strand; PAM type: YTN; PAM sequence: CTT
tgggacattaagcaactttt

SEQ ID NO: 100504 - DNA, 20 bp, Artificial Sequence
  Description of Artificial Sequence: Synthetic oligonucleotide
  Target: SCN9A; (+) strand; PAM type: YTN; PAM sequence: TTT
gggacattaagcaactttta

SEQ ID NO: 100505 - DNA, 20 bp, Artificial Sequence
  Description of Artificial Sequence: Synthetic oligonucleotide
  Target: SCN9A; (+) strand; PAM type: YTN; PAM sequence: TTG
ggacattaagcaacttttaa

SEQ ID NO: 100506 - DNA, 20 bp, Artificial Sequence
  Description of Artificial Sequence: Synthetic oligonucleotide
  Target: SCN9A; (+) strand; PAM type: YTN; PAM sequence: TTA
agcaacttttaaaactgtac

SEQ ID NO: 100507 - DNA, 20 bp, Artificial Sequence
  Description of Artificial Sequence: Synthetic oligonucleotide
  Target: SCN9A; (+) strand; PAM type: YTN; PAM sequence: CTT
ttaaaactgtacccagcttc

SEQ ID NO: 100508 - DNA, 20 bp, Artificial Sequence
  Description of Artificial Sequence: Synthetic oligonucleotide
  Target: SCN9A; (+) strand; PAM type: YTN; PAM sequence: TTT
taaaactgtacccagcttca

SEQ ID NO: 100509 - DNA, 20 bp, Artificial Sequence
  Description of Artificial Sequence: Synthetic oligonucleotide
  Target: SCN9A; (+) strand; PAM type: YTN; PAM sequence: TTT
aaaactgtacccagcttcat

SEQ ID NO: 100510 - DNA, 20 bp, Artificial Sequence
  Description of Artificial Sequence: Synthetic oligonucleotide
  Target: SCN9A; (+) strand; PAM type: YTN; PAM sequence: TTA
aaactgtacccagcttcatc

SEQ ID NO: 100511 - DNA, 20 bp, Artificial Sequence
  Description of Artificial Sequence: Synthetic oligonucleotide
  Target: SCN9A; (+) strand; PAM type: YTN; PAM sequence: CTG
tacccagcttcatcattggt

SEQ ID NO: 100512 - DNA, 20 bp, Artificial Sequence
  Description of Artificial Sequence: Synthetic oligonucleotide
  Target: SCN9A; (+) strand; PAM type: YTN; PAM sequence: CTT
catcattggtaaaataagca

SEQ ID NO: 100513 - DNA, 20 bp, Artificial Sequence
  Description of Artificial Sequence: Synthetic oligonucleotide
  Target: SCN9A; (+) strand; PAM type: YTN; PAM sequence: TTC
atcattggtaaaataagcaa

SEQ ID NO: 100514 - DNA, 20 bp, Artificial Sequence
  Description of Artificial Sequence: Synthetic oligonucleotide
  Target: SCN9A; (+) strand; PAM type: YTN; PAM sequence: TTG
gtaaaataagcaaaatatca

SEQ ID NO: 100515 - DNA, 20 bp, Artificial Sequence
  Description of Artificial Sequence: Synthetic oligonucleotide
  Target: SCN9A; (+) strand; PAM type: YTN; PAM sequence: CTC
acagggttgtttgaaaatta

SEQ ID NO: 100516 - DNA, 20 bp, Artificial Sequence
  Description of Artificial Sequence: Synthetic oligonucleotide
  Target: SCN9A; (+) strand; PAM type: YTN; PAM sequence: TTG
tttgaaaattaaatgagaaa

SEQ ID NO: 100517 - DNA, 20 bp, Artificial Sequence
  Description of Artificial Sequence: Synthetic oligonucleotide
  Target: SCN9A; (+) strand; PAM type: YTN; PAM sequence: TTT
gaaaattaaatgagaaaatc

SEQ ID NO: 100518 - DNA, 20 bp, Artificial Sequence
  Description of Artificial Sequence: Synthetic oligonucleotide
  Target: SCN9A; (+) strand; PAM type: YTN; PAM sequence: TTG
aaaattaaatgagaaaatct

SEQ ID NO: 100519 - DNA, 20 bp, Artificial Sequence
  Description of Artificial Sequence: Synthetic oligonucleotide
  Target: SCN9A; (+) strand; PAM type: YTN; PAM sequence: TTA
aatgagaaaatctaaaagaa

SEQ ID NO: 100520 - DNA, 20 bp, Artificial Sequence
  Description of Artificial Sequence: Synthetic oligonucleotide
  Target: SCN9A; (+) strand; PAM type: YTN; PAM sequence: CTA
aaagaagattctgaaacaca

SEQ ID NO: 100521 - DNA, 20 bp, Artificial Sequence
  Description of Artificial Sequence: Synthetic oligonucleotide
  Target: SCN9A; (+) strand; PAM type: YTN; PAM sequence: TTC
tgaaacacaataagtataag

SEQ ID NO: 100522 - DNA, 20 bp, Artificial Sequence
  Description of Artificial Sequence: Synthetic oligonucleotide
  Target: SCN9A; (+) strand; PAM type: YTN; PAM sequence: CTG
aaacacaataagtataagct

SEQ ID NO: 100523 - DNA, 20 bp, Artificial Sequence
  Description of Artificial Sequence: Synthetic oligonucleotide
  Target: SCN9A; (+) strand; PAM type: YTN; PAM sequence: CTA
aatgagagctattacttctt

SEQ ID NO: 100524 - DNA, 20 bp, Artificial Sequence
  Description of Artificial Sequence: Synthetic oligonucleotide
  Target: SCN9A; (+) strand; PAM type: YTN; PAM sequence: CTA
ttacttctttttaactttta

SEQ ID NO: 100525 - DNA, 20 bp, Artificial Sequence
  Description of Artificial Sequence: Synthetic oligonucleotide
  Target: SCN9A; (+) strand; PAM type: YTN; PAM sequence: TTA
cttctttttaacttttattt

SEQ ID NO: 100526 - DNA, 20 bp, Artificial Sequence
  Description of Artificial Sequence: Synthetic oligonucleotide
  Target: SCN9A; (+) strand; PAM type: YTN; PAM sequence: CTT
ctttttaacttttattttag

SEQ ID NO: 100527 - DNA, 20 bp, Artificial Sequence
  Description of Artificial Sequence: Synthetic oligonucleotide
  Target: SCN9A; (+) strand; PAM type: YTN; PAM sequence: TTC
tttttaacttttattttagg

SEQ ID NO: 100528 - DNA, 20 bp, Artificial Sequence
  Description of Artificial Sequence: Synthetic oligonucleotide
  Target: SCN9A; (+) strand; PAM type: YTN; PAM sequence: CTT
tttaacttttattttaggtt

SEQ ID NO: 100529 - DNA, 20 bp, Artificial Sequence
  Description of Artificial Sequence: Synthetic oligonucleotide
  Target: SCN9A; (+) strand; PAM type: YTN; PAM sequence: TTT
ttaacttttattttaggttt

SEQ ID NO: 100530 - DNA, 20 bp, Artificial Sequence
  Description of Artificial Sequence: Synthetic oligonucleotide
  Target: SCN9A; (+) strand; PAM type: YTN; PAM sequence: TTT
taacttttattttaggtttg

SEQ ID NO: 100531 - DNA, 20 bp, Artificial Sequence
  Description of Artificial Sequence: Synthetic oligonucleotide
  Target: SCN9A; (+) strand; PAM type: YTN; PAM sequence: TTT
aacttttattttaggtttga

SEQ ID NO: 100532 - DNA, 20 bp, Artificial Sequence
  Description of Artificial Sequence: Synthetic oligonucleotide
  Target: SCN9A; (+) strand; PAM type: YTN; PAM sequence: TTA
acttttattttaggtttgag

SEQ ID NO: 100533 - DNA, 20 bp, Artificial Sequence
  Description of Artificial Sequence: Synthetic oligonucleotide
  Target: SCN9A; (+) strand; PAM type: YTN; PAM sequence: CTT
ttattttaggtttgagggta

SEQ ID NO: 100534 - DNA, 20 bp, Artificial Sequence
  Description of Artificial Sequence: Synthetic oligonucleotide
  Target: SCN9A; (+) strand; PAM type: YTN; PAM sequence: TTT
tattttaggtttgagggtac

SEQ ID NO: 100535 - DNA, 20 bp, Artificial Sequence
  Description of Artificial Sequence: Synthetic oligonucleotide
  Target: SCN9A; (+) strand; PAM type: YTN; PAM sequence: TTT
attttaggtttgagggtaca

SEQ ID NO: 100536 - DNA, 20 bp, Artificial Sequence
  Description of Artificial Sequence: Synthetic oligonucleotide
  Target: SCN9A; (+) strand; PAM type: YTN; PAM sequence: TTA
ttttaggtttgagggtacat

SEQ ID NO: 100537 - DNA, 20 bp, Artificial Sequence
  Description of Artificial Sequence: Synthetic oligonucleotide
  Target: SCN9A; (+) strand; PAM type: YTN; PAM sequence: TTT
taggtttgagggtacatgtg

SEQ ID NO: 100538 - DNA, 20 bp, Artificial Sequence
  Description of Artificial Sequence: Synthetic oligonucleotide
  Target: SCN9A; (+) strand; PAM type: YTN; PAM sequence: TTT
aggtttgagggtacatgtga

SEQ ID NO: 100539 - DNA, 20 bp, Artificial Sequence
  Description of Artificial Sequence: Synthetic oligonucleotide
  Target: SCN9A; (+) strand; PAM type: YTN; PAM sequence: TTA
ggtttgagggtacatgtgaa

SEQ ID NO: 100540 - DNA, 20 bp, Artificial Sequence
  Description of Artificial Sequence: Synthetic oligonucleotide
  Target: SCN9A; (+) strand; PAM type: YTN; PAM sequence: TTT
gagggtacatgtgaaggttt

SEQ ID NO: 100541 - DNA, 20 bp, Artificial Sequence
  Description of Artificial Sequence: Synthetic oligonucleotide
  Target: SCN9A; (+) strand; PAM type: YTN; PAM sequence: TTG
agggtacatgtgaaggtttg

SEQ ID NO: 100542 - DNA, 20 bp, Artificial Sequence
  Description of Artificial Sequence: Synthetic oligonucleotide
  Target: SCN9A; (+) strand; PAM type: YTN; PAM sequence: TTT
gttacataggtaaacacgtg

SEQ ID NO: 100543 - DNA, 20 bp, Artificial Sequence
  Description of Artificial Sequence: Synthetic oligonucleotide
  Target: SCN9A; (+) strand; PAM type: YTN; PAM sequence: TTG
ttacataggtaaacacgtgt

SEQ ID NO: 100544 - DNA, 20 bp, Artificial Sequence
  Description of Artificial Sequence: Synthetic oligonucleotide
  Target: SCN9A; (+) strand; PAM type: YTN; PAM sequence: TTA
cataggtaaacacgtgtcat

SEQ ID NO: 100545 - DNA, 20 bp, Artificial Sequence
  Description of Artificial Sequence: Synthetic oligonucleotide
  Target: SCN9A; (+) strand; PAM type: YTN; PAM sequence: TTT
gctatacttttaaaaaatct

SEQ ID NO: 100546 - DNA, 20 bp, Artificial Sequence
  Description of Artificial Sequence: Synthetic oligonucleotide
  Target: SCN9A; (+) strand; PAM type: YTN; PAM sequence: TTG
ctatacttttaaaaaatcta

SEQ ID NO: 100547 - DNA, 20 bp, Artificial Sequence
  Description of Artificial Sequence: Synthetic oligonucleotide
  Target: SCN9A; (+) strand; PAM type: YTN; PAM sequence: CTA
tacttttaaaaaatctagtt

SEQ ID NO: 100548 - DNA, 20 bp, Artificial Sequence
  Description of Artificial Sequence: Synthetic oligonucleotide
  Target: SCN9A; (+) strand; PAM type: YTN; PAM sequence: CTT
ttaaaaaatctagtttaatt

SEQ ID NO: 100549 - DNA, 20 bp, Artificial Sequence
  Description of Artificial Sequence: Synthetic oligonucleotide
  Target: SCN9A; (+) strand; PAM type: YTN; PAM sequence: TTT
taaaaaatctagtttaattg

SEQ ID NO: 100550 - DNA, 20 bp, Artificial Sequence
  Description of Artificial Sequence: Synthetic oligonucleotide
  Target: SCN9A; (+) strand; PAM type: YTN; PAM sequence: TTT
aaaaaatctagtttaattgg

SEQ ID NO: 100551 - DNA, 20 bp, Artificial Sequence
  Description of Artificial Sequence: Synthetic oligonucleotide
  Target: SCN9A; (+) strand; PAM type: YTN; PAM sequence: TTA
aaaaatctagtttaattggc

SEQ ID NO: 100552 - DNA, 20 bp, Artificial Sequence
  Description of Artificial Sequence: Synthetic oligonucleotide
  Target: SCN9A; (+) strand; PAM type: YTN; PAM sequence: CTA
gtttaattggcaacctgtct

SEQ ID NO: 100553 - DNA, 20 bp, Artificial Sequence
  Description of Artificial Sequence: Synthetic oligonucleotide
  Target: SCN9A; (+) strand; PAM type: YTN; PAM sequence: TTT
aattggcaacctgtctaagt

SEQ ID NO: 100554 - DNA, 20 bp, Artificial Sequence
  Description of Artificial Sequence: Synthetic oligonucleotide
  Target: SCN9A; (+) strand; PAM type: YTN; PAM sequence: TTA
attggcaacctgtctaagta

SEQ ID NO: 100555 - DNA, 20 bp, Artificial Sequence
  Description of Artificial Sequence: Synthetic oligonucleotide
  Target: SCN9A; (+) strand; PAM type: YTN; PAM sequence: TTG
gcaacctgtctaagtacaaa

SEQ ID NO: 100556 - DNA, 20 bp, Artificial Sequence
  Description of Artificial Sequence: Synthetic oligonucleotide
  Target: SCN9A; (+) strand; PAM type: YTN; PAM sequence: CTG
tctaagtacaaacaccagct

SEQ ID NO: 100557 - DNA, 20 bp, Artificial Sequence
  Description of Artificial Sequence: Synthetic oligonucleotide
  Target: SCN9A; (+) strand; PAM type: YTN; PAM sequence: CTA
agtacaaacaccagcttctt

SEQ ID NO: 100558 - DNA, 20 bp, Artificial Sequence
  Description of Artificial Sequence: Synthetic oligonucleotide
  Target: SCN9A; (+) strand; PAM type: YTN; PAM sequence: CTT
cttgaaatatctttcccttt

SEQ ID NO: 100559 - DNA, 20 bp, Artificial Sequence
  Description of Artificial Sequence: Synthetic oligonucleotide
  Target: SCN9A; (+) strand; PAM type: YTN; PAM sequence: TTC
ttgaaatatctttccctttt

SEQ ID NO: 100560 - DNA, 20 bp, Artificial Sequence
  Description of Artificial Sequence: Synthetic oligonucleotide
  Target: SCN9A; (+) strand; PAM type: YTN; PAM sequence: CTT
gaaatatctttcccttttct

SEQ ID NO: 100561 - DNA, 20 bp, Artificial Sequence
  Description of Artificial Sequence: Synthetic oligonucleotide
  Target: SCN9A; (+) strand; PAM type: YTN; PAM sequence: TTG
aaatatctttcccttttctt

SEQ ID NO: 100562 - DNA, 20 bp, Artificial Sequence
  Description of Artificial Sequence: Synthetic oligonucleotide
  Target: SCN9A; (+) strand; PAM type: YTN; PAM sequence: CTT
tcccttttcttcctcatatg

SEQ ID NO: 100563 - DNA, 20 bp, Artificial Sequence
  Description of Artificial Sequence: Synthetic oligonucleotide
  Target: SCN9A; (+) strand; PAM type: YTN; PAM sequence: TTT
cccttttcttcctcatatga

SEQ ID NO: 100564 - DNA, 20 bp, Artificial Sequence
  Description of Artificial Sequence: Synthetic oligonucleotide
  Target: SCN9A; (+) strand; PAM type: YTN; PAM sequence: TTC
ccttttcttcctcatatgat

SEQ ID NO: 100565 - DNA, 20 bp, Artificial Sequence
  Description of Artificial Sequence: Synthetic oligonucleotide
  Target: SCN9A; (+) strand; PAM type: YTN; PAM sequence: CTT
ttcttcctcatatgatttat

SEQ ID NO: 100566 - DNA, 20 bp, Artificial Sequence
  Description of Artificial Sequence: Synthetic oligonucleotide
  Target: SCN9A; (+) strand; PAM type: YTN; PAM sequence: TTT
tcttcctcatatgatttatt

SEQ ID NO: 100567 - DNA, 20 bp, Artificial Sequence
  Description of Artificial Sequence: Synthetic oligonucleotide
  Target: SCN9A; (+) strand; PAM type: YTN; PAM sequence: TTT
cttcctcatatgatttattt

SEQ ID NO: 100568 - DNA, 20 bp, Artificial Sequence
  Description of Artificial Sequence: Synthetic oligonucleotide
  Target: SCN9A; (+) strand; PAM type: YTN; PAM sequence: TTC
ttcctcatatgatttattta

SEQ ID NO: 100569 - DNA, 20 bp, Artificial Sequence
  Description of Artificial Sequence: Synthetic oligonucleotide
  Target: SCN9A; (+) strand; PAM type: YTN; PAM sequence: CTT
cctcatatgatttatttaaa

SEQ ID NO: 100570 - DNA, 20 bp, Artificial Sequence
  Description of Artificial Sequence: Synthetic oligonucleotide
  Target: SCN9A; (+) strand; PAM type: YTN; PAM sequence: TTC
ctcatatgatttatttaaaa

SEQ ID NO: 100571 - DNA, 20 bp, Artificial Sequence
  Description of Artificial Sequence: Synthetic oligonucleotide
  Target: SCN9A; (+) strand; PAM type: YTN; PAM sequence: CTC
atatgatttatttaaaatac

SEQ ID NO: 100572 - DNA, 20 bp, Artificial Sequence
  Description of Artificial Sequence: Synthetic oligonucleotide
  Target: SCN9A; (+) strand; PAM type: YTN; PAM sequence: TTT
atttaaaatacacttttgag

SEQ ID NO: 100573 - DNA, 20 bp, Artificial Sequence
  Description of Artificial Sequence: Synthetic oligonucleotide
  Target: SCN9A; (+) strand; PAM type: YTN; PAM sequence: TTA
tttaaaatacacttttgaga

SEQ ID NO: 100574 - DNA, 20 bp, Artificial Sequence
  Description of Artificial Sequence: Synthetic oligonucleotide
  Target: SCN9A; (+) strand; PAM type: YTN; PAM sequence: TTT
aaaatacacttttgagaatg

SEQ ID NO: 100575 - DNA, 20 bp, Artificial Sequence
  Description of Artificial Sequence: Synthetic oligonucleotide
  Target: SCN9A; (+) strand; PAM type: YTN; PAM sequence: TTA
aaatacacttttgagaatgc

SEQ ID NO: 100576 - DNA, 20 bp, Artificial Sequence
  Description of Artificial Sequence: Synthetic oligonucleotide
  Target: SCN9A; (+) strand; PAM type: YTN; PAM sequence: CTT
ttgagaatgccctccccaaa

SEQ ID NO: 100577 - DNA, 20 bp, Artificial Sequence
  Description of Artificial Sequence: Synthetic oligonucleotide
  Target: SCN9A; (+) strand; PAM type: YTN; PAM sequence: TTT
tgagaatgccctccccaaat

SEQ ID NO: 100578 - DNA, 20 bp, Artificial Sequence
  Description of Artificial Sequence: Synthetic oligonucleotide
  Target: SCN9A; (+) strand; PAM type: YTN; PAM sequence: TTT
gagaatgccctccccaaatg

SEQ ID NO: 100579 - DNA, 20 bp, Artificial Sequence
  Description of Artificial Sequence: Synthetic oligonucleotide
  Target: SCN9A; (+) strand; PAM type: YTN; PAM sequence: TTG
agaatgccctccccaaatgt

SEQ ID NO: 100580 - DNA, 20 bp, Artificial Sequence
  Description of Artificial Sequence: Synthetic oligonucleotide
  Target: SCN9A; (+) strand; PAM type: YTN; PAM sequence: CTC
cccaaatgtcttcctctgtt

SEQ ID NO: 100581 - DNA, 20 bp, Artificial Sequence
  Description of Artificial Sequence: Synthetic oligonucleotide
  Target: SCN9A; (+) strand; PAM type: YTN; PAM sequence: CTT
cctctgttttagacattttg

SEQ ID NO: 100582 - DNA, 20 bp, Artificial Sequence
  Description of Artificial Sequence: Synthetic oligonucleotide
  Target: SCN9A; (+) strand; PAM type: YTN; PAM sequence: TTC
ctctgttttagacattttga

SEQ ID NO: 100583 - DNA, 20 bp, Artificial Sequence
  Description of Artificial Sequence: Synthetic oligonucleotide
  Target: SCN9A; (+) strand; PAM type: YTN; PAM sequence: CTC
tgttttagacattttgaaca

SEQ ID NO: 100584 - DNA, 20 bp, Artificial Sequence
  Description of Artificial Sequence: Synthetic oligonucleotide
  Target: SCN9A; (+) strand; PAM type: YTN; PAM sequence: CTG
ttttagacattttgaacaag

SEQ ID NO: 100585 - DNA, 20 bp, Artificial Sequence
  Description of Artificial Sequence: Synthetic oligonucleotide
  Target: SCN9A; (+) strand; PAM type: YTN; PAM sequence: TTT
tagacattttgaacaaggaa

SEQ ID NO: 100586 - DNA, 20 bp, Artificial Sequence
  Description of Artificial Sequence: Synthetic oligonucleotide
  Target: SCN9A; (+) strand; PAM type: YTN; PAM sequence: TTT
agacattttgaacaaggaat

SEQ ID NO: 100587 - DNA, 20 bp, Artificial Sequence
  Description of Artificial Sequence: Synthetic oligonucleotide
  Target: SCN9A; (+) strand; PAM type: YTN; PAM sequence: TTA
gacattttgaacaaggaatt

SEQ ID NO: 100588 - DNA, 20 bp, Artificial Sequence
  Description of Artificial Sequence: Synthetic oligonucleotide
  Target: SCN9A; (+) strand; PAM type: YTN; PAM sequence: TTT
tgaacaaggaattactccaa

SEQ ID NO: 100589 - DNA, 20 bp, Artificial Sequence
  Description of Artificial Sequence: Synthetic oligonucleotide
  Target: SCN9A; (+) strand; PAM type: YTN; PAM sequence: TTT
gaacaaggaattactccaaa

SEQ ID NO: 100590 - DNA, 20 bp, Artificial Sequence
  Description of Artificial Sequence: Synthetic oligonucleotide
  Target: SCN9A; (+) strand; PAM type: YTN; PAM sequence: TTG
aacaaggaattactccaaac

SEQ ID NO: 100591 - DNA, 20 bp, Artificial Sequence
  Description of Artificial Sequence: Synthetic oligonucleotide
  Target: SCN9A; (+) strand; PAM type: YTN; PAM sequence: TTA
ctccaaactttaattttttt

SEQ ID NO: 100592 - DNA, 20 bp, Artificial Sequence
  Description of Artificial Sequence: Synthetic oligonucleotide
  Target: SCN9A; (+) strand; PAM type: YTN; PAM sequence: CTC
caaactttaatttttttgta

SEQ ID NO: 100593 - DNA, 20 bp, Artificial Sequence
  Description of Artificial Sequence: Synthetic oligonucleotide
  Target: SCN9A; (+) strand; PAM type: YTN; PAM sequence: CTT
taatttttttgtaatctcct

SEQ ID NO: 100594 - DNA, 20 bp, Artificial Sequence
  Description of Artificial Sequence: Synthetic oligonucleotide
  Target: SCN9A; (+) strand; PAM type: YTN; PAM sequence: TTT
aatttttttgtaatctcctc

SEQ ID NO: 100595 - DNA, 20 bp, Artificial Sequence
  Description of Artificial Sequence: Synthetic oligonucleotide
  Target: SCN9A; (+) strand; PAM type: YTN; PAM sequence: TTA
atttttttgtaatctcctct

SEQ ID NO: 100596 - DNA, 20 bp, Artificial Sequence
  Description of Artificial Sequence: Synthetic oligonucleotide
  Target: SCN9A; (+) strand; PAM type: YTN; PAM sequence: TTT
ttttgtaatctcctctctga

SEQ ID NO: 100597 - DNA, 20 bp, Artificial Sequence
  Description of Artificial Sequence: Synthetic oligonucleotide
  Target: SCN9A; (+) strand; PAM type: YTN; PAM sequence: TTT
tttgtaatctcctctctgaa

SEQ ID NO: 100598 - DNA, 20 bp, Artificial Sequence
  Description of Artificial Sequence: Synthetic oligonucleotide
  Target: SCN9A; (+) strand; PAM type: YTN; PAM sequence: TTT
ttgtaatctcctctctgaaa

SEQ ID NO: 100599 - DNA, 20 bp, Artificial Sequence
  Description of Artificial Sequence: Synthetic oligonucleotide
  Target: SCN9A; (+) strand; PAM type: YTN; PAM sequence: TTT
tgtaatctcctctctgaaat

SEQ ID NO: 100600 - DNA, 20 bp, Artificial Sequence
  Description of Artificial Sequence: Synthetic oligonucleotide
  Target: SCN9A; (+) strand; PAM type: YTN; PAM sequence: TTT
gtaatctcctctctgaaatt

SEQ ID NO: 100601 - DNA, 20 bp, Artificial Sequence
  Description of Artificial Sequence: Synthetic oligonucleotide
  Target: SCN9A; (+) strand; PAM type: YTN; PAM sequence: TTG
taatctcctctctgaaattc

SEQ ID NO: 100602 - DNA, 20 bp, Artificial Sequence
  Description of Artificial Sequence: Synthetic oligonucleotide
  Target: SCN9A; (+) strand; PAM type: YTN; PAM sequence: CTC
ctctctgaaattctcagtca

SEQ ID NO: 100603 - DNA, 20 bp, Artificial Sequence
  Description of Artificial Sequence: Synthetic oligonucleotide
  Target: SCN9A; (+) strand; PAM type: YTN; PAM sequence: CTC
tctgaaattctcagtcacat

SEQ ID NO: 100604 - DNA, 20 bp, Artificial Sequence
  Description of Artificial Sequence: Synthetic oligonucleotide
  Target: SCN9A; (+) strand; PAM type: YTN; PAM sequence: CTC
tgaaattctcagtcacatat

SEQ ID NO: 100605 - DNA, 20 bp, Artificial Sequence
  Description of Artificial Sequence: Synthetic oligonucleotide
  Target: SCN9A; (+) strand; PAM type: YTN; PAM sequence: CTG
aaattctcagtcacatatgt

SEQ ID NO: 100606 - DNA, 20 bp, Artificial Sequence
  Description of Artificial Sequence: Synthetic oligonucleotide
  Target: SCN9A; (+) strand; PAM type: YTN; PAM sequence: TTC
tcagtcacatatgtgagtca

SEQ ID NO: 100607 - DNA, 20 bp, Artificial Sequence
  Description of Artificial Sequence: Synthetic oligonucleotide
  Target: SCN9A; (+) strand; PAM type: YTN; PAM sequence: CTC
agtcacatatgtgagtcagc

SEQ ID NO: 100608 - DNA, 20 bp, Artificial Sequence
  Description of Artificial Sequence: Synthetic oligonucleotide
  Target: SCN9A; (+) strand; PAM type: YTN; PAM sequence: CTC
cttagttactaggaatacat

SEQ ID NO: 100609 - DNA, 20 bp, Artificial Sequence
  Description of Artificial Sequence: Synthetic oligonucleotide
  Target: SCN9A; (+) strand; PAM type: YTN; PAM sequence: CTT
agttactaggaatacattgc

SEQ ID NO: 100610 - DNA, 20 bp, Artificial Sequence
  Description of Artificial Sequence: Synthetic oligonucleotide
  Target: SCN9A; (+) strand; PAM type: YTN; PAM sequence: TTA
gttactaggaatacattgca

SEQ ID NO: 100611 - DNA, 20 bp, Artificial Sequence
  Description of Artificial Sequence: Synthetic oligonucleotide
  Target: SCN9A; (+) strand; PAM type: YTN; PAM sequence: TTA
ctaggaatacattgcatggt

SEQ ID NO: 100612 - DNA, 20 bp, Artificial Sequence
  Description of Artificial Sequence: Synthetic oligonucleotide
  Target: SCN9A; (+) strand; PAM type: YTN; PAM sequence: CTA
ggaatacattgcatggtaga

SEQ ID NO: 100613 - DNA, 20 bp, Artificial Sequence
  Description of Artificial Sequence: Synthetic oligonucleotide
  Target: SCN9A; (+) strand; PAM type: YTN; PAM sequence: TTG
catggtagacactatcatga

SEQ ID NO: 100614 - DNA, 20 bp, Artificial Sequence
  Description of Artificial Sequence: Synthetic oligonucleotide
  Target: SCN9A; (+) strand; PAM type: YTN; PAM sequence: CTA
tcatgatttctacttggatg

SEQ ID NO: 100615 - DNA, 20 bp, Artificial Sequence
  Description of Artificial Sequence: Synthetic oligonucleotide
  Target: SCN9A; (+) strand; PAM type: YTN; PAM sequence: TTT
ctacttggatgactccaggt

SEQ ID NO: 100616 - DNA, 20 bp, Artificial Sequence
  Description of Artificial Sequence: Synthetic oligonucleotide
  Target: SCN9A; (+) strand; PAM type: YTN; PAM sequence: TTC
tacttggatgactccaggta

SEQ ID NO: 100617 - DNA, 20 bp, Artificial Sequence
  Description of Artificial Sequence: Synthetic oligonucleotide
  Target: SCN9A; (+) strand; PAM type: YTN; PAM sequence: CTA
cttggatgactccaggtaag

SEQ ID NO: 100618 - DNA, 20 bp, Artificial Sequence
  Description of Artificial Sequence: Synthetic oligonucleotide
  Target: SCN9A; (+) strand; PAM type: YTN; PAM sequence: CTT
ggatgactccaggtaaggaa

SEQ ID NO: 100619 - DNA, 20 bp, Artificial Sequence
  Description of Artificial Sequence: Synthetic oligonucleotide
  Target: SCN9A; (+) strand; PAM type: YTN; PAM sequence: TTG
gatgactccaggtaaggaaa

SEQ ID NO: 100620 - DNA, 20 bp, Artificial Sequence
  Description of Artificial Sequence: Synthetic oligonucleotide
  Target: SCN9A; (+) strand; PAM type: YTN; PAM sequence: CTC
caggtaaggaaaatagagct

SEQ ID NO: 100621 - DNA, 20 bp, Artificial Sequence
  Description of Artificial Sequence: Synthetic oligonucleotide
  Target: SCN9A; (+) strand; PAM type: YTN; PAM sequence: CTT
ttctgatcacattttctgtt

SEQ ID NO: 100622 - DNA, 20 bp, Artificial Sequence
  Description of Artificial Sequence: Synthetic oligonucleotide
  Target: SCN9A; (+) strand; PAM type: YTN; PAM sequence: TTT
tctgatcacattttctgttt

SEQ ID NO: 100623 - DNA, 20 bp, Artificial Sequence
  Description of Artificial Sequence: Synthetic oligonucleotide
  Target: SCN9A; (+) strand; PAM type: YTN; PAM sequence: TTT
ctgatcacattttctgtttc

SEQ ID NO: 100624 - DNA, 20 bp, Artificial Sequence
  Description of Artificial Sequence: Synthetic oligonucleotide
  Target: SCN9A; (+) strand; PAM type: YTN; PAM sequence: TTC
tgatcacattttctgtttct

SEQ ID NO: 100625 - DNA, 20 bp, Artificial Sequence
  Description of Artificial Sequence: Synthetic oligonucleotide
  Target: SCN9A; (+) strand; PAM type: YTN; PAM sequence: CTG
atcacattttctgtttctga

SEQ ID NO: 100626 - DNA, 20 bp, Artificial Sequence
  Description of Artificial Sequence: Synthetic oligonucleotide
  Target: SCN9A; (+) strand; PAM type: YTN; PAM sequence: TTT
tctgtttctgagagttgaga

SEQ ID NO: 100627 - DNA, 20 bp, Artificial Sequence
  Description of Artificial Sequence: Synthetic oligonucleotide
  Target: SCN9A; (+) strand; PAM type: YTN; PAM sequence: TTT
ctgtttctgagagttgagac

SEQ ID NO: 100628 - DNA, 20 bp, Artificial Sequence
  Description of Artificial Sequence: Synthetic oligonucleotide
  Target: SCN9A; (+) strand; PAM type: YTN; PAM sequence: TTC
tgtttctgagagttgagact

SEQ ID NO: 100629 - DNA, 20 bp, Artificial Sequence
  Description of Artificial Sequence: Synthetic oligonucleotide
  Target: SCN9A; (+) strand; PAM type: YTN; PAM sequence: CTG
tttctgagagttgagacttg

SEQ ID NO: 100630 - DNA, 20 bp, Artificial Sequence
  Description of Artificial Sequence: Synthetic oligonucleotide
  Target: SCN9A; (+) strand; PAM type: YTN; PAM sequence: TTT
ctgagagttgagacttgata

SEQ ID NO: 100631 - DNA, 20 bp, Artificial Sequence
  Description of Artificial Sequence: Synthetic oligonucleotide
  Target: SCN9A; (+) strand; PAM type: YTN; PAM sequence: TTC
tgagagttgagacttgatag

SEQ ID NO: 100632 - DNA, 20 bp, Artificial Sequence
  Description of Artificial Sequence: Synthetic oligonucleotide
  Target: SCN9A; (+) strand; PAM type: YTN; PAM sequence: CTG
agagttgagacttgatagga

SEQ ID NO: 100633 - DNA, 20 bp, Artificial Sequence
  Description of Artificial Sequence: Synthetic oligonucleotide
  Target: SCN9A; (+) strand; PAM type: YTN; PAM sequence: TTG
agacttgataggaaaggaaa

SEQ ID NO: 100634 - DNA, 20 bp, Artificial Sequence
  Description of Artificial Sequence: Synthetic oligonucleotide
  Target: SCN9A; (+) strand; PAM type: YTN; PAM sequence: CTT
gataggaaaggaaagccaca

SEQ ID NO: 100635 - DNA, 20 bp, Artificial Sequence
  Description of Artificial Sequence: Synthetic oligonucleotide
  Target: SCN9A; (+) strand; PAM type: YTN; PAM sequence: TTG
ataggaaaggaaagccacag

SEQ ID NO: 100636 - DNA, 20 bp, Artificial Sequence
  Description of Artificial Sequence: Synthetic oligonucleotide
  Target: SCN9A; (+) strand; PAM type: YTN; PAM sequence: CTG
caggttgttggggagtgtgc

SEQ ID NO: 100637 - DNA, 20 bp, Artificial Sequence
  Description of Artificial Sequence: Synthetic oligonucleotide
  Target: SCN9A; (+) strand; PAM type: YTN; PAM sequence: TTG
ttggggagtgtgccaagaat

SEQ ID NO: 100638 - DNA, 20 bp, Artificial Sequence
  Description of Artificial Sequence: Synthetic oligonucleotide
  Target: SCN9A; (+) strand; PAM type: YTN; PAM sequence: TTG
gggagtgtgccaagaatgcc

SEQ ID NO: 100639 - DNA, 20 bp, Artificial Sequence
  Description of Artificial Sequence: Synthetic oligonucleotide
  Target: SCN9A; (+) strand; PAM type: YTN; PAM sequence: CTC
tgcctgctccttacctagga

SEQ ID NO: 100640 - DNA, 20 bp, Artificial Sequence
  Description of Artificial Sequence: Synthetic oligonucleotide
  Target: SCN9A; (+) strand; PAM type: YTN; PAM sequence: CTG
cctgctccttacctaggaca

SEQ ID NO: 100641 - DNA, 20 bp, Artificial Sequence
  Description of Artificial Sequence: Synthetic oligonucleotide
  Target: SCN9A; (+) strand; PAM type: YTN; PAM sequence: CTG
ctccttacctaggacattcc

SEQ ID NO: 100642 - DNA, 20 bp, Artificial Sequence
  Description of Artificial Sequence: Synthetic oligonucleotide
  Target: SCN9A; (+) strand; PAM type: YTN; PAM sequence: CTC
cttacctaggacattcctca

SEQ ID NO: 100643 - DNA, 20 bp, Artificial Sequence
  Description of Artificial Sequence: Synthetic oligonucleotide
  Target: SCN9A; (+) strand; PAM type: YTN; PAM sequence: CTT
acctaggacattcctcaggg

SEQ ID NO: 100644 - DNA, 20 bp, Artificial Sequence
  Description of Artificial Sequence: Synthetic oligonucleotide
  Target: SCN9A; (+) strand; PAM type: YTN; PAM sequence: TTA
cctaggacattcctcagggt

SEQ ID NO: 100645 - DNA, 20 bp, Artificial Sequence
  Description of Artificial Sequence: Synthetic oligonucleotide
  Target: SCN9A; (+) strand; PAM type: YTN; PAM sequence: CTA
ggacattcctcagggttgtg

SEQ ID NO: 100646 - DNA, 20 bp, Artificial Sequence
  Description of Artificial Sequence: Synthetic oligonucleotide
  Target: SCN9A; (+) strand; PAM type: YTN; PAM sequence: TTC
ctcagggttgtgtttgcagt

SEQ ID NO: 100647 - DNA, 20 bp, Artificial Sequence
  Description of Artificial Sequence: Synthetic oligonucleotide
  Target: SCN9A; (+) strand; PAM type: YTN; PAM sequence: CTC
agggttgtgtttgcagtgag

SEQ ID NO: 100648 - DNA, 20 bp, Artificial Sequence
  Description of Artificial Sequence: Synthetic oligonucleotide
  Target: SCN9A; (+) strand; PAM type: YTN; PAM sequence: TTG
tgtttgcagtgagcaacctt

SEQ ID NO: 100649 - DNA, 20 bp, Artificial Sequence
  Description of Artificial Sequence: Synthetic oligonucleotide
  Target: SCN9A; (+) strand; PAM type: YTN; PAM sequence: TTT
gcagtgagcaaccttgagac

SEQ ID NO: 100650 - DNA, 20 bp, Artificial Sequence
  Description of Artificial Sequence: Synthetic oligonucleotide
  Target: SCN9A; (+) strand; PAM type: YTN; PAM sequence: TTG
cagtgagcaaccttgagaca

SEQ ID NO: 100651 - DNA, 20 bp, Artificial Sequence
  Description of Artificial Sequence: Synthetic oligonucleotide
  Target: SCN9A; (+) strand; PAM type: YTN; PAM sequence: CTT
gagacatgaggtagggtctc

SEQ ID NO: 100652 - DNA, 20 bp, Artificial Sequence
  Description of Artificial Sequence: Synthetic oligonucleotide
  Target: SCN9A; (+) strand; PAM type: YTN; PAM sequence: TTG
agacatgaggtagggtctct

SEQ ID NO: 100653 - DNA, 20 bp, Artificial Sequence
  Description of Artificial Sequence: Synthetic oligonucleotide
  Target: SCN9A; (+) strand; PAM type: YTN; PAM sequence: CTC
tgggacaaagagcagggttg

SEQ ID NO: 100654 - DNA, 20 bp, Artificial Sequence
  Description of Artificial Sequence: Synthetic oligonucleotide
  Target: SCN9A; (+) strand; PAM type: YTN; PAM sequence: CTG
ggacaaagagcagggttgct

SEQ ID NO: 100655 - DNA, 20 bp, Artificial Sequence
  Description of Artificial Sequence: Synthetic oligonucleotide
  Target: SCN9A; (+) strand; PAM type: YTN; PAM sequence: TTG
cttatgttgcttggtataaa

SEQ ID NO: 100656 - DNA, 20 bp, Artificial Sequence
  Description of Artificial Sequence: Synthetic oligonucleotide
  Target: SCN9A; (+) strand; PAM type: YTN; PAM sequence: CTT
atgttgcttggtataaaagg

SEQ ID NO: 100657 - DNA, 20 bp, Artificial Sequence
  Description of Artificial Sequence: Synthetic oligonucleotide
  Target: SCN9A; (+) strand; PAM type: YTN; PAM sequence: TTA
tgttgcttggtataaaagga

SEQ ID NO: 100658 - DNA, 20 bp, Artificial Sequence
  Description of Artificial Sequence: Synthetic oligonucleotide
  Target: SCN9A; (+) strand; PAM type: YTN; PAM sequence: TTG
cttggtataaaaggatgcat

SEQ ID NO: 100659 - DNA, 20 bp, Artificial Sequence
  Description of Artificial Sequence: Synthetic oligonucleotide
  Target: SCN9A; (+) strand; PAM type: YTN; PAM sequence: CTT
ggtataaaaggatgcattcc

SEQ ID NO: 100660 - DNA, 20 bp, Artificial Sequence
  Description of Artificial Sequence: Synthetic oligonucleotide
  Target: SCN9A; (+) strand; PAM type: YTN; PAM sequence: TTG
gtataaaaggatgcattccc

SEQ ID NO: 100661 - DNA, 20 bp, Artificial Sequence
  Description of Artificial Sequence: Synthetic oligonucleotide
  Target: SCN9A; (+) strand; PAM type: YTN; PAM sequence: TTC
cctaagctcagtgttcctca

SEQ ID NO: 100662 - DNA, 20 bp, Artificial Sequence
  Description of Artificial Sequence: Synthetic oligonucleotide
  Target: SCN9A; (+) strand; PAM type: YTN; PAM sequence: CTA
agctcagtgttcctcagctg

SEQ ID NO: 100663 - DNA, 20 bp, Artificial Sequence
  Description of Artificial Sequence: Synthetic oligonucleotide
  Target: SCN9A; (+) strand; PAM type: YTN; PAM sequence: CTC
agtgttcctcagctgtgaca

SEQ ID NO: 100664 - DNA, 20 bp, Artificial Sequence
  Description of Artificial Sequence: Synthetic oligonucleotide
  Target: SCN9A; (+) strand; PAM type: YTN; PAM sequence: TTC
ctcagctgtgacatcaatcc

SEQ ID NO: 100665 - DNA, 20 bp, Artificial Sequence
  Description of Artificial Sequence: Synthetic oligonucleotide
  Target: SCN9A; (+) strand; PAM type: YTN; PAM sequence: CTC
agctgtgacatcaatccact

SEQ ID NO: 100666 - DNA, 20 bp, Artificial Sequence
  Description of Artificial Sequence: Synthetic oligonucleotide
  Target: SCN9A; (+) strand; PAM type: YTN; PAM sequence: CTG
tgacatcaatccactatatg

SEQ ID NO: 100667 - DNA, 20 bp, Artificial Sequence
  Description of Artificial Sequence: Synthetic oligonucleotide
  Target: SCN9A; (+) strand; PAM type: YTN; PAM sequence: CTA
tatgtgtacacactcattca

SEQ ID NO: 100668 - DNA, 20 bp, Artificial Sequence
  Description of Artificial Sequence: Synthetic oligonucleotide
  Target: SCN9A; (+) strand; PAM type: YTN; PAM sequence: CTC
attcaggctcatataatgcc

SEQ ID NO: 100669 - DNA, 20 bp, Artificial Sequence
  Description of Artificial Sequence: Synthetic oligonucleotide
  Target: SCN9A; (+) strand; PAM type: YTN; PAM sequence: TTC
aggctcatataatgccccca

SEQ ID NO: 100670 - DNA, 20 bp, Artificial Sequence
  Description of Artificial Sequence: Synthetic oligonucleotide
  Target: SCN9A; (+) strand; PAM type: YTN; PAM sequence: CTC
atataatgcccccatgagac

SEQ ID NO: 100671 - DNA, 20 bp, Artificial Sequence
  Description of Artificial Sequence: Synthetic oligonucleotide
  Target: SCN9A; (+) strand; PAM type: YTN; PAM sequence: CTG
ggtaaagggggaaccaacag

SEQ ID NO: 100672 - DNA, 20 bp, Artificial Sequence
  Description of Artificial Sequence: Synthetic oligonucleotide
  Target: SCN9A; (+) strand; PAM type: YTN; PAM sequence: TTG
aaactcatgctactttccac

SEQ ID NO: 100673 - DNA, 20 bp, Artificial Sequence
  Description of Artificial Sequence: Synthetic oligonucleotide
  Target: SCN9A; (+) strand; PAM type: YTN; PAM sequence: CTC
atgctactttccacacataa

SEQ ID NO: 100674 - DNA, 20 bp, Artificial Sequence
  Description of Artificial Sequence: Synthetic oligonucleotide
  Target: SCN9A; (+) strand; PAM type: YTN; PAM sequence: CTA
ctttccacacataagtaaca

SEQ ID NO: 100675 - DNA, 20 bp, Artificial Sequence
  Description of Artificial Sequence: Synthetic oligonucleotide
  Target: SCN9A; (+) strand; PAM type: YTN; PAM sequence: CTT
tccacacataagtaacaaag

SEQ ID NO: 100676 - DNA, 20 bp, Artificial Sequence
  Description of Artificial Sequence: Synthetic oligonucleotide
  Target: SCN9A; (+) strand; PAM type: YTN; PAM sequence: TTT
ccacacataagtaacaaagt

SEQ ID NO: 100677 - DNA, 20 bp, Artificial Sequence
  Description of Artificial Sequence: Synthetic oligonucleotide
  Target: SCN9A; (+) strand; PAM type: YTN; PAM sequence: TTC
cacacataagtaacaaagtc

SEQ ID NO: 100678 - DNA, 20 bp, Artificial Sequence
  Description of Artificial Sequence: Synthetic oligonucleotide
  Target: SCN9A; (+) strand; PAM type: YTN; PAM sequence: CTT
tatctctgacccaagcacct

SEQ ID NO: 100679 - DNA, 20 bp, Artificial Sequence
  Description of Artificial Sequence: Synthetic oligonucleotide
  Target: SCN9A; (+) strand; PAM type: YTN; PAM sequence: TTT
atctctgacccaagcacctc

SEQ ID NO: 100680 - DNA, 20 bp, Artificial Sequence
  Description of Artificial Sequence: Synthetic oligonucleotide
  Target: SCN9A; (+) strand; PAM type: YTN; PAM sequence: TTA
tctctgacccaagcacctca

SEQ ID NO: 100681 - DNA, 20 bp, Artificial Sequence
  Description of Artificial Sequence: Synthetic oligonucleotide
  Target: SCN9A; (+) strand; PAM type: YTN; PAM sequence: CTC
tgacccaagcacctcatatc

SEQ ID NO: 100682 - DNA, 20 bp, Artificial Sequence
  Description of Artificial Sequence: Synthetic oligonucleotide
  Target: SCN9A; (+) strand; PAM type: YTN; PAM sequence: CTG
acccaagcacctcatatctt

SEQ ID NO: 100683 - DNA, 20 bp, Artificial Sequence
  Description of Artificial Sequence: Synthetic oligonucleotide
  Target: SCN9A; (+) strand; PAM type: YTN; PAM sequence: CTC
atatcttctgccagcatcca

SEQ ID NO: 100684 - DNA, 20 bp, Artificial Sequence
  Description of Artificial Sequence: Synthetic oligonucleotide
  Target: SCN9A; (+) strand; PAM type: YTN; PAM sequence: CTT
ctgccagcatccatgaaaca

SEQ ID NO: 100685 - DNA, 20 bp, Artificial Sequence
  Description of Artificial Sequence: Synthetic oligonucleotide
  Target: SCN9A; (+) strand; PAM type: YTN; PAM sequence: TTC
tgccagcatccatgaaacag

SEQ ID NO: 100686 - DNA, 20 bp, Artificial Sequence
  Description of Artificial Sequence: Synthetic oligonucleotide
  Target: SCN9A; (+) strand; PAM type: YTN; PAM sequence: CTG
ccagcatccatgaaacagta

SEQ ID NO: 100687 - DNA, 20 bp, Artificial Sequence
  Description of Artificial Sequence: Synthetic oligonucleotide
  Target: SCN9A; (+) strand; PAM type: YTN; PAM sequence: CTA
ttagcatataagtacagtaa

SEQ ID NO: 100688 - DNA, 20 bp, Artificial Sequence
  Description of Artificial Sequence: Synthetic oligonucleotide
  Target: SCN9A; (+) strand; PAM type: YTN; PAM sequence: TTA
gcatataagtacagtaaaat

SEQ ID NO: 100689 - DNA, 20 bp, Artificial Sequence
  Description of Artificial Sequence: Synthetic oligonucleotide
  Target: SCN9A; (+) strand; PAM type: YTN; PAM sequence: CTC
atgaagactgtctatgaggc

SEQ ID NO: 100690 - DNA, 20 bp, Artificial Sequence
  Description of Artificial Sequence: Synthetic oligonucleotide
  Target: SCN9A; (+) strand; PAM type: YTN; PAM sequence: CTG
tctatgaggcaagttacaaa

SEQ ID NO: 100691 - DNA, 20 bp, Artificial Sequence
  Description of Artificial Sequence: Synthetic oligonucleotide
  Target: SCN9A; (+) strand; PAM type: YTN; PAM sequence: CTA
tgaggcaagttacaaagttc

SEQ ID NO: 100692 - DNA, 20 bp, Artificial Sequence
  Description of Artificial Sequence: Synthetic oligonucleotide
  Target: SCN9A; (+) strand; PAM type: YTN; PAM sequence: TTA
caaagttcttgagtattcta

SEQ ID NO: 100693 - DNA, 20 bp, Artificial Sequence
  Description of Artificial Sequence: Synthetic oligonucleotide
  Target: SCN9A; (+) strand; PAM type: YTN; PAM sequence: TTC
ttgagtattctatttttagt

SEQ ID NO: 100694 - DNA, 20 bp, Artificial Sequence
  Description of Artificial Sequence: Synthetic oligonucleotide
  Target: SCN9A; (+) strand; PAM type: YTN; PAM sequence: CTT
gagtattctatttttagtat

SEQ ID NO: 100695 - DNA, 20 bp, Artificial Sequence
  Description of Artificial Sequence: Synthetic oligonucleotide
  Target: SCN9A; (+) strand; PAM type: YTN; PAM sequence: TTG
agtattctatttttagtata

SEQ ID NO: 100696 - DNA, 20 bp, Artificial Sequence
  Description of Artificial Sequence: Synthetic oligonucleotide
  Target: SCN9A; (+) strand; PAM type: YTN; PAM sequence: TTC
tatttttagtataatgaaac

SEQ ID NO: 100697 - DNA, 20 bp, Artificial Sequence
  Description of Artificial Sequence: Synthetic oligonucleotide
  Target: SCN9A; (+) strand; PAM type: YTN; PAM sequence: CTA
tttttagtataatgaaactt

SEQ ID NO: 100698 - DNA, 20 bp, Artificial Sequence
  Description of Artificial Sequence: Synthetic oligonucleotide
  Target: SCN9A; (+) strand; PAM type: YTN; PAM sequence: TTT
ttagtataatgaaacttcca

SEQ ID NO: 100699 - DNA, 20 bp, Artificial Sequence
  Description of Artificial Sequence: Synthetic oligonucleotide
  Target: SCN9A; (+) strand; PAM type: YTN; PAM sequence: TTT
tagtataatgaaacttccag

SEQ ID NO: 100700 - DNA, 20 bp, Artificial Sequence
  Description of Artificial Sequence: Synthetic oligonucleotide
  Target: SCN9A; (+) strand; PAM type: YTN; PAM sequence: TTT
agtataatgaaacttccagt

SEQ ID NO: 100701 - DNA, 20 bp, Artificial Sequence
  Description of Artificial Sequence: Synthetic oligonucleotide
  Target: SCN9A; (+) strand; PAM type: YTN; PAM sequence: TTA
gtataatgaaacttccagtg

SEQ ID NO: 100702 - DNA, 20 bp, Artificial Sequence
  Description of Artificial Sequence: Synthetic oligonucleotide
  Target: SCN9A; (+) strand; PAM type: YTN; PAM sequence: CTT
ccagtggtatatctagctag

SEQ ID NO: 100703 - DNA, 20 bp, Artificial Sequence
  Description of Artificial Sequence: Synthetic oligonucleotide
  Target: SCN9A; (+) strand; PAM type: YTN; PAM sequence: TTC
cagtggtatatctagctaga

SEQ ID NO: 100704 - DNA, 20 bp, Artificial Sequence
  Description of Artificial Sequence: Synthetic oligonucleotide
  Target: SCN9A; (+) strand; PAM type: YTN; PAM sequence: CTA
gctagatctgggctcctaat

SEQ ID NO: 100705 - DNA, 20 bp, Artificial Sequence
  Description of Artificial Sequence: Synthetic oligonucleotide
  Target: SCN9A; (+) strand; PAM type: YTN; PAM sequence: CTA
gatctgggctcctaatggct

SEQ ID NO: 100706 - DNA, 20 bp, Artificial Sequence
  Description of Artificial Sequence: Synthetic oligonucleotide
  Target: SCN9A; (+) strand; PAM type: YTN; PAM sequence: CTG
ggctcctaatggcttctaat

SEQ ID NO: 100707 - DNA, 20 bp, Artificial Sequence
  Description of Artificial Sequence: Synthetic oligonucleotide
  Target: SCN9A; (+) strand; PAM type: YTN; PAM sequence: CTC
ctaatggcttctaatggctc

SEQ ID NO: 100708 - DNA, 20 bp, Artificial Sequence
  Description of Artificial Sequence: Synthetic oligonucleotide
  Target: SCN9A; (+) strand; PAM type: YTN; PAM sequence: CTA
atggcttctaatggctcatc

SEQ ID NO: 100709 - DNA, 20 bp, Artificial Sequence
  Description of Artificial Sequence: Synthetic oligonucleotide
  Target: SCN9A; (+) strand; PAM type: YTN; PAM sequence: CTT
ctaatggctcatctctgtca

SEQ ID NO: 100710 - DNA, 20 bp, Artificial Sequence
  Description of Artificial Sequence: Synthetic oligonucleotide
  Target: SCN9A; (+) strand; PAM type: YTN; PAM sequence: TTC
taatggctcatctctgtcag

SEQ ID NO: 100711 - DNA, 20 bp, Artificial Sequence
  Description of Artificial Sequence: Synthetic oligonucleotide
  Target: SCN9A; (+) strand; PAM type: YTN; PAM sequence: CTA
atggctcatctctgtcagcg

SEQ ID NO: 100712 - DNA, 20 bp, Artificial Sequence
  Description of Artificial Sequence: Synthetic oligonucleotide
  Target: SCN9A; (+) strand; PAM type: YTN; PAM sequence: CTC
atctctgtcagcgtcagcag

SEQ ID NO: 100713 - DNA, 20 bp, Artificial Sequence
  Description of Artificial Sequence: Synthetic oligonucleotide
  Target: SCN9A; (+) strand; PAM type: YTN; PAM sequence: CTC
tgtcagcgtcagcaggaaaa

SEQ ID NO: 100714 - DNA, 20 bp, Artificial Sequence
  Description of Artificial Sequence: Synthetic oligonucleotide
  Target: SCN9A; (+) strand; PAM type: YTN; PAM sequence: CTG
tcagcgtcagcaggaaaaat

SEQ ID NO: 100715 - DNA, 20 bp, Artificial Sequence
  Description of Artificial Sequence: Synthetic oligonucleotide
  Target: SCN9A; (+) strand; PAM type: YTN; PAM sequence: TTA
agaaaaaggttcaggtagct

SEQ ID NO: 100716 - DNA, 20 bp, Artificial Sequence
  Description of Artificial Sequence: Synthetic oligonucleotide
  Target: SCN9A; (+) strand; PAM type: YTN; PAM sequence: TTC
aggtagcttgtaattctact

SEQ ID NO: 100717 - DNA, 20 bp, Artificial Sequence
  Description of Artificial Sequence: Synthetic oligonucleotide
  Target: SCN9A; (+) strand; PAM type: YTN; PAM sequence: CTT
gtaattctactagatctctt

SEQ ID NO: 100718 - DNA, 20 bp, Artificial Sequence
  Description of Artificial Sequence: Synthetic oligonucleotide
  Target: SCN9A; (+) strand; PAM type: YTN; PAM sequence: TTG
taattctactagatctcttt

SEQ ID NO: 100719 - DNA, 20 bp, Artificial Sequence
  Description of Artificial Sequence: Synthetic oligonucleotide
  Target: SCN9A; (+) strand; PAM type: YTN; PAM sequence: TTC
tactagatctctttcaactc

SEQ ID NO: 100720 - DNA, 20 bp, Artificial Sequence
  Description of Artificial Sequence: Synthetic oligonucleotide
  Target: SCN9A; (+) strand; PAM type: YTN; PAM sequence: CTA
ctagatctctttcaactctc

SEQ ID NO: 100721 - DNA, 20 bp, Artificial Sequence
  Description of Artificial Sequence: Synthetic oligonucleotide
  Target: SCN9A; (+) strand; PAM type: YTN; PAM sequence: CTA
gatctctttcaactctcatg

SEQ ID NO: 100722 - DNA, 20 bp, Artificial Sequence
  Description of Artificial Sequence: Synthetic oligonucleotide
  Target: SCN9A; (+) strand; PAM type: YTN; PAM sequence: CTC
tttcaactctcatggaagct

SEQ ID NO: 100723 - DNA, 20 bp, Artificial Sequence
  Description of Artificial Sequence: Synthetic oligonucleotide
  Target: SCN9A; (+) strand; PAM type: YTN; PAM sequence: CTT
tcaactctcatggaagctgc

SEQ ID NO: 100724 - DNA, 20 bp, Artificial Sequence
  Description of Artificial Sequence: Synthetic oligonucleotide
  Target: SCN9A; (+) strand; PAM type: YTN; PAM sequence: TTT
caactctcatggaagctgct

SEQ ID NO: 100725 - DNA, 20 bp, Artificial Sequence
  Description of Artificial Sequence: Synthetic oligonucleotide
  Target: SCN9A; (+) strand; PAM type: YTN; PAM sequence: TTC
aactctcatggaagctgctt

SEQ ID NO: 100726 - DNA, 20 bp, Artificial Sequence
  Description of Artificial Sequence: Synthetic oligonucleotide
  Target: SCN9A; (+) strand; PAM type: YTN; PAM sequence: CTC
tcatggaagctgcttgtatg

SEQ ID NO: 100727 - DNA, 20 bp, Artificial Sequence
  Description of Artificial Sequence: Synthetic oligonucleotide
  Target: SCN9A; (+) strand; PAM type: YTN; PAM sequence: CTC
atggaagctgcttgtatgtg

SEQ ID NO: 100728 - DNA, 20 bp, Artificial Sequence
  Description of Artificial Sequence: Synthetic oligonucleotide
  Target: SCN9A; (+) strand; PAM type: YTN; PAM sequence: CTG
cttgtatgtgtacaagaatg

SEQ ID NO: 100729 - DNA, 20 bp, Artificial Sequence
  Description of Artificial Sequence: Synthetic oligonucleotide
  Target: SCN9A; (+) strand; PAM type: YTN; PAM sequence: CTT
gtatgtgtacaagaatgaga

SEQ ID NO: 100730 - DNA, 20 bp, Artificial Sequence
  Description of Artificial Sequence: Synthetic oligonucleotide
  Target: SCN9A; (+) strand; PAM type: YTN; PAM sequence: TTG
tatgtgtacaagaatgagaa

SEQ ID NO: 100731 - DNA, 20 bp, Artificial Sequence
  Description of Artificial Sequence: Synthetic oligonucleotide
  Target: SCN9A; (+) strand; PAM type: YTN; PAM sequence: CTT
gtcctacttttatcctaaaa

SEQ ID NO: 100732 - DNA, 20 bp, Artificial Sequence
  Description of Artificial Sequence: Synthetic oligonucleotide
  Target: SCN9A; (+) strand; PAM type: YTN; PAM sequence: TTG
tcctacttttatcctaaaac

SEQ ID NO: 100733 - DNA, 20 bp, Artificial Sequence
  Description of Artificial Sequence: Synthetic oligonucleotide
  Target: SCN9A; (+) strand; PAM type: YTN; PAM sequence: CTA
cttttatcctaaaactacca

SEQ ID NO: 100734 - DNA, 20 bp, Artificial Sequence
  Description of Artificial Sequence: Synthetic oligonucleotide
  Target: SCN9A; (+) strand; PAM type: YTN; PAM sequence: CTT
ttatcctaaaactaccatct

SEQ ID NO: 100735 - DNA, 20 bp, Artificial Sequence
  Description of Artificial Sequence: Synthetic oligonucleotide
  Target: SCN9A; (+) strand; PAM type: YTN; PAM sequence: TTT
tatcctaaaactaccatctg

SEQ ID NO: 100736 - DNA, 20 bp, Artificial Sequence
  Description of Artificial Sequence: Synthetic oligonucleotide
  Target: SCN9A; (+) strand; PAM type: YTN; PAM sequence: TTT
atcctaaaactaccatctgt

SEQ ID NO: 100737 - DNA, 20 bp, Artificial Sequence
  Description of Artificial Sequence: Synthetic oligonucleotide
  Target: SCN9A; (+) strand; PAM type: YTN; PAM sequence: TTA
tcctaaaactaccatctgtt

SEQ ID NO: 100738 - DNA, 20 bp, Artificial Sequence
  Description of Artificial Sequence: Synthetic oligonucleotide
  Target: SCN9A; (+) strand; PAM type: YTN; PAM sequence: CTA
aaactaccatctgttttccc

SEQ ID NO: 100739 - DNA, 20 bp, Artificial Sequence
  Description of Artificial Sequence: Synthetic oligonucleotide
  Target: SCN9A; (+) strand; PAM type: YTN; PAM sequence: CTA
ccatctgttttcccttttta

SEQ ID NO: 100740 - DNA, 20 bp, Artificial Sequence
  Description of Artificial Sequence: Synthetic oligonucleotide
  Target: SCN9A; (+) strand; PAM type: YTN; PAM sequence: CTG
ttttccctttttataacaca

SEQ ID NO: 100741 - DNA, 20 bp, Artificial Sequence
  Description of Artificial Sequence: Synthetic oligonucleotide
  Target: SCN9A; (+) strand; PAM type: YTN; PAM sequence: TTT
tccctttttataacacacaa

SEQ ID NO: 100742 - DNA, 20 bp, Artificial Sequence
  Description of Artificial Sequence: Synthetic oligonucleotide
  Target: SCN9A; (+) strand; PAM type: YTN; PAM sequence: TTT
ccctttttataacacacaag

SEQ ID NO: 100743 - DNA, 20 bp, Artificial Sequence
  Description of Artificial Sequence: Synthetic oligonucleotide
  Target: SCN9A; (+) strand; PAM type: YTN; PAM sequence: TTC
cctttttataacacacaaga

SEQ ID NO: 100744 - DNA, 20 bp, Artificial Sequence
  Description of Artificial Sequence: Synthetic oligonucleotide
  Target: SCN9A; (+) strand; PAM type: YTN; PAM sequence: CTT
tttataacacacaagatgct

SEQ ID NO: 100745 - DNA, 20 bp, Artificial Sequence
  Description of Artificial Sequence: Synthetic oligonucleotide
  Target: SCN9A; (+) strand; PAM type: YTN; PAM sequence: TTT
ttataacacacaagatgctt

SEQ ID NO: 100746 - DNA, 20 bp, Artificial Sequence
  Description of Artificial Sequence: Synthetic oligonucleotide
  Target: SCN9A; (+) strand; PAM type: YTN; PAM sequence: TTT
tataacacacaagatgcttc

SEQ ID NO: 100747 - DNA, 20 bp, Artificial Sequence
  Description of Artificial Sequence: Synthetic oligonucleotide
  Target: SCN9A; (+) strand; PAM type: YTN; PAM sequence: TTT
ataacacacaagatgcttca

SEQ ID NO: 100748 - DNA, 20 bp, Artificial Sequence
  Description of Artificial Sequence: Synthetic oligonucleotide
  Target: SCN9A; (+) strand; PAM type: YTN; PAM sequence: TTA
taacacacaagatgcttcac

SEQ ID NO: 100749 - DNA, 20 bp, Artificial Sequence
  Description of Artificial Sequence: Synthetic oligonucleotide
  Target: SCN9A; (+) strand; PAM type: YTN; PAM sequence: CTT
cacaagctgaccttgctttc

SEQ ID NO: 100750 - DNA, 20 bp, Artificial Sequence
  Description of Artificial Sequence: Synthetic oligonucleotide
  Target: SCN9A; (+) strand; PAM type: YTN; PAM sequence: TTC
acaagctgaccttgctttct

SEQ ID NO: 100751 - DNA, 20 bp, Artificial Sequence
  Description of Artificial Sequence: Synthetic oligonucleotide
  Target: SCN9A; (+) strand; PAM type: YTN; PAM sequence: CTG
accttgctttctcatagtat

SEQ ID NO: 100752 - DNA, 20 bp, Artificial Sequence
  Description of Artificial Sequence: Synthetic oligonucleotide
  Target: SCN9A; (+) strand; PAM type: YTN; PAM sequence: CTT
gctttctcatagtatctctg

SEQ ID NO: 100753 - DNA, 20 bp, Artificial Sequence
  Description of Artificial Sequence: Synthetic oligonucleotide
  Target: SCN9A; (+) strand; PAM type: YTN; PAM sequence: TTG
ctttctcatagtatctctgg

SEQ ID NO: 100754 - DNA, 20 bp, Artificial Sequence
  Description of Artificial Sequence: Synthetic oligonucleotide
  Target: SCN9A; (+) strand; PAM type: YTN; PAM sequence: CTT
tctcatagtatctctggcca

SEQ ID NO: 100755 - DNA, 20 bp, Artificial Sequence
  Description of Artificial Sequence: Synthetic oligonucleotide
  Target: SCN9A; (+) strand; PAM type: YTN; PAM sequence: TTT
ctcatagtatctctggccac

SEQ ID NO: 100756 - DNA, 20 bp, Artificial Sequence
  Description of Artificial Sequence: Synthetic oligonucleotide
  Target: SCN9A; (+) strand; PAM type: YTN; PAM sequence: TTC
tcatagtatctctggccacc

SEQ ID NO: 100757 - DNA, 20 bp, Artificial Sequence
  Description of Artificial Sequence: Synthetic oligonucleotide
  Target: SCN9A; (+) strand; PAM type: YTN; PAM sequence: CTC
atagtatctctggccacctg

SEQ ID NO: 100758 - DNA, 20 bp, Artificial Sequence
  Description of Artificial Sequence: Synthetic oligonucleotide
  Target: SCN9A; (+) strand; PAM type: YTN; PAM sequence: CTC
tggccacctgtacttgttct

SEQ ID NO: 100759 - DNA, 20 bp, Artificial Sequence
  Description of Artificial Sequence: Synthetic oligonucleotide
  Target: SCN9A; (+) strand; PAM type: YTN; PAM sequence: CTG
gccacctgtacttgttcttc

SEQ ID NO: 100760 - DNA, 20 bp, Artificial Sequence
  Description of Artificial Sequence: Synthetic oligonucleotide
  Target: SCN9A; (+) strand; PAM type: YTN; PAM sequence: CTG
tacttgttcttcttcccacc

SEQ ID NO: 100761 - DNA, 20 bp, Artificial Sequence
  Description of Artificial Sequence: Synthetic oligonucleotide
  Target: SCN9A; (+) strand; PAM type: YTN; PAM sequence: CTT
gttcttcttcccaccacact

SEQ ID NO: 100762 - DNA, 20 bp, Artificial Sequence
  Description of Artificial Sequence: Synthetic oligonucleotide
  Target: SCN9A; (+) strand; PAM type: YTN; PAM sequence: TTG
ttcttcttcccaccacactt

SEQ ID NO: 100763 - DNA, 20 bp, Artificial Sequence
  Description of Artificial Sequence: Synthetic oligonucleotide
  Target: SCN9A; (+) strand; PAM type: YTN; PAM sequence: TTC
ttcttcccaccacacttgca

SEQ ID NO: 100764 - DNA, 20 bp, Artificial Sequence
  Description of Artificial Sequence: Synthetic oligonucleotide
  Target: SCN9A; (+) strand; PAM type: YTN; PAM sequence: CTT
cttcccaccacacttgcagt

SEQ ID NO: 100765 - DNA, 20 bp, Artificial Sequence
  Description of Artificial Sequence: Synthetic oligonucleotide
  Target: SCN9A; (+) strand; PAM type: YTN; PAM sequence: TTC
ttcccaccacacttgcagtt

SEQ ID NO: 100766 - DNA, 20 bp, Artificial Sequence
  Description of Artificial Sequence: Synthetic oligonucleotide
  Target: SCN9A; (+) strand; PAM type: YTN; PAM sequence: CTT
cccaccacacttgcagttca

SEQ ID NO: 100767 - DNA, 20 bp, Artificial Sequence
  Description of Artificial Sequence: Synthetic oligonucleotide
  Target: SCN9A; (+) strand; PAM type: YTN; PAM sequence: TTC
ccaccacacttgcagttcag

SEQ ID NO: 100768 - DNA, 20 bp, Artificial Sequence
  Description of Artificial Sequence: Synthetic oligonucleotide
  Target: SCN9A; (+) strand; PAM type: YTN; PAM sequence: CTT
gcagttcagcagtttttaat

SEQ ID NO: 100769 - DNA, 20 bp, Artificial Sequence
  Description of Artificial Sequence: Synthetic oligonucleotide
  Target: SCN9A; (+) strand; PAM type: YTN; PAM sequence: TTG
cagttcagcagtttttaatt

SEQ ID NO: 100770 - DNA, 20 bp, Artificial Sequence
  Description of Artificial Sequence: Synthetic oligonucleotide
  Target: SCN9A; (+) strand; PAM type: YTN; PAM sequence: TTC
agcagtttttaatttcctga

SEQ ID NO: 100771 - DNA, 20 bp, Artificial Sequence
  Description of Artificial Sequence: Synthetic oligonucleotide
  Target: SCN9A; (+) strand; PAM type: YTN; PAM sequence: TTT
ttaatttcctgaatatctga

SEQ ID NO: 100772 - DNA, 20 bp, Artificial Sequence
  Description of Artificial Sequence: Synthetic oligonucleotide
  Target: SCN9A; (+) strand; PAM type: YTN; PAM sequence: TTT
taatttcctgaatatctgat

SEQ ID NO: 100773 - DNA, 20 bp, Artificial Sequence
  Description of Artificial Sequence: Synthetic oligonucleotide
  Target: SCN9A; (+) strand; PAM type: YTN; PAM sequence: TTT
aatttcctgaatatctgatg

SEQ ID NO: 100774 - DNA, 20 bp, Artificial Sequence
  Description of Artificial Sequence: Synthetic oligonucleotide
  Target: SCN9A; (+) strand; PAM type: YTN; PAM sequence: TTA
atttcctgaatatctgatgc

SEQ ID NO: 100775 - DNA, 20 bp, Artificial Sequence
  Description of Artificial Sequence: Synthetic oligonucleotide
  Target: SCN9A; (+) strand; PAM type: YTN; PAM sequence: TTT
cctgaatatctgatgctgtt

SEQ ID NO: 100776 - DNA, 20 bp, Artificial Sequence
  Description of Artificial Sequence: Synthetic oligonucleotide
  Target: SCN9A; (+) strand; PAM type: YTN; PAM sequence: TTC
ctgaatatctgatgctgttt

SEQ ID NO: 100777 - DNA, 20 bp, Artificial Sequence
  Description of Artificial Sequence: Synthetic oligonucleotide
  Target: SCN9A; (+) strand; PAM type: YTN; PAM sequence: CTG
aatatctgatgctgttttat

SEQ ID NO: 100778 - DNA, 20 bp, Artificial Sequence
  Description of Artificial Sequence: Synthetic oligonucleotide
  Target: SCN9A; (+) strand; PAM type: YTN; PAM sequence: CTG
atgctgttttatgcctcctt

SEQ ID NO: 100779 - DNA, 20 bp, Artificial Sequence
  Description of Artificial Sequence: Synthetic oligonucleotide
  Target: SCN9A; (+) strand; PAM type: YTN; PAM sequence: CTG
ttttatgcctccttacgatt

SEQ ID NO: 100780 - DNA, 20 bp, Artificial Sequence
  Description of Artificial Sequence: Synthetic oligonucleotide
  Target: SCN9A; (+) strand; PAM type: YTN; PAM sequence: TTT
tatgcctccttacgattgta

SEQ ID NO: 100781 - DNA, 20 bp, Artificial Sequence
  Description of Artificial Sequence: Synthetic oligonucleotide
  Target: SCN9A; (+) strand; PAM type: YTN; PAM sequence: TTT
atgcctccttacgattgtat

SEQ ID NO: 100782 - DNA, 20 bp, Artificial Sequence
  Description of Artificial Sequence: Synthetic oligonucleotide
  Target: SCN9A; (+) strand; PAM type: YTN; PAM sequence: TTA
tgcctccttacgattgtata

SEQ ID NO: 100783 - DNA, 20 bp, Artificial Sequence
  Description of Artificial Sequence: Synthetic oligonucleotide
  Target: SCN9A; (+) strand; PAM type: YTN; PAM sequence: CTC
cttacgattgtatacttgtt

SEQ ID NO: 100784 - DNA, 20 bp, Artificial Sequence
  Description of Artificial Sequence: Synthetic oligonucleotide
  Target: SCN9A; (+) strand; PAM type: YTN; PAM sequence: CTT
acgattgtatacttgttccc

SEQ ID NO: 100785 - DNA, 20 bp, Artificial Sequence
  Description of Artificial Sequence: Synthetic oligonucleotide
  Target: SCN9A; (+) strand; PAM type: YTN; PAM sequence: TTA
cgattgtatacttgttcccc

SEQ ID NO: 100786 - DNA, 20 bp, Artificial Sequence
  Description of Artificial Sequence: Synthetic oligonucleotide
  Target: SCN9A; (+) strand; PAM type: YTN; PAM sequence: TTG
tatacttgttcccctcagcc

SEQ ID NO: 100787 - DNA, 20 bp, Artificial Sequence
  Description of Artificial Sequence: Synthetic oligonucleotide
  Target: SCN9A; (+) strand; PAM type: YTN; PAM sequence: CTT
gttcccctcagcctgccttg

SEQ ID NO: 100788 - DNA, 20 bp, Artificial Sequence
  Description of Artificial Sequence: Synthetic oligonucleotide
  Target: SCN9A; (+) strand; PAM type: YTN; PAM sequence: TTG
ttcccctcagcctgccttgc

SEQ ID NO: 100789 - DNA, 20 bp, Artificial Sequence
  Description of Artificial Sequence: Synthetic oligonucleotide
  Target: SCN9A; (+) strand; PAM type: YTN; PAM sequence: TTC
ccctcagcctgccttgccta

SEQ ID NO: 100790 - DNA, 20 bp, Artificial Sequence
  Description of Artificial Sequence: Synthetic oligonucleotide
  Target: SCN9A; (+) strand; PAM type: YTN; PAM sequence: CTC
agcctgccttgcctaactag

SEQ ID NO: 100791 - DNA, 20 bp, Artificial Sequence
  Description of Artificial Sequence: Synthetic oligonucleotide
  Target: SCN9A; (+) strand; PAM type: YTN; PAM sequence: CTG
ccttgcctaactagaaaatt

SEQ ID NO: 100792 - DNA, 20 bp, Artificial Sequence
  Description of Artificial Sequence: Synthetic oligonucleotide
  Target: SCN9A; (+) strand; PAM type: YTN; PAM sequence: CTT
gcctaactagaaaattcctg

SEQ ID NO: 100793 - DNA, 20 bp, Artificial Sequence
  Description of Artificial Sequence: Synthetic oligonucleotide
  Target: SCN9A; (+) strand; PAM type: YTN; PAM sequence: TTG
cctaactagaaaattcctgt

SEQ ID NO: 100794 - DNA, 20 bp, Artificial Sequence
  Description of Artificial Sequence: Synthetic oligonucleotide
  Target: SCN9A; (+) strand; PAM type: YTN; PAM sequence: CTA
actagaaaattcctgttcgt

SEQ ID NO: 100795 - DNA, 20 bp, Artificial Sequence
  Description of Artificial Sequence: Synthetic oligonucleotide
  Target: SCN9A; (+) strand; PAM type: YTN; PAM sequence: CTA
gaaaattcctgttcgtcttt

SEQ ID NO: 100796 - DNA, 20 bp, Artificial Sequence
  Description of Artificial Sequence: Synthetic oligonucleotide
  Target: SCN9A; (+) strand; PAM type: YTN; PAM sequence: TTC
ctgttcgtctttctagaccc

SEQ ID NO: 100797 - DNA, 20 bp, Artificial Sequence
  Description of Artificial Sequence: Synthetic oligonucleotide
  Target: SCN9A; (+) strand; PAM type: YTN; PAM sequence: CTG
ttcgtctttctagaccctga

SEQ ID NO: 100798 - DNA, 20 bp, Artificial Sequence
  Description of Artificial Sequence: Synthetic oligonucleotide
  Target: SCN9A; (+) strand; PAM type: YTN; PAM sequence: TTC
gtctttctagaccctgaaaa

SEQ ID NO: 100799 - DNA, 20 bp, Artificial Sequence
  Description of Artificial Sequence: Synthetic oligonucleotide
  Target: SCN9A; (+) strand; PAM type: YTN; PAM sequence: CTT
tctagaccctgaaaagcacc

SEQ ID NO: 100800 - DNA, 20 bp, Artificial Sequence
  Description of Artificial Sequence: Synthetic oligonucleotide
  Target: SCN9A; (+) strand; PAM type: YTN; PAM sequence: TTT
ctagaccctgaaaagcacca

SEQ ID NO: 100801 - DNA, 20 bp, Artificial Sequence
  Description of Artificial Sequence: Synthetic oligonucleotide
  Target: SCN9A; (+) strand; PAM type: YTN; PAM sequence: TTC
tagaccctgaaaagcaccat

SEQ ID NO: 100802 - DNA, 20 bp, Artificial Sequence
  Description of Artificial Sequence: Synthetic oligonucleotide
  Target: SCN9A; (+) strand; PAM type: YTN; PAM sequence: CTA
gaccctgaaaagcaccattt

SEQ ID NO: 100803 - DNA, 20 bp, Artificial Sequence
  Description of Artificial Sequence: Synthetic oligonucleotide
  Target: SCN9A; (+) strand; PAM type: YTN; PAM sequence: CTG
aaaagcaccatttacgtttc

SEQ ID NO: 100804 - DNA, 20 bp, Artificial Sequence
  Description of Artificial Sequence: Synthetic oligonucleotide
  Target: SCN9A; (+) strand; PAM type: YTN; PAM sequence: TTT
acgtttctgaaattgcaagc

SEQ ID NO: 100805 - DNA, 20 bp, Artificial Sequence
  Description of Artificial Sequence: Synthetic oligonucleotide
  Target: SCN9A; (+) strand; PAM type: YTN; PAM sequence: TTA
cgtttctgaaattgcaagca

SEQ ID NO: 100806 - DNA, 20 bp, Artificial Sequence
  Description of Artificial Sequence: Synthetic oligonucleotide
  Target: SCN9A; (+) strand; PAM type: YTN; PAM sequence: TTT
ctgaaattgcaagcagttgt

SEQ ID NO: 100807 - DNA, 20 bp, Artificial Sequence
  Description of Artificial Sequence: Synthetic oligonucleotide
  Target: SCN9A; (+) strand; PAM type: YTN; PAM sequence: TTC
tgaaattgcaagcagttgtt

SEQ ID NO: 100808 - DNA, 20 bp, Artificial Sequence
  Description of Artificial Sequence: Synthetic oligonucleotide
  Target: SCN9A; (+) strand; PAM type: YTN; PAM sequence: CTG
aaattgcaagcagttgttct

SEQ ID NO: 100809 - DNA, 20 bp, Artificial Sequence
  Description of Artificial Sequence: Synthetic oligonucleotide
  Target: SCN9A; (+) strand; PAM type: YTN; PAM sequence: TTG
caagcagttgttctccttgc

SEQ ID NO: 100810 - DNA, 20 bp, Artificial Sequence
  Description of Artificial Sequence: Synthetic oligonucleotide
  Target: SCN9A; (+) strand; PAM type: YTN; PAM sequence: TTG
ttctccttgctacagaactt

SEQ ID NO: 100811 - DNA, 20 bp, Artificial Sequence
  Description of Artificial Sequence: Synthetic oligonucleotide
  Target: SCN9A; (+) strand; PAM type: YTN; PAM sequence: TTC
tccttgctacagaactttgt

SEQ ID NO: 100812 - DNA, 20 bp, Artificial Sequence
  Description of Artificial Sequence: Synthetic oligonucleotide
  Target: SCN9A; (+) strand; PAM type: YTN; PAM sequence: CTC
cttgctacagaactttgtca

SEQ ID NO: 100813 - DNA, 20 bp, Artificial Sequence
  Description of Artificial Sequence: Synthetic oligonucleotide
  Target: SCN9A; (+) strand; PAM type: YTN; PAM sequence: CTT
gctacagaactttgtcacat

SEQ ID NO: 100814 - DNA, 20 bp, Artificial Sequence
  Description of Artificial Sequence: Synthetic oligonucleotide
  Target: SCN9A; (+) strand; PAM type: YTN; PAM sequence: TTG
ctacagaactttgtcacatt

SEQ ID NO: 100815 - DNA, 20 bp, Artificial Sequence
  Description of Artificial Sequence: Synthetic oligonucleotide
  Target: SCN9A; (+) strand; PAM type: YTN; PAM sequence: CTA
cagaactttgtcacatttac

SEQ ID NO: 100816 - DNA, 20 bp, Artificial Sequence
  Description of Artificial Sequence: Synthetic oligonucleotide
  Target: SCN9A; (+) strand; PAM type: YTN; PAM sequence: CTT
tgtcacatttacactttgct

SEQ ID NO: 100817 - DNA, 20 bp, Artificial Sequence
  Description of Artificial Sequence: Synthetic oligonucleotide
  Target: SCN9A; (+) strand; PAM type: YTN; PAM sequence: TTT
gtcacatttacactttgctt

SEQ ID NO: 100818 - DNA, 20 bp, Artificial Sequence
  Description of Artificial Sequence: Synthetic oligonucleotide
  Target: SCN9A; (+) strand; PAM type: YTN; PAM sequence: TTG
tcacatttacactttgctta

SEQ ID NO: 100819 - DNA, 20 bp, Artificial Sequence
  Description of Artificial Sequence: Synthetic oligonucleotide
  Target: SCN9A; (+) strand; PAM type: YTN; PAM sequence: TTT
acactttgcttacaaacaca

SEQ ID NO: 100820 - DNA, 20 bp, Artificial Sequence
  Description of Artificial Sequence: Synthetic oligonucleotide
  Target: SCN9A; (+) strand; PAM type: YTN; PAM sequence: TTA
cactttgcttacaaacacat

SEQ ID NO: 100821 - DNA, 20 bp, Artificial Sequence
  Description of Artificial Sequence: Synthetic oligonucleotide
  Target: SCN9A; (+) strand; PAM type: YTN; PAM sequence: CTT
tgcttacaaacacatccaag

SEQ ID NO: 100822 - DNA, 20 bp, Artificial Sequence
  Description of Artificial Sequence: Synthetic oligonucleotide
  Target: SCN9A; (+) strand; PAM type: YTN; PAM sequence: TTT
gcttacaaacacatccaagc

SEQ ID NO: 100823 - DNA, 20 bp, Artificial Sequence
  Description of Artificial Sequence: Synthetic oligonucleotide
  Target: SCN9A; (+) strand; PAM type: YTN; PAM sequence: TTG
cttacaaacacatccaagct

SEQ ID NO: 100824 - DNA, 20 bp, Artificial Sequence
  Description of Artificial Sequence: Synthetic oligonucleotide
  Target: SCN9A; (+) strand; PAM type: YTN; PAM sequence: CTT
acaaacacatccaagctcta

SEQ ID NO: 100825 - DNA, 20 bp, Artificial Sequence
  Description of Artificial Sequence: Synthetic oligonucleotide
  Target: SCN9A; (+) strand; PAM type: YTN; PAM sequence: TTA
caaacacatccaagctctac

SEQ ID NO: 100826 - DNA, 20 bp, Artificial Sequence
  Description of Artificial Sequence: Synthetic oligonucleotide
  Target: SCN9A; (+) strand; PAM type: YTN; PAM sequence: CTC
tacagttactcatttgtatt

SEQ ID NO: 100827 - DNA, 20 bp, Artificial Sequence
  Description of Artificial Sequence: Synthetic oligonucleotide
  Target: SCN9A; (+) strand; PAM type: YTN; PAM sequence: CTA
cagttactcatttgtattct

SEQ ID NO: 100828 - DNA, 20 bp, Artificial Sequence
  Description of Artificial Sequence: Synthetic oligonucleotide
  Target: SCN9A; (+) strand; PAM type: YTN; PAM sequence: TTA
ctcatttgtattcttctctt

SEQ ID NO: 100829 - DNA, 20 bp, Artificial Sequence
  Description of Artificial Sequence: Synthetic oligonucleotide
  Target: SCN9A; (+) strand; PAM type: YTN; PAM sequence: CTC
atttgtattcttctcttctc

SEQ ID NO: 100830 - DNA, 20 bp, Artificial Sequence
  Description of Artificial Sequence: Synthetic oligonucleotide
  Target: SCN9A; (+) strand; PAM type: YTN; PAM sequence: TTT
gtattcttctcttctccatt

SEQ ID NO: 100831 - DNA, 20 bp, Artificial Sequence
  Description of Artificial Sequence: Synthetic oligonucleotide
  Target: SCN9A; (+) strand; PAM type: YTN; PAM sequence: TTG
tattcttctcttctccattg

SEQ ID NO: 100832 - DNA, 20 bp, Artificial Sequence
  Description of Artificial Sequence: Synthetic oligonucleotide
  Target: SCN9A; (+) strand; PAM type: YTN; PAM sequence: TTC
ttctcttctccattgctctg

SEQ ID NO: 100833 - DNA, 20 bp, Artificial Sequence
  Description of Artificial Sequence: Synthetic oligonucleotide
  Target: SCN9A; (+) strand; PAM type: YTN; PAM sequence: CTT
ctcttctccattgctctgag

SEQ ID NO: 100834 - DNA, 20 bp, Artificial Sequence
  Description of Artificial Sequence: Synthetic oligonucleotide
  Target: SCN9A; (+) strand; PAM type: YTN; PAM sequence: TTC
tcttctccattgctctgagc

SEQ ID NO: 100835 - DNA, 20 bp, Artificial Sequence
  Description of Artificial Sequence: Synthetic oligonucleotide
  Target: SCN9A; (+) strand; PAM type: YTN; PAM sequence: CTC
ttctccattgctctgagctc

SEQ ID NO: 100836 - DNA, 20 bp, Artificial Sequence
  Description of Artificial Sequence: Synthetic oligonucleotide
  Target: SCN9A; (+) strand; PAM type: YTN; PAM sequence: CTT
ctccattgctctgagctcct

SEQ ID NO: 100837 - DNA, 20 bp, Artificial Sequence
  Description of Artificial Sequence: Synthetic oligonucleotide
  Target: SCN9A; (+) strand; PAM type: YTN; PAM sequence: TTC
tccattgctctgagctcctt

SEQ ID NO: 100838 - DNA, 20 bp, Artificial Sequence
  Description of Artificial Sequence: Synthetic oligonucleotide
  Target: SCN9A; (+) strand; PAM type: YTN; PAM sequence: CTC
cattgctctgagctccttaa

SEQ ID NO: 100839 - DNA, 20 bp, Artificial Sequence
  Description of Artificial Sequence: Synthetic oligonucleotide
  Target: SCN9A; (+) strand; PAM type: YTN; PAM sequence: TTG
ctctgagctccttaagaata

SEQ ID NO: 100840 - DNA, 20 bp, Artificial Sequence
  Description of Artificial Sequence: Synthetic oligonucleotide
  Target: SCN9A; (+) strand; PAM type: YTN; PAM sequence: CTC
tgagctccttaagaataaac

SEQ ID NO: 100841 - DNA, 20 bp, Artificial Sequence
  Description of Artificial Sequence: Synthetic oligonucleotide
  Target: SCN9A; (+) strand; PAM type: YTN; PAM sequence: CTG
agctccttaagaataaacag

SEQ ID NO: 100842 - DNA, 20 bp, Artificial Sequence
  Description of Artificial Sequence: Synthetic oligonucleotide
  Target: SCN9A; (+) strand; PAM type: YTN; PAM sequence: CTC
cttaagaataaacagtacct

SEQ ID NO: 100843 - DNA, 20 bp, Artificial Sequence
  Description of Artificial Sequence: Synthetic oligonucleotide
  Target: SCN9A; (+) strand; PAM type: YTN; PAM sequence: CTT
aagaataaacagtacctgga

SEQ ID NO: 100844 - DNA, 20 bp, Artificial Sequence
  Description of Artificial Sequence: Synthetic oligonucleotide
  Target: SCN9A; (+) strand; PAM type: YTN; PAM sequence: TTA
agaataaacagtacctggat

SEQ ID NO: 100845 - DNA, 20 bp, Artificial Sequence
  Description of Artificial Sequence: Synthetic oligonucleotide
  Target: SCN9A; (+) strand; PAM type: YTN; PAM sequence: CTG
gatcttatttatctttgcat

SEQ ID NO: 100846 - DNA, 20 bp, Artificial Sequence
  Description of Artificial Sequence: Synthetic oligonucleotide
  Target: SCN9A; (+) strand; PAM type: YTN; PAM sequence: CTT
atttatctttgcattgtgaa

SEQ ID NO: 100847 - DNA, 20 bp, Artificial Sequence
  Description of Artificial Sequence: Synthetic oligonucleotide
  Target: SCN9A; (+) strand; PAM type: YTN; PAM sequence: TTA
tttatctttgcattgtgaaa

SEQ ID NO: 100848 - DNA, 20 bp, Artificial Sequence
  Description of Artificial Sequence: Synthetic oligonucleotide
  Target: SCN9A; (+) strand; PAM type: YTN; PAM sequence: TTT
atctttgcattgtgaaagtt

SEQ ID NO: 100849 - DNA, 20 bp, Artificial Sequence
  Description of Artificial Sequence: Synthetic oligonucleotide
  Target: SCN9A; (+) strand; PAM type: YTN; PAM sequence: TTA
tctttgcattgtgaaagttg

SEQ ID NO: 100850 - DNA, 20 bp, Artificial Sequence
  Description of Artificial Sequence: Synthetic oligonucleotide
  Target: SCN9A; (+) strand; PAM type: YTN; PAM sequence: CTT
tgcattgtgaaagttgatca

SEQ ID NO: 100851 - DNA, 20 bp, Artificial Sequence
  Description of Artificial Sequence: Synthetic oligonucleotide
  Target: SCN9A; (+) strand; PAM type: YTN; PAM sequence: TTT
gcattgtgaaagttgatcat

SEQ ID NO: 100852 - DNA, 20 bp, Artificial Sequence
  Description of Artificial Sequence: Synthetic oligonucleotide
  Target: SCN9A; (+) strand; PAM type: YTN; PAM sequence: TTG
cattgtgaaagttgatcata

SEQ ID NO: 100853 - DNA, 20 bp, Artificial Sequence
  Description of Artificial Sequence: Synthetic oligonucleotide
  Target: SCN9A; (+) strand; PAM type: YTN; PAM sequence: TTG
tgaaagttgatcatacaaat

SEQ ID NO: 100854 - DNA, 20 bp, Artificial Sequence
  Description of Artificial Sequence: Synthetic oligonucleotide
  Target: SCN9A; (+) strand; PAM type: YTN; PAM sequence: TTG
atcatacaaattgggtagtt

SEQ ID NO: 100855 - DNA, 20 bp, Artificial Sequence
  Description of Artificial Sequence: Synthetic oligonucleotide
  Target: SCN9A; (+) strand; PAM type: YTN; PAM sequence: TTG
ggtagttcttgtcctactca

SEQ ID NO: 100856 - DNA, 20 bp, Artificial Sequence
  Description of Artificial Sequence: Synthetic oligonucleotide
  Target: SCN9A; (+) strand; PAM type: YTN; PAM sequence: TTC
ttgtcctactcaactaacag

SEQ ID NO: 100857 - DNA, 20 bp, Artificial Sequence
  Description of Artificial Sequence: Synthetic oligonucleotide
  Target: SCN9A; (+) strand; PAM type: YTN; PAM sequence: CTT
gtcctactcaactaacagtc

SEQ ID NO: 100858 - DNA, 20 bp, Artificial Sequence
  Description of Artificial Sequence: Synthetic oligonucleotide
  Target: SCN9A; (+) strand; PAM type: YTN; PAM sequence: TTG
tcctactcaactaacagtca

SEQ ID NO: 100859 - DNA, 20 bp, Artificial Sequence
  Description of Artificial Sequence: Synthetic oligonucleotide
  Target: SCN9A; (+) strand; PAM type: YTN; PAM sequence: CTA
ctcaactaacagtcaactaa

SEQ ID NO: 100860 - DNA, 20 bp, Artificial Sequence
  Description of Artificial Sequence: Synthetic oligonucleotide
  Target: SCN9A; (+) strand; PAM type: YTN; PAM sequence: CTC
aactaacagtcaactaagag

SEQ ID NO: 100861 - DNA, 20 bp, Artificial Sequence
  Description of Artificial Sequence: Synthetic oligonucleotide
  Target: SCN9A; (+) strand; PAM type: YTN; PAM sequence: CTA
acagtcaactaagagtcaag

SEQ ID NO: 100862 - DNA, 20 bp, Artificial Sequence
  Description of Artificial Sequence: Synthetic oligonucleotide
  Target: SCN9A; (+) strand; PAM type: YTN; PAM sequence: CTA
agagtcaagaaggcaggggg

SEQ ID NO: 100863 - DNA, 20 bp, Artificial Sequence
  Description of Artificial Sequence: Synthetic oligonucleotide
  Target: SCN9A; (+) strand; PAM type: YTN; PAM sequence: CTC
tcagggtacaaaacattact

SEQ ID NO: 100864 - DNA, 20 bp, Artificial Sequence
  Description of Artificial Sequence: Synthetic oligonucleotide
  Target: SCN9A; (+) strand; PAM type: YTN; PAM sequence: CTC
agggtacaaaacattactcc

SEQ ID NO: 100865 - DNA, 20 bp, Artificial Sequence
  Description of Artificial Sequence: Synthetic oligonucleotide
  Target: SCN9A; (+) strand; PAM type: YTN; PAM sequence: TTA
ctccaagaattataattctc

SEQ ID NO: 100866 - DNA, 20 bp, Artificial Sequence
  Description of Artificial Sequence: Synthetic oligonucleotide
  Target: SCN9A; (+) strand; PAM type: YTN; PAM sequence: CTC
caagaattataattctctgc

SEQ ID NO: 100867 - DNA, 20 bp, Artificial Sequence
  Description of Artificial Sequence: Synthetic oligonucleotide
  Target: SCN9A; (+) strand; PAM type: YTN; PAM sequence: TTA
taattctctgcaagactgac

SEQ ID NO: 100868 - DNA, 20 bp, Artificial Sequence
  Description of Artificial Sequence: Synthetic oligonucleotide
  Target: SCN9A; (+) strand; PAM type: YTN; PAM sequence: TTC
tctgcaagactgactgttga

SEQ ID NO: 100869 - DNA, 20 bp, Artificial Sequence
  Description of Artificial Sequence: Synthetic oligonucleotide
  Target: SCN9A; (+) strand; PAM type: YTN; PAM sequence: CTC
tgcaagactgactgttgaag

SEQ ID NO: 100870 - DNA, 20 bp, Artificial Sequence
  Description of Artificial Sequence: Synthetic oligonucleotide
  Target: SCN9A; (+) strand; PAM type: YTN; PAM sequence: CTG
caagactgactgttgaagct

SEQ ID NO: 100871 - DNA, 20 bp, Artificial Sequence
  Description of Artificial Sequence: Synthetic oligonucleotide
  Target: SCN9A; (+) strand; PAM type: YTN; PAM sequence: CTG
actgttgaagctgcttgttg

SEQ ID NO: 100872 - DNA, 20 bp, Artificial Sequence
  Description of Artificial Sequence: Synthetic oligonucleotide
  Target: SCN9A; (+) strand; PAM type: YTN; PAM sequence: CTG
ttgaagctgcttgttgtaac

SEQ ID NO: 100873 - DNA, 20 bp, Artificial Sequence
  Description of Artificial Sequence: Synthetic oligonucleotide
  Target: SCN9A; (+) strand; PAM type: YTN; PAM sequence: TTG
aagctgcttgttgtaacttg

SEQ ID NO: 100874 - DNA, 20 bp, Artificial Sequence
  Description of Artificial Sequence: Synthetic oligonucleotide
  Target: SCN9A; (+) strand; PAM type: YTN; PAM sequence: CTG
cttgttgtaacttgaaatta

SEQ ID NO: 100875 - DNA, 20 bp, Artificial Sequence
  Description of Artificial Sequence: Synthetic oligonucleotide
  Target: SCN9A; (+) strand; PAM type: YTN; PAM sequence: CTT
gttgtaacttgaaattagtt

SEQ ID NO: 100876 - DNA, 20 bp, Artificial Sequence
  Description of Artificial Sequence: Synthetic oligonucleotide
  Target: SCN9A; (+) strand; PAM type: YTN; PAM sequence: TTG
ttgtaacttgaaattagttt

SEQ ID NO: 100877 - DNA, 20 bp, Artificial Sequence
  Description of Artificial Sequence: Synthetic oligonucleotide
  Target: SCN9A; (+) strand; PAM type: YTN; PAM sequence: TTG
taacttgaaattagttttat

SEQ ID NO: 100878 - DNA, 20 bp, Artificial Sequence
  Description of Artificial Sequence: Synthetic oligonucleotide
  Target: SCN9A; (+) strand; PAM type: YTN; PAM sequence: CTT
gaaattagttttatctatag

SEQ ID NO: 100879 - DNA, 20 bp, Artificial Sequence
  Description of Artificial Sequence: Synthetic oligonucleotide
  Target: SCN9A; (+) strand; PAM type: YTN; PAM sequence: TTG
aaattagttttatctatagc

SEQ ID NO: 100880 - DNA, 20 bp, Artificial Sequence
  Description of Artificial Sequence: Synthetic oligonucleotide
  Target: SCN9A; (+) strand; PAM type: YTN; PAM sequence: TTA
gttttatctatagcttctga

SEQ ID NO: 100881 - DNA, 20 bp, Artificial Sequence
  Description of Artificial Sequence: Synthetic oligonucleotide
  Target: SCN9A; (+) strand; PAM type: YTN; PAM sequence: TTT
tatctatagcttctgaggaa

SEQ ID NO: 100882 - DNA, 20 bp, Artificial Sequence
  Description of Artificial Sequence: Synthetic oligonucleotide
  Target: SCN9A; (+) strand; PAM type: YTN; PAM sequence: TTT
atctatagcttctgaggaaa

SEQ ID NO: 100883 - DNA, 20 bp, Artificial Sequence
  Description of Artificial Sequence: Synthetic oligonucleotide
  Target: SCN9A; (+) strand; PAM type: YTN; PAM sequence: TTA
tctatagcttctgaggaaac

SEQ ID NO: 100884 - DNA, 20 bp, Artificial Sequence
  Description of Artificial Sequence: Synthetic oligonucleotide
  Target: SCN9A; (+) strand; PAM type: YTN; PAM sequence: CTA
tagcttctgaggaaacctgt

SEQ ID NO: 100885 - DNA, 20 bp, Artificial Sequence
  Description of Artificial Sequence: Synthetic oligonucleotide
  Target: SCN9A; (+) strand; PAM type: YTN; PAM sequence: CTT
ctgaggaaacctgttacact

SEQ ID NO: 100886 - DNA, 20 bp, Artificial Sequence
  Description of Artificial Sequence: Synthetic oligonucleotide
  Target: SCN9A; (+) strand; PAM type: YTN; PAM sequence: TTC
tgaggaaacctgttacactc

SEQ ID NO: 100887 - DNA, 20 bp, Artificial Sequence
  Description of Artificial Sequence: Synthetic oligonucleotide
  Target: SCN9A; (+) strand; PAM type: YTN; PAM sequence: CTG
aggaaacctgttacactcta

SEQ ID NO: 100888 - DNA, 20 bp, Artificial Sequence
  Description of Artificial Sequence: Synthetic oligonucleotide
  Target: SCN9A; (+) strand; PAM type: YTN; PAM sequence: CTG
ttacactctaggactaattg

SEQ ID NO: 100889 - DNA, 20 bp, Artificial Sequence
  Description of Artificial Sequence: Synthetic oligonucleotide
  Target: SCN9A; (+) strand; PAM type: YTN; PAM sequence: TTA
cactctaggactaattgtgc

SEQ ID NO: 100890 - DNA, 20 bp, Artificial Sequence
  Description of Artificial Sequence: Synthetic oligonucleotide
  Target: SCN9A; (+) strand; PAM type: YTN; PAM sequence: CTC
taggactaattgtgccaacg

SEQ ID NO: 100891 - DNA, 20 bp, Artificial Sequence
  Description of Artificial Sequence: Synthetic oligonucleotide
  Target: SCN9A; (+) strand; PAM type: YTN; PAM sequence: CTA
ggactaattgtgccaacgac

SEQ ID NO: 100892 - DNA, 20 bp, Artificial Sequence
  Description of Artificial Sequence: Synthetic oligonucleotide
  Target: SCN9A; (+) strand; PAM type: YTN; PAM sequence: CTA
attgtgccaacgactgttgc

SEQ ID NO: 100893 - DNA, 20 bp, Artificial Sequence
  Description of Artificial Sequence: Synthetic oligonucleotide
  Target: SCN9A; (+) strand; PAM type: YTN; PAM sequence: TTG
tgccaacgactgttgctcgc

SEQ ID NO: 100894 - DNA, 20 bp, Artificial Sequence
  Description of Artificial Sequence: Synthetic oligonucleotide
  Target: SCN9A; (+) strand; PAM type: YTN; PAM sequence: CTG
ttgctcgccagttggagctt

SEQ ID NO: 100895 - DNA, 20 bp, Artificial Sequence
  Description of Artificial Sequence: Synthetic oligonucleotide
  Target: SCN9A; (+) strand; PAM type: YTN; PAM sequence: TTG
ctcgccagttggagcttacc

SEQ ID NO: 100896 - DNA, 20 bp, Artificial Sequence
  Description of Artificial Sequence: Synthetic oligonucleotide
  Target: SCN9A; (+) strand; PAM type: YTN; PAM sequence: CTC
gccagttggagcttaccagt

SEQ ID NO: 100897 - DNA, 20 bp, Artificial Sequence
  Description of Artificial Sequence: Synthetic oligonucleotide
  Target: SCN9A; (+) strand; PAM type: YTN; PAM sequence: TTG
gagcttaccagttccccaga

SEQ ID NO: 100898 - DNA, 20 bp, Artificial Sequence
  Description of Artificial Sequence: Synthetic oligonucleotide
  Target: SCN9A; (+) strand; PAM type: YTN; PAM sequence: CTT
accagttccccagatcctta

SEQ ID NO: 100899 - DNA, 20 bp, Artificial Sequence
  Description of Artificial Sequence: Synthetic oligonucleotide
  Target: SCN9A; (+) strand; PAM type: YTN; PAM sequence: TTA
ccagttccccagatccttac

SEQ ID NO: 100900 - DNA, 20 bp, Artificial Sequence
  Description of Artificial Sequence: Synthetic oligonucleotide
  Target: SCN9A; (+) strand; PAM type: YTN; PAM sequence: TTC
cccagatccttactagggcc

SEQ ID NO: 100901 - DNA, 20 bp, Artificial Sequence
  Description of Artificial Sequence: Synthetic oligonucleotide
  Target: SCN9A; (+) strand; PAM type: YTN; PAM sequence: CTT
actagggccaatgaactttc

SEQ ID NO: 100902 - DNA, 20 bp, Artificial Sequence
  Description of Artificial Sequence: Synthetic oligonucleotide
  Target: SCN9A; (+) strand; PAM type: YTN; PAM sequence: TTA
ctagggccaatgaactttct

SEQ ID NO: 100903 - DNA, 20 bp, Artificial Sequence
  Description of Artificial Sequence: Synthetic oligonucleotide
  Target: SCN9A; (+) strand; PAM type: YTN; PAM sequence: CTA
gggccaatgaactttctcaa

SEQ ID NO: 100904 - DNA, 20 bp, Artificial Sequence
  Description of Artificial Sequence: Synthetic oligonucleotide
  Target: SCN9A; (+) strand; PAM type: YTN; PAM sequence: CTT
tctcaaagagcaatatataa

SEQ ID NO: 100905 - DNA, 20 bp, Artificial Sequence
  Description of Artificial Sequence: Synthetic oligonucleotide
  Target: SCN9A; (+) strand; PAM type: YTN; PAM sequence: TTT
ctcaaagagcaatatataac

SEQ ID NO: 100906 - DNA, 20 bp, Artificial Sequence
  Description of Artificial Sequence: Synthetic oligonucleotide
  Target: SCN9A; (+) strand; PAM type: YTN; PAM sequence: TTC
tcaaagagcaatatataaca

SEQ ID NO: 100907 - DNA, 20 bp, Artificial Sequence
  Description of Artificial Sequence: Synthetic oligonucleotide
  Target: SCN9A; (+) strand; PAM type: YTN; PAM sequence: CTC
aaagagcaatatataacatt

SEQ ID NO: 100908 - DNA, 20 bp, Artificial Sequence
  Description of Artificial Sequence: Synthetic oligonucleotide
  Target: SCN9A; (+) strand; PAM type: YTN; PAM sequence: TTT
tcccattttaataaaacctc

SEQ ID NO: 100909 - DNA, 20 bp, Artificial Sequence
  Description of Artificial Sequence: Synthetic oligonucleotide
  Target: SCN9A; (+) strand; PAM type: YTN; PAM sequence: TTT
cccattttaataaaacctct

SEQ ID NO: 100910 - DNA, 20 bp, Artificial Sequence
  Description of Artificial Sequence: Synthetic oligonucleotide
  Target: SCN9A; (+) strand; PAM type: YTN; PAM sequence: TTC
ccattttaataaaacctcta

SEQ ID NO: 100911 - DNA, 20 bp, Artificial Sequence
  Description of Artificial Sequence: Synthetic oligonucleotide
  Target: SCN9A; (+) strand; PAM type: YTN; PAM sequence: TTT
taataaaacctctaaccttc

SEQ ID NO: 100912 - DNA, 20 bp, Artificial Sequence
  Description of Artificial Sequence: Synthetic oligonucleotide
  Target: SCN9A; (+) strand; PAM type: YTN; PAM sequence: TTT
aataaaacctctaaccttct

SEQ ID NO: 100913 - DNA, 20 bp, Artificial Sequence
  Description of Artificial Sequence: Synthetic oligonucleotide
  Target: SCN9A; (+) strand; PAM type: YTN; PAM sequence: TTA
ataaaacctctaaccttctc

SEQ ID NO: 100914 - DNA, 20 bp, Artificial Sequence
  Description of Artificial Sequence: Synthetic oligonucleotide
  Target: SCN9A; (+) strand; PAM type: YTN; PAM sequence: CTC
taaccttctctctttgttct

SEQ ID NO: 100915 - DNA, 20 bp, Artificial Sequence
  Description of Artificial Sequence: Synthetic oligonucleotide
  Target: SCN9A; (+) strand; PAM type: YTN; PAM sequence: CTA
accttctctctttgttctac

SEQ ID NO: 100916 - DNA, 20 bp, Artificial Sequence
  Description of Artificial Sequence: Synthetic oligonucleotide
  Target: SCN9A; (+) strand; PAM type: YTN; PAM sequence: CTT
ctctctttgttctacaggga

SEQ ID NO: 100917 - DNA, 20 bp, Artificial Sequence
  Description of Artificial Sequence: Synthetic oligonucleotide
  Target: SCN9A; (+) strand; PAM type: YTN; PAM sequence: TTC
tctctttgttctacagggaa

SEQ ID NO: 100918 - DNA, 20 bp, Artificial Sequence
  Description of Artificial Sequence: Synthetic oligonucleotide
  Target: SCN9A; (+) strand; PAM type: YTN; PAM sequence: CTC
tctttgttctacagggaaag

SEQ ID NO: 100919 - DNA, 20 bp, Artificial Sequence
  Description of Artificial Sequence: Synthetic oligonucleotide
  Target: SCN9A; (+) strand; PAM type: YTN; PAM sequence: CTC
tttgttctacagggaaagtg

SEQ ID NO: 100920 - DNA, 20 bp, Artificial Sequence
  Description of Artificial Sequence: Synthetic oligonucleotide
  Target: SCN9A; (+) strand; PAM type: YTN; PAM sequence: CTT
tgttctacagggaaagtgct

SEQ ID NO: 100921 - DNA, 20 bp, Artificial Sequence
  Description of Artificial Sequence: Synthetic oligonucleotide
  Target: SCN9A; (+) strand; PAM type: YTN; PAM sequence: TTT
gttctacagggaaagtgctt

SEQ ID NO: 100922 - DNA, 20 bp, Artificial Sequence
  Description of Artificial Sequence: Synthetic oligonucleotide
  Target: SCN9A; (+) strand; PAM type: YTN; PAM sequence: TTG
ttctacagggaaagtgcttt

SEQ ID NO: 100923 - DNA, 20 bp, Artificial Sequence
  Description of Artificial Sequence: Synthetic oligonucleotide
  Target: SCN9A; (+) strand; PAM type: YTN; PAM sequence: TTC
tacagggaaagtgctttcag

SEQ ID NO: 100924 - DNA, 20 bp, Artificial Sequence
  Description of Artificial Sequence: Synthetic oligonucleotide
  Target: SCN9A; (+) strand; PAM type: YTN; PAM sequence: CTA
cagggaaagtgctttcagtt

SEQ ID NO: 100925 - DNA, 20 bp, Artificial Sequence
  Description of Artificial Sequence: Synthetic oligonucleotide
  Target: SCN9A; (+) strand; PAM type: YTN; PAM sequence: CTT
tcagtttatgccacagactc

SEQ ID NO: 100926 - DNA, 20 bp, Artificial Sequence
  Description of Artificial Sequence: Synthetic oligonucleotide
  Target: SCN9A; (+) strand; PAM type: YTN; PAM sequence: TTT
cagtttatgccacagactct

SEQ ID NO: 100927 - DNA, 20 bp, Artificial Sequence
  Description of Artificial Sequence: Synthetic oligonucleotide
  Target: SCN9A; (+) strand; PAM type: YTN; PAM sequence: TTC
agtttatgccacagactctc

SEQ ID NO: 100928 - DNA, 20 bp, Artificial Sequence
  Description of Artificial Sequence: Synthetic oligonucleotide
  Target: SCN9A; (+) strand; PAM type: YTN; PAM sequence: TTT
atgccacagactctctccct

SEQ ID NO: 100929 - DNA, 20 bp, Artificial Sequence
  Description of Artificial Sequence: Synthetic oligonucleotide
  Target: SCN9A; (+) strand; PAM type: YTN; PAM sequence: TTA
tgccacagactctctccctg

SEQ ID NO: 100930 - DNA, 20 bp, Artificial Sequence
  Description of Artificial Sequence: Synthetic oligonucleotide
  Target: SCN9A; (+) strand; PAM type: YTN; PAM sequence: CTC
tctccctgttttgcaaactg

SEQ ID NO: 100931 - DNA, 20 bp, Artificial Sequence
  Description of Artificial Sequence: Synthetic oligonucleotide
  Target: SCN9A; (+) strand; PAM type: YTN; PAM sequence: CTC
tccctgttttgcaaactgat

SEQ ID NO: 100932 - DNA, 20 bp, Artificial Sequence
  Description of Artificial Sequence: Synthetic oligonucleotide
  Target: SCN9A; (+) strand; PAM type: YTN; PAM sequence: CTC
cctgttttgcaaactgatat

SEQ ID NO: 100933 - DNA, 20 bp, Artificial Sequence
  Description of Artificial Sequence: Synthetic oligonucleotide
  Target: SCN9A; (+) strand; PAM type: YTN; PAM sequence: CTG
ttttgcaaactgatattgcc

SEQ ID NO: 100934 - DNA, 20 bp, Artificial Sequence
  Description of Artificial Sequence: Synthetic oligonucleotide
  Target: SCN9A; (+) strand; PAM type: YTN; PAM sequence: TTT
tgcaaactgatattgccagt

SEQ ID NO: 100935 - DNA, 20 bp, Artificial Sequence
  Description of Artificial Sequence: Synthetic oligonucleotide
  Target: SCN9A; (+) strand; PAM type: YTN; PAM sequence: TTT
gcaaactgatattgccagta

SEQ ID NO: 100936 - DNA, 20 bp, Artificial Sequence
  Description of Artificial Sequence: Synthetic oligonucleotide
  Target: SCN9A; (+) strand; PAM type: YTN; PAM sequence: TTG
caaactgatattgccagtaa

SEQ ID NO: 100937 - DNA, 20 bp, Artificial Sequence
  Description of Artificial Sequence: Synthetic oligonucleotide
  Target: SCN9A; (+) strand; PAM type: YTN; PAM sequence: CTG
atattgccagtaaaattctc

SEQ ID NO: 100938 - DNA, 20 bp, Artificial Sequence
  Description of Artificial Sequence: Synthetic oligonucleotide
  Target: SCN9A; (+) strand; PAM type: YTN; PAM sequence: TTG
ccagtaaaattctcttttct

SEQ ID NO: 100939 - DNA, 20 bp, Artificial Sequence
  Description of Artificial Sequence: Synthetic oligonucleotide
  Target: SCN9A; (+) strand; PAM type: YTN; PAM sequence: TTC
tcttttctattatagccatc

SEQ ID NO: 100940 - DNA, 20 bp, Artificial Sequence
  Description of Artificial Sequence: Synthetic oligonucleotide
  Target: SCN9A; (+) strand; PAM type: YTN; PAM sequence: CTC
ttttctattatagccatctg

SEQ ID NO: 100941 - DNA, 20 bp, Artificial Sequence
  Description of Artificial Sequence: Synthetic oligonucleotide
  Target: SCN9A; (+) strand; PAM type: YTN; PAM sequence: CTT
ttctattatagccatctggg

SEQ ID NO: 100942 - DNA, 20 bp, Artificial Sequence
  Description of Artificial Sequence: Synthetic oligonucleotide
  Target: SCN9A; (+) strand; PAM type: YTN; PAM sequence: TTT
tctattatagccatctgggt

SEQ ID NO: 100943 - DNA, 20 bp, Artificial Sequence
  Description of Artificial Sequence: Synthetic oligonucleotide
  Target: SCN9A; (+) strand; PAM type: YTN; PAM sequence: TTT
ctattatagccatctgggtg

SEQ ID NO: 100944 - DNA, 20 bp, Artificial Sequence
  Description of Artificial Sequence: Synthetic oligonucleotide
  Target: SCN9A; (+) strand; PAM type: YTN; PAM sequence: TTC
tattatagccatctgggtgg

SEQ ID NO: 100945 - DNA, 20 bp, Artificial Sequence
  Description of Artificial Sequence: Synthetic oligonucleotide
  Target: SCN9A; (+) strand; PAM type: YTN; PAM sequence: CTA
ttatagccatctgggtggtc

SEQ ID NO: 100946 - DNA, 20 bp, Artificial Sequence
  Description of Artificial Sequence: Synthetic oligonucleotide
  Target: SCN9A; (+) strand; PAM type: YTN; PAM sequence: TTA
tagccatctgggtggtcctt

SEQ ID NO: 100947 - DNA, 20 bp, Artificial Sequence
  Description of Artificial Sequence: Synthetic oligonucleotide
  Target: SCN9A; (+) strand; PAM type: YTN; PAM sequence: CTG
ggtggtcctttggacaacag

SEQ ID NO: 100948 - DNA, 20 bp, Artificial Sequence
  Description of Artificial Sequence: Synthetic oligonucleotide
  Target: SCN9A; (+) strand; PAM type: YTN; PAM sequence: CTT
tggacaacagcattcagggc

SEQ ID NO: 100949 - DNA, 20 bp, Artificial Sequence
  Description of Artificial Sequence: Synthetic oligonucleotide
  Target: SCN9A; (+) strand; PAM type: YTN; PAM sequence: TTT
ggacaacagcattcagggca

SEQ ID NO: 100950 - DNA, 20 bp, Artificial Sequence
  Description of Artificial Sequence: Synthetic oligonucleotide
  Target: SCN9A; (+) strand; PAM type: YTN; PAM sequence: TTG
gacaacagcattcagggcag

SEQ ID NO: 100951 - DNA, 20 bp, Artificial Sequence
  Description of Artificial Sequence: Synthetic oligonucleotide
  Target: SCN9A; (+) strand; PAM type: YTN; PAM sequence: TTC
agggcagcaaggataatgcc

SEQ ID NO: 100952 - DNA, 20 bp, Artificial Sequence
  Description of Artificial Sequence: Synthetic oligonucleotide
  Target: SCN9A; (+) strand; PAM type: YTN; PAM sequence: CTG
gcatgtaggagtgctcagta

SEQ ID NO: 100953 - DNA, 20 bp, Artificial Sequence
  Description of Artificial Sequence: Synthetic oligonucleotide
  Target: SCN9A; (+) strand; PAM type: YTN; PAM sequence: CTC
agtaactatttactgagctc

SEQ ID NO: 100954 - DNA, 20 bp, Artificial Sequence
  Description of Artificial Sequence: Synthetic oligonucleotide
  Target: SCN9A; (+) strand; PAM type: YTN; PAM sequence: CTA
tttactgagctcaagtaaaa

SEQ ID NO: 100955 - DNA, 20 bp, Artificial Sequence
  Description of Artificial Sequence: Synthetic oligonucleotide
  Target: SCN9A; (+) strand; PAM type: YTN; PAM sequence: TTT
actgagctcaagtaaaattt

SEQ ID NO: 100956 - DNA, 20 bp, Artificial Sequence
  Description of Artificial Sequence: Synthetic oligonucleotide
  Target: SCN9A; (+) strand; PAM type: YTN; PAM sequence: TTA
ctgagctcaagtaaaatttt

SEQ ID NO: 100957 - DNA, 20 bp, Artificial Sequence
  Description of Artificial Sequence: Synthetic oligonucleotide
  Target: SCN9A; (+) strand; PAM type: YTN; PAM sequence: CTG
agctcaagtaaaattttgtc

SEQ ID NO: 100958 - DNA, 20 bp, Artificial Sequence
  Description of Artificial Sequence: Synthetic oligonucleotide
  Target: SCN9A; (+) strand; PAM type: YTN; PAM sequence: CTC
aagtaaaattttgtcattgg

SEQ ID NO: 100959 - DNA, 20 bp, Artificial Sequence
  Description of Artificial Sequence: Synthetic oligonucleotide
  Target: SCN9A; (+) strand; PAM type: YTN; PAM sequence: TTT
tgtcattggcactaatcata

SEQ ID NO: 100960 - DNA, 20 bp, Artificial Sequence
  Description of Artificial Sequence: Synthetic oligonucleotide
  Target: SCN9A; (+) strand; PAM type: YTN; PAM sequence: TTT
gtcattggcactaatcatag

SEQ ID NO: 100961 - DNA, 20 bp, Artificial Sequence
  Description of Artificial Sequence: Synthetic oligonucleotide
  Target: SCN9A; (+) strand; PAM type: YTN; PAM sequence: TTG
tcattggcactaatcatagg

SEQ ID NO: 100962 - DNA, 20 bp, Artificial Sequence
  Description of Artificial Sequence: Synthetic oligonucleotide
  Target: SCN9A; (+) strand; PAM type: YTN; PAM sequence: TTG
gcactaatcatagggattaa

SEQ ID NO: 100963 - DNA, 20 bp, Artificial Sequence
  Description of Artificial Sequence: Synthetic oligonucleotide
  Target: SCN9A; (+) strand; PAM type: YTN; PAM sequence: CTA
atcatagggattaattctag

SEQ ID NO: 100964 - DNA, 20 bp, Artificial Sequence
  Description of Artificial Sequence: Synthetic oligonucleotide
  Target: SCN9A; (+) strand; PAM type: YTN; PAM sequence: TTA
attctaggtaaaacaacttg

SEQ ID NO: 100965 - DNA, 20 bp, Artificial Sequence
  Description of Artificial Sequence: Synthetic oligonucleotide
  Target: SCN9A; (+) strand; PAM type: YTN; PAM sequence: TTC
taggtaaaacaacttgccat

SEQ ID NO: 100966 - DNA, 20 bp, Artificial Sequence
  Description of Artificial Sequence: Synthetic oligonucleotide
  Target: SCN9A; (+) strand; PAM type: YTN; PAM sequence: CTA
ggtaaaacaacttgccatga

SEQ ID NO: 100967 - DNA, 20 bp, Artificial Sequence
  Description of Artificial Sequence: Synthetic oligonucleotide
  Target: SCN9A; (+) strand; PAM type: YTN; PAM sequence: CTT
gccatgatatttttatcttt

SEQ ID NO: 100968 - DNA, 20 bp, Artificial Sequence
  Description of Artificial Sequence: Synthetic oligonucleotide
  Target: SCN9A; (+) strand; PAM type: YTN; PAM sequence: TTG
ccatgatatttttatctttt

SEQ ID NO: 100969 - DNA, 20 bp, Artificial Sequence
  Description of Artificial Sequence: Synthetic oligonucleotide
  Target: SCN9A; (+) strand; PAM type: YTN; PAM sequence: TTT
ttatcttttagctcatttta

SEQ ID NO: 100970 - DNA, 20 bp, Artificial Sequence
  Description of Artificial Sequence: Synthetic oligonucleotide
  Target: SCN9A; (+) strand; PAM type: YTN; PAM sequence: TTT
tatcttttagctcattttaa

SEQ ID NO: 100971 - DNA, 20 bp, Artificial Sequence
  Description of Artificial Sequence: Synthetic oligonucleotide
  Target: SCN9A; (+) strand; PAM type: YTN; PAM sequence: TTT
atcttttagctcattttaaa

SEQ ID NO: 100972 - DNA, 20 bp, Artificial Sequence
  Description of Artificial Sequence: Synthetic oligonucleotide
  Target: SCN9A; (+) strand; PAM type: YTN; PAM sequence: TTA
tcttttagctcattttaaag

SEQ ID NO: 100973 - DNA, 20 bp, Artificial Sequence
  Description of Artificial Sequence: Synthetic oligonucleotide
  Target: SCN9A; (+) strand; PAM type: YTN; PAM sequence: CTT
ttagctcattttaaagaata

SEQ ID NO: 100974 - DNA, 20 bp, Artificial Sequence
  Description of Artificial Sequence: Synthetic oligonucleotide
  Target: SCN9A; (+) strand; PAM type: YTN; PAM sequence: TTT
tagctcattttaaagaatat

SEQ ID NO: 100975 - DNA, 20 bp, Artificial Sequence
  Description of Artificial Sequence: Synthetic oligonucleotide
  Target: SCN9A; (+) strand; PAM type: YTN; PAM sequence: TTT
agctcattttaaagaatatt

SEQ ID NO: 100976 - DNA, 20 bp, Artificial Sequence
  Description of Artificial Sequence: Synthetic oligonucleotide
  Target: SCN9A; (+) strand; PAM type: YTN; PAM sequence: TTA
gctcattttaaagaatattg

SEQ ID NO: 100977 - DNA, 20 bp, Artificial Sequence
  Description of Artificial Sequence: Synthetic oligonucleotide
  Target: SCN9A; (+) strand; PAM type: YTN; PAM sequence: CTC
attttaaagaatattgactt

SEQ ID NO: 100978 - DNA, 20 bp, Artificial Sequence
  Description of Artificial Sequence: Synthetic oligonucleotide
  Target: SCN9A; (+) strand; PAM type: YTN; PAM sequence: TTT
taaagaatattgacttaatc

SEQ ID NO: 100979 - DNA, 20 bp, Artificial Sequence
  Description of Artificial Sequence: Synthetic oligonucleotide
  Target: SCN9A; (+) strand; PAM type: YTN; PAM sequence: TTT
aaagaatattgacttaatca

SEQ ID NO: 100980 - DNA, 20 bp, Artificial Sequence
  Description of Artificial Sequence: Synthetic oligonucleotide
  Target: SCN9A; (+) strand; PAM type: YTN; PAM sequence: TTA
aagaatattgacttaatcaa

SEQ ID NO: 100981 - DNA, 20 bp, Artificial Sequence
  Description of Artificial Sequence: Synthetic oligonucleotide
  Target: SCN9A; (+) strand; PAM type: YTN; PAM sequence: TTG
acttaatcaatatattgact

SEQ ID NO: 100982 - DNA, 20 bp, Artificial Sequence
  Description of Artificial Sequence: Synthetic oligonucleotide
  Target: SCN9A; (+) strand; PAM type: YTN; PAM sequence: CTT
aatcaatatattgacttagg

SEQ ID NO: 100983 - DNA, 20 bp, Artificial Sequence
  Description of Artificial Sequence: Synthetic oligonucleotide
  Target: SCN9A; (+) strand; PAM type: YTN; PAM sequence: TTA
atcaatatattgacttaggt

SEQ ID NO: 100984 - DNA, 20 bp, Artificial Sequence
  Description of Artificial Sequence: Synthetic oligonucleotide
  Target: SCN9A; (+) strand; PAM type: YTN; PAM sequence: TTG
acttaggtgtcagatcattt

SEQ ID NO: 100985 - DNA, 20 bp, Artificial Sequence
  Description of Artificial Sequence: Synthetic oligonucleotide
  Target: SCN9A; (+) strand; PAM type: YTN; PAM sequence: CTT
aggtgtcagatcatttacca

SEQ ID NO: 100986 - DNA, 20 bp, Artificial Sequence
  Description of Artificial Sequence: Synthetic oligonucleotide
  Target: SCN9A; (+) strand; PAM type: YTN; PAM sequence: TTA
ggtgtcagatcatttaccag

SEQ ID NO: 100987 - DNA, 20 bp, Artificial Sequence
  Description of Artificial Sequence: Synthetic oligonucleotide
  Target: SCN9A; (+) strand; PAM type: YTN; PAM sequence: TTT
accagggcaccactgctgag

SEQ ID NO: 100988 - DNA, 20 bp, Artificial Sequence
  Description of Artificial Sequence: Synthetic oligonucleotide
  Target: SCN9A; (+) strand; PAM type: YTN; PAM sequence: TTA
ccagggcaccactgctgagc

SEQ ID NO: 100989 - DNA, 20 bp, Artificial Sequence
  Description of Artificial Sequence: Synthetic oligonucleotide
  Target: SCN9A; (+) strand; PAM type: YTN; PAM sequence: CTG
ctgagcaggatcatgaggac

SEQ ID NO: 100990 - DNA, 20 bp, Artificial Sequence
  Description of Artificial Sequence: Synthetic oligonucleotide
  Target: SCN9A; (+) strand; PAM type: YTN; PAM sequence: CTG
agcaggatcatgaggacaat

SEQ ID NO: 100991 - DNA, 20 bp, Artificial Sequence
  Description of Artificial Sequence: Synthetic oligonucleotide
  Target: SCN9A; (+) strand; PAM type: YTN; PAM sequence: CTT
tcaaaccaactgtgttcaac

SEQ ID NO: 100992 - DNA, 20 bp, Artificial Sequence
  Description of Artificial Sequence: Synthetic oligonucleotide
  Target: SCN9A; (+) strand; PAM type: YTN; PAM sequence: TTT
caaaccaactgtgttcaaca

SEQ ID NO: 100993 - DNA, 20 bp, Artificial Sequence
  Description of Artificial Sequence: Synthetic oligonucleotide
  Target: SCN9A; (+) strand; PAM type: YTN; PAM sequence: TTC
aaaccaactgtgttcaacaa

SEQ ID NO: 100994 - DNA, 20 bp, Artificial Sequence
  Description of Artificial Sequence: Synthetic oligonucleotide
  Target: SCN9A; (+) strand; PAM type: YTN; PAM sequence: CTG
tgttcaacaatcttgtagca

SEQ ID NO: 100995 - DNA, 20 bp, Artificial Sequence
  Description of Artificial Sequence: Synthetic oligonucleotide
  Target: SCN9A; (+) strand; PAM type: YTN; PAM sequence: TTC
aacaatcttgtagcaggttt

SEQ ID NO: 100996 - DNA, 20 bp, Artificial Sequence
  Description of Artificial Sequence: Synthetic oligonucleotide
  Target: SCN9A; (+) strand; PAM type: YTN; PAM sequence: CTT
gtagcaggttttcctgatgt

SEQ ID NO: 100997 - DNA, 20 bp, Artificial Sequence
  Description of Artificial Sequence: Synthetic oligonucleotide
  Target: SCN9A; (+) strand; PAM type: YTN; PAM sequence: TTG
tagcaggttttcctgatgtt

SEQ ID NO: 100998 - DNA, 20 bp, Artificial Sequence
  Description of Artificial Sequence: Synthetic oligonucleotide
  Target: SCN9A; (+) strand; PAM type: YTN; PAM sequence: TTT
tcctgatgttccaccagatt

SEQ ID NO: 100999 - DNA, 20 bp, Artificial Sequence
  Description of Artificial Sequence: Synthetic oligonucleotide
  Target: SCN9A; (+) strand; PAM type: YTN; PAM sequence: TTT
cctgatgttccaccagattt

SEQ ID NO: 101000 - DNA, 20 bp, Artificial Sequence
  Description of Artificial Sequence: Synthetic oligonucleotide
  Target: SCN9A; (+) strand; PAM type: YTN; PAM sequence: TTC
ctgatgttccaccagatttt

SEQ ID NO: 101001 - DNA, 20 bp, Artificial Sequence
  Description of Artificial Sequence: Synthetic oligonucleotide
  Target: SCN9A; (+) strand; PAM type: YTN; PAM sequence: CTG
atgttccaccagatttttcc

SEQ ID NO: 101002 - DNA, 20 bp, Artificial Sequence
  Description of Artificial Sequence: Synthetic oligonucleotide
  Target: SCN9A; (+) strand; PAM type: YTN; PAM sequence: TTC
caccagatttttcctttccc

SEQ ID NO: 101003 - DNA, 20 bp, Artificial Sequence
  Description of Artificial Sequence: Synthetic oligonucleotide
  Target: SCN9A; (+) strand; PAM type: YTN; PAM sequence: TTT
ttcctttccctgactctatg

SEQ ID NO: 101004 - DNA, 20 bp, Artificial Sequence
  Description of Artificial Sequence: Synthetic oligonucleotide
  Target: SCN9A; (+) strand; PAM type: YTN; PAM sequence: TTT
tcctttccctgactctatgt

SEQ ID NO: 101005 - DNA, 20 bp, Artificial Sequence
  Description of Artificial Sequence: Synthetic oligonucleotide
  Target: SCN9A; (+) strand; PAM type: YTN; PAM sequence: TTT
cctttccctgactctatgtt

SEQ ID NO: 101006 - DNA, 20 bp, Artificial Sequence
  Description of Artificial Sequence: Synthetic oligonucleotide
  Target: SCN9A; (+) strand; PAM type: YTN; PAM sequence: TTC
ctttccctgactctatgtta

SEQ ID NO: 101007 - DNA, 20 bp, Artificial Sequence
  Description of Artificial Sequence: Synthetic oligonucleotide
  Target: SCN9A; (+) strand; PAM type: YTN; PAM sequence: CTT
tccctgactctatgttaact

SEQ ID NO: 101008 - DNA, 20 bp, Artificial Sequence
  Description of Artificial Sequence: Synthetic oligonucleotide
  Target: SCN9A; (+) strand; PAM type: YTN; PAM sequence: TTT
ccctgactctatgttaactt

SEQ ID NO: 101009 - DNA, 20 bp, Artificial Sequence
  Description of Artificial Sequence: Synthetic oligonucleotide
  Target: SCN9A; (+) strand; PAM type: YTN; PAM sequence: TTC
cctgactctatgttaacttg

SEQ ID NO: 101010 - DNA, 20 bp, Artificial Sequence
  Description of Artificial Sequence: Synthetic oligonucleotide
  Target: SCN9A; (+) strand; PAM type: YTN; PAM sequence: CTG
actctatgttaacttggcag

SEQ ID NO: 101011 - DNA, 20 bp, Artificial Sequence
  Description of Artificial Sequence: Synthetic oligonucleotide
  Target: SCN9A; (+) strand; PAM type: YTN; PAM sequence: CTC
tatgttaacttggcagcatg

SEQ ID NO: 101012 - DNA, 20 bp, Artificial Sequence
  Description of Artificial Sequence: Synthetic oligonucleotide
  Target: SCN9A; (+) strand; PAM type: YTN; PAM sequence: CTA
tgttaacttggcagcatgag

SEQ ID NO: 101013 - DNA, 20 bp, Artificial Sequence
  Description of Artificial Sequence: Synthetic oligonucleotide
  Target: SCN9A; (+) strand; PAM type: YTN; PAM sequence: TTA
acttggcagcatgagaacct

SEQ ID NO: 101014 - DNA, 20 bp, Artificial Sequence
  Description of Artificial Sequence: Synthetic oligonucleotide
  Target: SCN9A; (+) strand; PAM type: YTN; PAM sequence: CTT
ggcagcatgagaacctccat

SEQ ID NO: 101015 - DNA, 20 bp, Artificial Sequence
  Description of Artificial Sequence: Synthetic oligonucleotide
  Target: SCN9A; (+) strand; PAM type: YTN; PAM sequence: TTG
gcagcatgagaacctccata

SEQ ID NO: 101016 - DNA, 20 bp, Artificial Sequence
  Description of Artificial Sequence: Synthetic oligonucleotide
  Target: SCN9A; (+) strand; PAM type: YTN; PAM sequence: CTC
catacacaacctgacaagaa

SEQ ID NO: 101017 - DNA, 20 bp, Artificial Sequence
  Description of Artificial Sequence: Synthetic oligonucleotide
  Target: SCN9A; (+) strand; PAM type: YTN; PAM sequence: CTG
acaagaaagacatgcatgtt

SEQ ID NO: 101018 - DNA, 20 bp, Artificial Sequence
  Description of Artificial Sequence: Synthetic oligonucleotide
  Target: SCN9A; (+) strand; PAM type: YTN; PAM sequence: TTA
aatcttgatattcagaataa

SEQ ID NO: 101019 - DNA, 20 bp, Artificial Sequence
  Description of Artificial Sequence: Synthetic oligonucleotide
  Target: SCN9A; (+) strand; PAM type: YTN; PAM sequence: CTT
gatattcagaataaataaaa

SEQ ID NO: 101020 - DNA, 20 bp, Artificial Sequence
  Description of Artificial Sequence: Synthetic oligonucleotide
  Target: SCN9A; (+) strand; PAM type: YTN; PAM sequence: TTG
atattcagaataaataaaat

SEQ ID NO: 101021 - DNA, 20 bp, Artificial Sequence
  Description of Artificial Sequence: Synthetic oligonucleotide
  Target: SCN9A; (+) strand; PAM type: YTN; PAM sequence: TTC
agaataaataaaatttttaa

SEQ ID NO: 101022 - DNA, 20 bp, Artificial Sequence
  Description of Artificial Sequence: Synthetic oligonucleotide
  Target: SCN9A; (+) strand; PAM type: YTN; PAM sequence: TTT
ttaatacattatttaatgca

SEQ ID NO: 101023 - DNA, 20 bp, Artificial Sequence
  Description of Artificial Sequence: Synthetic oligonucleotide
  Target: SCN9A; (+) strand; PAM type: YTN; PAM sequence: TTT
taatacattatttaatgcaa

SEQ ID NO: 101024 - DNA, 20 bp, Artificial Sequence
  Description of Artificial Sequence: Synthetic oligonucleotide
  Target: SCN9A; (+) strand; PAM type: YTN; PAM sequence: TTT
aatacattatttaatgcaaa

SEQ ID NO: 101025 - DNA, 20 bp, Artificial Sequence
  Description of Artificial Sequence: Synthetic oligonucleotide
  Target: SCN9A; (+) strand; PAM type: YTN; PAM sequence: TTA
atacattatttaatgcaaac

SEQ ID NO: 101026 - DNA, 20 bp, Artificial Sequence
  Description of Artificial Sequence: Synthetic oligonucleotide
  Target: SCN9A; (+) strand; PAM type: YTN; PAM sequence: TTA
tttaatgcaaactgctttct

SEQ ID NO: 101027 - DNA, 20 bp, Artificial Sequence
  Description of Artificial Sequence: Synthetic oligonucleotide
  Target: SCN9A; (+) strand; PAM type: YTN; PAM sequence: TTT
aatgcaaactgctttctgtg

SEQ ID NO: 101028 - DNA, 20 bp, Artificial Sequence
  Description of Artificial Sequence: Synthetic oligonucleotide
  Target: SCN9A; (+) strand; PAM type: YTN; PAM sequence: TTA
atgcaaactgctttctgtga

SEQ ID NO: 101029 - DNA, 20 bp, Artificial Sequence
  Description of Artificial Sequence: Synthetic oligonucleotide
  Target: SCN9A; (+) strand; PAM type: YTN; PAM sequence: CTG
ctttctgtgatactccctca

SEQ ID NO: 101030 - DNA, 20 bp, Artificial Sequence
  Description of Artificial Sequence: Synthetic oligonucleotide
  Target: SCN9A; (+) strand; PAM type: YTN; PAM sequence: CTT
tctgtgatactccctcaacc

SEQ ID NO: 101031 - DNA, 20 bp, Artificial Sequence
  Description of Artificial Sequence: Synthetic oligonucleotide
  Target: SCN9A; (+) strand; PAM type: YTN; PAM sequence: TTT
ctgtgatactccctcaacca

SEQ ID NO: 101032 - DNA, 20 bp, Artificial Sequence
  Description of Artificial Sequence: Synthetic oligonucleotide
  Target: SCN9A; (+) strand; PAM type: YTN; PAM sequence: TTC
tgtgatactccctcaaccaa

SEQ ID NO: 101033 - DNA, 20 bp, Artificial Sequence
  Description of Artificial Sequence: Synthetic oligonucleotide
  Target: SCN9A; (+) strand; PAM type: YTN; PAM sequence: CTG
tgatactccctcaaccaaat

SEQ ID NO: 101034 - DNA, 20 bp, Artificial Sequence
  Description of Artificial Sequence: Synthetic oligonucleotide
  Target: SCN9A; (+) strand; PAM type: YTN; PAM sequence: CTC
cctcaaccaaataatttcaa

SEQ ID NO: 101035 - DNA, 20 bp, Artificial Sequence
  Description of Artificial Sequence: Synthetic oligonucleotide
  Target: SCN9A; (+) strand; PAM type: YTN; PAM sequence: CTC
aaccaaataatttcaacacc

SEQ ID NO: 101036 - DNA, 20 bp, Artificial Sequence
  Description of Artificial Sequence: Synthetic oligonucleotide
  Target: SCN9A; (+) strand; PAM type: YTN; PAM sequence: TTT
caacacctatacttgcaatt

SEQ ID NO: 101037 - DNA, 20 bp, Artificial Sequence
  Description of Artificial Sequence: Synthetic oligonucleotide
  Target: SCN9A; (+) strand; PAM type: YTN; PAM sequence: TTC
aacacctatacttgcaattt

SEQ ID NO: 101038 - DNA, 20 bp, Artificial Sequence
  Description of Artificial Sequence: Synthetic oligonucleotide
  Target: SCN9A; (+) strand; PAM type: YTN; PAM sequence: CTA
tacttgcaatttcagataga

SEQ ID NO: 101039 - DNA, 20 bp, Artificial Sequence
  Description of Artificial Sequence: Synthetic oligonucleotide
  Target: SCN9A; (+) strand; PAM type: YTN; PAM sequence: CTT
gcaatttcagatagatttaa

SEQ ID NO: 101040 - DNA, 20 bp, Artificial Sequence
  Description of Artificial Sequence: Synthetic oligonucleotide
  Target: SCN9A; (+) strand; PAM type: YTN; PAM sequence: TTG
caatttcagatagatttaat

SEQ ID NO: 101041 - DNA, 20 bp, Artificial Sequence
  Description of Artificial Sequence: Synthetic oligonucleotide
  Target: SCN9A; (+) strand; PAM type: YTN; PAM sequence: TTT
cagatagatttaatttggat

SEQ ID NO: 101042 - DNA, 20 bp, Artificial Sequence
  Description of Artificial Sequence: Synthetic oligonucleotide
  Target: SCN9A; (+) strand; PAM type: YTN; PAM sequence: TTC
agatagatttaatttggatg

SEQ ID NO: 101043 - DNA, 20 bp, Artificial Sequence
  Description of Artificial Sequence: Synthetic oligonucleotide
  Target: SCN9A; (+) strand; PAM type: YTN; PAM sequence: TTT
aatttggatgctgccttcct

SEQ ID NO: 101044 - DNA, 20 bp, Artificial Sequence
  Description of Artificial Sequence: Synthetic oligonucleotide
  Target: SCN9A; (+) strand; PAM type: YTN; PAM sequence: TTA
atttggatgctgccttcctt

SEQ ID NO: 101045 - DNA, 20 bp, Artificial Sequence
  Description of Artificial Sequence: Synthetic oligonucleotide
  Target: SCN9A; (+) strand; PAM type: YTN; PAM sequence: TTT
ggatgctgccttccttcatc

SEQ ID NO: 101046 - DNA, 20 bp, Artificial Sequence
  Description of Artificial Sequence: Synthetic oligonucleotide
  Target: SCN9A; (+) strand; PAM type: YTN; PAM sequence: TTG
gatgctgccttccttcatct

SEQ ID NO: 101047 - DNA, 20 bp, Artificial Sequence
  Description of Artificial Sequence: Synthetic oligonucleotide
  Target: SCN9A; (+) strand; PAM type: YTN; PAM sequence: CTG
ccttccttcatcttctaact

SEQ ID NO: 101048 - DNA, 20 bp, Artificial Sequence
  Description of Artificial Sequence: Synthetic oligonucleotide
  Target: SCN9A; (+) strand; PAM type: YTN; PAM sequence: CTT
ccttcatcttctaactttgc

SEQ ID NO: 101049 - DNA, 20 bp, Artificial Sequence
  Description of Artificial Sequence: Synthetic oligonucleotide
  Target: SCN9A; (+) strand; PAM type: YTN; PAM sequence: TTC
cttcatcttctaactttgca

SEQ ID NO: 101050 - DNA, 20 bp, Artificial Sequence
  Description of Artificial Sequence: Synthetic oligonucleotide
  Target: SCN9A; (+) strand; PAM type: YTN; PAM sequence: CTT
catcttctaactttgcatga

SEQ ID NO: 101051 - DNA, 20 bp, Artificial Sequence
  Description of Artificial Sequence: Synthetic oligonucleotide
  Target: SCN9A; (+) strand; PAM type: YTN; PAM sequence: TTC
atcttctaactttgcatgat

SEQ ID NO: 101052 - DNA, 20 bp, Artificial Sequence
  Description of Artificial Sequence: Synthetic oligonucleotide
  Target: SCN9A; (+) strand; PAM type: YTN; PAM sequence: CTT
ctaactttgcatgatgtttt

SEQ ID NO: 101053 - DNA, 20 bp, Artificial Sequence
  Description of Artificial Sequence: Synthetic oligonucleotide
  Target: SCN9A; (+) strand; PAM type: YTN; PAM sequence: TTC
taactttgcatgatgttttc

SEQ ID NO: 101054 - DNA, 20 bp, Artificial Sequence
  Description of Artificial Sequence: Synthetic oligonucleotide
  Target: SCN9A; (+) strand; PAM type: YTN; PAM sequence: CTA
actttgcatgatgttttcta

SEQ ID NO: 101055 - DNA, 20 bp, Artificial Sequence
  Description of Artificial Sequence: Synthetic oligonucleotide
  Target: SCN9A; (+) strand; PAM type: YTN; PAM sequence: CTT
tgcatgatgttttctaaata

SEQ ID NO: 101056 - DNA, 20 bp, Artificial Sequence
  Description of Artificial Sequence: Synthetic oligonucleotide
  Target: SCN9A; (+) strand; PAM type: YTN; PAM sequence: TTT
gcatgatgttttctaaatag

SEQ ID NO: 101057 - DNA, 20 bp, Artificial Sequence
  Description of Artificial Sequence: Synthetic oligonucleotide
  Target: SCN9A; (+) strand; PAM type: YTN; PAM sequence: TTG
catgatgttttctaaatagt

SEQ ID NO: 101058 - DNA, 20 bp, Artificial Sequence
  Description of Artificial Sequence: Synthetic oligonucleotide
  Target: SCN9A; (+) strand; PAM type: YTN; PAM sequence: TTT
tctaaatagttgttagttag

SEQ ID NO: 101059 - DNA, 20 bp, Artificial Sequence
  Description of Artificial Sequence: Synthetic oligonucleotide
  Target: SCN9A; (+) strand; PAM type: YTN; PAM sequence: TTT
ctaaatagttgttagttagt

SEQ ID NO: 101060 - DNA, 20 bp, Artificial Sequence
  Description of Artificial Sequence: Synthetic oligonucleotide
  Target: SCN9A; (+) strand; PAM type: YTN; PAM sequence: TTC
taaatagttgttagttagtt

SEQ ID NO: 101061 - DNA, 20 bp, Artificial Sequence
  Description of Artificial Sequence: Synthetic oligonucleotide
  Target: SCN9A; (+) strand; PAM type: YTN; PAM sequence: CTA
aatagttgttagttagtttt

SEQ ID NO: 101062 - DNA, 20 bp, Artificial Sequence
  Description of Artificial Sequence: Synthetic oligonucleotide
  Target: SCN9A; (+) strand; PAM type: YTN; PAM sequence: TTG
ttagttagttttagcttaca

SEQ ID NO: 101063 - DNA, 20 bp, Artificial Sequence
  Description of Artificial Sequence: Synthetic oligonucleotide
  Target: SCN9A; (+) strand; PAM type: YTN; PAM sequence: TTA
gttagttttagcttacaatg

SEQ ID NO: 101064 - DNA, 20 bp, Artificial Sequence
  Description of Artificial Sequence: Synthetic oligonucleotide
  Target: SCN9A; (+) strand; PAM type: YTN; PAM sequence: TTA
gttttagcttacaatgtatt

SEQ ID NO: 101065 - DNA, 20 bp, Artificial Sequence
  Description of Artificial Sequence: Synthetic oligonucleotide
  Target: SCN9A; (+) strand; PAM type: YTN; PAM sequence: TTT
tagcttacaatgtattcttg

SEQ ID NO: 101066 - DNA, 20 bp, Artificial Sequence
  Description of Artificial Sequence: Synthetic oligonucleotide
  Target: SCN9A; (+) strand; PAM type: YTN; PAM sequence: TTT
agcttacaatgtattcttgt

SEQ ID NO: 101067 - DNA, 20 bp, Artificial Sequence
  Description of Artificial Sequence: Synthetic oligonucleotide
  Target: SCN9A; (+) strand; PAM type: YTN; PAM sequence: TTA
gcttacaatgtattcttgtc

SEQ ID NO: 101068 - DNA, 20 bp, Artificial Sequence
  Description of Artificial Sequence: Synthetic oligonucleotide
  Target: SCN9A; (+) strand; PAM type: YTN; PAM sequence: CTT
acaatgtattcttgtcttct

SEQ ID NO: 101069 - DNA, 20 bp, Artificial Sequence
  Description of Artificial Sequence: Synthetic oligonucleotide
  Target: SCN9A; (+) strand; PAM type: YTN; PAM sequence: TTA
caatgtattcttgtcttctg

SEQ ID NO: 101070 - DNA, 20 bp, Artificial Sequence
  Description of Artificial Sequence: Synthetic oligonucleotide
  Target: SCN9A; (+) strand; PAM type: YTN; PAM sequence: TTC
ttgtcttctgtaatccccaa

SEQ ID NO: 101071 - DNA, 20 bp, Artificial Sequence
  Description of Artificial Sequence: Synthetic oligonucleotide
  Target: SCN9A; (+) strand; PAM type: YTN; PAM sequence: CTT
gtcttctgtaatccccaatt

SEQ ID NO: 101072 - DNA, 20 bp, Artificial Sequence
  Description of Artificial Sequence: Synthetic oligonucleotide
  Target: SCN9A; (+) strand; PAM type: YTN; PAM sequence: TTG
tcttctgtaatccccaattt

SEQ ID NO: 101073 - DNA, 20 bp, Artificial Sequence
  Description of Artificial Sequence: Synthetic oligonucleotide
  Target: SCN9A; (+) strand; PAM type: YTN; PAM sequence: CTT
ctgtaatccccaatttctct

SEQ ID NO: 101074 - DNA, 20 bp, Artificial Sequence
  Description of Artificial Sequence: Synthetic oligonucleotide
  Target: SCN9A; (+) strand; PAM type: YTN; PAM sequence: TTC
tgtaatccccaatttctctt

SEQ ID NO: 101075 - DNA, 20 bp, Artificial Sequence
  Description of Artificial Sequence: Synthetic oligonucleotide
  Target: SCN9A; (+) strand; PAM type: YTN; PAM sequence: CTG
taatccccaatttctcttca

SEQ ID NO: 101076 - DNA, 20 bp, Artificial Sequence
  Description of Artificial Sequence: Synthetic oligonucleotide
  Target: SCN9A; (+) strand; PAM type: YTN; PAM sequence: TTT
ctcttcagtctcctccacag

SEQ ID NO: 101077 - DNA, 20 bp, Artificial Sequence
  Description of Artificial Sequence: Synthetic oligonucleotide
  Target: SCN9A; (+) strand; PAM type: YTN; PAM sequence: TTC
tcttcagtctcctccacagt

SEQ ID NO: 101078 - DNA, 20 bp, Artificial Sequence
  Description of Artificial Sequence: Synthetic oligonucleotide
  Target: SCN9A; (+) strand; PAM type: YTN; PAM sequence: CTC
ttcagtctcctccacagtct

SEQ ID NO: 101079 - DNA, 20 bp, Artificial Sequence
  Description of Artificial Sequence: Synthetic oligonucleotide
  Target: SCN9A; (+) strand; PAM type: YTN; PAM sequence: CTT
cagtctcctccacagtcttt

SEQ ID NO: 101080 - DNA, 20 bp, Artificial Sequence
  Description of Artificial Sequence: Synthetic oligonucleotide
  Target: SCN9A; (+) strand; PAM type: YTN; PAM sequence: TTC
agtctcctccacagtcttta

SEQ ID NO: 101081 - DNA, 20 bp, Artificial Sequence
  Description of Artificial Sequence: Synthetic oligonucleotide
  Target: SCN9A; (+) strand; PAM type: YTN; PAM sequence: CTC
ctccacagtctttaaaccac

SEQ ID NO: 101082 - DNA, 20 bp, Artificial Sequence
  Description of Artificial Sequence: Synthetic oligonucleotide
  Target: SCN9A; (+) strand; PAM type: YTN; PAM sequence: CTC
cacagtctttaaaccacttt

SEQ ID NO: 101083 - DNA, 20 bp, Artificial Sequence
  Description of Artificial Sequence: Synthetic oligonucleotide
  Target: SCN9A; (+) strand; PAM type: YTN; PAM sequence: CTT
taaaccactttcattttatg

SEQ ID NO: 101084 - DNA, 20 bp, Artificial Sequence
  Description of Artificial Sequence: Synthetic oligonucleotide
  Target: SCN9A; (+) strand; PAM type: YTN; PAM sequence: TTT
aaaccactttcattttatgt

SEQ ID NO: 101085 - DNA, 20 bp, Artificial Sequence
  Description of Artificial Sequence: Synthetic oligonucleotide
  Target: SCN9A; (+) strand; PAM type: YTN; PAM sequence: TTA
aaccactttcattttatgtg

SEQ ID NO: 101086 - DNA, 20 bp, Artificial Sequence
  Description of Artificial Sequence: Synthetic oligonucleotide
  Target: SCN9A; (+) strand; PAM type: YTN; PAM sequence: CTT
tcattttatgtgtgaatgaa

SEQ ID NO: 101087 - DNA, 20 bp, Artificial Sequence
  Description of Artificial Sequence: Synthetic oligonucleotide
  Target: SCN9A; (+) strand; PAM type: YTN; PAM sequence: TTT
cattttatgtgtgaatgaat

SEQ ID NO: 101088 - DNA, 20 bp, Artificial Sequence
  Description of Artificial Sequence: Synthetic oligonucleotide
  Target: SCN9A; (+) strand; PAM type: YTN; PAM sequence: TTC
attttatgtgtgaatgaatg

SEQ ID NO: 101089 - DNA, 20 bp, Artificial Sequence
  Description of Artificial Sequence: Synthetic oligonucleotide
  Target: SCN9A; (+) strand; PAM type: YTN; PAM sequence: TTT
tatgtgtgaatgaatgaatg

SEQ ID NO: 101090 - DNA, 20 bp, Artificial Sequence
  Description of Artificial Sequence: Synthetic oligonucleotide
  Target: SCN9A; (+) strand; PAM type: YTN; PAM sequence: TTT
atgtgtgaatgaatgaatga

SEQ ID NO: 101091 - DNA, 20 bp, Artificial Sequence
  Description of Artificial Sequence: Synthetic oligonucleotide
  Target: SCN9A; (+) strand; PAM type: YTN; PAM sequence: TTA
tgtgtgaatgaatgaatgaa

SEQ ID NO: 101092 - DNA, 20 bp, Artificial Sequence
  Description of Artificial Sequence: Synthetic oligonucleotide
  Target: SCN9A; (+) strand; PAM type: YTN; PAM sequence: CTA
aaatctgaagacgacatgaa

SEQ ID NO: 101093 - DNA, 20 bp, Artificial Sequence
  Description of Artificial Sequence: Synthetic oligonucleotide
  Target: SCN9A; (+) strand; PAM type: YTN; PAM sequence: CTG
aagacgacatgaattttagg

SEQ ID NO: 101094 - DNA, 20 bp, Artificial Sequence
  Description of Artificial Sequence: Synthetic oligonucleotide
  Target: SCN9A; (+) strand; PAM type: YTN; PAM sequence: TTT
tagggtcttcttttctgaca

SEQ ID NO: 101095 - DNA, 20 bp, Artificial Sequence
  Description of Artificial Sequence: Synthetic oligonucleotide
  Target: SCN9A; (+) strand; PAM type: YTN; PAM sequence: TTT
agggtcttcttttctgacag

SEQ ID NO: 101096 - DNA, 20 bp, Artificial Sequence
  Description of Artificial Sequence: Synthetic oligonucleotide
  Target: SCN9A; (+) strand; PAM type: YTN; PAM sequence: TTA
gggtcttcttttctgacaga

SEQ ID NO: 101097 - DNA, 20 bp, Artificial Sequence
  Description of Artificial Sequence: Synthetic oligonucleotide
  Target: SCN9A; (+) strand; PAM type: YTN; PAM sequence: CTT
cttttctgacagataaattt

SEQ ID NO: 101098 - DNA, 20 bp, Artificial Sequence
  Description of Artificial Sequence: Synthetic oligonucleotide
  Target: SCN9A; (+) strand; PAM type: YTN; PAM sequence: TTC
ttttctgacagataaatttt

SEQ ID NO: 101099 - DNA, 20 bp, Artificial Sequence
  Description of Artificial Sequence: Synthetic oligonucleotide
  Target: SCN9A; (+) strand; PAM type: YTN; PAM sequence: CTT
ttctgacagataaatttttc

SEQ ID NO: 101100 - DNA, 20 bp, Artificial Sequence
  Description of Artificial Sequence: Synthetic oligonucleotide
  Target: SCN9A; (+) strand; PAM type: YTN; PAM sequence: TTT
tctgacagataaatttttct

SEQ ID NO: 101101 - DNA, 20 bp, Artificial Sequence
  Description of Artificial Sequence: Synthetic oligonucleotide
  Target: SCN9A; (+) strand; PAM type: YTN; PAM sequence: TTT
ctgacagataaatttttcta

SEQ ID NO: 101102 - DNA, 20 bp, Artificial Sequence
  Description of Artificial Sequence: Synthetic oligonucleotide
  Target: SCN9A; (+) strand; PAM type: YTN; PAM sequence: TTC
tgacagataaatttttctag

SEQ ID NO: 101103 - DNA, 20 bp, Artificial Sequence
  Description of Artificial Sequence: Synthetic oligonucleotide
  Target: SCN9A; (+) strand; PAM type: YTN; PAM sequence: CTG
acagataaatttttctagtc

SEQ ID NO: 101104 - DNA, 20 bp, Artificial Sequence
  Description of Artificial Sequence: Synthetic oligonucleotide
  Target: SCN9A; (+) strand; PAM type: YTN; PAM sequence: TTT
ttctagtctataattttaga

SEQ ID NO: 101105 - DNA, 20 bp, Artificial Sequence
  Description of Artificial Sequence: Synthetic oligonucleotide
  Target: SCN9A; (+) strand; PAM type: YTN; PAM sequence: TTT
tctagtctataattttagat

SEQ ID NO: 101106 - DNA, 20 bp, Artificial Sequence
  Description of Artificial Sequence: Synthetic oligonucleotide
  Target: SCN9A; (+) strand; PAM type: YTN; PAM sequence: TTT
ctagtctataattttagata

SEQ ID NO: 101107 - DNA, 20 bp, Artificial Sequence
  Description of Artificial Sequence: Synthetic oligonucleotide
  Target: SCN9A; (+) strand; PAM type: YTN; PAM sequence: TTC
tagtctataattttagatac

SEQ ID NO: 101108 - DNA, 20 bp, Artificial Sequence
  Description of Artificial Sequence: Synthetic oligonucleotide
  Target: SCN9A; (+) strand; PAM type: YTN; PAM sequence: CTA
gtctataattttagatactt

SEQ ID NO: 101109 - DNA, 20 bp, Artificial Sequence
  Description of Artificial Sequence: Synthetic oligonucleotide
  Target: SCN9A; (+) strand; PAM type: YTN; PAM sequence: CTA
taattttagatacttccact

SEQ ID NO: 101110 - DNA, 20 bp, Artificial Sequence
  Description of Artificial Sequence: Synthetic oligonucleotide
  Target: SCN9A; (+) strand; PAM type: YTN; PAM sequence: TTT
tagatacttccactcctcta

SEQ ID NO: 101111 - DNA, 20 bp, Artificial Sequence
  Description of Artificial Sequence: Synthetic oligonucleotide
  Target: SCN9A; (+) strand; PAM type: YTN; PAM sequence: TTT
agatacttccactcctctat

SEQ ID NO: 101112 - DNA, 20 bp, Artificial Sequence
  Description of Artificial Sequence: Synthetic oligonucleotide
  Target: SCN9A; (+) strand; PAM type: YTN; PAM sequence: TTA
gatacttccactcctctatg

SEQ ID NO: 101113 - DNA, 20 bp, Artificial Sequence
  Description of Artificial Sequence: Synthetic oligonucleotide
  Target: SCN9A; (+) strand; PAM type: YTN; PAM sequence: CTT
ccactcctctatggtaaaaa

SEQ ID NO: 101114 - DNA, 20 bp, Artificial Sequence
  Description of Artificial Sequence: Synthetic oligonucleotide
  Target: SCN9A; (+) strand; PAM type: YTN; PAM sequence: TTC
cactcctctatggtaaaaac

SEQ ID NO: 101115 - DNA, 20 bp, Artificial Sequence
  Description of Artificial Sequence: Synthetic oligonucleotide
  Target: SCN9A; (+) strand; PAM type: YTN; PAM sequence: CTC
ctctatggtaaaaaccctct

SEQ ID NO: 101116 - DNA, 20 bp, Artificial Sequence
  Description of Artificial Sequence: Synthetic oligonucleotide
  Target: SCN9A; (+) strand; PAM type: YTN; PAM sequence: CTC
tatggtaaaaaccctctgaa

SEQ ID NO: 101117 - DNA, 20 bp, Artificial Sequence
  Description of Artificial Sequence: Synthetic oligonucleotide
  Target: SCN9A; (+) strand; PAM type: YTN; PAM sequence: CTA
tggtaaaaaccctctgaaat

SEQ ID NO: 101118 - DNA, 20 bp, Artificial Sequence
  Description of Artificial Sequence: Synthetic oligonucleotide
  Target: SCN9A; (+) strand; PAM type: YTN; PAM sequence: CTC
tgaaatacacctttctaaac

SEQ ID NO: 101119 - DNA, 20 bp, Artificial Sequence
  Description of Artificial Sequence: Synthetic oligonucleotide
  Target: SCN9A; (+) strand; PAM type: YTN; PAM sequence: CTG
aaatacacctttctaaacaa

SEQ ID NO: 101120 - DNA, 20 bp, Artificial Sequence
  Description of Artificial Sequence: Synthetic oligonucleotide
  Target: SCN9A; (+) strand; PAM type: YTN; PAM sequence: CTT
tctaaacaatattgagaaaa

SEQ ID NO: 101121 - DNA, 20 bp, Artificial Sequence
  Description of Artificial Sequence: Synthetic oligonucleotide
  Target: SCN9A; (+) strand; PAM type: YTN; PAM sequence: TTT
ctaaacaatattgagaaaat

SEQ ID NO: 101122 - DNA, 20 bp, Artificial Sequence
  Description of Artificial Sequence: Synthetic oligonucleotide
  Target: SCN9A; (+) strand; PAM type: YTN; PAM sequence: TTC
taaacaatattgagaaaatt

SEQ ID NO: 101123 - DNA, 20 bp, Artificial Sequence
  Description of Artificial Sequence: Synthetic oligonucleotide
  Target: SCN9A; (+) strand; PAM type: YTN; PAM sequence: CTA
aacaatattgagaaaattag

SEQ ID NO: 101124 - DNA, 20 bp, Artificial Sequence
  Description of Artificial Sequence: Synthetic oligonucleotide
  Target: SCN9A; (+) strand; PAM type: YTN; PAM sequence: TTG
agaaaattagtggaaactcc

SEQ ID NO: 101125 - DNA, 20 bp, Artificial Sequence
  Description of Artificial Sequence: Synthetic oligonucleotide
  Target: SCN9A; (+) strand; PAM type: YTN; PAM sequence: TTA
gtggaaactcctgaaattaa

SEQ ID NO: 101126 - DNA, 20 bp, Artificial Sequence
  Description of Artificial Sequence: Synthetic oligonucleotide
  Target: SCN9A; (+) strand; PAM type: YTN; PAM sequence: CTC
ctgaaattaagttcaaaaga

SEQ ID NO: 101127 - DNA, 20 bp, Artificial Sequence
  Description of Artificial Sequence: Synthetic oligonucleotide
  Target: SCN9A; (+) strand; PAM type: YTN; PAM sequence: CTG
aaattaagttcaaaagaaac

SEQ ID NO: 101128 - DNA, 20 bp, Artificial Sequence
  Description of Artificial Sequence: Synthetic oligonucleotide
  Target: SCN9A; (+) strand; PAM type: YTN; PAM sequence: TTA
agttcaaaagaaactcatct

SEQ ID NO: 101129 - DNA, 20 bp, Artificial Sequence
  Description of Artificial Sequence: Synthetic oligonucleotide
  Target: SCN9A; (+) strand; PAM type: YTN; PAM sequence: TTC
aaaagaaactcatcttgatt

SEQ ID NO: 101130 - DNA, 20 bp, Artificial Sequence
  Description of Artificial Sequence: Synthetic oligonucleotide
  Target: SCN9A; (+) strand; PAM type: YTN; PAM sequence: CTC
atcttgattagaagatccag

SEQ ID NO: 101131 - DNA, 20 bp, Artificial Sequence
  Description of Artificial Sequence: Synthetic oligonucleotide
  Target: SCN9A; (+) strand; PAM type: YTN; PAM sequence: CTT
gattagaagatccagatgaa

SEQ ID NO: 101132 - DNA, 20 bp, Artificial Sequence
  Description of Artificial Sequence: Synthetic oligonucleotide
  Target: SCN9A; (+) strand; PAM type: YTN; PAM sequence: TTG
attagaagatccagatgaaa

SEQ ID NO: 101133 - DNA, 20 bp, Artificial Sequence
  Description of Artificial Sequence: Synthetic oligonucleotide
  Target: SCN9A; (+) strand; PAM type: YTN; PAM sequence: TTA
gaagatccagatgaaactgt

SEQ ID NO: 101134 - DNA, 20 bp, Artificial Sequence
  Description of Artificial Sequence: Synthetic oligonucleotide
  Target: SCN9A; (+) strand; PAM type: YTN; PAM sequence: CTG
tttcaagtattctaagttaa

SEQ ID NO: 101135 - DNA, 20 bp, Artificial Sequence
  Description of Artificial Sequence: Synthetic oligonucleotide
  Target: SCN9A; (+) strand; PAM type: YTN; PAM sequence: TTT
caagtattctaagttaaaaa

SEQ ID NO: 101136 - DNA, 20 bp, Artificial Sequence
  Description of Artificial Sequence: Synthetic oligonucleotide
  Target: SCN9A; (+) strand; PAM type: YTN; PAM sequence: TTC
aagtattctaagttaaaaac

SEQ ID NO: 101137 - DNA, 20 bp, Artificial Sequence
  Description of Artificial Sequence: Synthetic oligonucleotide
  Target: SCN9A; (+) strand; PAM type: YTN; PAM sequence: TTC
taagttaaaaacaaatgtga

SEQ ID NO: 101138 - DNA, 20 bp, Artificial Sequence
  Description of Artificial Sequence: Synthetic oligonucleotide
  Target: SCN9A; (+) strand; PAM type: YTN; PAM sequence: CTA
agttaaaaacaaatgtgact

SEQ ID NO: 101139 - DNA, 20 bp, Artificial Sequence
  Description of Artificial Sequence: Synthetic oligonucleotide
  Target: SCN9A; (+) strand; PAM type: YTN; PAM sequence: TTA
aaaacaaatgtgactttaaa

SEQ ID NO: 101140 - DNA, 20 bp, Artificial Sequence
  Description of Artificial Sequence: Synthetic oligonucleotide
  Target: SCN9A; (+) strand; PAM type: YTN; PAM sequence: CTT
taaatttttatgtacaaaat

SEQ ID NO: 101141 - DNA, 20 bp, Artificial Sequence
  Description of Artificial Sequence: Synthetic oligonucleotide
  Target: SCN9A; (+) strand; PAM type: YTN; PAM sequence: TTT
aaatttttatgtacaaaata

SEQ ID NO: 101142 - DNA, 20 bp, Artificial Sequence
  Description of Artificial Sequence: Synthetic oligonucleotide
  Target: SCN9A; (+) strand; PAM type: YTN; PAM sequence: TTA
aatttttatgtacaaaatat

SEQ ID NO: 101143 - DNA, 20 bp, Artificial Sequence
  Description of Artificial Sequence: Synthetic oligonucleotide
  Target: SCN9A; (+) strand; PAM type: YTN; PAM sequence: TTT
ttatgtacaaaatatactgc

SEQ ID NO: 101144 - DNA, 20 bp, Artificial Sequence
  Description of Artificial Sequence: Synthetic oligonucleotide
  Target: SCN9A; (+) strand; PAM type: YTN; PAM sequence: TTT
tatgtacaaaatatactgct

SEQ ID NO: 101145 - DNA, 20 bp, Artificial Sequence
  Description of Artificial Sequence: Synthetic oligonucleotide
  Target: SCN9A; (+) strand; PAM type: YTN; PAM sequence: TTT
atgtacaaaatatactgcta

SEQ ID NO: 101146 - DNA, 20 bp, Artificial Sequence
  Description of Artificial Sequence: Synthetic oligonucleotide
  Target: SCN9A; (+) strand; PAM type: YTN; PAM sequence: TTA
tgtacaaaatatactgctac

SEQ ID NO: 101147 - DNA, 20 bp, Artificial Sequence
  Description of Artificial Sequence: Synthetic oligonucleotide
  Target: SCN9A; (+) strand; PAM type: YTN; PAM sequence: CTG
ctacaaaaaattgaaaattg

SEQ ID NO: 101148 - DNA, 20 bp, Artificial Sequence
  Description of Artificial Sequence: Synthetic oligonucleotide
  Target: SCN9A; (+) strand; PAM type: YTN; PAM sequence: CTA
caaaaaattgaaaattgtac

SEQ ID NO: 101149 - DNA, 20 bp, Artificial Sequence
  Description of Artificial Sequence: Synthetic oligonucleotide
  Target: SCN9A; (+) strand; PAM type: YTN; PAM sequence: TTG
aaaattgtacttaaaaatgg

SEQ ID NO: 101150 - DNA, 20 bp, Artificial Sequence
  Description of Artificial Sequence: Synthetic oligonucleotide
  Target: SCN9A; (+) strand; PAM type: YTN; PAM sequence: TTG
tacttaaaaatggttaggtt

SEQ ID NO: 101151 - DNA, 20 bp, Artificial Sequence
  Description of Artificial Sequence: Synthetic oligonucleotide
  Target: SCN9A; (+) strand; PAM type: YTN; PAM sequence: CTT
aaaaatggttaggtttattc

SEQ ID NO: 101152 - DNA, 20 bp, Artificial Sequence
  Description of Artificial Sequence: Synthetic oligonucleotide
  Target: SCN9A; (+) strand; PAM type: YTN; PAM sequence: TTA
aaaatggttaggtttattca

SEQ ID NO: 101153 - DNA, 20 bp, Artificial Sequence
  Description of Artificial Sequence: Synthetic oligonucleotide
  Target: SCN9A; (+) strand; PAM type: YTN; PAM sequence: TTA
ggtttattcattcattaacg

SEQ ID NO: 101154 - DNA, 20 bp, Artificial Sequence
  Description of Artificial Sequence: Synthetic oligonucleotide
  Target: SCN9A; (+) strand; PAM type: YTN; PAM sequence: TTT
attcattcattaacgcattc

SEQ ID NO: 101155 - DNA, 20 bp, Artificial Sequence
  Description of Artificial Sequence: Synthetic oligonucleotide
  Target: SCN9A; (+) strand; PAM type: YTN; PAM sequence: TTA
ttcattcattaacgcattct

SEQ ID NO: 101156 - DNA, 20 bp, Artificial Sequence
  Description of Artificial Sequence: Synthetic oligonucleotide
  Target: SCN9A; (+) strand; PAM type: YTN; PAM sequence: TTC
attcattaacgcattctttt

SEQ ID NO: 101157 - DNA, 20 bp, Artificial Sequence
  Description of Artificial Sequence: Synthetic oligonucleotide
  Target: SCN9A; (+) strand; PAM type: YTN; PAM sequence: TTC
attaacgcattcttttgtcc

SEQ ID NO: 101158 - DNA, 20 bp, Artificial Sequence
  Description of Artificial Sequence: Synthetic oligonucleotide
  Target: SCN9A; (+) strand; PAM type: YTN; PAM sequence: TTA
acgcattcttttgtccatca

SEQ ID NO: 101159 - DNA, 20 bp, Artificial Sequence
  Description of Artificial Sequence: Synthetic oligonucleotide
  Target: SCN9A; (+) strand; PAM type: YTN; PAM sequence: TTC
ttttgtccatcaaacccttg

SEQ ID NO: 101160 - DNA, 20 bp, Artificial Sequence
  Description of Artificial Sequence: Synthetic oligonucleotide
  Target: SCN9A; (+) strand; PAM type: YTN; PAM sequence: CTT
ttgtccatcaaacccttgtt

SEQ ID NO: 101161 - DNA, 20 bp, Artificial Sequence
  Description of Artificial Sequence: Synthetic oligonucleotide
  Target: SCN9A; (+) strand; PAM type: YTN; PAM sequence: TTT
tgtccatcaaacccttgtta

SEQ ID NO: 101162 - DNA, 20 bp, Artificial Sequence
  Description of Artificial Sequence: Synthetic oligonucleotide
  Target: SCN9A; (+) strand; PAM type: YTN; PAM sequence: TTT
gtccatcaaacccttgttac

SEQ ID NO: 101163 - DNA, 20 bp, Artificial Sequence
  Description of Artificial Sequence: Synthetic oligonucleotide
  Target: SCN9A; (+) strand; PAM type: YTN; PAM sequence: TTG
tccatcaaacccttgttacg

SEQ ID NO: 101164 - DNA, 20 bp, Artificial Sequence
  Description of Artificial Sequence: Synthetic oligonucleotide
  Target: SCN9A; (+) strand; PAM type: YTN; PAM sequence: CTT
gttacgtatcttttatgtat

SEQ ID NO: 101165 - DNA, 20 bp, Artificial Sequence
  Description of Artificial Sequence: Synthetic oligonucleotide
  Target: SCN9A; (+) strand; PAM type: YTN; PAM sequence: TTG
ttacgtatcttttatgtatt

SEQ ID NO: 101166 - DNA, 20 bp, Artificial Sequence
  Description of Artificial Sequence: Synthetic oligonucleotide
  Target: SCN9A; (+) strand; PAM type: YTN; PAM sequence: TTA
cgtatcttttatgtattcac

SEQ ID NO: 101167 - DNA, 20 bp, Artificial Sequence
  Description of Artificial Sequence: Synthetic oligonucleotide
  Target: SCN9A; (+) strand; PAM type: YTN; PAM sequence: CTT
ttatgtattcacctctgtac

SEQ ID NO: 101168 - DNA, 20 bp, Artificial Sequence
  Description of Artificial Sequence: Synthetic oligonucleotide
  Target: SCN9A; (+) strand; PAM type: YTN; PAM sequence: TTT
tatgtattcacctctgtaca

SEQ ID NO: 101169 - DNA, 20 bp, Artificial Sequence
  Description of Artificial Sequence: Synthetic oligonucleotide
  Target: SCN9A; (+) strand; PAM type: YTN; PAM sequence: TTT
atgtattcacctctgtacat

SEQ ID NO: 101170 - DNA, 20 bp, Artificial Sequence
  Description of Artificial Sequence: Synthetic oligonucleotide
  Target: SCN9A; (+) strand; PAM type: YTN; PAM sequence: TTA
tgtattcacctctgtacatg

SEQ ID NO: 101171 - DNA, 20 bp, Artificial Sequence
  Description of Artificial Sequence: Synthetic oligonucleotide
  Target: SCN9A; (+) strand; PAM type: YTN; PAM sequence: TTC
acctctgtacatgatttcct

SEQ ID NO: 101172 - DNA, 20 bp, Artificial Sequence
  Description of Artificial Sequence: Synthetic oligonucleotide
  Target: SCN9A; (+) strand; PAM type: YTN; PAM sequence: CTC
tgtacatgatttcctttcct

SEQ ID NO: 101173 - DNA, 20 bp, Artificial Sequence
  Description of Artificial Sequence: Synthetic oligonucleotide
  Target: SCN9A; (+) strand; PAM type: YTN; PAM sequence: CTG
tacatgatttcctttcctca

SEQ ID NO: 101174 - DNA, 20 bp, Artificial Sequence
  Description of Artificial Sequence: Synthetic oligonucleotide
  Target: SCN9A; (+) strand; PAM type: YTN; PAM sequence: TTT
cctttcctcagtgaatttat

SEQ ID NO: 101175 - DNA, 20 bp, Artificial Sequence
  Description of Artificial Sequence: Synthetic oligonucleotide
  Target: SCN9A; (+) strand; PAM type: YTN; PAM sequence: TTC
ctttcctcagtgaatttatg

SEQ ID NO: 101176 - DNA, 20 bp, Artificial Sequence
  Description of Artificial Sequence: Synthetic oligonucleotide
  Target: SCN9A; (+) strand; PAM type: YTN; PAM sequence: CTT
tcctcagtgaatttatgtta

SEQ ID NO: 101177 - DNA, 20 bp, Artificial Sequence
  Description of Artificial Sequence: Synthetic oligonucleotide
  Target: SCN9A; (+) strand; PAM type: YTN; PAM sequence: TTT
cctcagtgaatttatgttag

SEQ ID NO: 101178 - DNA, 20 bp, Artificial Sequence
  Description of Artificial Sequence: Synthetic oligonucleotide
  Target: SCN9A; (+) strand; PAM type: YTN; PAM sequence: TTC
ctcagtgaatttatgttagg

SEQ ID NO: 101179 - DNA, 20 bp, Artificial Sequence
  Description of Artificial Sequence: Synthetic oligonucleotide
  Target: SCN9A; (+) strand; PAM type: YTN; PAM sequence: CTC
agtgaatttatgttaggttt

SEQ ID NO: 101180 - DNA, 20 bp, Artificial Sequence
  Description of Artificial Sequence: Synthetic oligonucleotide
  Target: SCN9A; (+) strand; PAM type: YTN; PAM sequence: TTT
atgttaggttttggttaggt

SEQ ID NO: 101181 - DNA, 20 bp, Artificial Sequence
  Description of Artificial Sequence: Synthetic oligonucleotide
  Target: SCN9A; (+) strand; PAM type: YTN; PAM sequence: TTA
tgttaggttttggttaggta

SEQ ID NO: 101182 - DNA, 20 bp, Artificial Sequence
  Description of Artificial Sequence: Synthetic oligonucleotide
  Target: SCN9A; (+) strand; PAM type: YTN; PAM sequence: TTA
ggttttggttaggtagataa

SEQ ID NO: 101183 - DNA, 20 bp, Artificial Sequence
  Description of Artificial Sequence: Synthetic oligonucleotide
  Target: SCN9A; (+) strand; PAM type: YTN; PAM sequence: TTT
tggttaggtagataaaaaca

SEQ ID NO: 101184 - DNA, 20 bp, Artificial Sequence
  Description of Artificial Sequence: Synthetic oligonucleotide
  Target: SCN9A; (+) strand; PAM type: YTN; PAM sequence: TTT
ggttaggtagataaaaacag

SEQ ID NO: 101185 - DNA, 20 bp, Artificial Sequence
  Description of Artificial Sequence: Synthetic oligonucleotide
  Target: SCN9A; (+) strand; PAM type: YTN; PAM sequence: TTG
gttaggtagataaaaacaga

SEQ ID NO: 101186 - DNA, 20 bp, Artificial Sequence
  Description of Artificial Sequence: Synthetic oligonucleotide
  Target: SCN9A; (+) strand; PAM type: YTN; PAM sequence: TTA
ggtagataaaaacagaaata

SEQ ID NO: 101187 - DNA, 20 bp, Artificial Sequence
  Description of Artificial Sequence: Synthetic oligonucleotide
  Target: SCN9A; (+) strand; PAM type: YTN; PAM sequence: CTA
taactagatatggcaactaa

SEQ ID NO: 101188 - DNA, 20 bp, Artificial Sequence
  Description of Artificial Sequence: Synthetic oligonucleotide
  Target: SCN9A; (+) strand; PAM type: YTN; PAM sequence: CTA
gatatggcaactaaagtgac

SEQ ID NO: 101189 - DNA, 20 bp, Artificial Sequence
  Description of Artificial Sequence: Synthetic oligonucleotide
  Target: SCN9A; (+) strand; PAM type: YTN; PAM sequence: CTA
aagtgacagatagtcagggt

SEQ ID NO: 101190 - DNA, 20 bp, Artificial Sequence
  Description of Artificial Sequence: Synthetic oligonucleotide
  Target: SCN9A; (+) strand; PAM type: YTN; PAM sequence: TTC
attttgatagcatggaagaa

SEQ ID NO: 101191 - DNA, 20 bp, Artificial Sequence
  Description of Artificial Sequence: Synthetic oligonucleotide
  Target: SCN9A; (+) strand; PAM type: YTN; PAM sequence: TTT
tgatagcatggaagaaatca

SEQ ID NO: 101192 - DNA, 20 bp, Artificial Sequence
  Description of Artificial Sequence: Synthetic oligonucleotide
  Target: SCN9A; (+) strand; PAM type: YTN; PAM sequence: TTT
gatagcatggaagaaatcaa

SEQ ID NO: 101193 - DNA, 20 bp, Artificial Sequence
  Description of Artificial Sequence: Synthetic oligonucleotide
  Target: SCN9A; (+) strand; PAM type: YTN; PAM sequence: TTG
atagcatggaagaaatcaat

SEQ ID NO: 101194 - DNA, 20 bp, Artificial Sequence
  Description of Artificial Sequence: Synthetic oligonucleotide
  Target: SCN9A; (+) strand; PAM type: YTN; PAM sequence: CTC
acctggcttatttcttgaga

SEQ ID NO: 101195 - DNA, 20 bp, Artificial Sequence
  Description of Artificial Sequence: Synthetic oligonucleotide
  Target: SCN9A; (+) strand; PAM type: YTN; PAM sequence: CTG
gcttatttcttgagaaagag

SEQ ID NO: 101196 - DNA, 20 bp, Artificial Sequence
  Description of Artificial Sequence: Synthetic oligonucleotide
  Target: SCN9A; (+) strand; PAM type: YTN; PAM sequence: CTT
atttcttgagaaagagagat

SEQ ID NO: 101197 - DNA, 20 bp, Artificial Sequence
  Description of Artificial Sequence: Synthetic oligonucleotide
  Target: SCN9A; (+) strand; PAM type: YTN; PAM sequence: TTA
tttcttgagaaagagagatc

SEQ ID NO: 101198 - DNA, 20 bp, Artificial Sequence
  Description of Artificial Sequence: Synthetic oligonucleotide
  Target: SCN9A; (+) strand; PAM type: YTN; PAM sequence: TTT
cttgagaaagagagatcagt

SEQ ID NO: 101199 - DNA, 20 bp, Artificial Sequence
  Description of Artificial Sequence: Synthetic oligonucleotide
  Target: SCN9A; (+) strand; PAM type: YTN; PAM sequence: TTC
ttgagaaagagagatcagta

SEQ ID NO: 101200 - DNA, 20 bp, Artificial Sequence
  Description of Artificial Sequence: Synthetic oligonucleotide
  Target: SCN9A; (+) strand; PAM type: YTN; PAM sequence: CTT
gagaaagagagatcagtaga

SEQ ID NO: 101201 - DNA, 20 bp, Artificial Sequence
  Description of Artificial Sequence: Synthetic oligonucleotide
  Target: SCN9A; (+) strand; PAM type: YTN; PAM sequence: TTG
agaaagagagatcagtagag

SEQ ID NO: 101202 - DNA, 20 bp, Artificial Sequence
  Description of Artificial Sequence: Synthetic oligonucleotide
  Target: SCN9A; (+) strand; PAM type: YTN; PAM sequence: CTT
cctagaagagatggagcctg

SEQ ID NO: 101203 - DNA, 20 bp, Artificial Sequence
  Description of Artificial Sequence: Synthetic oligonucleotide
  Target: SCN9A; (+) strand; PAM type: YTN; PAM sequence: TTC
ctagaagagatggagcctgg

SEQ ID NO: 101204 - DNA, 20 bp, Artificial Sequence
  Description of Artificial Sequence: Synthetic oligonucleotide
  Target: SCN9A; (+) strand; PAM type: YTN; PAM sequence: CTA
gaagagatggagcctgggtt

SEQ ID NO: 101205 - DNA, 20 bp, Artificial Sequence
  Description of Artificial Sequence: Synthetic oligonucleotide
  Target: SCN9A; (+) strand; PAM type: YTN; PAM sequence: CTG
ggttgaatcaaaatatcagt

SEQ ID NO: 101206 - DNA, 20 bp, Artificial Sequence
  Description of Artificial Sequence: Synthetic oligonucleotide
  Target: SCN9A; (+) strand; PAM type: YTN; PAM sequence: TTG
aatcaaaatatcagtaaaaa

SEQ ID NO: 101207 - DNA, 20 bp, Artificial Sequence
  Description of Artificial Sequence: Synthetic oligonucleotide
  Target: SCN9A; (+) strand; PAM type: YTN; PAM sequence: TTT
gggtggaattccaggcagca

SEQ ID NO: 101208 - DNA, 20 bp, Artificial Sequence
  Description of Artificial Sequence: Synthetic oligonucleotide
  Target: SCN9A; (+) strand; PAM type: YTN; PAM sequence: TTG
ggtggaattccaggcagcaa

SEQ ID NO: 101209 - DNA, 20 bp, Artificial Sequence
  Description of Artificial Sequence: Synthetic oligonucleotide
  Target: SCN9A; (+) strand; PAM type: YTN; PAM sequence: TTC
caggcagcaaaaattgttat

SEQ ID NO: 101210 - DNA, 20 bp, Artificial Sequence
  Description of Artificial Sequence: Synthetic oligonucleotide
  Target: SCN9A; (+) strand; PAM type: YTN; PAM sequence: TTG
ttatgcatagaaatttaaac

SEQ ID NO: 101211 - DNA, 20 bp, Artificial Sequence
  Description of Artificial Sequence: Synthetic oligonucleotide
  Target: SCN9A; (+) strand; PAM type: YTN; PAM sequence: TTA
tgcatagaaatttaaaccag

SEQ ID NO: 101212 - DNA, 20 bp, Artificial Sequence
  Description of Artificial Sequence: Synthetic oligonucleotide
  Target: SCN9A; (+) strand; PAM type: YTN; PAM sequence: TTT
aaaccagtttagaattgtga

SEQ ID NO: 101213 - DNA, 20 bp, Artificial Sequence
  Description of Artificial Sequence: Synthetic oligonucleotide
  Target: SCN9A; (+) strand; PAM type: YTN; PAM sequence: TTA
aaccagtttagaattgtgat

SEQ ID NO: 101214 - DNA, 20 bp, Artificial Sequence
  Description of Artificial Sequence: Synthetic oligonucleotide
  Target: SCN9A; (+) strand; PAM type: YTN; PAM sequence: TTT
agaattgtgatgcaagcaga

SEQ ID NO: 101215 - DNA, 20 bp, Artificial Sequence
  Description of Artificial Sequence: Synthetic oligonucleotide
  Target: SCN9A; (+) strand; PAM type: YTN; PAM sequence: TTA
gaattgtgatgcaagcagaa

SEQ ID NO: 101216 - DNA, 20 bp, Artificial Sequence
  Description of Artificial Sequence: Synthetic oligonucleotide
  Target: SCN9A; (+) strand; PAM type: YTN; PAM sequence: TTG
tgatgcaagcagaatgtaca

SEQ ID NO: 101217 - DNA, 20 bp, Artificial Sequence
  Description of Artificial Sequence: Synthetic oligonucleotide
  Target: SCN9A; (+) strand; PAM type: YTN; PAM sequence: CTT
agaaaaattggtcagattat

SEQ ID NO: 101218 - DNA, 20 bp, Artificial Sequence
  Description of Artificial Sequence: Synthetic oligonucleotide
  Target: SCN9A; (+) strand; PAM type: YTN; PAM sequence: TTA
gaaaaattggtcagattatg

SEQ ID NO: 101219 - DNA, 20 bp, Artificial Sequence
  Description of Artificial Sequence: Synthetic oligonucleotide
  Target: SCN9A; (+) strand; PAM type: YTN; PAM sequence: TTG
gtcagattatggaaagcatt

SEQ ID NO: 101220 - DNA, 20 bp, Artificial Sequence
  Description of Artificial Sequence: Synthetic oligonucleotide
  Target: SCN9A; (+) strand; PAM type: YTN; PAM sequence: TTA
tggaaagcattggcctttac

SEQ ID NO: 101221 - DNA, 20 bp, Artificial Sequence
  Description of Artificial Sequence: Synthetic oligonucleotide
  Target: SCN9A; (+) strand; PAM type: YTN; PAM sequence: TTG
gcctttaccttaaggagttt

SEQ ID NO: 101222 - DNA, 20 bp, Artificial Sequence
  Description of Artificial Sequence: Synthetic oligonucleotide
  Target: SCN9A; (+) strand; PAM type: YTN; PAM sequence: CTT
taccttaaggagtttggctt

SEQ ID NO: 101223 - DNA, 20 bp, Artificial Sequence
  Description of Artificial Sequence: Synthetic oligonucleotide
  Target: SCN9A; (+) strand; PAM type: YTN; PAM sequence: TTT
accttaaggagtttggctta

SEQ ID NO: 101224 - DNA, 20 bp, Artificial Sequence
  Description of Artificial Sequence: Synthetic oligonucleotide
  Target: SCN9A; (+) strand; PAM type: YTN; PAM sequence: TTA
ccttaaggagtttggcttat

SEQ ID NO: 101225 - DNA, 20 bp, Artificial Sequence
  Description of Artificial Sequence: Synthetic oligonucleotide
  Target: SCN9A; (+) strand; PAM type: YTN; PAM sequence: CTT
aaggagtttggcttatatcc

SEQ ID NO: 101226 - DNA, 20 bp, Artificial Sequence
  Description of Artificial Sequence: Synthetic oligonucleotide
  Target: SCN9A; (+) strand; PAM type: YTN; PAM sequence: TTA
aggagtttggcttatatcct

SEQ ID NO: 101227 - DNA, 20 bp, Artificial Sequence
  Description of Artificial Sequence: Synthetic oligonucleotide
  Target: SCN9A; (+) strand; PAM type: YTN; PAM sequence: TTT
ggcttatatcctattgaggt

SEQ ID NO: 101228 - DNA, 20 bp, Artificial Sequence
  Description of Artificial Sequence: Synthetic oligonucleotide
  Target: SCN9A; (+) strand; PAM type: YTN; PAM sequence: TTG
gcttatatcctattgaggtt

SEQ ID NO: 101229 - DNA, 20 bp, Artificial Sequence
  Description of Artificial Sequence: Synthetic oligonucleotide
  Target: SCN9A; (+) strand; PAM type: YTN; PAM sequence: CTT
atatcctattgaggttgagg

SEQ ID NO: 101230 - DNA, 20 bp, Artificial Sequence
  Description of Artificial Sequence: Synthetic oligonucleotide
  Target: SCN9A; (+) strand; PAM type: YTN; PAM sequence: TTA
tatcctattgaggttgagga

SEQ ID NO: 101231 - DNA, 20 bp, Artificial Sequence
  Description of Artificial Sequence: Synthetic oligonucleotide
  Target: SCN9A; (+) strand; PAM type: YTN; PAM sequence: CTA
ttgaggttgaggagtaagta

SEQ ID NO: 101232 - DNA, 20 bp, Artificial Sequence
  Description of Artificial Sequence: Synthetic oligonucleotide
  Target: SCN9A; (+) strand; PAM type: YTN; PAM sequence: TTG
aggttgaggagtaagtaaag

SEQ ID NO: 101233 - DNA, 20 bp, Artificial Sequence
  Description of Artificial Sequence: Synthetic oligonucleotide
  Target: SCN9A; (+) strand; PAM type: YTN; PAM sequence: TTG
aggagtaagtaaagggttat

SEQ ID NO: 101234 - DNA, 20 bp, Artificial Sequence
  Description of Artificial Sequence: Synthetic oligonucleotide
  Target: SCN9A; (+) strand; PAM type: YTN; PAM sequence: TTA
taagcagggaacgagatacg

SEQ ID NO: 101235 - DNA, 20 bp, Artificial Sequence
  Description of Artificial Sequence: Synthetic oligonucleotide
  Target: SCN9A; (+) strand; PAM type: YTN; PAM sequence: TTG
caatgtaaatagatgtctcc

SEQ ID NO: 101236 - DNA, 20 bp, Artificial Sequence
  Description of Artificial Sequence: Synthetic oligonucleotide
  Target: SCN9A; (+) strand; PAM type: YTN; PAM sequence: CTC
cacggtacatggaggataag

SEQ ID NO: 101237 - DNA, 20 bp, Artificial Sequence
  Description of Artificial Sequence: Synthetic oligonucleotide
  Target: SCN9A; (+) strand; PAM type: YTN; PAM sequence: TTG
gaagggtgaatagagaggag

SEQ ID NO: 101238 - DNA, 20 bp, Artificial Sequence
  Description of Artificial Sequence: Synthetic oligonucleotide
  Target: SCN9A; (+) strand; PAM type: YTN; PAM sequence: TTT
catacccagaaaaccatttg

SEQ ID NO: 101239 - DNA, 20 bp, Artificial Sequence
  Description of Artificial Sequence: Synthetic oligonucleotide
  Target: SCN9A; (+) strand; PAM type: YTN; PAM sequence: TTC
atacccagaaaaccatttgg

SEQ ID NO: 101240 - DNA, 20 bp, Artificial Sequence
  Description of Artificial Sequence: Synthetic oligonucleotide
  Target: SCN9A; (+) strand; PAM type: YTN; PAM sequence: TTT
ggattctggtccagtatcct

SEQ ID NO: 101241 - DNA, 20 bp, Artificial Sequence
  Description of Artificial Sequence: Synthetic oligonucleotide
  Target: SCN9A; (+) strand; PAM type: YTN; PAM sequence: TTG
gattctggtccagtatcctg

SEQ ID NO: 101242 - DNA, 20 bp, Artificial Sequence
  Description of Artificial Sequence: Synthetic oligonucleotide
  Target: SCN9A; (+) strand; PAM type: YTN; PAM sequence: TTC
tggtccagtatcctgtctgg

SEQ ID NO: 101243 - DNA, 20 bp, Artificial Sequence
  Description of Artificial Sequence: Synthetic oligonucleotide
  Target: SCN9A; (+) strand; PAM type: YTN; PAM sequence: CTG
gtccagtatcctgtctggag

SEQ ID NO: 101244 - DNA, 20 bp, Artificial Sequence
  Description of Artificial Sequence: Synthetic oligonucleotide
  Target: SCN9A; (+) strand; PAM type: YTN; PAM sequence: CTG
tctggagggaaagattagtt

SEQ ID NO: 101245 - DNA, 20 bp, Artificial Sequence
  Description of Artificial Sequence: Synthetic oligonucleotide
  Target: SCN9A; (+) strand; PAM type: YTN; PAM sequence: CTG
gagggaaagattagttagga

SEQ ID NO: 101246 - DNA, 20 bp, Artificial Sequence
  Description of Artificial Sequence: Synthetic oligonucleotide
  Target: SCN9A; (+) strand; PAM type: YTN; PAM sequence: TTA
gttaggaactagagttgtaa

SEQ ID NO: 101247 - DNA, 20 bp, Artificial Sequence
  Description of Artificial Sequence: Synthetic oligonucleotide
  Target: SCN9A; (+) strand; PAM type: YTN; PAM sequence: TTA
ggaactagagttgtaacaga

SEQ ID NO: 101248 - DNA, 20 bp, Artificial Sequence
  Description of Artificial Sequence: Synthetic oligonucleotide
  Target: SCN9A; (+) strand; PAM type: YTN; PAM sequence: CTA
gagttgtaacagattcaaga

SEQ ID NO: 101249 - DNA, 20 bp, Artificial Sequence
  Description of Artificial Sequence: Synthetic oligonucleotide
  Target: SCN9A; (+) strand; PAM type: YTN; PAM sequence: TTG
taacagattcaagacatatt

SEQ ID NO: 101250 - DNA, 20 bp, Artificial Sequence
  Description of Artificial Sequence: Synthetic oligonucleotide
  Target: SCN9A; (+) strand; PAM type: YTN; PAM sequence: TTC
aagacatatttggcagataa

SEQ ID NO: 101251 - DNA, 20 bp, Artificial Sequence
  Description of Artificial Sequence: Synthetic oligonucleotide
  Target: SCN9A; (+) strand; PAM type: YTN; PAM sequence: TTT
ggcagataaaatcagcagga

SEQ ID NO: 101252 - DNA, 20 bp, Artificial Sequence
  Description of Artificial Sequence: Synthetic oligonucleotide
  Target: SCN9A; (+) strand; PAM type: YTN; PAM sequence: TTG
gcagataaaatcagcaggat

SEQ ID NO: 101253 - DNA, 20 bp, Artificial Sequence
  Description of Artificial Sequence: Synthetic oligonucleotide
  Target: SCN9A; (+) strand; PAM type: YTN; PAM sequence: TTT
ggtgattgattggatatcaa

SEQ ID NO: 101254 - DNA, 20 bp, Artificial Sequence
  Description of Artificial Sequence: Synthetic oligonucleotide
  Target: SCN9A; (+) strand; PAM type: YTN; PAM sequence: TTG
gtgattgattggatatcaaa

SEQ ID NO: 101255 - DNA, 20 bp, Artificial Sequence
  Description of Artificial Sequence: Synthetic oligonucleotide
  Target: SCN9A; (+) strand; PAM type: YTN; PAM sequence: TTG
attggatatcaaatgtaaga

SEQ ID NO: 101256 - DNA, 20 bp, Artificial Sequence
  Description of Artificial Sequence: Synthetic oligonucleotide
  Target: SCN9A; (+) strand; PAM type: YTN; PAM sequence: TTG
gatatcaaatgtaagagaaa

SEQ ID NO: 101257 - DNA, 20 bp, Artificial Sequence
  Description of Artificial Sequence: Synthetic oligonucleotide
  Target: SCN9A; (+) strand; PAM type: YTN; PAM sequence: CTA
ccaggtggatgttagcagtg

SEQ ID NO: 101258 - DNA, 20 bp, Artificial Sequence
  Description of Artificial Sequence: Synthetic oligonucleotide
  Target: SCN9A; (+) strand; PAM type: YTN; PAM sequence: TTA
gcagtgaattgaaaaccaca

SEQ ID NO: 101259 - DNA, 20 bp, Artificial Sequence
  Description of Artificial Sequence: Synthetic oligonucleotide
  Target: SCN9A; (+) strand; PAM type: YTN; PAM sequence: TTG
aaaaccacaggaggaggagc

SEQ ID NO: 101260 - DNA, 20 bp, Artificial Sequence
  Description of Artificial Sequence: Synthetic oligonucleotide
  Target: SCN9A; (+) strand; PAM type: YTN; PAM sequence: CTG
actcggcaggtaatgatttt

SEQ ID NO: 101261 - DNA, 20 bp, Artificial Sequence
  Description of Artificial Sequence: Synthetic oligonucleotide
  Target: SCN9A; (+) strand; PAM type: YTN; PAM sequence: CTC
ggcaggtaatgattttgaga

SEQ ID NO: 101262 - DNA, 20 bp, Artificial Sequence
  Description of Artificial Sequence: Synthetic oligonucleotide
  Target: SCN9A; (+) strand; PAM type: YTN; PAM sequence: TTT
tgagatgcctgtgaattgtt

SEQ ID NO: 101263 - DNA, 20 bp, Artificial Sequence
  Description of Artificial Sequence: Synthetic oligonucleotide
  Target: SCN9A; (+) strand; PAM type: YTN; PAM sequence: TTT
gagatgcctgtgaattgttt

SEQ ID NO: 101264 - DNA, 20 bp, Artificial Sequence
  Description of Artificial Sequence: Synthetic oligonucleotide
  Target: SCN9A; (+) strand; PAM type: YTN; PAM sequence: TTG
agatgcctgtgaattgttta

SEQ ID NO: 101265 - DNA, 20 bp, Artificial Sequence
  Description of Artificial Sequence: Synthetic oligonucleotide
  Target: SCN9A; (+) strand; PAM type: YTN; PAM sequence: CTG
tgaattgtttaaatacagat

SEQ ID NO: 101266 - DNA, 20 bp, Artificial Sequence
  Description of Artificial Sequence: Synthetic oligonucleotide
  Target: SCN9A; (+) strand; PAM type: YTN; PAM sequence: TTG
tttaaatacagatatcctat

SEQ ID NO: 101267 - DNA, 20 bp, Artificial Sequence
  Description of Artificial Sequence: Synthetic oligonucleotide
  Target: SCN9A; (+) strand; PAM type: YTN; PAM sequence: TTT
aaatacagatatcctataga

SEQ ID NO: 101268 - DNA, 20 bp, Artificial Sequence
  Description of Artificial Sequence: Synthetic oligonucleotide
  Target: SCN9A; (+) strand; PAM type: YTN; PAM sequence: TTA
aatacagatatcctatagat

SEQ ID NO: 101269 - DNA, 20 bp, Artificial Sequence
  Description of Artificial Sequence: Synthetic oligonucleotide
  Target: SCN9A; (+) strand; PAM type: YTN; PAM sequence: CTA
tagattttaaaaatgggggt

SEQ ID NO: 101270 - DNA, 20 bp, Artificial Sequence
  Description of Artificial Sequence: Synthetic oligonucleotide
  Target: SCN9A; (+) strand; PAM type: YTN; PAM sequence: TTT
taaaaatgggggtgggaacc

SEQ ID NO: 101271 - DNA, 20 bp, Artificial Sequence
  Description of Artificial Sequence: Synthetic oligonucleotide
  Target: SCN9A; (+) strand; PAM type: YTN; PAM sequence: TTT
aaaaatgggggtgggaacct

SEQ ID NO: 101272 - DNA, 20 bp, Artificial Sequence
  Description of Artificial Sequence: Synthetic oligonucleotide
  Target: SCN9A; (+) strand; PAM type: YTN; PAM sequence: TTA
aaaatgggggtgggaacctg

SEQ ID NO: 101273 - DNA, 20 bp, Artificial Sequence
  Description of Artificial Sequence: Synthetic oligonucleotide
  Target: SCN9A; (+) strand; PAM type: YTN; PAM sequence: CTG
aaacgggaaaaacctgtcta

SEQ ID NO: 101274 - DNA, 20 bp, Artificial Sequence
  Description of Artificial Sequence: Synthetic oligonucleotide
  Target: SCN9A; (+) strand; PAM type: YTN; PAM sequence: CTG
tctagaaaagaattcttagt

SEQ ID NO: 101275 - DNA, 20 bp, Artificial Sequence
  Description of Artificial Sequence: Synthetic oligonucleotide
  Target: SCN9A; (+) strand; PAM type: YTN; PAM sequence: CTA
gaaaagaattcttagtaata

SEQ ID NO: 101276 - DNA, 20 bp, Artificial Sequence
  Description of Artificial Sequence: Synthetic oligonucleotide
  Target: SCN9A; (+) strand; PAM type: YTN; PAM sequence: TTC
ttagtaataattagcataca

SEQ ID NO: 101277 - DNA, 20 bp, Artificial Sequence
  Description of Artificial Sequence: Synthetic oligonucleotide
  Target: SCN9A; (+) strand; PAM type: YTN; PAM sequence: CTT
agtaataattagcatacatg

SEQ ID NO: 101278 - DNA, 20 bp, Artificial Sequence
  Description of Artificial Sequence: Synthetic oligonucleotide
  Target: SCN9A; (+) strand; PAM type: YTN; PAM sequence: TTA
gtaataattagcatacatgt

SEQ ID NO: 101279 - DNA, 20 bp, Artificial Sequence
  Description of Artificial Sequence: Synthetic oligonucleotide
  Target: SCN9A; (+) strand; PAM type: YTN; PAM sequence: TTA
gcatacatgtatctgctgaa

SEQ ID NO: 101280 - DNA, 20 bp, Artificial Sequence
  Description of Artificial Sequence: Synthetic oligonucleotide
  Target: SCN9A; (+) strand; PAM type: YTN; PAM sequence: CTG
ctgaagtcagaacagttttt

SEQ ID NO: 101281 - DNA, 20 bp, Artificial Sequence
  Description of Artificial Sequence: Synthetic oligonucleotide
  Target: SCN9A; (+) strand; PAM type: YTN; PAM sequence: CTG
aagtcagaacagtttttgag

SEQ ID NO: 101282 - DNA, 20 bp, Artificial Sequence
  Description of Artificial Sequence: Synthetic oligonucleotide
  Target: SCN9A; (+) strand; PAM type: YTN; PAM sequence: TTT
ttgaggtcacacaaaaagag

SEQ ID NO: 101283 - DNA, 20 bp, Artificial Sequence
  Description of Artificial Sequence: Synthetic oligonucleotide
  Target: SCN9A; (+) strand; PAM type: YTN; PAM sequence: TTT
tgaggtcacacaaaaagagt

SEQ ID NO: 101284 - DNA, 20 bp, Artificial Sequence
  Description of Artificial Sequence: Synthetic oligonucleotide
  Target: SCN9A; (+) strand; PAM type: YTN; PAM sequence: TTT
gaggtcacacaaaaagagta

SEQ ID NO: 101285 - DNA, 20 bp, Artificial Sequence
  Description of Artificial Sequence: Synthetic oligonucleotide
  Target: SCN9A; (+) strand; PAM type: YTN; PAM sequence: TTG
aggtcacacaaaaagagtat

SEQ ID NO: 101286 - DNA, 20 bp, Artificial Sequence
  Description of Artificial Sequence: Synthetic oligonucleotide
  Target: SCN9A; (+) strand; PAM type: YTN; PAM sequence: TTT
agggtgagcagaaaaagggc

SEQ ID NO: 101287 - DNA, 20 bp, Artificial Sequence
  Description of Artificial Sequence: Synthetic oligonucleotide
  Target: SCN9A; (+) strand; PAM type: YTN; PAM sequence: TTA
gggtgagcagaaaaagggcc

SEQ ID NO: 101288 - DNA, 20 bp, Artificial Sequence
  Description of Artificial Sequence: Synthetic oligonucleotide
  Target: SCN9A; (+) strand; PAM type: YTN; PAM sequence: CTC
cgaaacattctgaaacaaca

SEQ ID NO: 101289 - DNA, 20 bp, Artificial Sequence
  Description of Artificial Sequence: Synthetic oligonucleotide
  Target: SCN9A; (+) strand; PAM type: YTN; PAM sequence: TTC
tgaaacaacaatattaaggg

SEQ ID NO: 101290 - DNA, 20 bp, Artificial Sequence
  Description of Artificial Sequence: Synthetic oligonucleotide
  Target: SCN9A; (+) strand; PAM type: YTN; PAM sequence: CTG
aaacaacaatattaagggag

SEQ ID NO: 101291 - DNA, 20 bp, Artificial Sequence
  Description of Artificial Sequence: Synthetic oligonucleotide
  Target: SCN9A; (+) strand; PAM type: YTN; PAM sequence: TTA
agggagagaattcaatggtg

SEQ ID NO: 101292 - DNA, 20 bp, Artificial Sequence
  Description of Artificial Sequence: Synthetic oligonucleotide
  Target: SCN9A; (+) strand; PAM type: YTN; PAM sequence: TTC
aatggtgtgctgaaagcaga

SEQ ID NO: 101293 - DNA, 20 bp, Artificial Sequence
  Description of Artificial Sequence: Synthetic oligonucleotide
  Target: SCN9A; (+) strand; PAM type: YTN; PAM sequence: CTG
aaagcagaccataccaattc

SEQ ID NO: 101294 - DNA, 20 bp, Artificial Sequence
  Description of Artificial Sequence: Synthetic oligonucleotide
  Target: SCN9A; (+) strand; PAM type: YTN; PAM sequence: TTC
ttgttgttaaactgtcagaa

SEQ ID NO: 101295 - DNA, 20 bp, Artificial Sequence
  Description of Artificial Sequence: Synthetic oligonucleotide
  Target: SCN9A; (+) strand; PAM type: YTN; PAM sequence: CTT
gttgttaaactgtcagaaat

SEQ ID NO: 101296 - DNA, 20 bp, Artificial Sequence
  Description of Artificial Sequence: Synthetic oligonucleotide
  Target: SCN9A; (+) strand; PAM type: YTN; PAM sequence: TTG
ttgttaaactgtcagaaatt

SEQ ID NO: 101297 - DNA, 20 bp, Artificial Sequence
  Description of Artificial Sequence: Synthetic oligonucleotide
  Target: SCN9A; (+) strand; PAM type: YTN; PAM sequence: TTG
ttaaactgtcagaaattcct

SEQ ID NO: 101298 - DNA, 20 bp, Artificial Sequence
  Description of Artificial Sequence: Synthetic oligonucleotide
  Target: SCN9A; (+) strand; PAM type: YTN; PAM sequence: TTA
aactgtcagaaattcctgct

SEQ ID NO: 101299 - DNA, 20 bp, Artificial Sequence
  Description of Artificial Sequence: Synthetic oligonucleotide
  Target: SCN9A; (+) strand; PAM type: YTN; PAM sequence: CTG
tcagaaattcctgcttgtct

SEQ ID NO: 101300 - DNA, 20 bp, Artificial Sequence
  Description of Artificial Sequence: Synthetic oligonucleotide
  Target: SCN9A; (+) strand; PAM type: YTN; PAM sequence: TTC
ctgcttgtctgttgttaaaa

SEQ ID NO: 101301 - DNA, 20 bp, Artificial Sequence
  Description of Artificial Sequence: Synthetic oligonucleotide
  Target: SCN9A; (+) strand; PAM type: YTN; PAM sequence: CTG
cttgtctgttgttaaaagca

SEQ ID NO: 101302 - DNA, 20 bp, Artificial Sequence
  Description of Artificial Sequence: Synthetic oligonucleotide
  Target: SCN9A; (+) strand; PAM type: YTN; PAM sequence: CTT
gtctgttgttaaaagcagcc

SEQ ID NO: 101303 - DNA, 20 bp, Artificial Sequence
  Description of Artificial Sequence: Synthetic oligonucleotide
  Target: SCN9A; (+) strand; PAM type: YTN; PAM sequence: TTG
tctgttgttaaaagcagcca

SEQ ID NO: 101304 - DNA, 20 bp, Artificial Sequence
  Description of Artificial Sequence: Synthetic oligonucleotide
  Target: SCN9A; (+) strand; PAM type: YTN; PAM sequence: CTG
ttgttaaaagcagccattat

SEQ ID NO: 101305 - DNA, 20 bp, Artificial Sequence
  Description of Artificial Sequence: Synthetic oligonucleotide
  Target: SCN9A; (+) strand; PAM type: YTN; PAM sequence: TTG
ttaaaagcagccattattaa

SEQ ID NO: 101306 - DNA, 20 bp, Artificial Sequence
  Description of Artificial Sequence: Synthetic oligonucleotide
  Target: SCN9A; (+) strand; PAM type: YTN; PAM sequence: TTA
aaagcagccattattaaata

SEQ ID NO: 101307 - DNA, 20 bp, Artificial Sequence
  Description of Artificial Sequence: Synthetic oligonucleotide
  Target: SCN9A; (+) strand; PAM type: YTN; PAM sequence: TTA
ttaaatatttgactatataa

SEQ ID NO: 101308 - DNA, 20 bp, Artificial Sequence
  Description of Artificial Sequence: Synthetic oligonucleotide
  Target: SCN9A; (+) strand; PAM type: YTN; PAM sequence: TTA
aatatttgactatataaact

SEQ ID NO: 101309 - DNA, 20 bp, Artificial Sequence
  Description of Artificial Sequence: Synthetic oligonucleotide
  Target: SCN9A; (+) strand; PAM type: YTN; PAM sequence: TTT
gactatataaacttagaatt

SEQ ID NO: 101310 - DNA, 20 bp, Artificial Sequence
  Description of Artificial Sequence: Synthetic oligonucleotide
  Target: SCN9A; (+) strand; PAM type: YTN; PAM sequence: TTG
actatataaacttagaattc

SEQ ID NO: 101311 - DNA, 20 bp, Artificial Sequence
  Description of Artificial Sequence: Synthetic oligonucleotide
  Target: SCN9A; (+) strand; PAM type: YTN; PAM sequence: CTA
tataaacttagaattctata

SEQ ID NO: 101312 - DNA, 20 bp, Artificial Sequence
  Description of Artificial Sequence: Synthetic oligonucleotide
  Target: SCN9A; (+) strand; PAM type: YTN; PAM sequence: CTT
agaattctataacttacctt

SEQ ID NO: 101313 - DNA, 20 bp, Artificial Sequence
  Description of Artificial Sequence: Synthetic oligonucleotide
  Target: SCN9A; (+) strand; PAM type: YTN; PAM sequence: TTA
gaattctataacttacctta

SEQ ID NO: 101314 - DNA, 20 bp, Artificial Sequence
  Description of Artificial Sequence: Synthetic oligonucleotide
  Target: SCN9A; (+) strand; PAM type: YTN; PAM sequence: TTC
tataacttaccttaaggaaa

SEQ ID NO: 101315 - DNA, 20 bp, Artificial Sequence
  Description of Artificial Sequence: Synthetic oligonucleotide
  Target: SCN9A; (+) strand; PAM type: YTN; PAM sequence: CTA
taacttaccttaaggaaagg

SEQ ID NO: 101316 - DNA, 20 bp, Artificial Sequence
  Description of Artificial Sequence: Synthetic oligonucleotide
  Target: SCN9A; (+) strand; PAM type: YTN; PAM sequence: CTT
accttaaggaaaggtaataa

SEQ ID NO: 101317 - DNA, 20 bp, Artificial Sequence
  Description of Artificial Sequence: Synthetic oligonucleotide
  Target: SCN9A; (+) strand; PAM type: YTN; PAM sequence: TTA
ccttaaggaaaggtaataaa

SEQ ID NO: 101318 - DNA, 20 bp, Artificial Sequence
  Description of Artificial Sequence: Synthetic oligonucleotide
  Target: SCN9A; (+) strand; PAM type: YTN; PAM sequence: CTT
aaggaaaggtaataaatact

SEQ ID NO: 101319 - DNA, 20 bp, Artificial Sequence
  Description of Artificial Sequence: Synthetic oligonucleotide
  Target: SCN9A; (+) strand; PAM type: YTN; PAM sequence: TTA
aggaaaggtaataaatacta

SEQ ID NO: 101320 - DNA, 20 bp, Artificial Sequence
  Description of Artificial Sequence: Synthetic oligonucleotide
  Target: SCN9A; (+) strand; PAM type: YTN; PAM sequence: CTA
agacatatcacttcctaatt

SEQ ID NO: 101321 - DNA, 20 bp, Artificial Sequence
  Description of Artificial Sequence: Synthetic oligonucleotide
  Target: SCN9A; (+) strand; PAM type: YTN; PAM sequence: CTT
cctaattattttactgtatt

SEQ ID NO: 101322 - DNA, 20 bp, Artificial Sequence
  Description of Artificial Sequence: Synthetic oligonucleotide
  Target: SCN9A; (+) strand; PAM type: YTN; PAM sequence: TTC
ctaattattttactgtattt

SEQ ID NO: 101323 - DNA, 20 bp, Artificial Sequence
  Description of Artificial Sequence: Synthetic oligonucleotide
  Target: SCN9A; (+) strand; PAM type: YTN; PAM sequence: CTA
attattttactgtattttat

SEQ ID NO: 101324 - DNA, 20 bp, Artificial Sequence
  Description of Artificial Sequence: Synthetic oligonucleotide
  Target: SCN9A; (+) strand; PAM type: YTN; PAM sequence: TTA
ttttactgtattttatttgt

SEQ ID NO: 101325 - DNA, 20 bp, Artificial Sequence
  Description of Artificial Sequence: Synthetic oligonucleotide
  Target: SCN9A; (+) strand; PAM type: YTN; PAM sequence: TTT
tactgtattttatttgtcta

SEQ ID NO: 101326 - DNA, 20 bp, Artificial Sequence
  Description of Artificial Sequence: Synthetic oligonucleotide
  Target: SCN9A; (+) strand; PAM type: YTN; PAM sequence: TTT
actgtattttatttgtctat

SEQ ID NO: 101327 - DNA, 20 bp, Artificial Sequence
  Description of Artificial Sequence: Synthetic oligonucleotide
  Target: SCN9A; (+) strand; PAM type: YTN; PAM sequence: TTA
ctgtattttatttgtctatt

SEQ ID NO: 101328 - DNA, 20 bp, Artificial Sequence
  Description of Artificial Sequence: Synthetic oligonucleotide
  Target: SCN9A; (+) strand; PAM type: YTN; PAM sequence: CTG
tattttatttgtctattccg

SEQ ID NO: 101329 - DNA, 20 bp, Artificial Sequence
  Description of Artificial Sequence: Synthetic oligonucleotide
  Target: SCN9A; (+) strand; PAM type: YTN; PAM sequence: TTT
tatttgtctattccgtttga

SEQ ID NO: 101330 - DNA, 20 bp, Artificial Sequence
  Description of Artificial Sequence: Synthetic oligonucleotide
  Target: SCN9A; (+) strand; PAM type: YTN; PAM sequence: TTT
atttgtctattccgtttgaa

SEQ ID NO: 101331 - DNA, 20 bp, Artificial Sequence
  Description of Artificial Sequence: Synthetic oligonucleotide
  Target: SCN9A; (+) strand; PAM type: YTN; PAM sequence: TTA
tttgtctattccgtttgaat

SEQ ID NO: 101332 - DNA, 20 bp, Artificial Sequence
  Description of Artificial Sequence: Synthetic oligonucleotide
  Target: SCN9A; (+) strand; PAM type: YTN; PAM sequence: TTT
gtctattccgtttgaatagc

SEQ ID NO: 101333 - DNA, 20 bp, Artificial Sequence
  Description of Artificial Sequence: Synthetic oligonucleotide
  Target: SCN9A; (+) strand; PAM type: YTN; PAM sequence: TTG
tctattccgtttgaatagca

SEQ ID NO: 101334 - DNA, 20 bp, Artificial Sequence
  Description of Artificial Sequence: Synthetic oligonucleotide
  Target: SCN9A; (+) strand; PAM type: YTN; PAM sequence: CTA
ttccgtttgaatagcagaag

SEQ ID NO: 101335 - DNA, 20 bp, Artificial Sequence
  Description of Artificial Sequence: Synthetic oligonucleotide
  Target: SCN9A; (+) strand; PAM type: YTN; PAM sequence: TTC
cgtttgaatagcagaagtat

SEQ ID NO: 101336 - DNA, 20 bp, Artificial Sequence
  Description of Artificial Sequence: Synthetic oligonucleotide
  Target: SCN9A; (+) strand; PAM type: YTN; PAM sequence: TTT
gaatagcagaagtatggcat

SEQ ID NO: 101337 - DNA, 20 bp, Artificial Sequence
  Description of Artificial Sequence: Synthetic oligonucleotide
  Target: SCN9A; (+) strand; PAM type: YTN; PAM sequence: TTG
aatagcagaagtatggcata

SEQ ID NO: 101338 - DNA, 20 bp, Artificial Sequence
  Description of Artificial Sequence: Synthetic oligonucleotide
  Target: SCN9A; (+) strand; PAM type: YTN; PAM sequence: CTG
tcgggctattgtgcatctct

SEQ ID NO: 101339 - DNA, 20 bp, Artificial Sequence
  Description of Artificial Sequence: Synthetic oligonucleotide
  Target: SCN9A; (+) strand; PAM type: YTN; PAM sequence: CTA
ttgtgcatctcttctttctg

SEQ ID NO: 101340 - DNA, 20 bp, Artificial Sequence
  Description of Artificial Sequence: Synthetic oligonucleotide
  Target: SCN9A; (+) strand; PAM type: YTN; PAM sequence: TTG
tgcatctcttctttctggac

SEQ ID NO: 101341 - DNA, 20 bp, Artificial Sequence
  Description of Artificial Sequence: Synthetic oligonucleotide
  Target: SCN9A; (+) strand; PAM type: YTN; PAM sequence: CTC
ttctttctggacggtggtct

SEQ ID NO: 101342 - DNA, 20 bp, Artificial Sequence
  Description of Artificial Sequence: Synthetic oligonucleotide
  Target: SCN9A; (+) strand; PAM type: YTN; PAM sequence: CTT
ctttctggacggtggtctat

SEQ ID NO: 101343 - DNA, 20 bp, Artificial Sequence
  Description of Artificial Sequence: Synthetic oligonucleotide
  Target: SCN9A; (+) strand; PAM type: YTN; PAM sequence: TTC
tttctggacggtggtctatt

SEQ ID NO: 101344 - DNA, 20 bp, Artificial Sequence
  Description of Artificial Sequence: Synthetic oligonucleotide
  Target: SCN9A; (+) strand; PAM type: YTN; PAM sequence: CTT
tctggacggtggtctattct

SEQ ID NO: 101345 - DNA, 20 bp, Artificial Sequence
  Description of Artificial Sequence: Synthetic oligonucleotide
  Target: SCN9A; (+) strand; PAM type: YTN; PAM sequence: TTT
ctggacggtggtctattctc

SEQ ID NO: 101346 - DNA, 20 bp, Artificial Sequence
  Description of Artificial Sequence: Synthetic oligonucleotide
  Target: SCN9A; (+) strand; PAM type: YTN; PAM sequence: TTC
tggacggtggtctattctct

SEQ ID NO: 101347 - DNA, 20 bp, Artificial Sequence
  Description of Artificial Sequence: Synthetic oligonucleotide
  Target: SCN9A; (+) strand; PAM type: YTN; PAM sequence: CTG
gacggtggtctattctctct

SEQ ID NO: 101348 - DNA, 20 bp, Artificial Sequence
  Description of Artificial Sequence: Synthetic oligonucleotide
  Target: SCN9A; (+) strand; PAM type: YTN; PAM sequence: CTA
ttctctctggattattctct

SEQ ID NO: 101349 - DNA, 20 bp, Artificial Sequence
  Description of Artificial Sequence: Synthetic oligonucleotide
  Target: SCN9A; (+) strand; PAM type: YTN; PAM sequence: TTC
tctctggattattctctctg

SEQ ID NO: 101350 - DNA, 20 bp, Artificial Sequence
  Description of Artificial Sequence: Synthetic oligonucleotide
  Target: SCN9A; (+) strand; PAM type: YTN; PAM sequence: CTC
tctggattattctctctgga

SEQ ID NO: 101351 - DNA, 20 bp, Artificial Sequence
  Description of Artificial Sequence: Synthetic oligonucleotide
  Target: SCN9A; (+) strand; PAM type: YTN; PAM sequence: CTC
tggattattctctctggaca

SEQ ID NO: 101352 - DNA, 20 bp, Artificial Sequence
  Description of Artificial Sequence: Synthetic oligonucleotide
  Target: SCN9A; (+) strand; PAM type: YTN; PAM sequence: CTG
gattattctctctggacagt

SEQ ID NO: 101353 - DNA, 20 bp, Artificial Sequence
  Description of Artificial Sequence: Synthetic oligonucleotide
  Target: SCN9A; (+) strand; PAM type: YTN; PAM sequence: TTA
ttctctctggacagtagtaa

SEQ ID NO: 101354 - DNA, 20 bp, Artificial Sequence
  Description of Artificial Sequence: Synthetic oligonucleotide
  Target: SCN9A; (+) strand; PAM type: YTN; PAM sequence: TTC
tctctggacagtagtaatat

SEQ ID NO: 101355 - DNA, 20 bp, Artificial Sequence
  Description of Artificial Sequence: Synthetic oligonucleotide
  Target: SCN9A; (+) strand; PAM type: YTN; PAM sequence: CTC
tctggacagtagtaatatgc

SEQ ID NO: 101356 - DNA, 20 bp, Artificial Sequence
  Description of Artificial Sequence: Synthetic oligonucleotide
  Target: SCN9A; (+) strand; PAM type: YTN; PAM sequence: CTC
tggacagtagtaatatgcta

SEQ ID NO: 101357 - DNA, 20 bp, Artificial Sequence
  Description of Artificial Sequence: Synthetic oligonucleotide
  Target: SCN9A; (+) strand; PAM type: YTN; PAM sequence: CTG
gacagtagtaatatgctata

SEQ ID NO: 101358 - DNA, 20 bp, Artificial Sequence
  Description of Artificial Sequence: Synthetic oligonucleotide
  Target: SCN9A; (+) strand; PAM type: YTN; PAM sequence: CTA
tactattgggctactgtgca

SEQ ID NO: 101359 - DNA, 20 bp, Artificial Sequence
  Description of Artificial Sequence: Synthetic oligonucleotide
  Target: SCN9A; (+) strand; PAM type: YTN; PAM sequence: CTA
ttgggctactgtgcaactct

SEQ ID NO: 101360 - DNA, 20 bp, Artificial Sequence
  Description of Artificial Sequence: Synthetic oligonucleotide
  Target: SCN9A; (+) strand; PAM type: YTN; PAM sequence: TTG
ggctactgtgcaactcttct

SEQ ID NO: 101361 - DNA, 20 bp, Artificial Sequence
  Description of Artificial Sequence: Synthetic oligonucleotide
  Target: SCN9A; (+) strand; PAM type: YTN; PAM sequence: CTA
ctgtgcaactcttctttctg

SEQ ID NO: 101362 - DNA, 20 bp, Artificial Sequence
  Description of Artificial Sequence: Synthetic oligonucleotide
  Target: SCN9A; (+) strand; PAM type: YTN; PAM sequence: CTG
tgcaactcttctttctggat

SEQ ID NO: 101363 - DNA, 20 bp, Artificial Sequence
  Description of Artificial Sequence: Synthetic oligonucleotide
  Target: SCN9A; (+) strand; PAM type: YTN; PAM sequence: CTC
ttctttctggatgctggtct

SEQ ID NO: 101364 - DNA, 20 bp, Artificial Sequence
  Description of Artificial Sequence: Synthetic oligonucleotide
  Target: SCN9A; (+) strand; PAM type: YTN; PAM sequence: CTT
ctttctggatgctggtctat

SEQ ID NO: 101365 - DNA, 20 bp, Artificial Sequence
  Description of Artificial Sequence: Synthetic oligonucleotide
  Target: SCN9A; (+) strand; PAM type: YTN; PAM sequence: TTC
tttctggatgctggtctatt

SEQ ID NO: 101366 - DNA, 20 bp, Artificial Sequence
  Description of Artificial Sequence: Synthetic oligonucleotide
  Target: SCN9A; (+) strand; PAM type: YTN; PAM sequence: CTT
tctggatgctggtctattct

SEQ ID NO: 101367 - DNA, 20 bp, Artificial Sequence
  Description of Artificial Sequence: Synthetic oligonucleotide
  Target: SCN9A; (+) strand; PAM type: YTN; PAM sequence: TTT
ctggatgctggtctattcta

SEQ ID NO: 101368 - DNA, 20 bp, Artificial Sequence
  Description of Artificial Sequence: Synthetic oligonucleotide
  Target: SCN9A; (+) strand; PAM type: YTN; PAM sequence: TTC
tggatgctggtctattctat

SEQ ID NO: 101369 - DNA, 20 bp, Artificial Sequence
  Description of Artificial Sequence: Synthetic oligonucleotide
  Target: SCN9A; (+) strand; PAM type: YTN; PAM sequence: CTG
gatgctggtctattctatct

SEQ ID NO: 101370 - DNA, 20 bp, Artificial Sequence
  Description of Artificial Sequence: Synthetic oligonucleotide
  Target: SCN9A; (+) strand; PAM type: YTN; PAM sequence: CTG
gtctattctatctggcctat

SEQ ID NO: 101371 - DNA, 20 bp, Artificial Sequence
  Description of Artificial Sequence: Synthetic oligonucleotide
  Target: SCN9A; (+) strand; PAM type: YTN; PAM sequence: CTA
ttctatctggcctattctat

SEQ ID NO: 101372 - DNA, 20 bp, Artificial Sequence
  Description of Artificial Sequence: Synthetic oligonucleotide
  Target: SCN9A; (+) strand; PAM type: YTN; PAM sequence: TTC
tatctggcctattctatctg

SEQ ID NO: 101373 - DNA, 20 bp, Artificial Sequence
  Description of Artificial Sequence: Synthetic oligonucleotide
  Target: SCN9A; (+) strand; PAM type: YTN; PAM sequence: CTA
tctggcctattctatctgga

SEQ ID NO: 101374 - DNA, 20 bp, Artificial Sequence
  Description of Artificial Sequence: Synthetic oligonucleotide
  Target: SCN9A; (+) strand; PAM type: YTN; PAM sequence: CTG
gcctattctatctggatggt

SEQ ID NO: 101375 - DNA, 20 bp, Artificial Sequence
  Description of Artificial Sequence: Synthetic oligonucleotide
  Target: SCN9A; (+) strand; PAM type: YTN; PAM sequence: CTA
ttctatctggatggtggaag

SEQ ID NO: 101376 - DNA, 20 bp, Artificial Sequence
  Description of Artificial Sequence: Synthetic oligonucleotide
  Target: SCN9A; (+) strand; PAM type: YTN; PAM sequence: TTC
tatctggatggtggaagtat

SEQ ID NO: 101377 - DNA, 20 bp, Artificial Sequence
  Description of Artificial Sequence: Synthetic oligonucleotide
  Target: SCN9A; (+) strand; PAM type: YTN; PAM sequence: CTA
tctggatggtggaagtatgt

SEQ ID NO: 101378 - DNA, 20 bp, Artificial Sequence
  Description of Artificial Sequence: Synthetic oligonucleotide
  Target: SCN9A; (+) strand; PAM type: YTN; PAM sequence: CTG
gatggtggaagtatgtcaca

SEQ ID NO: 101379 - DNA, 20 bp, Artificial Sequence
  Description of Artificial Sequence: Synthetic oligonucleotide
  Target: SCN9A; (+) strand; PAM type: YTN; PAM sequence: CTG
ttgagctactgtgaatctct

SEQ ID NO: 101380 - DNA, 20 bp, Artificial Sequence
  Description of Artificial Sequence: Synthetic oligonucleotide
  Target: SCN9A; (+) strand; PAM type: YTN; PAM sequence: TTG
agctactgtgaatctcttct

SEQ ID NO: 101381 - DNA, 20 bp, Artificial Sequence
  Description of Artificial Sequence: Synthetic oligonucleotide
  Target: SCN9A; (+) strand; PAM type: YTN; PAM sequence: CTA
ctgtgaatctcttcttaact

SEQ ID NO: 101382 - DNA, 20 bp, Artificial Sequence
  Description of Artificial Sequence: Synthetic oligonucleotide
  Target: SCN9A; (+) strand; PAM type: YTN; PAM sequence: CTG
tgaatctcttcttaactctg

SEQ ID NO: 101383 - DNA, 20 bp, Artificial Sequence
  Description of Artificial Sequence: Synthetic oligonucleotide
  Target: SCN9A; (+) strand; PAM type: YTN; PAM sequence: CTC
ttcttaactctgcatttagc

SEQ ID NO: 101384 - DNA, 20 bp, Artificial Sequence
  Description of Artificial Sequence: Synthetic oligonucleotide
  Target: SCN9A; (+) strand; PAM type: YTN; PAM sequence: CTT
cttaactctgcatttagcaa

SEQ ID NO: 101385 - DNA, 20 bp, Artificial Sequence
  Description of Artificial Sequence: Synthetic oligonucleotide
  Target: SCN9A; (+) strand; PAM type: YTN; PAM sequence: TTC
ttaactctgcatttagcaat

SEQ ID NO: 101386 - DNA, 20 bp, Artificial Sequence
  Description of Artificial Sequence: Synthetic oligonucleotide
  Target: SCN9A; (+) strand; PAM type: YTN; PAM sequence: CTT
aactctgcatttagcaattt

SEQ ID NO: 101387 - DNA, 20 bp, Artificial Sequence
  Description of Artificial Sequence: Synthetic oligonucleotide
  Target: SCN9A; (+) strand; PAM type: YTN; PAM sequence: TTA
actctgcatttagcaatttc

SEQ ID NO: 101388 - DNA, 20 bp, Artificial Sequence
  Description of Artificial Sequence: Synthetic oligonucleotide
  Target: SCN9A; (+) strand; PAM type: YTN; PAM sequence: CTC
tgcatttagcaatttcacat

SEQ ID NO: 101389 - DNA, 20 bp, Artificial Sequence
  Description of Artificial Sequence: Synthetic oligonucleotide
  Target: SCN9A; (+) strand; PAM type: YTN; PAM sequence: CTG
catttagcaatttcacatca

SEQ ID NO: 101390 - DNA, 20 bp, Artificial Sequence
  Description of Artificial Sequence: Synthetic oligonucleotide
  Target: SCN9A; (+) strand; PAM type: YTN; PAM sequence: TTT
agcaatttcacatcagtagt

SEQ ID NO: 101391 - DNA, 20 bp, Artificial Sequence
  Description of Artificial Sequence: Synthetic oligonucleotide
  Target: SCN9A; (+) strand; PAM type: YTN; PAM sequence: TTA
gcaatttcacatcagtagtt

SEQ ID NO: 101392 - DNA, 20 bp, Artificial Sequence
  Description of Artificial Sequence: Synthetic oligonucleotide
  Target: SCN9A; (+) strand; PAM type: YTN; PAM sequence: TTT
cacatcagtagtttgaaatc

SEQ ID NO: 101393 - DNA, 20 bp, Artificial Sequence
  Description of Artificial Sequence: Synthetic oligonucleotide
  Target: SCN9A; (+) strand; PAM type: YTN; PAM sequence: TTC
acatcagtagtttgaaatca

SEQ ID NO: 101394 - DNA, 20 bp, Artificial Sequence
  Description of Artificial Sequence: Synthetic oligonucleotide
  Target: SCN9A; (+) strand; PAM type: YTN; PAM sequence: TTT
gaaatcagtgatggtgggaa

SEQ ID NO: 101395 - DNA, 20 bp, Artificial Sequence
  Description of Artificial Sequence: Synthetic oligonucleotide
  Target: SCN9A; (+) strand; PAM type: YTN; PAM sequence: TTG
aaatcagtgatggtgggaat

SEQ ID NO: 101396 - DNA, 20 bp, Artificial Sequence
  Description of Artificial Sequence: Synthetic oligonucleotide
  Target: SCN9A; (+) strand; PAM type: YTN; PAM sequence: CTT
tacattacaaaaatctccaa

SEQ ID NO: 101397 - DNA, 20 bp, Artificial Sequence
  Description of Artificial Sequence: Synthetic oligonucleotide
  Target: SCN9A; (+) strand; PAM type: YTN; PAM sequence: TTT
acattacaaaaatctccaag

SEQ ID NO: 101398 - DNA, 20 bp, Artificial Sequence
  Description of Artificial Sequence: Synthetic oligonucleotide
  Target: SCN9A; (+) strand; PAM type: YTN; PAM sequence: TTA
cattacaaaaatctccaagc

SEQ ID NO: 101399 - DNA, 20 bp, Artificial Sequence
  Description of Artificial Sequence: Synthetic oligonucleotide
  Target: SCN9A; (+) strand; PAM type: YTN; PAM sequence: TTA
caaaaatctccaagcactac

SEQ ID NO: 101400 - DNA, 20 bp, Artificial Sequence
  Description of Artificial Sequence: Synthetic oligonucleotide
  Target: SCN9A; (+) strand; PAM type: YTN; PAM sequence: CTC
caagcactacaaatgagagc

SEQ ID NO: 101401 - DNA, 20 bp, Artificial Sequence
  Description of Artificial Sequence: Synthetic oligonucleotide
  Target: SCN9A; (+) strand; PAM type: YTN; PAM sequence: CTA
caaatgagagcttcttgatt

SEQ ID NO: 101402 - DNA, 20 bp, Artificial Sequence
  Description of Artificial Sequence: Synthetic oligonucleotide
  Target: SCN9A; (+) strand; PAM type: YTN; PAM sequence: CTT
cttgattttctagagtagaa

SEQ ID NO: 101403 - DNA, 20 bp, Artificial Sequence
  Description of Artificial Sequence: Synthetic oligonucleotide
  Target: SCN9A; (+) strand; PAM type: YTN; PAM sequence: TTC
ttgattttctagagtagaat

SEQ ID NO: 101404 - DNA, 20 bp, Artificial Sequence
  Description of Artificial Sequence: Synthetic oligonucleotide
  Target: SCN9A; (+) strand; PAM type: YTN; PAM sequence: CTT
gattttctagagtagaatta

SEQ ID NO: 101405 - DNA, 20 bp, Artificial Sequence
  Description of Artificial Sequence: Synthetic oligonucleotide
  Target: SCN9A; (+) strand; PAM type: YTN; PAM sequence: TTG
attttctagagtagaattaa

SEQ ID NO: 101406 - DNA, 20 bp, Artificial Sequence
  Description of Artificial Sequence: Synthetic oligonucleotide
  Target: SCN9A; (+) strand; PAM type: YTN; PAM sequence: TTT
tctagagtagaattaagaag

SEQ ID NO: 101407 - DNA, 20 bp, Artificial Sequence
  Description of Artificial Sequence: Synthetic oligonucleotide
  Target: SCN9A; (+) strand; PAM type: YTN; PAM sequence: TTT
ctagagtagaattaagaagg

SEQ ID NO: 101408 - DNA, 20 bp, Artificial Sequence
  Description of Artificial Sequence: Synthetic oligonucleotide
  Target: SCN9A; (+) strand; PAM type: YTN; PAM sequence: TTC
tagagtagaattaagaaggt

SEQ ID NO: 101409 - DNA, 20 bp, Artificial Sequence
  Description of Artificial Sequence: Synthetic oligonucleotide
  Target: SCN9A; (+) strand; PAM type: YTN; PAM sequence: CTA
gagtagaattaagaaggtga

SEQ ID NO: 101410 - DNA, 20 bp, Artificial Sequence
  Description of Artificial Sequence: Synthetic oligonucleotide
  Target: SCN9A; (+) strand; PAM type: YTN; PAM sequence: TTA
agaaggtgatggaggaaatg

SEQ ID NO: 101411 - DNA, 20 bp, Artificial Sequence
  Description of Artificial Sequence: Synthetic oligonucleotide
  Target: SCN9A; (+) strand; PAM type: YTN; PAM sequence: TTG
tgtttgtagccattactctg

SEQ ID NO: 101412 - DNA, 20 bp, Artificial Sequence
  Description of Artificial Sequence: Synthetic oligonucleotide
  Target: SCN9A; (+) strand; PAM type: YTN; PAM sequence: TTT
gtagccattactctgaatag

SEQ ID NO: 101413 - DNA, 20 bp, Artificial Sequence
  Description of Artificial Sequence: Synthetic oligonucleotide
  Target: SCN9A; (+) strand; PAM type: YTN; PAM sequence: TTG
tagccattactctgaatagc

SEQ ID NO: 101414 - DNA, 20 bp, Artificial Sequence
  Description of Artificial Sequence: Synthetic oligonucleotide
  Target: SCN9A; (+) strand; PAM type: YTN; PAM sequence: TTA
ctctgaatagcacaaaaatt

SEQ ID NO: 101415 - DNA, 20 bp, Artificial Sequence
  Description of Artificial Sequence: Synthetic oligonucleotide
  Target: SCN9A; (+) strand; PAM type: YTN; PAM sequence: CTC
tgaatagcacaaaaattaaa

SEQ ID NO: 101416 - DNA, 20 bp, Artificial Sequence
  Description of Artificial Sequence: Synthetic oligonucleotide
  Target: SCN9A; (+) strand; PAM type: YTN; PAM sequence: CTG
aatagcacaaaaattaaaaa

SEQ ID NO: 101417 - DNA, 20 bp, Artificial Sequence
  Description of Artificial Sequence: Synthetic oligonucleotide
  Target: SCN9A; (+) strand; PAM type: YTN; PAM sequence: TTA
aaaaatatcctttcattatt

SEQ ID NO: 101418 - DNA, 20 bp, Artificial Sequence
  Description of Artificial Sequence: Synthetic oligonucleotide
  Target: SCN9A; (+) strand; PAM type: YTN; PAM sequence: CTT
tcattattgaaattctgttt

SEQ ID NO: 101419 - DNA, 20 bp, Artificial Sequence
  Description of Artificial Sequence: Synthetic oligonucleotide
  Target: SCN9A; (+) strand; PAM type: YTN; PAM sequence: TTT
cattattgaaattctgtttt

SEQ ID NO: 101420 - DNA, 20 bp, Artificial Sequence
  Description of Artificial Sequence: Synthetic oligonucleotide
  Target: SCN9A; (+) strand; PAM type: YTN; PAM sequence: TTC
attattgaaattctgttttt

SEQ ID NO: 101421 - DNA, 20 bp, Artificial Sequence
  Description of Artificial Sequence: Synthetic oligonucleotide
  Target: SCN9A; (+) strand; PAM type: YTN; PAM sequence: TTA
ttgaaattctgttttttgat

SEQ ID NO: 101422 - DNA, 20 bp, Artificial Sequence
  Description of Artificial Sequence: Synthetic oligonucleotide
  Target: SCN9A; (+) strand; PAM type: YTN; PAM sequence: TTG
aaattctgttttttgatttg

SEQ ID NO: 101423 - DNA, 20 bp, Artificial Sequence
  Description of Artificial Sequence: Synthetic oligonucleotide
  Target: SCN9A; (+) strand; PAM type: YTN; PAM sequence: TTC
tgttttttgatttgcaaata

SEQ ID NO: 101424 - DNA, 20 bp, Artificial Sequence
  Description of Artificial Sequence: Synthetic oligonucleotide
  Target: SCN9A; (+) strand; PAM type: YTN; PAM sequence: CTG
ttttttgatttgcaaataat

SEQ ID NO: 101425 - DNA, 20 bp, Artificial Sequence
  Description of Artificial Sequence: Synthetic oligonucleotide
  Target: SCN9A; (+) strand; PAM type: YTN; PAM sequence: TTT
tttgatttgcaaataattgc

SEQ ID NO: 101426 - DNA, 20 bp, Artificial Sequence
  Description of Artificial Sequence: Synthetic oligonucleotide
  Target: SCN9A; (+) strand; PAM type: YTN; PAM sequence: TTT
ttgatttgcaaataattgct

SEQ ID NO: 101427 - DNA, 20 bp, Artificial Sequence
  Description of Artificial Sequence: Synthetic oligonucleotide
  Target: SCN9A; (+) strand; PAM type: YTN; PAM sequence: TTT
tgatttgcaaataattgctt

SEQ ID NO: 101428 - DNA, 20 bp, Artificial Sequence
  Description of Artificial Sequence: Synthetic oligonucleotide
  Target: SCN9A; (+) strand; PAM type: YTN; PAM sequence: TTT
gatttgcaaataattgctta

SEQ ID NO: 101429 - DNA, 20 bp, Artificial Sequence
  Description of Artificial Sequence: Synthetic oligonucleotide
  Target: SCN9A; (+) strand; PAM type: YTN; PAM sequence: TTG
atttgcaaataattgcttac

SEQ ID NO: 101430 - DNA, 20 bp, Artificial Sequence
  Description of Artificial Sequence: Synthetic oligonucleotide
  Target: SCN9A; (+) strand; PAM type: YTN; PAM sequence: TTT
gcaaataattgcttacatca

SEQ ID NO: 101431 - DNA, 20 bp, Artificial Sequence
  Description of Artificial Sequence: Synthetic oligonucleotide
  Target: SCN9A; (+) strand; PAM type: YTN; PAM sequence: TTG
caaataattgcttacatcac

SEQ ID NO: 101432 - DNA, 20 bp, Artificial Sequence
  Description of Artificial Sequence: Synthetic oligonucleotide
  Target: SCN9A; (+) strand; PAM type: YTN; PAM sequence: TTG
cttacatcactgatgaatga

SEQ ID NO: 101433 - DNA, 20 bp, Artificial Sequence
  Description of Artificial Sequence: Synthetic oligonucleotide
  Target: SCN9A; (+) strand; PAM type: YTN; PAM sequence: CTT
acatcactgatgaatgagta

SEQ ID NO: 101434 - DNA, 20 bp, Artificial Sequence
  Description of Artificial Sequence: Synthetic oligonucleotide
  Target: SCN9A; (+) strand; PAM type: YTN; PAM sequence: TTA
catcactgatgaatgagtaa

SEQ ID NO: 101435 - DNA, 20 bp, Artificial Sequence
  Description of Artificial Sequence: Synthetic oligonucleotide
  Target: SCN9A; (+) strand; PAM type: YTN; PAM sequence: CTG
atgaatgagtaaagttctga

SEQ ID NO: 101436 - DNA, 20 bp, Artificial Sequence
  Description of Artificial Sequence: Synthetic oligonucleotide
  Target: SCN9A; (+) strand; PAM type: YTN; PAM sequence: TTC
tgacatatagcttcttcatt

SEQ ID NO: 101437 - DNA, 20 bp, Artificial Sequence
  Description of Artificial Sequence: Synthetic oligonucleotide
  Target: SCN9A; (+) strand; PAM type: YTN; PAM sequence: CTG
acatatagcttcttcatttc

SEQ ID NO: 101438 - DNA, 20 bp, Artificial Sequence
  Description of Artificial Sequence: Synthetic oligonucleotide
  Target: SCN9A; (+) strand; PAM type: YTN; PAM sequence: CTT
cttcatttcttttttatttc

SEQ ID NO: 101439 - DNA, 20 bp, Artificial Sequence
  Description of Artificial Sequence: Synthetic oligonucleotide
  Target: SCN9A; (+) strand; PAM type: YTN; PAM sequence: TTC
ttcatttcttttttatttca

SEQ ID NO: 101440 - DNA, 20 bp, Artificial Sequence
  Description of Artificial Sequence: Synthetic oligonucleotide
  Target: SCN9A; (+) strand; PAM type: YTN; PAM sequence: CTT
catttcttttttatttcact

SEQ ID NO: 101441 - DNA, 20 bp, Artificial Sequence
  Description of Artificial Sequence: Synthetic oligonucleotide
  Target: SCN9A; (+) strand; PAM type: YTN; PAM sequence: TTC
atttcttttttatttcactg

SEQ ID NO: 101442 - DNA, 20 bp, Artificial Sequence
  Description of Artificial Sequence: Synthetic oligonucleotide
  Target: SCN9A; (+) strand; PAM type: YTN; PAM sequence: TTT
cttttttatttcactgacta

SEQ ID NO: 101443 - DNA, 20 bp, Artificial Sequence
  Description of Artificial Sequence: Synthetic oligonucleotide
  Target: SCN9A; (+) strand; PAM type: YTN; PAM sequence: TTC
ttttttatttcactgactaa

SEQ ID NO: 101444 - DNA, 20 bp, Artificial Sequence
  Description of Artificial Sequence: Synthetic oligonucleotide
  Target: SCN9A; (+) strand; PAM type: YTN; PAM sequence: CTT
ttttatttcactgactaaca

SEQ ID NO: 101445 - DNA, 20 bp, Artificial Sequence
  Description of Artificial Sequence: Synthetic oligonucleotide
  Target: SCN9A; (+) strand; PAM type: YTN; PAM sequence: TTT
tttatttcactgactaacat

SEQ ID NO: 101446 - DNA, 20 bp, Artificial Sequence
  Description of Artificial Sequence: Synthetic oligonucleotide
  Target: SCN9A; (+) strand; PAM type: YTN; PAM sequence: TTT
ttatttcactgactaacata

SEQ ID NO: 101447 - DNA, 20 bp, Artificial Sequence
  Description of Artificial Sequence: Synthetic oligonucleotide
  Target: SCN9A; (+) strand; PAM type: YTN; PAM sequence: TTT
tatttcactgactaacataa

SEQ ID NO: 101448 - DNA, 20 bp, Artificial Sequence
  Description of Artificial Sequence: Synthetic oligonucleotide
  Target: SCN9A; (+) strand; PAM type: YTN; PAM sequence: TTT
atttcactgactaacataaa

SEQ ID NO: 101449 - DNA, 20 bp, Artificial Sequence
  Description of Artificial Sequence: Synthetic oligonucleotide
  Target: SCN9A; (+) strand; PAM type: YTN; PAM sequence: TTA
tttcactgactaacataaat

SEQ ID NO: 101450 - DNA, 20 bp, Artificial Sequence
  Description of Artificial Sequence: Synthetic oligonucleotide
  Target: SCN9A; (+) strand; PAM type: YTN; PAM sequence: TTT
cactgactaacataaatatc

SEQ ID NO: 101451 - DNA, 20 bp, Artificial Sequence
  Description of Artificial Sequence: Synthetic oligonucleotide
  Target: SCN9A; (+) strand; PAM type: YTN; PAM sequence: TTC
actgactaacataaatatca

SEQ ID NO: 101452 - DNA, 20 bp, Artificial Sequence
  Description of Artificial Sequence: Synthetic oligonucleotide
  Target: SCN9A; (+) strand; PAM type: YTN; PAM sequence: CTG
actaacataaatatcaagca

SEQ ID NO: 101453 - DNA, 20 bp, Artificial Sequence
  Description of Artificial Sequence: Synthetic oligonucleotide
  Target: SCN9A; (+) strand; PAM type: YTN; PAM sequence: CTA
acataaatatcaagcagtct

SEQ ID NO: 101454 - DNA, 20 bp, Artificial Sequence
  Description of Artificial Sequence: Synthetic oligonucleotide
  Target: SCN9A; (+) strand; PAM type: YTN; PAM sequence: CTT
catgctaaaactatacttgt

SEQ ID NO: 101455 - DNA, 20 bp, Artificial Sequence
  Description of Artificial Sequence: Synthetic oligonucleotide
  Target: SCN9A; (+) strand; PAM type: YTN; PAM sequence: TTC
atgctaaaactatacttgtt

SEQ ID NO: 101456 - DNA, 20 bp, Artificial Sequence
  Description of Artificial Sequence: Synthetic oligonucleotide
  Target: SCN9A; (+) strand; PAM type: YTN; PAM sequence: CTA
aaactatacttgtttattag

SEQ ID NO: 101457 - DNA, 20 bp, Artificial Sequence
  Description of Artificial Sequence: Synthetic oligonucleotide
  Target: SCN9A; (+) strand; PAM type: YTN; PAM sequence: CTA
tacttgtttattagctgcaa

SEQ ID NO: 101458 - DNA, 20 bp, Artificial Sequence
  Description of Artificial Sequence: Synthetic oligonucleotide
  Target: SCN9A; (+) strand; PAM type: YTN; PAM sequence: CTT
gtttattagctgcaaaaata

SEQ ID NO: 101459 - DNA, 20 bp, Artificial Sequence
  Description of Artificial Sequence: Synthetic oligonucleotide
  Target: SCN9A; (+) strand; PAM type: YTN; PAM sequence: TTG
tttattagctgcaaaaatag

SEQ ID NO: 101460 - DNA, 20 bp, Artificial Sequence
  Description of Artificial Sequence: Synthetic oligonucleotide
  Target: SCN9A; (+) strand; PAM type: YTN; PAM sequence: TTT
attagctgcaaaaataggtt

SEQ ID NO: 101461 - DNA, 20 bp, Artificial Sequence
  Description of Artificial Sequence: Synthetic oligonucleotide
  Target: SCN9A; (+) strand; PAM type: YTN; PAM sequence: TTA
ttagctgcaaaaataggttg

SEQ ID NO: 101462 - DNA, 20 bp, Artificial Sequence
  Description of Artificial Sequence: Synthetic oligonucleotide
  Target: SCN9A; (+) strand; PAM type: YTN; PAM sequence: TTA
gctgcaaaaataggttgcct

SEQ ID NO: 101463 - DNA, 20 bp, Artificial Sequence
  Description of Artificial Sequence: Synthetic oligonucleotide
  Target: SCN9A; (+) strand; PAM type: YTN; PAM sequence: CTG
caaaaataggttgcctatac

SEQ ID NO: 101464 - DNA, 20 bp, Artificial Sequence
  Description of Artificial Sequence: Synthetic oligonucleotide
  Target: SCN9A; (+) strand; PAM type: YTN; PAM sequence: TTG
cctatacatgcaaaagtttg

SEQ ID NO: 101465 - DNA, 20 bp, Artificial Sequence
  Description of Artificial Sequence: Synthetic oligonucleotide
  Target: SCN9A; (+) strand; PAM type: YTN; PAM sequence: CTA
tacatgcaaaagtttggcaa

SEQ ID NO: 101466 - DNA, 20 bp, Artificial Sequence
  Description of Artificial Sequence: Synthetic oligonucleotide
  Target: SCN9A; (+) strand; PAM type: YTN; PAM sequence: TTT
ggcaaagttcaaaaaaagca

SEQ ID NO: 101467 - DNA, 20 bp, Artificial Sequence
  Description of Artificial Sequence: Synthetic oligonucleotide
  Target: SCN9A; (+) strand; PAM type: YTN; PAM sequence: TTG
gcaaagttcaaaaaaagcat

SEQ ID NO: 101468 - DNA, 20 bp, Artificial Sequence
  Description of Artificial Sequence: Synthetic oligonucleotide
  Target: SCN9A; (+) strand; PAM type: YTN; PAM sequence: TTC
aaaaaaagcattctttgaga

SEQ ID NO: 101469 - DNA, 20 bp, Artificial Sequence
  Description of Artificial Sequence: Synthetic oligonucleotide
  Target: SCN9A; (+) strand; PAM type: YTN; PAM sequence: TTC
tttgagaaacaatttgatat

SEQ ID NO: 101470 - DNA, 20 bp, Artificial Sequence
  Description of Artificial Sequence: Synthetic oligonucleotide
  Target: SCN9A; (+) strand; PAM type: YTN; PAM sequence: CTT
tgagaaacaatttgatatac

SEQ ID NO: 101471 - DNA, 20 bp, Artificial Sequence
  Description of Artificial Sequence: Synthetic oligonucleotide
  Target: SCN9A; (+) strand; PAM type: YTN; PAM sequence: TTT
gagaaacaatttgatataca

SEQ ID NO: 101472 - DNA, 20 bp, Artificial Sequence
  Description of Artificial Sequence: Synthetic oligonucleotide
  Target: SCN9A; (+) strand; PAM type: YTN; PAM sequence: TTG
agaaacaatttgatatacag

SEQ ID NO: 101473 - DNA, 20 bp, Artificial Sequence
  Description of Artificial Sequence: Synthetic oligonucleotide
  Target: SCN9A; (+) strand; PAM type: YTN; PAM sequence: TTT
gatatacagaatgttcaata

SEQ ID NO: 101474 - DNA, 20 bp, Artificial Sequence
  Description of Artificial Sequence: Synthetic oligonucleotide
  Target: SCN9A; (+) strand; PAM type: YTN; PAM sequence: TTG
atatacagaatgttcaataa

SEQ ID NO: 101475 - DNA, 20 bp, Artificial Sequence
  Description of Artificial Sequence: Synthetic oligonucleotide
  Target: SCN9A; (+) strand; PAM type: YTN; PAM sequence: TTC
aataaaaagttgtaatattt

SEQ ID NO: 101476 - DNA, 20 bp, Artificial Sequence
  Description of Artificial Sequence: Synthetic oligonucleotide
  Target: SCN9A; (+) strand; PAM type: YTN; PAM sequence: TTG
taatattttattatttgtaa

SEQ ID NO: 101477 - DNA, 20 bp, Artificial Sequence
  Description of Artificial Sequence: Synthetic oligonucleotide
  Target: SCN9A; (+) strand; PAM type: YTN; PAM sequence: TTT
tattatttgtaaattgtgtg

SEQ ID NO: 101478 - DNA, 20 bp, Artificial Sequence
  Description of Artificial Sequence: Synthetic oligonucleotide
  Target: SCN9A; (+) strand; PAM type: YTN; PAM sequence: TTT
attatttgtaaattgtgtgt

SEQ ID NO: 101479 - DNA, 20 bp, Artificial Sequence
  Description of Artificial Sequence: Synthetic oligonucleotide
  Target: SCN9A; (+) strand; PAM type: YTN; PAM sequence: TTA
ttatttgtaaattgtgtgtc

SEQ ID NO: 101480 - DNA, 20 bp, Artificial Sequence
  Description of Artificial Sequence: Synthetic oligonucleotide
  Target: SCN9A; (+) strand; PAM type: YTN; PAM sequence: TTA
tttgtaaattgtgtgtcata

SEQ ID NO: 101481 - DNA, 20 bp, Artificial Sequence
  Description of Artificial Sequence: Synthetic oligonucleotide
  Target: SCN9A; (+) strand; PAM type: YTN; PAM sequence: TTT
gtaaattgtgtgtcatatat

SEQ ID NO: 101482 - DNA, 20 bp, Artificial Sequence
  Description of Artificial Sequence: Synthetic oligonucleotide
  Target: SCN9A; (+) strand; PAM type: YTN; PAM sequence: TTG
taaattgtgtgtcatatatc

SEQ ID NO: 101483 - DNA, 20 bp, Artificial Sequence
  Description of Artificial Sequence: Synthetic oligonucleotide
  Target: SCN9A; (+) strand; PAM type: YTN; PAM sequence: TTG
tgtgtcatatatcctaatat

SEQ ID NO: 101484 - DNA, 20 bp, Artificial Sequence
  Description of Artificial Sequence: Synthetic oligonucleotide
  Target: SCN9A; (+) strand; PAM type: YTN; PAM sequence: CTA
atatcagtaaaatttatagt

SEQ ID NO: 101485 - DNA, 20 bp, Artificial Sequence
  Description of Artificial Sequence: Synthetic oligonucleotide
  Target: SCN9A; (+) strand; PAM type: YTN; PAM sequence: TTT
atagtaaatgatataagtac

SEQ ID NO: 101486 - DNA, 20 bp, Artificial Sequence
  Description of Artificial Sequence: Synthetic oligonucleotide
  Target: SCN9A; (+) strand; PAM type: YTN; PAM sequence: TTA
tagtaaatgatataagtaca

SEQ ID NO: 101487 - DNA, 20 bp, Artificial Sequence
  Description of Artificial Sequence: Synthetic oligonucleotide
  Target: SCN9A; (+) strand; PAM type: YTN; PAM sequence: TTT
tttattttccttggagaacc

SEQ ID NO: 101488 - DNA, 20 bp, Artificial Sequence
  Description of Artificial Sequence: Synthetic oligonucleotide
  Target: SCN9A; (+) strand; PAM type: YTN; PAM sequence: TTT
ttattttccttggagaacca

SEQ ID NO: 101489 - DNA, 20 bp, Artificial Sequence
  Description of Artificial Sequence: Synthetic oligonucleotide
  Target: SCN9A; (+) strand; PAM type: YTN; PAM sequence: TTT
tattttccttggagaaccag

SEQ ID NO: 101490 - DNA, 20 bp, Artificial Sequence
  Description of Artificial Sequence: Synthetic oligonucleotide
  Target: SCN9A; (+) strand; PAM type: YTN; PAM sequence: TTT
attttccttggagaaccagt

SEQ ID NO: 101491 - DNA, 20 bp, Artificial Sequence
  Description of Artificial Sequence: Synthetic oligonucleotide
  Target: SCN9A; (+) strand; PAM type: YTN; PAM sequence: TTA
ttttccttggagaaccagtt

SEQ ID NO: 101492 - DNA, 20 bp, Artificial Sequence
  Description of Artificial Sequence: Synthetic oligonucleotide
  Target: SCN9A; (+) strand; PAM type: YTN; PAM sequence: TTT
tccttggagaaccagtttat

SEQ ID NO: 101493 - DNA, 20 bp, Artificial Sequence
  Description of Artificial Sequence: Synthetic oligonucleotide
  Target: SCN9A; (+) strand; PAM type: YTN; PAM sequence: TTT
ccttggagaaccagtttata

SEQ ID NO: 101494 - DNA, 20 bp, Artificial Sequence
  Description of Artificial Sequence: Synthetic oligonucleotide
  Target: SCN9A; (+) strand; PAM type: YTN; PAM sequence: TTC
cttggagaaccagtttataa

SEQ ID NO: 101495 - DNA, 20 bp, Artificial Sequence
  Description of Artificial Sequence: Synthetic oligonucleotide
  Target: SCN9A; (+) strand; PAM type: YTN; PAM sequence: CTT
ggagaaccagtttataaaaa

SEQ ID NO: 101496 - DNA, 20 bp, Artificial Sequence
  Description of Artificial Sequence: Synthetic oligonucleotide
  Target: SCN9A; (+) strand; PAM type: YTN; PAM sequence: TTG
gagaaccagtttataaaaat

SEQ ID NO: 101497 - DNA, 20 bp, Artificial Sequence
  Description of Artificial Sequence: Synthetic oligonucleotide
  Target: SCN9A; (+) strand; PAM type: YTN; PAM sequence: TTT
ataaaaatatttacctacac

SEQ ID NO: 101498 - DNA, 20 bp, Artificial Sequence
  Description of Artificial Sequence: Synthetic oligonucleotide
  Target: SCN9A; (+) strand; PAM type: YTN; PAM sequence: TTA
taaaaatatttacctacaca

SEQ ID NO: 101499 - DNA, 20 bp, Artificial Sequence
  Description of Artificial Sequence: Synthetic oligonucleotide
  Target: SCN9A; (+) strand; PAM type: YTN; PAM sequence: TTT
acctacacatcactaggaca

SEQ ID NO: 101500 - DNA, 20 bp, Artificial Sequence
  Description of Artificial Sequence: Synthetic oligonucleotide
  Target: SCN9A; (+) strand; PAM type: YTN; PAM sequence: TTA
cctacacatcactaggacag

SEQ ID NO: 101501 - DNA, 20 bp, Artificial Sequence
  Description of Artificial Sequence: Synthetic oligonucleotide
  Target: SCN9A; (+) strand; PAM type: YTN; PAM sequence: CTA
cacatcactaggacaggtag

SEQ ID NO: 101502 - DNA, 20 bp, Artificial Sequence
  Description of Artificial Sequence: Synthetic oligonucleotide
  Target: SCN9A; (+) strand; PAM type: YTN; PAM sequence: CTA
ggacaggtagaggagaaaac

SEQ ID NO: 101503 - DNA, 20 bp, Artificial Sequence
  Description of Artificial Sequence: Synthetic oligonucleotide
  Target: SCN9A; (+) strand; PAM type: YTN; PAM sequence: CTT
tgaagtagatgaaatgagag

SEQ ID NO: 101504 - DNA, 20 bp, Artificial Sequence
  Description of Artificial Sequence: Synthetic oligonucleotide
  Target: SCN9A; (+) strand; PAM type: YTN; PAM sequence: TTT
gaagtagatgaaatgagaga

SEQ ID NO: 101505 - DNA, 20 bp, Artificial Sequence
  Description of Artificial Sequence: Synthetic oligonucleotide
  Target: SCN9A; (+) strand; PAM type: YTN; PAM sequence: TTG
aagtagatgaaatgagagat

SEQ ID NO: 101506 - DNA, 20 bp, Artificial Sequence
  Description of Artificial Sequence: Synthetic oligonucleotide
  Target: SCN9A; (+) strand; PAM type: YTN; PAM sequence: TTT
tataagaagtgataaacaga

SEQ ID NO: 101507 - DNA, 20 bp, Artificial Sequence
  Description of Artificial Sequence: Synthetic oligonucleotide
  Target: SCN9A; (+) strand; PAM type: YTN; PAM sequence: TTT
ataagaagtgataaacagag

SEQ ID NO: 101508 - DNA, 20 bp, Artificial Sequence
  Description of Artificial Sequence: Synthetic oligonucleotide
  Target: SCN9A; (+) strand; PAM type: YTN; PAM sequence: TTA
taagaagtgataaacagagc

SEQ ID NO: 101509 - DNA, 20 bp, Artificial Sequence
  Description of Artificial Sequence: Synthetic oligonucleotide
  Target: SCN9A; (+) strand; PAM type: YTN; PAM sequence: CTA
tgaacataagaggcccagaa

SEQ ID NO: 101510 - DNA, 20 bp, Artificial Sequence
  Description of Artificial Sequence: Synthetic oligonucleotide
  Target: SCN9A; (+) strand; PAM type: YTN; PAM sequence: TTG
aaacattgaaaaattttaat

SEQ ID NO: 101511 - DNA, 20 bp, Artificial Sequence
  Description of Artificial Sequence: Synthetic oligonucleotide
  Target: SCN9A; (+) strand; PAM type: YTN; PAM sequence: TTG
aaaaattttaatcaatttaa

SEQ ID NO: 101512 - DNA, 20 bp, Artificial Sequence
  Description of Artificial Sequence: Synthetic oligonucleotide
  Target: SCN9A; (+) strand; PAM type: YTN; PAM sequence: TTT
taatcaatttaaagtttatt

SEQ ID NO: 101513 - DNA, 20 bp, Artificial Sequence
  Description of Artificial Sequence: Synthetic oligonucleotide
  Target: SCN9A; (+) strand; PAM type: YTN; PAM sequence: TTT
aatcaatttaaagtttatta

SEQ ID NO: 101514 - DNA, 20 bp, Artificial Sequence
  Description of Artificial Sequence: Synthetic oligonucleotide
  Target: SCN9A; (+) strand; PAM type: YTN; PAM sequence: TTA
atcaatttaaagtttattaa

SEQ ID NO: 101515 - DNA, 20 bp, Artificial Sequence
  Description of Artificial Sequence: Synthetic oligonucleotide
  Target: SCN9A; (+) strand; PAM type: YTN; PAM sequence: TTT
aaagtttattaaagcaacta

SEQ ID NO: 101516 - DNA, 20 bp, Artificial Sequence
  Description of Artificial Sequence: Synthetic oligonucleotide
  Target: SCN9A; (+) strand; PAM type: YTN; PAM sequence: TTA
aagtttattaaagcaactag

SEQ ID NO: 101517 - DNA, 20 bp, Artificial Sequence
  Description of Artificial Sequence: Synthetic oligonucleotide
  Target: SCN9A; (+) strand; PAM type: YTN; PAM sequence: TTT
attaaagcaactagaattac

SEQ ID NO: 101518 - DNA, 20 bp, Artificial Sequence
  Description of Artificial Sequence: Synthetic oligonucleotide
  Target: SCN9A; (+) strand; PAM type: YTN; PAM sequence: TTA
ttaaagcaactagaattact

SEQ ID NO: 101519 - DNA, 20 bp, Artificial Sequence
  Description of Artificial Sequence: Synthetic oligonucleotide
  Target: SCN9A; (+) strand; PAM type: YTN; PAM sequence: TTA
aagcaactagaattactctg

SEQ ID NO: 101520 - DNA, 20 bp, Artificial Sequence
  Description of Artificial Sequence: Synthetic oligonucleotide
  Target: SCN9A; (+) strand; PAM type: YTN; PAM sequence: CTA
gaattactctgaagaaaaga

SEQ ID NO: 101521 - DNA, 20 bp, Artificial Sequence
  Description of Artificial Sequence: Synthetic oligonucleotide
  Target: SCN9A; (+) strand; PAM type: YTN; PAM sequence: TTA
ctctgaagaaaagagagact

SEQ ID NO: 101522 - DNA, 20 bp, Artificial Sequence
  Description of Artificial Sequence: Synthetic oligonucleotide
  Target: SCN9A; (+) strand; PAM type: YTN; PAM sequence: CTC
tgaagaaaagagagactctt

SEQ ID NO: 101523 - DNA, 20 bp, Artificial Sequence
  Description of Artificial Sequence: Synthetic oligonucleotide
  Target: SCN9A; (+) strand; PAM type: YTN; PAM sequence: CTG
aagaaaagagagactcttta

SEQ ID NO: 101524 - DNA, 20 bp, Artificial Sequence
  Description of Artificial Sequence: Synthetic oligonucleotide
  Target: SCN9A; (+) strand; PAM type: YTN; PAM sequence: CTC
tttaaaaagtaactacagtg

SEQ ID NO: 101525 - DNA, 20 bp, Artificial Sequence
  Description of Artificial Sequence: Synthetic oligonucleotide
  Target: SCN9A; (+) strand; PAM type: YTN; PAM sequence: CTT
taaaaagtaactacagtgaa

SEQ ID NO: 101526 - DNA, 20 bp, Artificial Sequence
  Description of Artificial Sequence: Synthetic oligonucleotide
  Target: SCN9A; (+) strand; PAM type: YTN; PAM sequence: TTT
aaaaagtaactacagtgaat

SEQ ID NO: 101527 - DNA, 20 bp, Artificial Sequence
  Description of Artificial Sequence: Synthetic oligonucleotide
  Target: SCN9A; (+) strand; PAM type: YTN; PAM sequence: TTA
aaaagtaactacagtgaatt

SEQ ID NO: 101528 - DNA, 20 bp, Artificial Sequence
  Description of Artificial Sequence: Synthetic oligonucleotide
  Target: SCN9A; (+) strand; PAM type: YTN; PAM sequence: CTA
cagtgaattcttcctcataa

SEQ ID NO: 101529 - DNA, 20 bp, Artificial Sequence
  Description of Artificial Sequence: Synthetic oligonucleotide
  Target: SCN9A; (+) strand; PAM type: YTN; PAM sequence: TTC
ttcctcataaaattttagat

SEQ ID NO: 101530 - DNA, 20 bp, Artificial Sequence
  Description of Artificial Sequence: Synthetic oligonucleotide
  Target: SCN9A; (+) strand; PAM type: YTN; PAM sequence: CTT
cctcataaaattttagatga

SEQ ID NO: 101531 - DNA, 20 bp, Artificial Sequence
  Description of Artificial Sequence: Synthetic oligonucleotide
  Target: SCN9A; (+) strand; PAM type: YTN; PAM sequence: TTC
ctcataaaattttagatgaa

SEQ ID NO: 101532 - DNA, 20 bp, Artificial Sequence
  Description of Artificial Sequence: Synthetic oligonucleotide
  Target: SCN9A; (+) strand; PAM type: YTN; PAM sequence: CTC
ataaaattttagatgaaaaa

SEQ ID NO: 101533 - DNA, 20 bp, Artificial Sequence
  Description of Artificial Sequence: Synthetic oligonucleotide
  Target: SCN9A; (+) strand; PAM type: YTN; PAM sequence: TTT
tagatgaaaaacctcatttt

SEQ ID NO: 101534 - DNA, 20 bp, Artificial Sequence
  Description of Artificial Sequence: Synthetic oligonucleotide
  Target: SCN9A; (+) strand; PAM type: YTN; PAM sequence: TTT
agatgaaaaacctcatttta

SEQ ID NO: 101535 - DNA, 20 bp, Artificial Sequence
  Description of Artificial Sequence: Synthetic oligonucleotide
  Target: SCN9A; (+) strand; PAM type: YTN; PAM sequence: TTA
gatgaaaaacctcattttag

SEQ ID NO: 101536 - DNA, 20 bp, Artificial Sequence
  Description of Artificial Sequence: Synthetic oligonucleotide
  Target: SCN9A; (+) strand; PAM type: YTN; PAM sequence: CTC
attttagatgaaggcaggag

SEQ ID NO: 101537 - DNA, 20 bp, Artificial Sequence
  Description of Artificial Sequence: Synthetic oligonucleotide
  Target: SCN9A; (+) strand; PAM type: YTN; PAM sequence: TTT
tagatgaaggcaggaggtgg

SEQ ID NO: 101538 - DNA, 20 bp, Artificial Sequence
  Description of Artificial Sequence: Synthetic oligonucleotide
  Target: SCN9A; (+) strand; PAM type: YTN; PAM sequence: TTT
agatgaaggcaggaggtggg

SEQ ID NO: 101539 - DNA, 20 bp, Artificial Sequence
  Description of Artificial Sequence: Synthetic oligonucleotide
  Target: SCN9A; (+) strand; PAM type: YTN; PAM sequence: TTA
gatgaaggcaggaggtggga

SEQ ID NO: 101540 - DNA, 20 bp, Artificial Sequence
  Description of Artificial Sequence: Synthetic oligonucleotide
  Target: SCN9A; (+) strand; PAM type: YTN; PAM sequence: CTT
ttttgatacctgtttcagaa

SEQ ID NO: 101541 - DNA, 20 bp, Artificial Sequence
  Description of Artificial Sequence: Synthetic oligonucleotide
  Target: SCN9A; (+) strand; PAM type: YTN; PAM sequence: TTT
tttgatacctgtttcagaag

SEQ ID NO: 101542 - DNA, 20 bp, Artificial Sequence
  Description of Artificial Sequence: Synthetic oligonucleotide
  Target: SCN9A; (+) strand; PAM type: YTN; PAM sequence: TTT
ttgatacctgtttcagaagt

SEQ ID NO: 101543 - DNA, 20 bp, Artificial Sequence
  Description of Artificial Sequence: Synthetic oligonucleotide
  Target: SCN9A; (+) strand; PAM type: YTN; PAM sequence: TTT
tgatacctgtttcagaagtt

SEQ ID NO: 101544 - DNA, 20 bp, Artificial Sequence
  Description of Artificial Sequence: Synthetic oligonucleotide
  Target: SCN9A; (+) strand; PAM type: YTN; PAM sequence: TTT
gatacctgtttcagaagttt

SEQ ID NO: 101545 - DNA, 20 bp, Artificial Sequence
  Description of Artificial Sequence: Synthetic oligonucleotide
  Target: SCN9A; (+) strand; PAM type: YTN; PAM sequence: TTG
atacctgtttcagaagtttg

SEQ ID NO: 101546 - DNA, 20 bp, Artificial Sequence
  Description of Artificial Sequence: Synthetic oligonucleotide
  Target: SCN9A; (+) strand; PAM type: YTN; PAM sequence: CTG
tttcagaagtttgaatttta

SEQ ID NO: 101547 - DNA, 20 bp, Artificial Sequence
  Description of Artificial Sequence: Synthetic oligonucleotide
  Target: SCN9A; (+) strand; PAM type: YTN; PAM sequence: TTT
cagaagtttgaattttagat

SEQ ID NO: 101548 - DNA, 20 bp, Artificial Sequence
  Description of Artificial Sequence: Synthetic oligonucleotide
  Target: SCN9A; (+) strand; PAM type: YTN; PAM sequence: TTC
agaagtttgaattttagata

SEQ ID NO: 101549 - DNA, 20 bp, Artificial Sequence
  Description of Artificial Sequence: Synthetic oligonucleotide
  Target: SCN9A; (+) strand; PAM type: YTN; PAM sequence: TTT
gaattttagatatttctaaa

SEQ ID NO: 101550 - DNA, 20 bp, Artificial Sequence
  Description of Artificial Sequence: Synthetic oligonucleotide
  Target: SCN9A; (+) strand; PAM type: YTN; PAM sequence: TTG
aattttagatatttctaaaa

SEQ ID NO: 101551 - DNA, 20 bp, Artificial Sequence
  Description of Artificial Sequence: Synthetic oligonucleotide
  Target: SCN9A; (+) strand; PAM type: YTN; PAM sequence: TTT
tagatatttctaaaagattg

SEQ ID NO: 101552 - DNA, 20 bp, Artificial Sequence
  Description of Artificial Sequence: Synthetic oligonucleotide
  Target: SCN9A; (+) strand; PAM type: YTN; PAM sequence: TTT
agatatttctaaaagattga

SEQ ID NO: 101553 - DNA, 20 bp, Artificial Sequence
  Description of Artificial Sequence: Synthetic oligonucleotide
  Target: SCN9A; (+) strand; PAM type: YTN; PAM sequence: TTA
gatatttctaaaagattgat

SEQ ID NO: 101554 - DNA, 20 bp, Artificial Sequence
  Description of Artificial Sequence: Synthetic oligonucleotide
  Target: SCN9A; (+) strand; PAM type: YTN; PAM sequence: TTT
ctaaaagattgatctccttt

SEQ ID NO: 101555 - DNA, 20 bp, Artificial Sequence
  Description of Artificial Sequence: Synthetic oligonucleotide
  Target: SCN9A; (+) strand; PAM type: YTN; PAM sequence: TTC
taaaagattgatctcctttt

SEQ ID NO: 101556 - DNA, 20 bp, Artificial Sequence
  Description of Artificial Sequence: Synthetic oligonucleotide
  Target: SCN9A; (+) strand; PAM type: YTN; PAM sequence: CTA
aaagattgatctccttttct

SEQ ID NO: 101557 - DNA, 20 bp, Artificial Sequence
  Description of Artificial Sequence: Synthetic oligonucleotide
  Target: SCN9A; (+) strand; PAM type: YTN; PAM sequence: TTG
atctccttttctgtaaaaca

SEQ ID NO: 101558 - DNA, 20 bp, Artificial Sequence
  Description of Artificial Sequence: Synthetic oligonucleotide
  Target: SCN9A; (+) strand; PAM type: YTN; PAM sequence: CTC
cttttctgtaaaacaatata

SEQ ID NO: 101559 - DNA, 20 bp, Artificial Sequence
  Description of Artificial Sequence: Synthetic oligonucleotide
  Target: SCN9A; (+) strand; PAM type: YTN; PAM sequence: CTT
ttctgtaaaacaatataatt

SEQ ID NO: 101560 - DNA, 20 bp, Artificial Sequence
  Description of Artificial Sequence: Synthetic oligonucleotide
  Target: SCN9A; (+) strand; PAM type: YTN; PAM sequence: TTT
tctgtaaaacaatataattc

SEQ ID NO: 101561 - DNA, 20 bp, Artificial Sequence
  Description of Artificial Sequence: Synthetic oligonucleotide
  Target: SCN9A; (+) strand; PAM type: YTN; PAM sequence: TTT
ctgtaaaacaatataattca

SEQ ID NO: 101562 - DNA, 20 bp, Artificial Sequence
  Description of Artificial Sequence: Synthetic oligonucleotide
  Target: SCN9A; (+) strand; PAM type: YTN; PAM sequence: TTC
tgtaaaacaatataattcat

SEQ ID NO: 101563 - DNA, 20 bp, Artificial Sequence
  Description of Artificial Sequence: Synthetic oligonucleotide
  Target: SCN9A; (+) strand; PAM type: YTN; PAM sequence: CTG
taaaacaatataattcatta

SEQ ID NO: 101564 - DNA, 20 bp, Artificial Sequence
  Description of Artificial Sequence: Synthetic oligonucleotide
  Target: SCN9A; (+) strand; PAM type: YTN; PAM sequence: TTC
attaacaagtattgagtttt

SEQ ID NO: 101565 - DNA, 20 bp, Artificial Sequence
  Description of Artificial Sequence: Synthetic oligonucleotide
  Target: SCN9A; (+) strand; PAM type: YTN; PAM sequence: TTA
acaagtattgagttttcaag

SEQ ID NO: 101566 - DNA, 20 bp, Artificial Sequence
  Description of Artificial Sequence: Synthetic oligonucleotide
  Target: SCN9A; (+) strand; PAM type: YTN; PAM sequence: TTG
agttttcaagtaacaacttc

SEQ ID NO: 101567 - DNA, 20 bp, Artificial Sequence
  Description of Artificial Sequence: Synthetic oligonucleotide
  Target: SCN9A; (+) strand; PAM type: YTN; PAM sequence: TTT
tcaagtaacaacttcagata

SEQ ID NO: 101568 - DNA, 20 bp, Artificial Sequence
  Description of Artificial Sequence: Synthetic oligonucleotide
  Target: SCN9A; (+) strand; PAM type: YTN; PAM sequence: TTT
caagtaacaacttcagataa

SEQ ID NO: 101569 - DNA, 20 bp, Artificial Sequence
  Description of Artificial Sequence: Synthetic oligonucleotide
  Target: SCN9A; (+) strand; PAM type: YTN; PAM sequence: TTC
aagtaacaacttcagataat

SEQ ID NO: 101570 - DNA, 20 bp, Artificial Sequence
  Description of Artificial Sequence: Synthetic oligonucleotide
  Target: SCN9A; (+) strand; PAM type: YTN; PAM sequence: CTT
cagataatcataagttgtat

SEQ ID NO: 101571 - DNA, 20 bp, Artificial Sequence
  Description of Artificial Sequence: Synthetic oligonucleotide
  Target: SCN9A; (+) strand; PAM type: YTN; PAM sequence: TTC
agataatcataagttgtatg

SEQ ID NO: 101572 - DNA, 20 bp, Artificial Sequence
  Description of Artificial Sequence: Synthetic oligonucleotide
  Target: SCN9A; (+) strand; PAM type: YTN; PAM sequence: TTG
tatgttctaaaacaacaaaa

SEQ ID NO: 101573 - DNA, 20 bp, Artificial Sequence
  Description of Artificial Sequence: Synthetic oligonucleotide
  Target: SCN9A; (+) strand; PAM type: YTN; PAM sequence: TTC
taaaacaacaaaactagaat

SEQ ID NO: 101574 - DNA, 20 bp, Artificial Sequence
  Description of Artificial Sequence: Synthetic oligonucleotide
  Target: SCN9A; (+) strand; PAM type: YTN; PAM sequence: CTA
aaacaacaaaactagaatcc

SEQ ID NO: 101575 - DNA, 20 bp, Artificial Sequence
  Description of Artificial Sequence: Synthetic oligonucleotide
  Target: SCN9A; (+) strand; PAM type: YTN; PAM sequence: CTA
gaatcctcttgacaagatgc

SEQ ID NO: 101576 - DNA, 20 bp, Artificial Sequence
  Description of Artificial Sequence: Synthetic oligonucleotide
  Target: SCN9A; (+) strand; PAM type: YTN; PAM sequence: CTC
ttgacaagatgcacctggta

SEQ ID NO: 101577 - DNA, 20 bp, Artificial Sequence
  Description of Artificial Sequence: Synthetic oligonucleotide
  Target: SCN9A; (+) strand; PAM type: YTN; PAM sequence: CTT
gacaagatgcacctggtaga

SEQ ID NO: 101578 - DNA, 20 bp, Artificial Sequence
  Description of Artificial Sequence: Synthetic oligonucleotide
  Target: SCN9A; (+) strand; PAM type: YTN; PAM sequence: TTG
acaagatgcacctggtagaa

SEQ ID NO: 101579 - DNA, 20 bp, Artificial Sequence
  Description of Artificial Sequence: Synthetic oligonucleotide
  Target: SCN9A; (+) strand; PAM type: YTN; PAM sequence: CTG
gtagaaaatgttttgtaatg

SEQ ID NO: 101580 - DNA, 20 bp, Artificial Sequence
  Description of Artificial Sequence: Synthetic oligonucleotide
  Target: SCN9A; (+) strand; PAM type: YTN; PAM sequence: TTT
tgtaatgaatcttttcatgt

SEQ ID NO: 101581 - DNA, 20 bp, Artificial Sequence
  Description of Artificial Sequence: Synthetic oligonucleotide
  Target: SCN9A; (+) strand; PAM type: YTN; PAM sequence: TTT
gtaatgaatcttttcatgtt

SEQ ID NO: 101582 - DNA, 20 bp, Artificial Sequence
  Description of Artificial Sequence: Synthetic oligonucleotide
  Target: SCN9A; (+) strand; PAM type: YTN; PAM sequence: TTG
taatgaatcttttcatgttt

SEQ ID NO: 101583 - DNA, 20 bp, Artificial Sequence
  Description of Artificial Sequence: Synthetic oligonucleotide
  Target: SCN9A; (+) strand; PAM type: YTN; PAM sequence: CTT
ttcatgtttctgaagtctaa

SEQ ID NO: 101584 - DNA, 20 bp, Artificial Sequence
  Description of Artificial Sequence: Synthetic oligonucleotide
  Target: SCN9A; (+) strand; PAM type: YTN; PAM sequence: TTT
tcatgtttctgaagtctaat

SEQ ID NO: 101585 - DNA, 20 bp, Artificial Sequence
  Description of Artificial Sequence: Synthetic oligonucleotide
  Target: SCN9A; (+) strand; PAM type: YTN; PAM sequence: TTT
catgtttctgaagtctaatt

SEQ ID NO: 101586 - DNA, 20 bp, Artificial Sequence
  Description of Artificial Sequence: Synthetic oligonucleotide
  Target: SCN9A; (+) strand; PAM type: YTN; PAM sequence: TTC
atgtttctgaagtctaatta

SEQ ID NO: 101587 - DNA, 20 bp, Artificial Sequence
  Description of Artificial Sequence: Synthetic oligonucleotide
  Target: SCN9A; (+) strand; PAM type: YTN; PAM sequence: TTT
ctgaagtctaattagtgcat

SEQ ID NO: 101588 - DNA, 20 bp, Artificial Sequence
  Description of Artificial Sequence: Synthetic oligonucleotide
  Target: SCN9A; (+) strand; PAM type: YTN; PAM sequence: TTC
tgaagtctaattagtgcatt

SEQ ID NO: 101589 - DNA, 20 bp, Artificial Sequence
  Description of Artificial Sequence: Synthetic oligonucleotide
  Target: SCN9A; (+) strand; PAM type: YTN; PAM sequence: CTG
aagtctaattagtgcattga

SEQ ID NO: 101590 - DNA, 20 bp, Artificial Sequence
  Description of Artificial Sequence: Synthetic oligonucleotide
  Target: SCN9A; (+) strand; PAM type: YTN; PAM sequence: CTA
attagtgcattgatccagtt

SEQ ID NO: 101591 - DNA, 20 bp, Artificial Sequence
  Description of Artificial Sequence: Synthetic oligonucleotide
  Target: SCN9A; (+) strand; PAM type: YTN; PAM sequence: TTA
gtgcattgatccagttgata

SEQ ID NO: 101592 - DNA, 20 bp, Artificial Sequence
  Description of Artificial Sequence: Synthetic oligonucleotide
  Target: SCN9A; (+) strand; PAM type: YTN; PAM sequence: TTG
atccagttgatataaggtta

SEQ ID NO: 101593 - DNA, 20 bp, Artificial Sequence
  Description of Artificial Sequence: Synthetic oligonucleotide
  Target: SCN9A; (+) strand; PAM type: YTN; PAM sequence: TTG
atataaggttattttctagc

SEQ ID NO: 101594 - DNA, 20 bp, Artificial Sequence
  Description of Artificial Sequence: Synthetic oligonucleotide
  Target: SCN9A; (+) strand; PAM type: YTN; PAM sequence: TTA
ttttctagcactttaatttc

SEQ ID NO: 101595 - DNA, 20 bp, Artificial Sequence
  Description of Artificial Sequence: Synthetic oligonucleotide
  Target: SCN9A; (+) strand; PAM type: YTN; PAM sequence: TTT
tctagcactttaatttccag

SEQ ID NO: 101596 - DNA, 20 bp, Artificial Sequence
  Description of Artificial Sequence: Synthetic oligonucleotide
  Target: SCN9A; (+) strand; PAM type: YTN; PAM sequence: TTT
ctagcactttaatttccagc

SEQ ID NO: 101597 - DNA, 20 bp, Artificial Sequence
  Description of Artificial Sequence: Synthetic oligonucleotide
  Target: SCN9A; (+) strand; PAM type: YTN; PAM sequence: TTC
tagcactttaatttccagct

SEQ ID NO: 101598 - DNA, 20 bp, Artificial Sequence
  Description of Artificial Sequence: Synthetic oligonucleotide
  Target: SCN9A; (+) strand; PAM type: YTN; PAM sequence: CTA
gcactttaatttccagctct

SEQ ID NO: 101599 - DNA, 20 bp, Artificial Sequence
  Description of Artificial Sequence: Synthetic oligonucleotide
  Target: SCN9A; (+) strand; PAM type: YTN; PAM sequence: CTT
taatttccagctctatagaa

SEQ ID NO: 101600 - DNA, 20 bp, Artificial Sequence
  Description of Artificial Sequence: Synthetic oligonucleotide
  Target: SCN9A; (+) strand; PAM type: YTN; PAM sequence: TTT
aatttccagctctatagaaa

SEQ ID NO: 101601 - DNA, 20 bp, Artificial Sequence
  Description of Artificial Sequence: Synthetic oligonucleotide
  Target: SCN9A; (+) strand; PAM type: YTN; PAM sequence: TTA
atttccagctctatagaaat

SEQ ID NO: 101602 - DNA, 20 bp, Artificial Sequence
  Description of Artificial Sequence: Synthetic oligonucleotide
  Target: SCN9A; (+) strand; PAM type: YTN; PAM sequence: TTT
ccagctctatagaaatacag

SEQ ID NO: 101603 - DNA, 20 bp, Artificial Sequence
  Description of Artificial Sequence: Synthetic oligonucleotide
  Target: SCN9A; (+) strand; PAM type: YTN; PAM sequence: TTC
cagctctatagaaatacagc

SEQ ID NO: 101604 - DNA, 20 bp, Artificial Sequence
  Description of Artificial Sequence: Synthetic oligonucleotide
  Target: SCN9A; (+) strand; PAM type: YTN; PAM sequence: CTC
tatagaaatacagcaaacaa

SEQ ID NO: 101605 - DNA, 20 bp, Artificial Sequence
  Description of Artificial Sequence: Synthetic oligonucleotide
  Target: SCN9A; (+) strand; PAM type: YTN; PAM sequence: CTA
tagaaatacagcaaacaagg

SEQ ID NO: 101606 - DNA, 20 bp, Artificial Sequence
  Description of Artificial Sequence: Synthetic oligonucleotide
  Target: SCN9A; (+) strand; PAM type: YTN; PAM sequence: TTT
ccctctccccctatgtctct

SEQ ID NO: 101607 - DNA, 20 bp, Artificial Sequence
  Description of Artificial Sequence: Synthetic oligonucleotide
  Target: SCN9A; (+) strand; PAM type: YTN; PAM sequence: TTC
cctctccccctatgtctctg

SEQ ID NO: 101608 - DNA, 20 bp, Artificial Sequence
  Description of Artificial Sequence: Synthetic oligonucleotide
  Target: SCN9A; (+) strand; PAM type: YTN; PAM sequence: CTC
tccccctatgtctctggtgt

SEQ ID NO: 101609 - DNA, 20 bp, Artificial Sequence
  Description of Artificial Sequence: Synthetic oligonucleotide
  Target: SCN9A; (+) strand; PAM type: YTN; PAM sequence: CTC
cccctatgtctctggtgttt

SEQ ID NO: 101610 - DNA, 20 bp, Artificial Sequence
  Description of Artificial Sequence: Synthetic oligonucleotide
  Target: SCN9A; (+) strand; PAM type: YTN; PAM sequence: CTA
tgtctctggtgtttttgtta

SEQ ID NO: 101611 - DNA, 20 bp, Artificial Sequence
  Description of Artificial Sequence: Synthetic oligonucleotide
  Target: SCN9A; (+) strand; PAM type: YTN; PAM sequence: CTC
tggtgtttttgttatcatgt

SEQ ID NO: 101612 - DNA, 20 bp, Artificial Sequence
  Description of Artificial Sequence: Synthetic oligonucleotide
  Target: SCN9A; (+) strand; PAM type: YTN; PAM sequence: CTG
gtgtttttgttatcatgtat

SEQ ID NO: 101613 - DNA, 20 bp, Artificial Sequence
  Description of Artificial Sequence: Synthetic oligonucleotide
  Target: SCN9A; (+) strand; PAM type: YTN; PAM sequence: TTT
ttgttatcatgtatatttta

SEQ ID NO: 101614 - DNA, 20 bp, Artificial Sequence
  Description of Artificial Sequence: Synthetic oligonucleotide
  Target: SCN9A; (+) strand; PAM type: YTN; PAM sequence: TTT
tgttatcatgtatattttat

SEQ ID NO: 101615 - DNA, 20 bp, Artificial Sequence
  Description of Artificial Sequence: Synthetic oligonucleotide
  Target: SCN9A; (+) strand; PAM type: YTN; PAM sequence: TTT
gttatcatgtatattttatg

SEQ ID NO: 101616 - DNA, 20 bp, Artificial Sequence
  Description of Artificial Sequence: Synthetic oligonucleotide
  Target: SCN9A; (+) strand; PAM type: YTN; PAM sequence: TTG
ttatcatgtatattttatgt

SEQ ID NO: 101617 - DNA, 20 bp, Artificial Sequence
  Description of Artificial Sequence: Synthetic oligonucleotide
  Target: SCN9A; (+) strand; PAM type: YTN; PAM sequence: TTA
tcatgtatattttatgtgtt

SEQ ID NO: 101618 - DNA, 20 bp, Artificial Sequence
  Description of Artificial Sequence: Synthetic oligonucleotide
  Target: SCN9A; (+) strand; PAM type: YTN; PAM sequence: TTT
tatgtgttcctgttttttct

SEQ ID NO: 101619 - DNA, 20 bp, Artificial Sequence
  Description of Artificial Sequence: Synthetic oligonucleotide
  Target: SCN9A; (+) strand; PAM type: YTN; PAM sequence: TTT
atgtgttcctgttttttctc

SEQ ID NO: 101620 - DNA, 20 bp, Artificial Sequence
  Description of Artificial Sequence: Synthetic oligonucleotide
  Target: SCN9A; (+) strand; PAM type: YTN; PAM sequence: TTA
tgtgttcctgttttttctct

SEQ ID NO: 101621 - DNA, 20 bp, Artificial Sequence
  Description of Artificial Sequence: Synthetic oligonucleotide
  Target: SCN9A; (+) strand; PAM type: YTN; PAM sequence: TTC
ctgttttttctctctggaag

SEQ ID NO: 101622 - DNA, 20 bp, Artificial Sequence
  Description of Artificial Sequence: Synthetic oligonucleotide
  Target: SCN9A; (+) strand; PAM type: YTN; PAM sequence: CTG
ttttttctctctggaagttt

SEQ ID NO: 101623 - DNA, 20 bp, Artificial Sequence
  Description of Artificial Sequence: Synthetic oligonucleotide
  Target: SCN9A; (+) strand; PAM type: YTN; PAM sequence: TTT
tttctctctggaagtttcta

SEQ ID NO: 101624 - DNA, 20 bp, Artificial Sequence
  Description of Artificial Sequence: Synthetic oligonucleotide
  Target: SCN9A; (+) strand; PAM type: YTN; PAM sequence: TTT
ttctctctggaagtttctaa

SEQ ID NO: 101625 - DNA, 20 bp, Artificial Sequence
  Description of Artificial Sequence: Synthetic oligonucleotide
  Target: SCN9A; (+) strand; PAM type: YTN; PAM sequence: TTT
tctctctggaagtttctaag

SEQ ID NO: 101626 - DNA, 20 bp, Artificial Sequence
  Description of Artificial Sequence: Synthetic oligonucleotide
  Target: SCN9A; (+) strand; PAM type: YTN; PAM sequence: TTT
ctctctggaagtttctaagt

SEQ ID NO: 101627 - DNA, 20 bp, Artificial Sequence
  Description of Artificial Sequence: Synthetic oligonucleotide
  Target: SCN9A; (+) strand; PAM type: YTN; PAM sequence: TTC
tctctggaagtttctaagtt

SEQ ID NO: 101628 - DNA, 20 bp, Artificial Sequence
  Description of Artificial Sequence: Synthetic oligonucleotide
  Target: SCN9A; (+) strand; PAM type: YTN; PAM sequence: CTC
tctggaagtttctaagttcc

SEQ ID NO: 101629 - DNA, 20 bp, Artificial Sequence
  Description of Artificial Sequence: Synthetic oligonucleotide
  Target: SCN9A; (+) strand; PAM type: YTN; PAM sequence: CTC
tggaagtttctaagttccca

SEQ ID NO: 101630 - DNA, 20 bp, Artificial Sequence
  Description of Artificial Sequence: Synthetic oligonucleotide
  Target: SCN9A; (+) strand; PAM type: YTN; PAM sequence: CTG
gaagtttctaagttcccaga

SEQ ID NO: 101631 - DNA, 20 bp, Artificial Sequence
  Description of Artificial Sequence: Synthetic oligonucleotide
  Target: SCN9A; (+) strand; PAM type: YTN; PAM sequence: TTT
ctaagttcccagaagactca

SEQ ID NO: 101632 - DNA, 20 bp, Artificial Sequence
  Description of Artificial Sequence: Synthetic oligonucleotide
  Target: SCN9A; (+) strand; PAM type: YTN; PAM sequence: TTC
taagttcccagaagactcaa

SEQ ID NO: 101633 - DNA, 20 bp, Artificial Sequence
  Description of Artificial Sequence: Synthetic oligonucleotide
  Target: SCN9A; (+) strand; PAM type: YTN; PAM sequence: CTA
agttcccagaagactcaaac

SEQ ID NO: 101634 - DNA, 20 bp, Artificial Sequence
  Description of Artificial Sequence: Synthetic oligonucleotide
  Target: SCN9A; (+) strand; PAM type: YTN; PAM sequence: TTC
ccagaagactcaaactgagt

SEQ ID NO: 101635 - DNA, 20 bp, Artificial Sequence
  Description of Artificial Sequence: Synthetic oligonucleotide
  Target: SCN9A; (+) strand; PAM type: YTN; PAM sequence: CTC
aaactgagtctgtaatgctt

SEQ ID NO: 101636 - DNA, 20 bp, Artificial Sequence
  Description of Artificial Sequence: Synthetic oligonucleotide
  Target: SCN9A; (+) strand; PAM type: YTN; PAM sequence: CTG
agtctgtaatgcttgctctt

SEQ ID NO: 101637 - DNA, 20 bp, Artificial Sequence
  Description of Artificial Sequence: Synthetic oligonucleotide
  Target: SCN9A; (+) strand; PAM type: YTN; PAM sequence: CTG
taatgcttgctctttgtgct

SEQ ID NO: 101638 - DNA, 20 bp, Artificial Sequence
  Description of Artificial Sequence: Synthetic oligonucleotide
  Target: SCN9A; (+) strand; PAM type: YTN; PAM sequence: CTT
gctctttgtgcttatagtac

SEQ ID NO: 101639 - DNA, 20 bp, Artificial Sequence
  Description of Artificial Sequence: Synthetic oligonucleotide
  Target: SCN9A; (+) strand; PAM type: YTN; PAM sequence: TTG
ctctttgtgcttatagtact

SEQ ID NO: 101640 - DNA, 20 bp, Artificial Sequence
  Description of Artificial Sequence: Synthetic oligonucleotide
  Target: SCN9A; (+) strand; PAM type: YTN; PAM sequence: CTC
tttgtgcttatagtactcat

SEQ ID NO: 101641 - DNA, 20 bp, Artificial Sequence
  Description of Artificial Sequence: Synthetic oligonucleotide
  Target: SCN9A; (+) strand; PAM type: YTN; PAM sequence: CTT
tgtgcttatagtactcatca

SEQ ID NO: 101642 - DNA, 20 bp, Artificial Sequence
  Description of Artificial Sequence: Synthetic oligonucleotide
  Target: SCN9A; (+) strand; PAM type: YTN; PAM sequence: TTT
gtgcttatagtactcatcat

SEQ ID NO: 101643 - DNA, 20 bp, Artificial Sequence
  Description of Artificial Sequence: Synthetic oligonucleotide
  Target: SCN9A; (+) strand; PAM type: YTN; PAM sequence: TTG
tgcttatagtactcatcata

SEQ ID NO: 101644 - DNA, 20 bp, Artificial Sequence
  Description of Artificial Sequence: Synthetic oligonucleotide
  Target: SCN9A; (+) strand; PAM type: YTN; PAM sequence: CTT
atagtactcatcatagtcct

SEQ ID NO: 101645 - DNA, 20 bp, Artificial Sequence
  Description of Artificial Sequence: Synthetic oligonucleotide
  Target: SCN9A; (+) strand; PAM type: YTN; PAM sequence: TTA
tagtactcatcatagtcctc

SEQ ID NO: 101646 - DNA, 20 bp, Artificial Sequence
  Description of Artificial Sequence: Synthetic oligonucleotide
  Target: SCN9A; (+) strand; PAM type: YTN; PAM sequence: CTC
atcatagtcctctacttggc

SEQ ID NO: 101647 - DNA, 20 bp, Artificial Sequence
  Description of Artificial Sequence: Synthetic oligonucleotide
  Target: SCN9A; (+) strand; PAM type: YTN; PAM sequence: CTC
tacttggcttaataggtcat

SEQ ID NO: 101648 - DNA, 20 bp, Artificial Sequence
  Description of Artificial Sequence: Synthetic oligonucleotide
  Target: SCN9A; (+) strand; PAM type: YTN; PAM sequence: CTA
cttggcttaataggtcattt

SEQ ID NO: 101649 - DNA, 20 bp, Artificial Sequence
  Description of Artificial Sequence: Synthetic oligonucleotide
  Target: SCN9A; (+) strand; PAM type: YTN; PAM sequence: CTT
ggcttaataggtcatttata

SEQ ID NO: 101650 - DNA, 20 bp, Artificial Sequence
  Description of Artificial Sequence: Synthetic oligonucleotide
  Target: SCN9A; (+) strand; PAM type: YTN; PAM sequence: TTG
gcttaataggtcatttatag

SEQ ID NO: 101651 - DNA, 20 bp, Artificial Sequence
  Description of Artificial Sequence: Synthetic oligonucleotide
  Target: SCN9A; (+) strand; PAM type: YTN; PAM sequence: CTT
aataggtcatttatagttga

SEQ ID NO: 101652 - DNA, 20 bp, Artificial Sequence
  Description of Artificial Sequence: Synthetic oligonucleotide
  Target: SCN9A; (+) strand; PAM type: YTN; PAM sequence: TTA
ataggtcatttatagttgat

SEQ ID NO: 101653 - DNA, 20 bp, Artificial Sequence
  Description of Artificial Sequence: Synthetic oligonucleotide
  Target: SCN9A; (+) strand; PAM type: YTN; PAM sequence: TTT
atagttgatttttaaaagac

SEQ ID NO: 101654 - DNA, 20 bp, Artificial Sequence
  Description of Artificial Sequence: Synthetic oligonucleotide
  Target: SCN9A; (+) strand; PAM type: YTN; PAM sequence: TTA
tagttgatttttaaaagact

SEQ ID NO: 101655 - DNA, 20 bp, Artificial Sequence
  Description of Artificial Sequence: Synthetic oligonucleotide
  Target: SCN9A; (+) strand; PAM type: YTN; PAM sequence: TTG
atttttaaaagacttgattc

SEQ ID NO: 101656 - DNA, 20 bp, Artificial Sequence
  Description of Artificial Sequence: Synthetic oligonucleotide
  Target: SCN9A; (+) strand; PAM type: YTN; PAM sequence: TTT
ttaaaagacttgattcccca

SEQ ID NO: 101657 - DNA, 20 bp, Artificial Sequence
  Description of Artificial Sequence: Synthetic oligonucleotide
  Target: SCN9A; (+) strand; PAM type: YTN; PAM sequence: TTT
taaaagacttgattccccaa

SEQ ID NO: 101658 - DNA, 20 bp, Artificial Sequence
  Description of Artificial Sequence: Synthetic oligonucleotide
  Target: SCN9A; (+) strand; PAM type: YTN; PAM sequence: TTT
aaaagacttgattccccaaa

SEQ ID NO: 101659 - DNA, 20 bp, Artificial Sequence
  Description of Artificial Sequence: Synthetic oligonucleotide
  Target: SCN9A; (+) strand; PAM type: YTN; PAM sequence: TTA
aaagacttgattccccaaaa

SEQ ID NO: 101660 - DNA, 20 bp, Artificial Sequence
  Description of Artificial Sequence: Synthetic oligonucleotide
  Target: SCN9A; (+) strand; PAM type: YTN; PAM sequence: CTT
gattccccaaaaagagttat

SEQ ID NO: 101661 - DNA, 20 bp, Artificial Sequence
  Description of Artificial Sequence: Synthetic oligonucleotide
  Target: SCN9A; (+) strand; PAM type: YTN; PAM sequence: TTG
attccccaaaaagagttata

SEQ ID NO: 101662 - DNA, 20 bp, Artificial Sequence
  Description of Artificial Sequence: Synthetic oligonucleotide
  Target: SCN9A; (+) strand; PAM type: YTN; PAM sequence: TTC
cccaaaaagagttatataat

SEQ ID NO: 101663 - DNA, 20 bp, Artificial Sequence
  Description of Artificial Sequence: Synthetic oligonucleotide
  Target: SCN9A; (+) strand; PAM type: YTN; PAM sequence: TTA
tataatcttctaagcagtta

SEQ ID NO: 101664 - DNA, 20 bp, Artificial Sequence
  Description of Artificial Sequence: Synthetic oligonucleotide
  Target: SCN9A; (+) strand; PAM type: YTN; PAM sequence: CTT
ctaagcagttagtcataatt

SEQ ID NO: 101665 - DNA, 20 bp, Artificial Sequence
  Description of Artificial Sequence: Synthetic oligonucleotide
  Target: SCN9A; (+) strand; PAM type: YTN; PAM sequence: TTC
taagcagttagtcataattt

SEQ ID NO: 101666 - DNA, 20 bp, Artificial Sequence
  Description of Artificial Sequence: Synthetic oligonucleotide
  Target: SCN9A; (+) strand; PAM type: YTN; PAM sequence: CTA
agcagttagtcataatttga

SEQ ID NO: 101667 - DNA, 20 bp, Artificial Sequence
  Description of Artificial Sequence: Synthetic oligonucleotide
  Target: SCN9A; (+) strand; PAM type: YTN; PAM sequence: TTA
gtcataatttgaaaggttac

SEQ ID NO: 101668 - DNA, 20 bp, Artificial Sequence
  Description of Artificial Sequence: Synthetic oligonucleotide
  Target: SCN9A; (+) strand; PAM type: YTN; PAM sequence: TTT
gaaaggttacatctctgtga

SEQ ID NO: 101669 - DNA, 20 bp, Artificial Sequence
  Description of Artificial Sequence: Synthetic oligonucleotide
  Target: SCN9A; (+) strand; PAM type: YTN; PAM sequence: TTG
aaaggttacatctctgtgaa

SEQ ID NO: 101670 - DNA, 20 bp, Artificial Sequence
  Description of Artificial Sequence: Synthetic oligonucleotide
  Target: SCN9A; (+) strand; PAM type: YTN; PAM sequence: TTA
catctctgtgaattctatac

SEQ ID NO: 101671 - DNA, 20 bp, Artificial Sequence
  Description of Artificial Sequence: Synthetic oligonucleotide
  Target: SCN9A; (+) strand; PAM type: YTN; PAM sequence: CTC
tgtgaattctatactttaca

SEQ ID NO: 101672 - DNA, 20 bp, Artificial Sequence
  Description of Artificial Sequence: Synthetic oligonucleotide
  Target: SCN9A; (+) strand; PAM type: YTN; PAM sequence: CTG
tgaattctatactttacata

SEQ ID NO: 101673 - DNA, 20 bp, Artificial Sequence
  Description of Artificial Sequence: Synthetic oligonucleotide
  Target: SCN9A; (+) strand; PAM type: YTN; PAM sequence: TTC
tatactttacataaacattg

SEQ ID NO: 101674 - DNA, 20 bp, Artificial Sequence
  Description of Artificial Sequence: Synthetic oligonucleotide
  Target: SCN9A; (+) strand; PAM type: YTN; PAM sequence: CTA
tactttacataaacattgga

SEQ ID NO: 101675 - DNA, 20 bp, Artificial Sequence
  Description of Artificial Sequence: Synthetic oligonucleotide
  Target: SCN9A; (+) strand; PAM type: YTN; PAM sequence: CTT
tacataaacattggatgaaa

SEQ ID NO: 101676 - DNA, 20 bp, Artificial Sequence
  Description of Artificial Sequence: Synthetic oligonucleotide
  Target: SCN9A; (+) strand; PAM type: YTN; PAM sequence: TTT
acataaacattggatgaaaa

SEQ ID NO: 101677 - DNA, 20 bp, Artificial Sequence
  Description of Artificial Sequence: Synthetic oligonucleotide
  Target: SCN9A; (+) strand; PAM type: YTN; PAM sequence: TTA
cataaacattggatgaaaaa

SEQ ID NO: 101678 - DNA, 20 bp, Artificial Sequence
  Description of Artificial Sequence: Synthetic oligonucleotide
  Target: SCN9A; (+) strand; PAM type: YTN; PAM sequence: TTG
gatgaaaaagaaaaaaaaag

SEQ ID NO: 101679 - DNA, 20 bp, Artificial Sequence
  Description of Artificial Sequence: Synthetic oligonucleotide
  Target: SCN9A; (+) strand; PAM type: YTN; PAM sequence: CTA
cacatagcttcatttataca

SEQ ID NO: 101680 - DNA, 20 bp, Artificial Sequence
  Description of Artificial Sequence: Synthetic oligonucleotide
  Target: SCN9A; (+) strand; PAM type: YTN; PAM sequence: CTT
catttatacaatgttaatta

SEQ ID NO: 101681 - DNA, 20 bp, Artificial Sequence
  Description of Artificial Sequence: Synthetic oligonucleotide
  Target: SCN9A; (+) strand; PAM type: YTN; PAM sequence: TTC
atttatacaatgttaattac

SEQ ID NO: 101682 - DNA, 20 bp, Artificial Sequence
  Description of Artificial Sequence: Synthetic oligonucleotide
  Target: SCN9A; (+) strand; PAM type: YTN; PAM sequence: TTT
atacaatgttaattacagtg

SEQ ID NO: 101683 - DNA, 20 bp, Artificial Sequence
  Description of Artificial Sequence: Synthetic oligonucleotide
  Target: SCN9A; (+) strand; PAM type: YTN; PAM sequence: TTA
tacaatgttaattacagtga

SEQ ID NO: 101684 - DNA, 20 bp, Artificial Sequence
  Description of Artificial Sequence: Synthetic oligonucleotide
  Target: SCN9A; (+) strand; PAM type: YTN; PAM sequence: TTA
attacagtgaacatgatctc

SEQ ID NO: 101685 - DNA, 20 bp, Artificial Sequence
  Description of Artificial Sequence: Synthetic oligonucleotide
  Target: SCN9A; (+) strand; PAM type: YTN; PAM sequence: TTA
cagtgaacatgatctcagat

SEQ ID NO: 101686 - DNA, 20 bp, Artificial Sequence
  Description of Artificial Sequence: Synthetic oligonucleotide
  Target: SCN9A; (+) strand; PAM type: YTN; PAM sequence: CTC
agatctgaaattatgtatca

SEQ ID NO: 101687 - DNA, 20 bp, Artificial Sequence
  Description of Artificial Sequence: Synthetic oligonucleotide
  Target: SCN9A; (+) strand; PAM type: YTN; PAM sequence: CTG
aaattatgtatcatcctata

SEQ ID NO: 101688 - DNA, 20 bp, Artificial Sequence
  Description of Artificial Sequence: Synthetic oligonucleotide
  Target: SCN9A; (+) strand; PAM type: YTN; PAM sequence: TTA
tgtatcatcctatacttaaa

SEQ ID NO: 101689 - DNA, 20 bp, Artificial Sequence
  Description of Artificial Sequence: Synthetic oligonucleotide
  Target: SCN9A; (+) strand; PAM type: YTN; PAM sequence: CTA
tacttaaataattattatct

SEQ ID NO: 101690 - DNA, 20 bp, Artificial Sequence
  Description of Artificial Sequence: Synthetic oligonucleotide
  Target: SCN9A; (+) strand; PAM type: YTN; PAM sequence: CTT
aaataattattatctacatg

SEQ ID NO: 101691 - DNA, 20 bp, Artificial Sequence
  Description of Artificial Sequence: Synthetic oligonucleotide
  Target: SCN9A; (+) strand; PAM type: YTN; PAM sequence: TTA
aataattattatctacatgc

SEQ ID NO: 101692 - DNA, 20 bp, Artificial Sequence
  Description of Artificial Sequence: Synthetic oligonucleotide
  Target: SCN9A; (+) strand; PAM type: YTN; PAM sequence: TTA
ttatctacatgcatttagtt

SEQ ID NO: 101693 - DNA, 20 bp, Artificial Sequence
  Description of Artificial Sequence: Synthetic oligonucleotide
  Target: SCN9A; (+) strand; PAM type: YTN; PAM sequence: TTA
tctacatgcatttagttaag

SEQ ID NO: 101694 - DNA, 20 bp, Artificial Sequence
  Description of Artificial Sequence: Synthetic oligonucleotide
  Target: SCN9A; (+) strand; PAM type: YTN; PAM sequence: CTA
catgcatttagttaagagag

SEQ ID NO: 101695 - DNA, 20 bp, Artificial Sequence
  Description of Artificial Sequence: Synthetic oligonucleotide
  Target: SCN9A; (+) strand; PAM type: YTN; PAM sequence: TTT
agttaagagagaacattcga

SEQ ID NO: 101696 - DNA, 20 bp, Artificial Sequence
  Description of Artificial Sequence: Synthetic oligonucleotide
  Target: SCN9A; (+) strand; PAM type: YTN; PAM sequence: TTA
gttaagagagaacattcgat

SEQ ID NO: 101697 - DNA, 20 bp, Artificial Sequence
  Description of Artificial Sequence: Synthetic oligonucleotide
  Target: SCN9A; (+) strand; PAM type: YTN; PAM sequence: TTA
agagagaacattcgataaaa

SEQ ID NO: 101698 - DNA, 20 bp, Artificial Sequence
  Description of Artificial Sequence: Synthetic oligonucleotide
  Target: SCN9A; (+) strand; PAM type: YTN; PAM sequence: TTC
gataaaatgatataaaaaca

SEQ ID NO: 101699 - DNA, 20 bp, Artificial Sequence
  Description of Artificial Sequence: Synthetic oligonucleotide
  Target: SCN9A; (+) strand; PAM type: YTN; PAM sequence: TTA
actctaagttaatctttttc

SEQ ID NO: 101700 - DNA, 20 bp, Artificial Sequence
  Description of Artificial Sequence: Synthetic oligonucleotide
  Target: SCN9A; (+) strand; PAM type: YTN; PAM sequence: CTC
taagttaatctttttcaggg

SEQ ID NO: 101701 - DNA, 20 bp, Artificial Sequence
  Description of Artificial Sequence: Synthetic oligonucleotide
  Target: SCN9A; (+) strand; PAM type: YTN; PAM sequence: CTA
agttaatctttttcagggaa

SEQ ID NO: 101702 - DNA, 20 bp, Artificial Sequence
  Description of Artificial Sequence: Synthetic oligonucleotide
  Target: SCN9A; (+) strand; PAM type: YTN; PAM sequence: TTA
atctttttcagggaaaataa

SEQ ID NO: 101703 - DNA, 20 bp, Artificial Sequence
  Description of Artificial Sequence: Synthetic oligonucleotide
  Target: SCN9A; (+) strand; PAM type: YTN; PAM sequence: CTT
tttcagggaaaataaaaata

SEQ ID NO: 101704 - DNA, 20 bp, Artificial Sequence
  Description of Artificial Sequence: Synthetic oligonucleotide
  Target: SCN9A; (+) strand; PAM type: YTN; PAM sequence: TTT
ttcagggaaaataaaaatac

SEQ ID NO: 101705 - DNA, 20 bp, Artificial Sequence
  Description of Artificial Sequence: Synthetic oligonucleotide
  Target: SCN9A; (+) strand; PAM type: YTN; PAM sequence: TTT
tcagggaaaataaaaatacc

SEQ ID NO: 101706 - DNA, 20 bp, Artificial Sequence
  Description of Artificial Sequence: Synthetic oligonucleotide
  Target: SCN9A; (+) strand; PAM type: YTN; PAM sequence: TTT
cagggaaaataaaaatacca

SEQ ID NO: 101707 - DNA, 20 bp, Artificial Sequence
  Description of Artificial Sequence: Synthetic oligonucleotide
  Target: SCN9A; (+) strand; PAM type: YTN; PAM sequence: TTC
agggaaaataaaaataccag

SEQ ID NO: 101708 - DNA, 20 bp, Artificial Sequence
  Description of Artificial Sequence: Synthetic oligonucleotide
  Target: SCN9A; (+) strand; PAM type: YTN; PAM sequence: TTT
tttaatattaacttagtgct

SEQ ID NO: 101709 - DNA, 20 bp, Artificial Sequence
  Description of Artificial Sequence: Synthetic oligonucleotide
  Target: SCN9A; (+) strand; PAM type: YTN; PAM sequence: TTT
ttaatattaacttagtgctt

SEQ ID NO: 101710 - DNA, 20 bp, Artificial Sequence
  Description of Artificial Sequence: Synthetic oligonucleotide
  Target: SCN9A; (+) strand; PAM type: YTN; PAM sequence: TTT
taatattaacttagtgcttt

SEQ ID NO: 101711 - DNA, 20 bp, Artificial Sequence
  Description of Artificial Sequence: Synthetic oligonucleotide
  Target: SCN9A; (+) strand; PAM type: YTN; PAM sequence: TTT
aatattaacttagtgcttta

SEQ ID NO: 101712 - DNA, 20 bp, Artificial Sequence
  Description of Artificial Sequence: Synthetic oligonucleotide
  Target: SCN9A; (+) strand; PAM type: YTN; PAM sequence: TTA
atattaacttagtgctttag

SEQ ID NO: 101713 - DNA, 20 bp, Artificial Sequence
  Description of Artificial Sequence: Synthetic oligonucleotide
  Target: SCN9A; (+) strand; PAM type: YTN; PAM sequence: TTA
acttagtgctttagaatttg

SEQ ID NO: 101714 - DNA, 20 bp, Artificial Sequence
  Description of Artificial Sequence: Synthetic oligonucleotide
  Target: SCN9A; (+) strand; PAM type: YTN; PAM sequence: CTT
agtgctttagaatttgtctt

SEQ ID NO: 101715 - DNA, 20 bp, Artificial Sequence
  Description of Artificial Sequence: Synthetic oligonucleotide
  Target: SCN9A; (+) strand; PAM type: YTN; PAM sequence: TTA
gtgctttagaatttgtctta

SEQ ID NO: 101716 - DNA, 20 bp, Artificial Sequence
  Description of Artificial Sequence: Synthetic oligonucleotide
  Target: SCN9A; (+) strand; PAM type: YTN; PAM sequence: CTT
tagaatttgtcttaaactta

SEQ ID NO: 101717 - DNA, 20 bp, Artificial Sequence
  Description of Artificial Sequence: Synthetic oligonucleotide
  Target: SCN9A; (+) strand; PAM type: YTN; PAM sequence: TTT
agaatttgtcttaaacttaa

SEQ ID NO: 101718 - DNA, 20 bp, Artificial Sequence
  Description of Artificial Sequence: Synthetic oligonucleotide
  Target: SCN9A; (+) strand; PAM type: YTN; PAM sequence: TTA
gaatttgtcttaaacttaaa

SEQ ID NO: 101719 - DNA, 20 bp, Artificial Sequence
  Description of Artificial Sequence: Synthetic oligonucleotide
  Target: SCN9A; (+) strand; PAM type: YTN; PAM sequence: TTT
gtcttaaacttaaaaacaat

SEQ ID NO: 101720 - DNA, 20 bp, Artificial Sequence
  Description of Artificial Sequence: Synthetic oligonucleotide
  Target: SCN9A; (+) strand; PAM type: YTN; PAM sequence: TTG
tcttaaacttaaaaacaatg

SEQ ID NO: 101721 - DNA, 20 bp, Artificial Sequence
  Description of Artificial Sequence: Synthetic oligonucleotide
  Target: SCN9A; (+) strand; PAM type: YTN; PAM sequence: CTT
aaacttaaaaacaatgatca

SEQ ID NO: 101722 - DNA, 20 bp, Artificial Sequence
  Description of Artificial Sequence: Synthetic oligonucleotide
  Target: SCN9A; (+) strand; PAM type: YTN; PAM sequence: TTA
aacttaaaaacaatgatcac

SEQ ID NO: 101723 - DNA, 20 bp, Artificial Sequence
  Description of Artificial Sequence: Synthetic oligonucleotide
  Target: SCN9A; (+) strand; PAM type: YTN; PAM sequence: CTT
aaaaacaatgatcacatata

SEQ ID NO: 101724 - DNA, 20 bp, Artificial Sequence
  Description of Artificial Sequence: Synthetic oligonucleotide
  Target: SCN9A; (+) strand; PAM type: YTN; PAM sequence: TTA
aaaacaatgatcacatataa

SEQ ID NO: 101725 - DNA, 20 bp, Artificial Sequence
  Description of Artificial Sequence: Synthetic oligonucleotide
  Target: SCN9A; (+) strand; PAM type: YTN; PAM sequence: TTT
atctttctcaggggcaaatt

SEQ ID NO: 101726 - DNA, 20 bp, Artificial Sequence
  Description of Artificial Sequence: Synthetic oligonucleotide
  Target: SCN9A; (+) strand; PAM type: YTN; PAM sequence: TTA
tctttctcaggggcaaatta

SEQ ID NO: 101727 - DNA, 20 bp, Artificial Sequence
  Description of Artificial Sequence: Synthetic oligonucleotide
  Target: SCN9A; (+) strand; PAM type: YTN; PAM sequence: CTT
tctcaggggcaaattattgg

SEQ ID NO: 101728 - DNA, 20 bp, Artificial Sequence
  Description of Artificial Sequence: Synthetic oligonucleotide
  Target: SCN9A; (+) strand; PAM type: YTN; PAM sequence: TTT
ctcaggggcaaattattgga

SEQ ID NO: 101729 - DNA, 20 bp, Artificial Sequence
  Description of Artificial Sequence: Synthetic oligonucleotide
  Target: SCN9A; (+) strand; PAM type: YTN; PAM sequence: TTC
tcaggggcaaattattggat

SEQ ID NO: 101730 - DNA, 20 bp, Artificial Sequence
  Description of Artificial Sequence: Synthetic oligonucleotide
  Target: SCN9A; (+) strand; PAM type: YTN; PAM sequence: CTC
aggggcaaattattggataa

SEQ ID NO: 101731 - DNA, 20 bp, Artificial Sequence
  Description of Artificial Sequence: Synthetic oligonucleotide
  Target: SCN9A; (+) strand; PAM type: YTN; PAM sequence: TTA
ttggataagaaaattatccc

SEQ ID NO: 101732 - DNA, 20 bp, Artificial Sequence
  Description of Artificial Sequence: Synthetic oligonucleotide
  Target: SCN9A; (+) strand; PAM type: YTN; PAM sequence: TTG
gataagaaaattatcccttt

SEQ ID NO: 101733 - DNA, 20 bp, Artificial Sequence
  Description of Artificial Sequence: Synthetic oligonucleotide
  Target: SCN9A; (+) strand; PAM type: YTN; PAM sequence: TTA
tccctttggttaagaagatt

SEQ ID NO: 101734 - DNA, 20 bp, Artificial Sequence
  Description of Artificial Sequence: Synthetic oligonucleotide
  Target: SCN9A; (+) strand; PAM type: YTN; PAM sequence: CTT
tggttaagaagattttgctc

SEQ ID NO: 101735 - DNA, 20 bp, Artificial Sequence
  Description of Artificial Sequence: Synthetic oligonucleotide
  Target: SCN9A; (+) strand; PAM type: YTN; PAM sequence: TTT
ggttaagaagattttgctct

SEQ ID NO: 101736 - DNA, 20 bp, Artificial Sequence
  Description of Artificial Sequence: Synthetic oligonucleotide
  Target: SCN9A; (+) strand; PAM type: YTN; PAM sequence: TTG
gttaagaagattttgctctc

SEQ ID NO: 101737 - DNA, 20 bp, Artificial Sequence
  Description of Artificial Sequence: Synthetic oligonucleotide
  Target: SCN9A; (+) strand; PAM type: YTN; PAM sequence: TTA
agaagattttgctctctggg

SEQ ID NO: 101738 - DNA, 20 bp, Artificial Sequence
  Description of Artificial Sequence: Synthetic oligonucleotide
  Target: SCN9A; (+) strand; PAM type: YTN; PAM sequence: TTT
tgctctctgggatttacttt

SEQ ID NO: 101739 - DNA, 20 bp, Artificial Sequence
  Description of Artificial Sequence: Synthetic oligonucleotide
  Target: SCN9A; (+) strand; PAM type: YTN; PAM sequence: TTT
gctctctgggatttactttt

SEQ ID NO: 101740 - DNA, 20 bp, Artificial Sequence
  Description of Artificial Sequence: Synthetic oligonucleotide
  Target: SCN9A; (+) strand; PAM type: YTN; PAM sequence: TTG
ctctctgggatttacttttg

SEQ ID NO: 101741 - DNA, 20 bp, Artificial Sequence
  Description of Artificial Sequence: Synthetic oligonucleotide
  Target: SCN9A; (+) strand; PAM type: YTN; PAM sequence: CTC
tctgggatttacttttgtca

SEQ ID NO: 101742 - DNA, 20 bp, Artificial Sequence
  Description of Artificial Sequence: Synthetic oligonucleotide
  Target: SCN9A; (+) strand; PAM type: YTN; PAM sequence: CTC
tgggatttacttttgtcaat

SEQ ID NO: 101743 - DNA, 20 bp, Artificial Sequence
  Description of Artificial Sequence: Synthetic oligonucleotide
  Target: SCN9A; (+) strand; PAM type: YTN; PAM sequence: CTG
ggatttacttttgtcaatct

SEQ ID NO: 101744 - DNA, 20 bp, Artificial Sequence
  Description of Artificial Sequence: Synthetic oligonucleotide
  Target: SCN9A; (+) strand; PAM type: YTN; PAM sequence: TTT
acttttgtcaatcttaaaat

SEQ ID NO: 101745 - DNA, 20 bp, Artificial Sequence
  Description of Artificial Sequence: Synthetic oligonucleotide
  Target: SCN9A; (+) strand; PAM type: YTN; PAM sequence: TTA
cttttgtcaatcttaaaatt

SEQ ID NO: 101746 - DNA, 20 bp, Artificial Sequence
  Description of Artificial Sequence: Synthetic oligonucleotide
  Target: SCN9A; (+) strand; PAM type: YTN; PAM sequence: CTT
ttgtcaatcttaaaattgaa

SEQ ID NO: 101747 - DNA, 20 bp, Artificial Sequence
  Description of Artificial Sequence: Synthetic oligonucleotide
  Target: SCN9A; (+) strand; PAM type: YTN; PAM sequence: TTT
tgtcaatcttaaaattgaag

SEQ ID NO: 101748 - DNA, 20 bp, Artificial Sequence
  Description of Artificial Sequence: Synthetic oligonucleotide
  Target: SCN9A; (+) strand; PAM type: YTN; PAM sequence: TTT
gtcaatcttaaaattgaagg

SEQ ID NO: 101749 - DNA, 20 bp, Artificial Sequence
  Description of Artificial Sequence: Synthetic oligonucleotide
  Target: SCN9A; (+) strand; PAM type: YTN; PAM sequence: TTG
tcaatcttaaaattgaaggg

SEQ ID NO: 101750 - DNA, 20 bp, Artificial Sequence
  Description of Artificial Sequence: Synthetic oligonucleotide
  Target: SCN9A; (+) strand; PAM type: YTN; PAM sequence: CTT
aaaattgaagggaaacatta

SEQ ID NO: 101751 - DNA, 20 bp, Artificial Sequence
  Description of Artificial Sequence: Synthetic oligonucleotide
  Target: SCN9A; (+) strand; PAM type: YTN; PAM sequence: TTA
aaattgaagggaaacattat

SEQ ID NO: 101752 - DNA, 20 bp, Artificial Sequence
  Description of Artificial Sequence: Synthetic oligonucleotide
  Target: SCN9A; (+) strand; PAM type: YTN; PAM sequence: TTG
aagggaaacattattcttat

SEQ ID NO: 101753 - DNA, 20 bp, Artificial Sequence
  Description of Artificial Sequence: Synthetic oligonucleotide
  Target: SCN9A; (+) strand; PAM type: YTN; PAM sequence: TTA
ttcttatgattgaggaaata

SEQ ID NO: 101754 - DNA, 20 bp, Artificial Sequence
  Description of Artificial Sequence: Synthetic oligonucleotide
  Target: SCN9A; (+) strand; PAM type: YTN; PAM sequence: TTC
ttatgattgaggaaataaaa

SEQ ID NO: 101755 - DNA, 20 bp, Artificial Sequence
  Description of Artificial Sequence: Synthetic oligonucleotide
  Target: SCN9A; (+) strand; PAM type: YTN; PAM sequence: CTT
atgattgaggaaataaaaac

SEQ ID NO: 101756 - DNA, 20 bp, Artificial Sequence
  Description of Artificial Sequence: Synthetic oligonucleotide
  Target: SCN9A; (+) strand; PAM type: YTN; PAM sequence: TTA
tgattgaggaaataaaaaca

SEQ ID NO: 101757 - DNA, 20 bp, Artificial Sequence
  Description of Artificial Sequence: Synthetic oligonucleotide
  Target: SCN9A; (+) strand; PAM type: YTN; PAM sequence: TTG
aggaaataaaaacactaaaa

SEQ ID NO: 101758 - DNA, 20 bp, Artificial Sequence
  Description of Artificial Sequence: Synthetic oligonucleotide
  Target: SCN9A; (+) strand; PAM type: YTN; PAM sequence: CTA
aaaatcctaattagaaaagt

SEQ ID NO: 101759 - DNA, 20 bp, Artificial Sequence
  Description of Artificial Sequence: Synthetic oligonucleotide
  Target: SCN9A; (+) strand; PAM type: YTN; PAM sequence: CTA
attagaaaagttagtaaact

SEQ ID NO: 101760 - DNA, 20 bp, Artificial Sequence
  Description of Artificial Sequence: Synthetic oligonucleotide
  Target: SCN9A; (+) strand; PAM type: YTN; PAM sequence: TTA
gaaaagttagtaaactttca

SEQ ID NO: 101761 - DNA, 20 bp, Artificial Sequence
  Description of Artificial Sequence: Synthetic oligonucleotide
  Target: SCN9A; (+) strand; PAM type: YTN; PAM sequence: TTA
gtaaactttcaatctgaaat

SEQ ID NO: 101762 - DNA, 20 bp, Artificial Sequence
  Description of Artificial Sequence: Synthetic oligonucleotide
  Target: SCN9A; (+) strand; PAM type: YTN; PAM sequence: CTT
tcaatctgaaatgaagtttc

SEQ ID NO: 101763 - DNA, 20 bp, Artificial Sequence
  Description of Artificial Sequence: Synthetic oligonucleotide
  Target: SCN9A; (+) strand; PAM type: YTN; PAM sequence: TTT
caatctgaaatgaagtttca

SEQ ID NO: 101764 - DNA, 20 bp, Artificial Sequence
  Description of Artificial Sequence: Synthetic oligonucleotide
  Target: SCN9A; (+) strand; PAM type: YTN; PAM sequence: TTC
aatctgaaatgaagtttcat

SEQ ID NO: 101765 - DNA, 20 bp, Artificial Sequence
  Description of Artificial Sequence: Synthetic oligonucleotide
  Target: SCN9A; (+) strand; PAM type: YTN; PAM sequence: CTG
aaatgaagtttcataaatat

SEQ ID NO: 101766 - DNA, 20 bp, Artificial Sequence
  Description of Artificial Sequence: Synthetic oligonucleotide
  Target: SCN9A; (+) strand; PAM type: YTN; PAM sequence: TTT
cataaatattgccctcaggg

SEQ ID NO: 101767 - DNA, 20 bp, Artificial Sequence
  Description of Artificial Sequence: Synthetic oligonucleotide
  Target: SCN9A; (+) strand; PAM type: YTN; PAM sequence: TTC
ataaatattgccctcagggt

SEQ ID NO: 101768 - DNA, 20 bp, Artificial Sequence
  Description of Artificial Sequence: Synthetic oligonucleotide
  Target: SCN9A; (+) strand; PAM type: YTN; PAM sequence: TTG
ccctcagggtttattacacc

SEQ ID NO: 101769 - DNA, 20 bp, Artificial Sequence
  Description of Artificial Sequence: Synthetic oligonucleotide
  Target: SCN9A; (+) strand; PAM type: YTN; PAM sequence: CTC
agggtttattacacctcaga

SEQ ID NO: 101770 - DNA, 20 bp, Artificial Sequence
  Description of Artificial Sequence: Synthetic oligonucleotide
  Target: SCN9A; (+) strand; PAM type: YTN; PAM sequence: TTT
attacacctcagagagtttc

SEQ ID NO: 101771 - DNA, 20 bp, Artificial Sequence
  Description of Artificial Sequence: Synthetic oligonucleotide
  Target: SCN9A; (+) strand; PAM type: YTN; PAM sequence: TTA
ttacacctcagagagtttct

SEQ ID NO: 101772 - DNA, 20 bp, Artificial Sequence
  Description of Artificial Sequence: Synthetic oligonucleotide
  Target: SCN9A; (+) strand; PAM type: YTN; PAM sequence: TTA
cacctcagagagtttctttc

SEQ ID NO: 101773 - DNA, 20 bp, Artificial Sequence
  Description of Artificial Sequence: Synthetic oligonucleotide
  Target: SCN9A; (+) strand; PAM type: YTN; PAM sequence: CTC
agagagtttctttctcttat

SEQ ID NO: 101774 - DNA, 20 bp, Artificial Sequence
  Description of Artificial Sequence: Synthetic oligonucleotide
  Target: SCN9A; (+) strand; PAM type: YTN; PAM sequence: TTT
ctttctcttattttgaggca

SEQ ID NO: 101775 - DNA, 20 bp, Artificial Sequence
  Description of Artificial Sequence: Synthetic oligonucleotide
  Target: SCN9A; (+) strand; PAM type: YTN; PAM sequence: TTC
tttctcttattttgaggcaa

SEQ ID NO: 101776 - DNA, 20 bp, Artificial Sequence
  Description of Artificial Sequence: Synthetic oligonucleotide
  Target: SCN9A; (+) strand; PAM type: YTN; PAM sequence: CTT
tctcttattttgaggcaaga

SEQ ID NO: 101777 - DNA, 20 bp, Artificial Sequence
  Description of Artificial Sequence: Synthetic oligonucleotide
  Target: SCN9A; (+) strand; PAM type: YTN; PAM sequence: TTT
ctcttattttgaggcaagag

SEQ ID NO: 101778 - DNA, 20 bp, Artificial Sequence
  Description of Artificial Sequence: Synthetic oligonucleotide
  Target: SCN9A; (+) strand; PAM type: YTN; PAM sequence: TTC
tcttattttgaggcaagagt

SEQ ID NO: 101779 - DNA, 20 bp, Artificial Sequence
  Description of Artificial Sequence: Synthetic oligonucleotide
  Target: SCN9A; (+) strand; PAM type: YTN; PAM sequence: CTC
ttattttgaggcaagagtga

SEQ ID NO: 101780 - DNA, 20 bp, Artificial Sequence
  Description of Artificial Sequence: Synthetic oligonucleotide
  Target: SCN9A; (+) strand; PAM type: YTN; PAM sequence: CTT
attttgaggcaagagtgatg

SEQ ID NO: 101781 - DNA, 20 bp, Artificial Sequence
  Description of Artificial Sequence: Synthetic oligonucleotide
  Target: SCN9A; (+) strand; PAM type: YTN; PAM sequence: TTA
ttttgaggcaagagtgatgg

SEQ ID NO: 101782 - DNA, 20 bp, Artificial Sequence
  Description of Artificial Sequence: Synthetic oligonucleotide
  Target: SCN9A; (+) strand; PAM type: YTN; PAM sequence: TTT
tgaggcaagagtgatggagc

SEQ ID NO: 101783 - DNA, 20 bp, Artificial Sequence
  Description of Artificial Sequence: Synthetic oligonucleotide
  Target: SCN9A; (+) strand; PAM type: YTN; PAM sequence: TTT
gaggcaagagtgatggagcg

SEQ ID NO: 101784 - DNA, 20 bp, Artificial Sequence
  Description of Artificial Sequence: Synthetic oligonucleotide
  Target: SCN9A; (+) strand; PAM type: YTN; PAM sequence: TTG
aggcaagagtgatggagcgc

SEQ ID NO: 101785 - DNA, 20 bp, Artificial Sequence
  Description of Artificial Sequence: Synthetic oligonucleotide
  Target: SCN9A; (+) strand; PAM type: YTN; PAM sequence: CTG
tctggtttttgtgcaaaggt

SEQ ID NO: 101786 - DNA, 20 bp, Artificial Sequence
  Description of Artificial Sequence: Synthetic oligonucleotide
  Target: SCN9A; (+) strand; PAM type: YTN; PAM sequence: CTG
gtttttgtgcaaaggtatat

SEQ ID NO: 101787 - DNA, 20 bp, Artificial Sequence
  Description of Artificial Sequence: Synthetic oligonucleotide
  Target: SCN9A; (+) strand; PAM type: YTN; PAM sequence: TTT
ttgtgcaaaggtatatccca

SEQ ID NO: 101788 - DNA, 20 bp, Artificial Sequence
  Description of Artificial Sequence: Synthetic oligonucleotide
  Target: SCN9A; (+) strand; PAM type: YTN; PAM sequence: TTT
tgtgcaaaggtatatcccaa

SEQ ID NO: 101789 - DNA, 20 bp, Artificial Sequence
  Description of Artificial Sequence: Synthetic oligonucleotide
  Target: SCN9A; (+) strand; PAM type: YTN; PAM sequence: TTT
gtgcaaaggtatatcccaag

SEQ ID NO: 101790 - DNA, 20 bp, Artificial Sequence
  Description of Artificial Sequence: Synthetic oligonucleotide
  Target: SCN9A; (+) strand; PAM type: YTN; PAM sequence: TTG
tgcaaaggtatatcccaaga

SEQ ID NO: 101791 - DNA, 20 bp, Artificial Sequence
  Description of Artificial Sequence: Synthetic oligonucleotide
  Target: SCN9A; (+) strand; PAM type: YTN; PAM sequence: TTT
ccaactaagctggttagcaa

SEQ ID NO: 101792 - DNA, 20 bp, Artificial Sequence
  Description of Artificial Sequence: Synthetic oligonucleotide
  Target: SCN9A; (+) strand; PAM type: YTN; PAM sequence: TTC
caactaagctggttagcaat

SEQ ID NO: 101793 - DNA, 20 bp, Artificial Sequence
  Description of Artificial Sequence: Synthetic oligonucleotide
  Target: SCN9A; (+) strand; PAM type: YTN; PAM sequence: CTA
agctggttagcaatgttatc

SEQ ID NO: 101794 - DNA, 20 bp, Artificial Sequence
  Description of Artificial Sequence: Synthetic oligonucleotide
  Target: SCN9A; (+) strand; PAM type: YTN; PAM sequence: CTG
gttagcaatgttatcatacc

SEQ ID NO: 101795 - DNA, 20 bp, Artificial Sequence
  Description of Artificial Sequence: Synthetic oligonucleotide
  Target: SCN9A; (+) strand; PAM type: YTN; PAM sequence: TTA
gcaatgttatcataccttct

SEQ ID NO: 101796 - DNA, 20 bp, Artificial Sequence
  Description of Artificial Sequence: Synthetic oligonucleotide
  Target: SCN9A; (+) strand; PAM type: YTN; PAM sequence: TTA
tcataccttctctttaaaag

SEQ ID NO: 101797 - DNA, 20 bp, Artificial Sequence
  Description of Artificial Sequence: Synthetic oligonucleotide
  Target: SCN9A; (+) strand; PAM type: YTN; PAM sequence: CTT
ctctttaaaaggactattaa

SEQ ID NO: 101798 - DNA, 20 bp, Artificial Sequence
  Description of Artificial Sequence: Synthetic oligonucleotide
  Target: SCN9A; (+) strand; PAM type: YTN; PAM sequence: TTC
tctttaaaaggactattaat

SEQ ID NO: 101799 - DNA, 20 bp, Artificial Sequence
  Description of Artificial Sequence: Synthetic oligonucleotide
  Target: SCN9A; (+) strand; PAM type: YTN; PAM sequence: CTC
tttaaaaggactattaattg

SEQ ID NO: 101800 - DNA, 20 bp, Artificial Sequence
  Description of Artificial Sequence: Synthetic oligonucleotide
  Target: SCN9A; (+) strand; PAM type: YTN; PAM sequence: CTT
taaaaggactattaattgaa

SEQ ID NO: 101801 - DNA, 20 bp, Artificial Sequence
  Description of Artificial Sequence: Synthetic oligonucleotide
  Target: SCN9A; (+) strand; PAM type: YTN; PAM sequence: TTT
aaaaggactattaattgaat

SEQ ID NO: 101802 - DNA, 20 bp, Artificial Sequence
  Description of Artificial Sequence: Synthetic oligonucleotide
  Target: SCN9A; (+) strand; PAM type: YTN; PAM sequence: TTA
aaaggactattaattgaatg

SEQ ID NO: 101803 - DNA, 20 bp, Artificial Sequence
  Description of Artificial Sequence: Synthetic oligonucleotide
  Target: SCN9A; (+) strand; PAM type: YTN; PAM sequence: CTA
ttaattgaatgtaaacataa

SEQ ID NO: 101804 - DNA, 20 bp, Artificial Sequence
  Description of Artificial Sequence: Synthetic oligonucleotide
  Target: SCN9A; (+) strand; PAM type: YTN; PAM sequence: TTA
attgaatgtaaacataacag

SEQ ID NO: 101805 - DNA, 20 bp, Artificial Sequence
  Description of Artificial Sequence: Synthetic oligonucleotide
  Target: SCN9A; (+) strand; PAM type: YTN; PAM sequence: TTG
aatgtaaacataacagagaa

SEQ ID NO: 101806 - DNA, 20 bp, Artificial Sequence
  Description of Artificial Sequence: Synthetic oligonucleotide
  Target: SCN9A; (+) strand; PAM type: YTN; PAM sequence: CTC
tcaaacattttaatgggtcc

SEQ ID NO: 101807 - DNA, 20 bp, Artificial Sequence
  Description of Artificial Sequence: Synthetic oligonucleotide
  Target: SCN9A; (+) strand; PAM type: YTN; PAM sequence: CTC
aaacattttaatgggtccca

SEQ ID NO: 101808 - DNA, 20 bp, Artificial Sequence
  Description of Artificial Sequence: Synthetic oligonucleotide
  Target: SCN9A; (+) strand; PAM type: YTN; PAM sequence: TTT
taatgggtcccagtgagtaa

SEQ ID NO: 101809 - DNA, 20 bp, Artificial Sequence
  Description of Artificial Sequence: Synthetic oligonucleotide
  Target: SCN9A; (+) strand; PAM type: YTN; PAM sequence: TTT
aatgggtcccagtgagtaaa

SEQ ID NO: 101810 - DNA, 20 bp, Artificial Sequence
  Description of Artificial Sequence: Synthetic oligonucleotide
  Target: SCN9A; (+) strand; PAM type: YTN; PAM sequence: TTA
atgggtcccagtgagtaaat

SEQ ID NO: 101811 - DNA, 20 bp, Artificial Sequence
  Description of Artificial Sequence: Synthetic oligonucleotide
  Target: SCN9A; (+) strand; PAM type: YTN; PAM sequence: CTA
tttcttttgggtggtttcac

SEQ ID NO: 101812 - DNA, 20 bp, Artificial Sequence
  Description of Artificial Sequence: Synthetic oligonucleotide
  Target: SCN9A; (+) strand; PAM type: YTN; PAM sequence: TTT
cttttgggtggtttcactaa

SEQ ID NO: 101813 - DNA, 20 bp, Artificial Sequence
  Description of Artificial Sequence: Synthetic oligonucleotide
  Target: SCN9A; (+) strand; PAM type: YTN; PAM sequence: TTC
ttttgggtggtttcactaat

SEQ ID NO: 101814 - DNA, 20 bp, Artificial Sequence
  Description of Artificial Sequence: Synthetic oligonucleotide
  Target: SCN9A; (+) strand; PAM type: YTN; PAM sequence: CTT
ttgggtggtttcactaatgt

SEQ ID NO: 101815 - DNA, 20 bp, Artificial Sequence
  Description of Artificial Sequence: Synthetic oligonucleotide
  Target: SCN9A; (+) strand; PAM type: YTN; PAM sequence: TTT
tgggtggtttcactaatgtg

SEQ ID NO: 101816 - DNA, 20 bp, Artificial Sequence
  Description of Artificial Sequence: Synthetic oligonucleotide
  Target: SCN9A; (+) strand; PAM type: YTN; PAM sequence: TTT
gggtggtttcactaatgtgc

SEQ ID NO: 101817 - DNA, 20 bp, Artificial Sequence
  Description of Artificial Sequence: Synthetic oligonucleotide
  Target: SCN9A; (+) strand; PAM type: YTN; PAM sequence: TTG
ggtggtttcactaatgtgct

SEQ ID NO: 101818 - DNA, 20 bp, Artificial Sequence
  Description of Artificial Sequence: Synthetic oligonucleotide
  Target: SCN9A; (+) strand; PAM type: YTN; PAM sequence: TTT
cactaatgtgctctcatggt

SEQ ID NO: 101819 - DNA, 20 bp, Artificial Sequence
  Description of Artificial Sequence: Synthetic oligonucleotide
  Target: SCN9A; (+) strand; PAM type: YTN; PAM sequence: TTC
actaatgtgctctcatggtg

SEQ ID NO: 101820 - DNA, 20 bp, Artificial Sequence
  Description of Artificial Sequence: Synthetic oligonucleotide
  Target: SCN9A; (+) strand; PAM type: YTN; PAM sequence: CTA
atgtgctctcatggtgcatt

SEQ ID NO: 101821 - DNA, 20 bp, Artificial Sequence
  Description of Artificial Sequence: Synthetic oligonucleotide
  Target: SCN9A; (+) strand; PAM type: YTN; PAM sequence: CTC
tcatggtgcattacataaag

SEQ ID NO: 101822 - DNA, 20 bp, Artificial Sequence
  Description of Artificial Sequence: Synthetic oligonucleotide
  Target: SCN9A; (+) strand; PAM type: YTN; PAM sequence: CTC
atggtgcattacataaagtc

SEQ ID NO: 101823 - DNA, 20 bp, Artificial Sequence
  Description of Artificial Sequence: Synthetic oligonucleotide
  Target: SCN9A; (+) strand; PAM type: YTN; PAM sequence: TTA
cataaagtctatgctgagtt

SEQ ID NO: 101824 - DNA, 20 bp, Artificial Sequence
  Description of Artificial Sequence: Synthetic oligonucleotide
  Target: SCN9A; (+) strand; PAM type: YTN; PAM sequence: CTA
tgctgagtttcatcatgtta

SEQ ID NO: 101825 - DNA, 20 bp, Artificial Sequence
  Description of Artificial Sequence: Synthetic oligonucleotide
  Target: SCN9A; (+) strand; PAM type: YTN; PAM sequence: CTG
agtttcatcatgttaaacca

SEQ ID NO: 101826 - DNA, 20 bp, Artificial Sequence
  Description of Artificial Sequence: Synthetic oligonucleotide
  Target: SCN9A; (+) strand; PAM type: YTN; PAM sequence: TTT
catcatgttaaaccaaagct

SEQ ID NO: 101827 - DNA, 20 bp, Artificial Sequence
  Description of Artificial Sequence: Synthetic oligonucleotide
  Target: SCN9A; (+) strand; PAM type: YTN; PAM sequence: TTC
atcatgttaaaccaaagctc

SEQ ID NO: 101828 - DNA, 20 bp, Artificial Sequence
  Description of Artificial Sequence: Synthetic oligonucleotide
  Target: SCN9A; (+) strand; PAM type: YTN; PAM sequence: TTA
aaccaaagctctcaaaaaaa

SEQ ID NO: 101829 - DNA, 20 bp, Artificial Sequence
  Description of Artificial Sequence: Synthetic oligonucleotide
  Target: SCN9A; (+) strand; PAM type: YTN; PAM sequence: CTC
tcaaaaaaaaaaaaaaaaaa

SEQ ID NO: 101830 - DNA, 20 bp, Artificial Sequence
  Description of Artificial Sequence: Synthetic oligonucleotide
  Target: SCN9A; (+) strand; PAM type: YTN; PAM sequence: CTC
aaaaaaaaaaaaaaaaaaaa

SEQ ID NO: 101831 - DNA, 20 bp, Artificial Sequence
  Description of Artificial Sequence: Synthetic oligonucleotide
  Target: SCN9A; (+) strand; PAM type: YTN; PAM sequence: CTG
accacttcaaaagacagact

SEQ ID NO: 101832 - DNA, 20 bp, Artificial Sequence
  Description of Artificial Sequence: Synthetic oligonucleotide
  Target: SCN9A; (+) strand; PAM type: YTN; PAM sequence: CTT
caaaagacagactattcatt

SEQ ID NO: 101833 - DNA, 20 bp, Artificial Sequence
  Description of Artificial Sequence: Synthetic oligonucleotide
  Target: SCN9A; (+) strand; PAM type: YTN; PAM sequence: TTC
aaaagacagactattcatta

SEQ ID NO: 101834 - DNA, 20 bp, Artificial Sequence
  Description of Artificial Sequence: Synthetic oligonucleotide
  Target: SCN9A; (+) strand; PAM type: YTN; PAM sequence: CTA
ttcattaaaaaccataacag

SEQ ID NO: 101835 - DNA, 20 bp, Artificial Sequence
  Description of Artificial Sequence: Synthetic oligonucleotide
  Target: SCN9A; (+) strand; PAM type: YTN; PAM sequence: TTC
attaaaaaccataacagcat

SEQ ID NO: 101836 - DNA, 20 bp, Artificial Sequence
  Description of Artificial Sequence: Synthetic oligonucleotide
  Target: SCN9A; (+) strand; PAM type: YTN; PAM sequence: TTA
aaaaccataacagcatgatc

SEQ ID NO: 101837 - DNA, 20 bp, Artificial Sequence
  Description of Artificial Sequence: Synthetic oligonucleotide
  Target: SCN9A; (+) strand; PAM type: YTN; PAM sequence: TTA
atttaaaaattgattatgaa

SEQ ID NO: 101838 - DNA, 20 bp, Artificial Sequence
  Description of Artificial Sequence: Synthetic oligonucleotide
  Target: SCN9A; (+) strand; PAM type: YTN; PAM sequence: TTT
aaaaattgattatgaaaaca

SEQ ID NO: 101839 - DNA, 20 bp, Artificial Sequence
  Description of Artificial Sequence: Synthetic oligonucleotide
  Target: SCN9A; (+) strand; PAM type: YTN; PAM sequence: TTA
aaaattgattatgaaaacaa

SEQ ID NO: 101840 - DNA, 20 bp, Artificial Sequence
  Description of Artificial Sequence: Synthetic oligonucleotide
  Target: SCN9A; (+) strand; PAM type: YTN; PAM sequence: TTG
attatgaaaacaagcttttt

SEQ ID NO: 101841 - DNA, 20 bp, Artificial Sequence
  Description of Artificial Sequence: Synthetic oligonucleotide
  Target: SCN9A; (+) strand; PAM type: YTN; PAM sequence: TTA
tgaaaacaagcttttttcac

SEQ ID NO: 101842 - DNA, 20 bp, Artificial Sequence
  Description of Artificial Sequence: Synthetic oligonucleotide
  Target: SCN9A; (+) strand; PAM type: YTN; PAM sequence: CTT
ttttcaccatttcttaacat

SEQ ID NO: 101843 - DNA, 20 bp, Artificial Sequence
  Description of Artificial Sequence: Synthetic oligonucleotide
  Target: SCN9A; (+) strand; PAM type: YTN; PAM sequence: TTT
tttcaccatttcttaacatc

SEQ ID NO: 101844 - DNA, 20 bp, Artificial Sequence
  Description of Artificial Sequence: Synthetic oligonucleotide
  Target: SCN9A; (+) strand; PAM type: YTN; PAM sequence: TTT
ttcaccatttcttaacatca

SEQ ID NO: 101845 - DNA, 20 bp, Artificial Sequence
  Description of Artificial Sequence: Synthetic oligonucleotide
  Target: SCN9A; (+) strand; PAM type: YTN; PAM sequence: TTT
tcaccatttcttaacatcaa

SEQ ID NO: 101846 - DNA, 20 bp, Artificial Sequence
  Description of Artificial Sequence: Synthetic oligonucleotide
  Target: SCN9A; (+) strand; PAM type: YTN; PAM sequence: TTT
caccatttcttaacatcaaa

SEQ ID NO: 101847 - DNA, 20 bp, Artificial Sequence
  Description of Artificial Sequence: Synthetic oligonucleotide
  Target: SCN9A; (+) strand; PAM type: YTN; PAM sequence: TTC
accatttcttaacatcaaat

SEQ ID NO: 101848 - DNA, 20 bp, Artificial Sequence
  Description of Artificial Sequence: Synthetic oligonucleotide
  Target: SCN9A; (+) strand; PAM type: YTN; PAM sequence: TTT
cttaacatcaaatataacta

SEQ ID NO: 101849 - DNA, 20 bp, Artificial Sequence
  Description of Artificial Sequence: Synthetic oligonucleotide
  Target: SCN9A; (+) strand; PAM type: YTN; PAM sequence: TTC
ttaacatcaaatataactaa

SEQ ID NO: 101850 - DNA, 20 bp, Artificial Sequence
  Description of Artificial Sequence: Synthetic oligonucleotide
  Target: SCN9A; (+) strand; PAM type: YTN; PAM sequence: CTT
aacatcaaatataactaaaa

SEQ ID NO: 101851 - DNA, 20 bp, Artificial Sequence
  Description of Artificial Sequence: Synthetic oligonucleotide
  Target: SCN9A; (+) strand; PAM type: YTN; PAM sequence: TTA
acatcaaatataactaaaac

SEQ ID NO: 101852 - DNA, 20 bp, Artificial Sequence
  Description of Artificial Sequence: Synthetic oligonucleotide
  Target: SCN9A; (+) strand; PAM type: YTN; PAM sequence: CTA
aaacaaatatttgttaacat

SEQ ID NO: 101853 - DNA, 20 bp, Artificial Sequence
  Description of Artificial Sequence: Synthetic oligonucleotide
  Target: SCN9A; (+) strand; PAM type: YTN; PAM sequence: TTT
gttaacattatctttccaaa

SEQ ID NO: 101854 - DNA, 20 bp, Artificial Sequence
  Description of Artificial Sequence: Synthetic oligonucleotide
  Target: SCN9A; (+) strand; PAM type: YTN; PAM sequence: TTG
ttaacattatctttccaaaa

SEQ ID NO: 101855 - DNA, 20 bp, Artificial Sequence
  Description of Artificial Sequence: Synthetic oligonucleotide
  Target: SCN9A; (+) strand; PAM type: YTN; PAM sequence: TTA
acattatctttccaaaagaa

SEQ ID NO: 101856 - DNA, 20 bp, Artificial Sequence
  Description of Artificial Sequence: Synthetic oligonucleotide
  Target: SCN9A; (+) strand; PAM type: YTN; PAM sequence: TTA
tctttccaaaagaaagaaaa

SEQ ID NO: 101857 - DNA, 20 bp, Artificial Sequence
  Description of Artificial Sequence: Synthetic oligonucleotide
  Target: SCN9A; (+) strand; PAM type: YTN; PAM sequence: CTT
tccaaaagaaagaaaaaata

SEQ ID NO: 101858 - DNA, 20 bp, Artificial Sequence
  Description of Artificial Sequence: Synthetic oligonucleotide
  Target: SCN9A; (+) strand; PAM type: YTN; PAM sequence: TTT
ccaaaagaaagaaaaaataa

SEQ ID NO: 101859 - DNA, 20 bp, Artificial Sequence
  Description of Artificial Sequence: Synthetic oligonucleotide
  Target: SCN9A; (+) strand; PAM type: YTN; PAM sequence: TTC
caaaagaaagaaaaaataaa

SEQ ID NO: 101860 - DNA, 20 bp, Artificial Sequence
  Description of Artificial Sequence: Synthetic oligonucleotide
  Target: SCN9A; (+) strand; PAM type: YTN; PAM sequence: TTG
gttattgtgttactaaagtt

SEQ ID NO: 101861 - DNA, 20 bp, Artificial Sequence
  Description of Artificial Sequence: Synthetic oligonucleotide
  Target: SCN9A; (+) strand; PAM type: YTN; PAM sequence: TTA
ttgtgttactaaagttagaa

SEQ ID NO: 101862 - DNA, 20 bp, Artificial Sequence
  Description of Artificial Sequence: Synthetic oligonucleotide
  Target: SCN9A; (+) strand; PAM type: YTN; PAM sequence: TTG
tgttactaaagttagaatta

SEQ ID NO: 101863 - DNA, 20 bp, Artificial Sequence
  Description of Artificial Sequence: Synthetic oligonucleotide
  Target: SCN9A; (+) strand; PAM type: YTN; PAM sequence: TTA
ctaaagttagaattaattat

SEQ ID NO: 101864 - DNA, 20 bp, Artificial Sequence
  Description of Artificial Sequence: Synthetic oligonucleotide
  Target: SCN9A; (+) strand; PAM type: YTN; PAM sequence: CTA
aagttagaattaattattag

SEQ ID NO: 101865 - DNA, 20 bp, Artificial Sequence
  Description of Artificial Sequence: Synthetic oligonucleotide
  Target: SCN9A; (+) strand; PAM type: YTN; PAM sequence: TTA
gaattaattattagttattt

SEQ ID NO: 101866 - DNA, 20 bp, Artificial Sequence
  Description of Artificial Sequence: Synthetic oligonucleotide
  Target: SCN9A; (+) strand; PAM type: YTN; PAM sequence: TTA
attattagttattttatagg

SEQ ID NO: 101867 - DNA, 20 bp, Artificial Sequence
  Description of Artificial Sequence: Synthetic oligonucleotide
  Target: SCN9A; (+) strand; PAM type: YTN; PAM sequence: TTA
ttagttattttataggaagg

SEQ ID NO: 101868 - DNA, 20 bp, Artificial Sequence
  Description of Artificial Sequence: Synthetic oligonucleotide
  Target: SCN9A; (+) strand; PAM type: YTN; PAM sequence: TTA
gttattttataggaaggggg

SEQ ID NO: 101869 - DNA, 20 bp, Artificial Sequence
  Description of Artificial Sequence: Synthetic oligonucleotide
  Target: SCN9A; (+) strand; PAM type: YTN; PAM sequence: TTA
ttttataggaagggggtgaa

SEQ ID NO: 101870 - DNA, 20 bp, Artificial Sequence
  Description of Artificial Sequence: Synthetic oligonucleotide
  Target: SCN9A; (+) strand; PAM type: YTN; PAM sequence: TTT
tataggaagggggtgaatac

SEQ ID NO: 101871 - DNA, 20 bp, Artificial Sequence
  Description of Artificial Sequence: Synthetic oligonucleotide
  Target: SCN9A; (+) strand; PAM type: YTN; PAM sequence: TTT
ataggaagggggtgaataca

SEQ ID NO: 101872 - DNA, 20 bp, Artificial Sequence
  Description of Artificial Sequence: Synthetic oligonucleotide
  Target: SCN9A; (+) strand; PAM type: YTN; PAM sequence: TTA
taggaagggggtgaatacaa

SEQ ID NO: 101873 - DNA, 20 bp, Artificial Sequence
  Description of Artificial Sequence: Synthetic oligonucleotide
  Target: SCN9A; (+) strand; PAM type: YTN; PAM sequence: TTT
tgaaaggaagatgatttggc

SEQ ID NO: 101874 - DNA, 20 bp, Artificial Sequence
  Description of Artificial Sequence: Synthetic oligonucleotide
  Target: SCN9A; (+) strand; PAM type: YTN; PAM sequence: TTT
gaaaggaagatgatttggct

SEQ ID NO: 101875 - DNA, 20 bp, Artificial Sequence
  Description of Artificial Sequence: Synthetic oligonucleotide
  Target: SCN9A; (+) strand; PAM type: YTN; PAM sequence: TTG
aaaggaagatgatttggctt

SEQ ID NO: 101876 - DNA, 20 bp, Artificial Sequence
  Description of Artificial Sequence: Synthetic oligonucleotide
  Target: SCN9A; (+) strand; PAM type: YTN; PAM sequence: TTT
ggcttctcctaccaagttaa

SEQ ID NO: 101877 - DNA, 20 bp, Artificial Sequence
  Description of Artificial Sequence: Synthetic oligonucleotide
  Target: SCN9A; (+) strand; PAM type: YTN; PAM sequence: TTG
gcttctcctaccaagttaac

SEQ ID NO: 101878 - DNA, 20 bp, Artificial Sequence
  Description of Artificial Sequence: Synthetic oligonucleotide
  Target: SCN9A; (+) strand; PAM type: YTN; PAM sequence: CTT
ctcctaccaagttaacagaa

SEQ ID NO: 101879 - DNA, 20 bp, Artificial Sequence
  Description of Artificial Sequence: Synthetic oligonucleotide
  Target: SCN9A; (+) strand; PAM type: YTN; PAM sequence: TTC
tcctaccaagttaacagaaa

SEQ ID NO: 101880 - DNA, 20 bp, Artificial Sequence
  Description of Artificial Sequence: Synthetic oligonucleotide
  Target: SCN9A; (+) strand; PAM type: YTN; PAM sequence: CTC
ctaccaagttaacagaaaaa

SEQ ID NO: 101881 - DNA, 20 bp, Artificial Sequence
  Description of Artificial Sequence: Synthetic oligonucleotide
  Target: SCN9A; (+) strand; PAM type: YTN; PAM sequence: CTA
ccaagttaacagaaaaatac

SEQ ID NO: 101882 - DNA, 20 bp, Artificial Sequence
  Description of Artificial Sequence: Synthetic oligonucleotide
  Target: SCN9A; (+) strand; PAM type: YTN; PAM sequence: TTA
acagaaaaatacattactat

SEQ ID NO: 101883 - DNA, 20 bp, Artificial Sequence
  Description of Artificial Sequence: Synthetic oligonucleotide
  Target: SCN9A; (+) strand; PAM type: YTN; PAM sequence: TTA
ctattattaccattattatt

SEQ ID NO: 101884 - DNA, 20 bp, Artificial Sequence
  Description of Artificial Sequence: Synthetic oligonucleotide
  Target: SCN9A; (+) strand; PAM type: YTN; PAM sequence: CTA
ttattaccattattattttt

SEQ ID NO: 101885 - DNA, 20 bp, Artificial Sequence
  Description of Artificial Sequence: Synthetic oligonucleotide
  Target: SCN9A; (+) strand; PAM type: YTN; PAM sequence: TTA
ttaccattattattttttga

SEQ ID NO: 101886 - DNA, 20 bp, Artificial Sequence
  Description of Artificial Sequence: Synthetic oligonucleotide
  Target: SCN9A; (+) strand; PAM type: YTN; PAM sequence: TTA
ccattattattttttgagac

SEQ ID NO: 101887 - DNA, 20 bp, Artificial Sequence
  Description of Artificial Sequence: Synthetic oligonucleotide
  Target: SCN9A; (+) strand; PAM type: YTN; PAM sequence: TTA
ttattttttgagacagagtc

SEQ ID NO: 101888 - DNA, 20 bp, Artificial Sequence
  Description of Artificial Sequence: Synthetic oligonucleotide
  Target: SCN9A; (+) strand; PAM type: YTN; PAM sequence: TTA
ttttttgagacagagtctca

SEQ ID NO: 101889 - DNA, 20 bp, Artificial Sequence
  Description of Artificial Sequence: Synthetic oligonucleotide
  Target: SCN9A; (+) strand; PAM type: YTN; PAM sequence: TTT
tttgagacagagtctcactt

SEQ ID NO: 101890 - DNA, 20 bp, Artificial Sequence
  Description of Artificial Sequence: Synthetic oligonucleotide
  Target: SCN9A; (+) strand; PAM type: YTN; PAM sequence: TTT
ttgagacagagtctcacttt

SEQ ID NO: 101891 - DNA, 20 bp, Artificial Sequence
  Description of Artificial Sequence: Synthetic oligonucleotide
  Target: SCN9A; (+) strand; PAM type: YTN; PAM sequence: TTT
tgagacagagtctcactttg

SEQ ID NO: 101892 - DNA, 20 bp, Artificial Sequence
  Description of Artificial Sequence: Synthetic oligonucleotide
  Target: SCN9A; (+) strand; PAM type: YTN; PAM sequence: TTT
gagacagagtctcactttgt

SEQ ID NO: 101893 - DNA, 20 bp, Artificial Sequence
  Description of Artificial Sequence: Synthetic oligonucleotide
  Target: SCN9A; (+) strand; PAM type: YTN; PAM sequence: TTG
agacagagtctcactttgtt

SEQ ID NO: 101894 - DNA, 20 bp, Artificial Sequence
  Description of Artificial Sequence: Synthetic oligonucleotide
  Target: SCN9A; (+) strand; PAM type: YTN; PAM sequence: CTC
actttgttgccaggctggag

SEQ ID NO: 101895 - DNA, 20 bp, Artificial Sequence
  Description of Artificial Sequence: Synthetic oligonucleotide
  Target: SCN9A; (+) strand; PAM type: YTN; PAM sequence: CTT
tgttgccaggctggagtgca

SEQ ID NO: 101896 - DNA, 20 bp, Artificial Sequence
  Description of Artificial Sequence: Synthetic oligonucleotide
  Target: SCN9A; (+) strand; PAM type: YTN; PAM sequence: TTT
gttgccaggctggagtgcag

SEQ ID NO: 101897 - DNA, 20 bp, Artificial Sequence
  Description of Artificial Sequence: Synthetic oligonucleotide
  Target: SCN9A; (+) strand; PAM type: YTN; PAM sequence: TTG
ttgccaggctggagtgcagt

SEQ ID NO: 101898 - DNA, 20 bp, Artificial Sequence
  Description of Artificial Sequence: Synthetic oligonucleotide
  Target: SCN9A; (+) strand; PAM type: YTN; PAM sequence: TTG
ccaggctggagtgcagtagc

SEQ ID NO: 101899 - DNA, 20 bp, Artificial Sequence
  Description of Artificial Sequence: Synthetic oligonucleotide
  Target: SCN9A; (+) strand; PAM type: YTN; PAM sequence: CTG
gagtgcagtagcaggatctc

SEQ ID NO: 101900 - DNA, 20 bp, Artificial Sequence
  Description of Artificial Sequence: Synthetic oligonucleotide
  Target: SCN9A; (+) strand; PAM type: YTN; PAM sequence: CTC
agctcactgcaacctctgcc

SEQ ID NO: 101901 - DNA, 20 bp, Artificial Sequence
  Description of Artificial Sequence: Synthetic oligonucleotide
  Target: SCN9A; (+) strand; PAM type: YTN; PAM sequence: CTC
actgcaacctctgcctcctg

SEQ ID NO: 101902 - DNA, 20 bp, Artificial Sequence
  Description of Artificial Sequence: Synthetic oligonucleotide
  Target: SCN9A; (+) strand; PAM type: YTN; PAM sequence: CTG
caacctctgcctcctgggtt

SEQ ID NO: 101903 - DNA, 20 bp, Artificial Sequence
  Description of Artificial Sequence: Synthetic oligonucleotide
  Target: SCN9A; (+) strand; PAM type: YTN; PAM sequence: CTC
tgcctcctgggttcaagcga

SEQ ID NO: 101904 - DNA, 20 bp, Artificial Sequence
  Description of Artificial Sequence: Synthetic oligonucleotide
  Target: SCN9A; (+) strand; PAM type: YTN; PAM sequence: CTG
cctcctgggttcaagcgatt

SEQ ID NO: 101905 - DNA, 20 bp, Artificial Sequence
  Description of Artificial Sequence: Synthetic oligonucleotide
  Target: SCN9A; (+) strand; PAM type: YTN; PAM sequence: CTC
ctgggttcaagcgattctcc

SEQ ID NO: 101906 - DNA, 20 bp, Artificial Sequence
  Description of Artificial Sequence: Synthetic oligonucleotide
  Target: SCN9A; (+) strand; PAM type: YTN; PAM sequence: CTG
ggttcaagcgattctcctgc

SEQ ID NO: 101907 - DNA, 20 bp, Artificial Sequence
  Description of Artificial Sequence: Synthetic oligonucleotide
  Target: SCN9A; (+) strand; PAM type: YTN; PAM sequence: TTC
aagcgattctcctgcctcag

SEQ ID NO: 101908 - DNA, 20 bp, Artificial Sequence
  Description of Artificial Sequence: Synthetic oligonucleotide
  Target: SCN9A; (+) strand; PAM type: YTN; PAM sequence: TTC
tcctgcctcagcctcttgag

SEQ ID NO: 101909 - DNA, 20 bp, Artificial Sequence
  Description of Artificial Sequence: Synthetic oligonucleotide
  Target: SCN9A; (+) strand; PAM type: YTN; PAM sequence: CTC
ctgcctcagcctcttgagta

SEQ ID NO: 101910 - DNA, 20 bp, Artificial Sequence
  Description of Artificial Sequence: Synthetic oligonucleotide
  Target: SCN9A; (+) strand; PAM type: YTN; PAM sequence: CTG
cctcagcctcttgagtagct

SEQ ID NO: 101911 - DNA, 20 bp, Artificial Sequence
  Description of Artificial Sequence: Synthetic oligonucleotide
  Target: SCN9A; (+) strand; PAM type: YTN; PAM sequence: CTC
agcctcttgagtagctggga

SEQ ID NO: 101912 - DNA, 20 bp, Artificial Sequence
  Description of Artificial Sequence: Synthetic oligonucleotide
  Target: SCN9A; (+) strand; PAM type: YTN; PAM sequence: CTC
ttgagtagctgggactacag

SEQ ID NO: 101913 - DNA, 20 bp, Artificial Sequence
  Description of Artificial Sequence: Synthetic oligonucleotide
  Target: SCN9A; (+) strand; PAM type: YTN; PAM sequence: CTT
gagtagctgggactacaggc

SEQ ID NO: 101914 - DNA, 20 bp, Artificial Sequence
  Description of Artificial Sequence: Synthetic oligonucleotide
  Target: SCN9A; (+) strand; PAM type: YTN; PAM sequence: TTG
agtagctgggactacaggcg

SEQ ID NO: 101915 - DNA, 20 bp, Artificial Sequence
  Description of Artificial Sequence: Synthetic oligonucleotide
  Target: SCN9A; (+) strand; PAM type: YTN; PAM sequence: CTG
ggactacaggcgctcaccac

SEQ ID NO: 101916 - DNA, 20 bp, Artificial Sequence
  Description of Artificial Sequence: Synthetic oligonucleotide
  Target: SCN9A; (+) strand; PAM type: YTN; PAM sequence: CTA
caggcgctcaccaccaggct

SEQ ID NO: 101917 - DNA, 20 bp, Artificial Sequence
  Description of Artificial Sequence: Synthetic oligonucleotide
  Target: SCN9A; (+) strand; PAM type: YTN; PAM sequence: CTC
accaccaggctcagctaatt

SEQ ID NO: 101918 - DNA, 20 bp, Artificial Sequence
  Description of Artificial Sequence: Synthetic oligonucleotide
  Target: SCN9A; (+) strand; PAM type: YTN; PAM sequence: CTC
agctaatttttgtattttta

SEQ ID NO: 101919 - DNA, 20 bp, Artificial Sequence
  Description of Artificial Sequence: Synthetic oligonucleotide
  Target: SCN9A; (+) strand; PAM type: YTN; PAM sequence: CTA
atttttgtatttttagtaga

SEQ ID NO: 101920 - DNA, 20 bp, Artificial Sequence
  Description of Artificial Sequence: Synthetic oligonucleotide
  Target: SCN9A; (+) strand; PAM type: YTN; PAM sequence: TTT
ttgtatttttagtagaaacg

SEQ ID NO: 101921 - DNA, 20 bp, Artificial Sequence
  Description of Artificial Sequence: Synthetic oligonucleotide
  Target: SCN9A; (+) strand; PAM type: YTN; PAM sequence: TTT
tgtatttttagtagaaacgg

SEQ ID NO: 101922 - DNA, 20 bp, Artificial Sequence
  Description of Artificial Sequence: Synthetic oligonucleotide
  Target: SCN9A; (+) strand; PAM type: YTN; PAM sequence: TTT
gtatttttagtagaaacggg

SEQ ID NO: 101923 - DNA, 20 bp, Artificial Sequence
  Description of Artificial Sequence: Synthetic oligonucleotide
  Target: SCN9A; (+) strand; PAM type: YTN; PAM sequence: TTG
tatttttagtagaaacggga

SEQ ID NO: 101924 - DNA, 20 bp, Artificial Sequence
  Description of Artificial Sequence: Synthetic oligonucleotide
  Target: SCN9A; (+) strand; PAM type: YTN; PAM sequence: TTT
ttagtagaaacgggatttca

SEQ ID NO: 101925 - DNA, 20 bp, Artificial Sequence
  Description of Artificial Sequence: Synthetic oligonucleotide
  Target: SCN9A; (+) strand; PAM type: YTN; PAM sequence: TTT
tagtagaaacgggatttcac

SEQ ID NO: 101926 - DNA, 20 bp, Artificial Sequence
  Description of Artificial Sequence: Synthetic oligonucleotide
  Target: SCN9A; (+) strand; PAM type: YTN; PAM sequence: TTT
agtagaaacgggatttcacc

SEQ ID NO: 101927 - DNA, 20 bp, Artificial Sequence
  Description of Artificial Sequence: Synthetic oligonucleotide
  Target: SCN9A; (+) strand; PAM type: YTN; PAM sequence: TTA
gtagaaacgggatttcacca

SEQ ID NO: 101928 - DNA, 20 bp, Artificial Sequence
  Description of Artificial Sequence: Synthetic oligonucleotide
  Target: SCN9A; (+) strand; PAM type: YTN; PAM sequence: TTT
caccatgttagccaggatgg

SEQ ID NO: 101929 - DNA, 20 bp, Artificial Sequence
  Description of Artificial Sequence: Synthetic oligonucleotide
  Target: SCN9A; (+) strand; PAM type: YTN; PAM sequence: TTC
accatgttagccaggatggt

SEQ ID NO: 101930 - DNA, 20 bp, Artificial Sequence
  Description of Artificial Sequence: Synthetic oligonucleotide
  Target: SCN9A; (+) strand; PAM type: YTN; PAM sequence: TTA
gccaggatggtctcgatctc

SEQ ID NO: 101931 - DNA, 20 bp, Artificial Sequence
  Description of Artificial Sequence: Synthetic oligonucleotide
  Target: SCN9A; (+) strand; PAM type: YTN; PAM sequence: CTC
gatctcttgaccttgtgaaa

SEQ ID NO: 101932 - DNA, 20 bp, Artificial Sequence
  Description of Artificial Sequence: Synthetic oligonucleotide
  Target: SCN9A; (+) strand; PAM type: YTN; PAM sequence: CTC
ttgaccttgtgaaaaaggtt

SEQ ID NO: 101933 - DNA, 20 bp, Artificial Sequence
  Description of Artificial Sequence: Synthetic oligonucleotide
  Target: SCN9A; (+) strand; PAM type: YTN; PAM sequence: CTT
gaccttgtgaaaaaggttat

SEQ ID NO: 101934 - DNA, 20 bp, Artificial Sequence
  Description of Artificial Sequence: Synthetic oligonucleotide
  Target: SCN9A; (+) strand; PAM type: YTN; PAM sequence: TTG
accttgtgaaaaaggttatt

SEQ ID NO: 101935 - DNA, 20 bp, Artificial Sequence
  Description of Artificial Sequence: Synthetic oligonucleotide
  Target: SCN9A; (+) strand; PAM type: YTN; PAM sequence: CTT
gtgaaaaaggttatttttcg

SEQ ID NO: 101936 - DNA, 20 bp, Artificial Sequence
  Description of Artificial Sequence: Synthetic oligonucleotide
  Target: SCN9A; (+) strand; PAM type: YTN; PAM sequence: TTG
tgaaaaaggttatttttcgc

SEQ ID NO: 101937 - DNA, 20 bp, Artificial Sequence
  Description of Artificial Sequence: Synthetic oligonucleotide
  Target: SCN9A; (+) strand; PAM type: YTN; PAM sequence: TTA
tttttcgctaactctaatcc

SEQ ID NO: 101938 - DNA, 20 bp, Artificial Sequence
  Description of Artificial Sequence: Synthetic oligonucleotide
  Target: SCN9A; (+) strand; PAM type: YTN; PAM sequence: TTT
ttcgctaactctaatcctga

SEQ ID NO: 101939 - DNA, 20 bp, Artificial Sequence
  Description of Artificial Sequence: Synthetic oligonucleotide
  Target: SCN9A; (+) strand; PAM type: YTN; PAM sequence: TTT
tcgctaactctaatcctgat

SEQ ID NO: 101940 - DNA, 20 bp, Artificial Sequence
  Description of Artificial Sequence: Synthetic oligonucleotide
  Target: SCN9A; (+) strand; PAM type: YTN; PAM sequence: TTT
cgctaactctaatcctgatt

SEQ ID NO: 101941 - DNA, 20 bp, Artificial Sequence
  Description of Artificial Sequence: Synthetic oligonucleotide
  Target: SCN9A; (+) strand; PAM type: YTN; PAM sequence: TTC
gctaactctaatcctgatta

SEQ ID NO: 101942 - DNA, 20 bp, Artificial Sequence
  Description of Artificial Sequence: Synthetic oligonucleotide
  Target: SCN9A; (+) strand; PAM type: YTN; PAM sequence: CTA
actctaatcctgattatgta

SEQ ID NO: 101943 - DNA, 20 bp, Artificial Sequence
  Description of Artificial Sequence: Synthetic oligonucleotide
  Target: SCN9A; (+) strand; PAM type: YTN; PAM sequence: CTC
taatcctgattatgtaattt

SEQ ID NO: 101944 - DNA, 20 bp, Artificial Sequence
  Description of Artificial Sequence: Synthetic oligonucleotide
  Target: SCN9A; (+) strand; PAM type: YTN; PAM sequence: CTA
atcctgattatgtaatttac

SEQ ID NO: 101945 - DNA, 20 bp, Artificial Sequence
  Description of Artificial Sequence: Synthetic oligonucleotide
  Target: SCN9A; (+) strand; PAM type: YTN; PAM sequence: CTG
attatgtaatttactaattt

SEQ ID NO: 101946 - DNA, 20 bp, Artificial Sequence
  Description of Artificial Sequence: Synthetic oligonucleotide
  Target: SCN9A; (+) strand; PAM type: YTN; PAM sequence: TTA
tgtaatttactaatttgata

SEQ ID NO: 101947 - DNA, 20 bp, Artificial Sequence
  Description of Artificial Sequence: Synthetic oligonucleotide
  Target: SCN9A; (+) strand; PAM type: YTN; PAM sequence: TTT
actaatttgataatctaaaa

SEQ ID NO: 101948 - DNA, 20 bp, Artificial Sequence
  Description of Artificial Sequence: Synthetic oligonucleotide
  Target: SCN9A; (+) strand; PAM type: YTN; PAM sequence: TTA
ctaatttgataatctaaaag

SEQ ID NO: 101949 - DNA, 20 bp, Artificial Sequence
  Description of Artificial Sequence: Synthetic oligonucleotide
  Target: SCN9A; (+) strand; PAM type: YTN; PAM sequence: CTA
atttgataatctaaaagcag

SEQ ID NO: 101950 - DNA, 20 bp, Artificial Sequence
  Description of Artificial Sequence: Synthetic oligonucleotide
  Target: SCN9A; (+) strand; PAM type: YTN; PAM sequence: TTT
gataatctaaaagcagcaca

SEQ ID NO: 101951 - DNA, 20 bp, Artificial Sequence
  Description of Artificial Sequence: Synthetic oligonucleotide
  Target: SCN9A; (+) strand; PAM type: YTN; PAM sequence: TTG
ataatctaaaagcagcacaa

SEQ ID NO: 101952 - DNA, 20 bp, Artificial Sequence
  Description of Artificial Sequence: Synthetic oligonucleotide
  Target: SCN9A; (+) strand; PAM type: YTN; PAM sequence: CTA
aaagcagcacaatataaaac

SEQ ID NO: 101953 - DNA, 20 bp, Artificial Sequence
  Description of Artificial Sequence: Synthetic oligonucleotide
  Target: SCN9A; (+) strand; PAM type: YTN; PAM sequence: TTC
ataattatataggttgccaa

SEQ ID NO: 101954 - DNA, 20 bp, Artificial Sequence
  Description of Artificial Sequence: Synthetic oligonucleotide
  Target: SCN9A; (+) strand; PAM type: YTN; PAM sequence: TTA
tataggttgccaagtcatgt

SEQ ID NO: 101955 - DNA, 20 bp, Artificial Sequence
  Description of Artificial Sequence: Synthetic oligonucleotide
  Target: SCN9A; (+) strand; PAM type: YTN; PAM sequence: TTG
ccaagtcatgtagaactaag

SEQ ID NO: 101956 - DNA, 20 bp, Artificial Sequence
  Description of Artificial Sequence: Synthetic oligonucleotide
  Target: SCN9A; (+) strand; PAM type: YTN; PAM sequence: CTA
aggatagtaaagaacagggc

SEQ ID NO: 101957 - DNA, 20 bp, Artificial Sequence
  Description of Artificial Sequence: Synthetic oligonucleotide
  Target: SCN9A; (+) strand; PAM type: YTN; PAM sequence: CTG
aagtcttcaaatacaaagta

SEQ ID NO: 101958 - DNA, 20 bp, Artificial Sequence
  Description of Artificial Sequence: Synthetic oligonucleotide
  Target: SCN9A; (+) strand; PAM type: YTN; PAM sequence: CTT
caaatacaaagtaatagaca

SEQ ID NO: 101959 - DNA, 20 bp, Artificial Sequence
  Description of Artificial Sequence: Synthetic oligonucleotide
  Target: SCN9A; (+) strand; PAM type: YTN; PAM sequence: TTC
aaatacaaagtaatagacac

SEQ ID NO: 101960 - DNA, 20 bp, Artificial Sequence
  Description of Artificial Sequence: Synthetic oligonucleotide
  Target: SCN9A; (+) strand; PAM type: YTN; PAM sequence: CTA
aggaacaaccttgcataaga

SEQ ID NO: 101961 - DNA, 20 bp, Artificial Sequence
  Description of Artificial Sequence: Synthetic oligonucleotide
  Target: SCN9A; (+) strand; PAM type: YTN; PAM sequence: CTT
gcataagagggagagaaaag

SEQ ID NO: 101962 - DNA, 20 bp, Artificial Sequence
  Description of Artificial Sequence: Synthetic oligonucleotide
  Target: SCN9A; (+) strand; PAM type: YTN; PAM sequence: TTG
cataagagggagagaaaagg

SEQ ID NO: 101963 - DNA, 20 bp, Artificial Sequence
  Description of Artificial Sequence: Synthetic oligonucleotide
  Target: SCN9A; (+) strand; PAM type: YTN; PAM sequence: TTA
gtaaagtgataattatgaag

SEQ ID NO: 101964 - DNA, 20 bp, Artificial Sequence
  Description of Artificial Sequence: Synthetic oligonucleotide
  Target: SCN9A; (+) strand; PAM type: YTN; PAM sequence: TTA
tgaagctgaaatgaatcaac

SEQ ID NO: 101965 - DNA, 20 bp, Artificial Sequence
  Description of Artificial Sequence: Synthetic oligonucleotide
  Target: SCN9A; (+) strand; PAM type: YTN; PAM sequence: CTG
aaatgaatcaacaaatgtga

SEQ ID NO: 101966 - DNA, 20 bp, Artificial Sequence
  Description of Artificial Sequence: Synthetic oligonucleotide
  Target: SCN9A; (+) strand; PAM type: YTN; PAM sequence: CTA
tgaacaacaaaatcgtttta

SEQ ID NO: 101967 - DNA, 20 bp, Artificial Sequence
  Description of Artificial Sequence: Synthetic oligonucleotide
  Target: SCN9A; (+) strand; PAM type: YTN; PAM sequence: TTT
taacatttatcttcagtaaa

SEQ ID NO: 101968 - DNA, 20 bp, Artificial Sequence
  Description of Artificial Sequence: Synthetic oligonucleotide
  Target: SCN9A; (+) strand; PAM type: YTN; PAM sequence: TTT
aacatttatcttcagtaaaa

SEQ ID NO: 101969 - DNA, 20 bp, Artificial Sequence
  Description of Artificial Sequence: Synthetic oligonucleotide
  Target: SCN9A; (+) strand; PAM type: YTN; PAM sequence: TTA
acatttatcttcagtaaaaa

SEQ ID NO: 101970 - DNA, 20 bp, Artificial Sequence
  Description of Artificial Sequence: Synthetic oligonucleotide
  Target: SCN9A; (+) strand; PAM type: YTN; PAM sequence: TTT
atcttcagtaaaaacatgct

SEQ ID NO: 101971 - DNA, 20 bp, Artificial Sequence
  Description of Artificial Sequence: Synthetic oligonucleotide
  Target: SCN9A; (+) strand; PAM type: YTN; PAM sequence: TTA
tcttcagtaaaaacatgcta

SEQ ID NO: 101972 - DNA, 20 bp, Artificial Sequence
  Description of Artificial Sequence: Synthetic oligonucleotide
  Target: SCN9A; (+) strand; PAM type: YTN; PAM sequence: CTT
cagtaaaaacatgctacttg

SEQ ID NO: 101973 - DNA, 20 bp, Artificial Sequence
  Description of Artificial Sequence: Synthetic oligonucleotide
  Target: SCN9A; (+) strand; PAM type: YTN; PAM sequence: TTC
agtaaaaacatgctacttgg

SEQ ID NO: 101974 - DNA, 20 bp, Artificial Sequence
  Description of Artificial Sequence: Synthetic oligonucleotide
  Target: SCN9A; (+) strand; PAM type: YTN; PAM sequence: CTA
cttggatttaattctttttc

SEQ ID NO: 101975 - DNA, 20 bp, Artificial Sequence
  Description of Artificial Sequence: Synthetic oligonucleotide
  Target: SCN9A; (+) strand; PAM type: YTN; PAM sequence: CTT
ggatttaattctttttcata

SEQ ID NO: 101976 - DNA, 20 bp, Artificial Sequence
  Description of Artificial Sequence: Synthetic oligonucleotide
  Target: SCN9A; (+) strand; PAM type: YTN; PAM sequence: TTG
gatttaattctttttcatac

SEQ ID NO: 101977 - DNA, 20 bp, Artificial Sequence
  Description of Artificial Sequence: Synthetic oligonucleotide
  Target: SCN9A; (+) strand; PAM type: YTN; PAM sequence: TTT
aattctttttcatacttcat

SEQ ID NO: 101978 - DNA, 20 bp, Artificial Sequence
  Description of Artificial Sequence: Synthetic oligonucleotide
  Target: SCN9A; (+) strand; PAM type: YTN; PAM sequence: TTA
attctttttcatacttcatt

SEQ ID NO: 101979 - DNA, 20 bp, Artificial Sequence
  Description of Artificial Sequence: Synthetic oligonucleotide
  Target: SCN9A; (+) strand; PAM type: YTN; PAM sequence: TTC
tttttcatacttcatttaat

SEQ ID NO: 101980 - DNA, 20 bp, Artificial Sequence
  Description of Artificial Sequence: Synthetic oligonucleotide
  Target: SCN9A; (+) strand; PAM type: YTN; PAM sequence: CTT
tttcatacttcatttaattt

SEQ ID NO: 101981 - DNA, 20 bp, Artificial Sequence
  Description of Artificial Sequence: Synthetic oligonucleotide
  Target: SCN9A; (+) strand; PAM type: YTN; PAM sequence: TTT
ttcatacttcatttaatttt

SEQ ID NO: 101982 - DNA, 20 bp, Artificial Sequence
  Description of Artificial Sequence: Synthetic oligonucleotide
  Target: SCN9A; (+) strand; PAM type: YTN; PAM sequence: TTT
tcatacttcatttaattttt

SEQ ID NO: 101983 - DNA, 20 bp, Artificial Sequence
  Description of Artificial Sequence: Synthetic oligonucleotide
  Target: SCN9A; (+) strand; PAM type: YTN; PAM sequence: TTT
catacttcatttaatttttt

SEQ ID NO: 101984 - DNA, 20 bp, Artificial Sequence
  Description of Artificial Sequence: Synthetic oligonucleotide
  Target: SCN9A; (+) strand; PAM type: YTN; PAM sequence: TTC
atacttcatttaattttttc

SEQ ID NO: 101985 - DNA, 20 bp, Artificial Sequence
  Description of Artificial Sequence: Synthetic oligonucleotide
  Target: SCN9A; (+) strand; PAM type: YTN; PAM sequence: CTT
catttaattttttctgttac

SEQ ID NO: 101986 - DNA, 20 bp, Artificial Sequence
  Description of Artificial Sequence: Synthetic oligonucleotide
  Target: SCN9A; (+) strand; PAM type: YTN; PAM sequence: TTC
atttaattttttctgttacc

SEQ ID NO: 101987 - DNA, 20 bp, Artificial Sequence
  Description of Artificial Sequence: Synthetic oligonucleotide
  Target: SCN9A; (+) strand; PAM type: YTN; PAM sequence: TTT
aattttttctgttacctttc

SEQ ID NO: 101988 - DNA, 20 bp, Artificial Sequence
  Description of Artificial Sequence: Synthetic oligonucleotide
  Target: SCN9A; (+) strand; PAM type: YTN; PAM sequence: TTA
attttttctgttacctttca

SEQ ID NO: 101989 - DNA, 20 bp, Artificial Sequence
  Description of Artificial Sequence: Synthetic oligonucleotide
  Target: SCN9A; (+) strand; PAM type: YTN; PAM sequence: TTT
tttctgttacctttcaggta

SEQ ID NO: 101990 - DNA, 20 bp, Artificial Sequence
  Description of Artificial Sequence: Synthetic oligonucleotide
  Target: SCN9A; (+) strand; PAM type: YTN; PAM sequence: TTT
ttctgttacctttcaggtag

SEQ ID NO: 101991 - DNA, 20 bp, Artificial Sequence
  Description of Artificial Sequence: Synthetic oligonucleotide
  Target: SCN9A; (+) strand; PAM type: YTN; PAM sequence: TTT
tctgttacctttcaggtagc

SEQ ID NO: 101992 - DNA, 20 bp, Artificial Sequence
  Description of Artificial Sequence: Synthetic oligonucleotide
  Target: SCN9A; (+) strand; PAM type: YTN; PAM sequence: TTT
ctgttacctttcaggtagca

SEQ ID NO: 101993 - DNA, 20 bp, Artificial Sequence
  Description of Artificial Sequence: Synthetic oligonucleotide
  Target: SCN9A; (+) strand; PAM type: YTN; PAM sequence: TTC
tgttacctttcaggtagcag

SEQ ID NO: 101994 - DNA, 20 bp, Artificial Sequence
  Description of Artificial Sequence: Synthetic oligonucleotide
  Target: SCN9A; (+) strand; PAM type: YTN; PAM sequence: CTG
ttacctttcaggtagcagag

SEQ ID NO: 101995 - DNA, 20 bp, Artificial Sequence
  Description of Artificial Sequence: Synthetic oligonucleotide
  Target: SCN9A; (+) strand; PAM type: YTN; PAM sequence: TTA
cctttcaggtagcagagatc

SEQ ID NO: 101996 - DNA, 20 bp, Artificial Sequence
  Description of Artificial Sequence: Synthetic oligonucleotide
  Target: SCN9A; (+) strand; PAM type: YTN; PAM sequence: CTT
tcaggtagcagagatctctg

SEQ ID NO: 101997 - DNA, 20 bp, Artificial Sequence
  Description of Artificial Sequence: Synthetic oligonucleotide
  Target: SCN9A; (+) strand; PAM type: YTN; PAM sequence: TTT
caggtagcagagatctctgg

SEQ ID NO: 101998 - DNA, 20 bp, Artificial Sequence
  Description of Artificial Sequence: Synthetic oligonucleotide
  Target: SCN9A; (+) strand; PAM type: YTN; PAM sequence: TTC
aggtagcagagatctctgga

SEQ ID NO: 101999 - DNA, 20 bp, Artificial Sequence
  Description of Artificial Sequence: Synthetic oligonucleotide
  Target: SCN9A; (+) strand; PAM type: YTN; PAM sequence: CTC
tggaggtgaaacattgctct

SEQ ID NO: 102000 - DNA, 20 bp, Artificial Sequence
  Description of Artificial Sequence: Synthetic oligonucleotide
  Target: SCN9A; (+) strand; PAM type: YTN; PAM sequence: CTG
gaggtgaaacattgctctga

SEQ ID NO: 102001 - DNA, 20 bp, Artificial Sequence
  Description of Artificial Sequence: Synthetic oligonucleotide
  Target: SCN9A; (+) strand; PAM type: YTN; PAM sequence: TTG
ctctgaactggcattgattc

SEQ ID NO: 102002 - DNA, 20 bp, Artificial Sequence
  Description of Artificial Sequence: Synthetic oligonucleotide
  Target: SCN9A; (+) strand; PAM type: YTN; PAM sequence: CTC
tgaactggcattgattctag

SEQ ID NO: 102003 - DNA, 20 bp, Artificial Sequence
  Description of Artificial Sequence: Synthetic oligonucleotide
  Target: SCN9A; (+) strand; PAM type: YTN; PAM sequence: CTG
aactggcattgattctagcc

SEQ ID NO: 102004 - DNA, 20 bp, Artificial Sequence
  Description of Artificial Sequence: Synthetic oligonucleotide
  Target: SCN9A; (+) strand; PAM type: YTN; PAM sequence: CTG
gcattgattctagcccagct

SEQ ID NO: 102005 - DNA, 20 bp, Artificial Sequence
  Description of Artificial Sequence: Synthetic oligonucleotide
  Target: SCN9A; (+) strand; PAM type: YTN; PAM sequence: TTG
attctagcccagctcttgta

SEQ ID NO: 102006 - DNA, 20 bp, Artificial Sequence
  Description of Artificial Sequence: Synthetic oligonucleotide
  Target: SCN9A; (+) strand; PAM type: YTN; PAM sequence: TTC
tagcccagctcttgtagacc

SEQ ID NO: 102007 - DNA, 20 bp, Artificial Sequence
  Description of Artificial Sequence: Synthetic oligonucleotide
  Target: SCN9A; (+) strand; PAM type: YTN; PAM sequence: CTA
gcccagctcttgtagaccaa

SEQ ID NO: 102008 - DNA, 20 bp, Artificial Sequence
  Description of Artificial Sequence: Synthetic oligonucleotide
  Target: SCN9A; (+) strand; PAM type: YTN; PAM sequence: CTC
ttgtagaccaattaccaact

SEQ ID NO: 102009 - DNA, 20 bp, Artificial Sequence
  Description of Artificial Sequence: Synthetic oligonucleotide
  Target: SCN9A; (+) strand; PAM type: YTN; PAM sequence: CTT
gtagaccaattaccaacttg

SEQ ID NO: 102010 - DNA, 20 bp, Artificial Sequence
  Description of Artificial Sequence: Synthetic oligonucleotide
  Target: SCN9A; (+) strand; PAM type: YTN; PAM sequence: TTG
tagaccaattaccaacttgt

SEQ ID NO: 102011 - DNA, 20 bp, Artificial Sequence
  Description of Artificial Sequence: Synthetic oligonucleotide
  Target: SCN9A; (+) strand; PAM type: YTN; PAM sequence: TTA
ccaacttgtaagtaaacatg

SEQ ID NO: 102012 - DNA, 20 bp, Artificial Sequence
  Description of Artificial Sequence: Synthetic oligonucleotide
  Target: SCN9A; (+) strand; PAM type: YTN; PAM sequence: CTT
gtaagtaaacatgttcatga

SEQ ID NO: 102013 - DNA, 20 bp, Artificial Sequence
  Description of Artificial Sequence: Synthetic oligonucleotide
  Target: SCN9A; (+) strand; PAM type: YTN; PAM sequence: TTG
taagtaaacatgttcatgat

SEQ ID NO: 102014 - DNA, 20 bp, Artificial Sequence
  Description of Artificial Sequence: Synthetic oligonucleotide
  Target: SCN9A; (+) strand; PAM type: YTN; PAM sequence: TTC
atgattcttcattctgacaa

SEQ ID NO: 102015 - DNA, 20 bp, Artificial Sequence
  Description of Artificial Sequence: Synthetic oligonucleotide
  Target: SCN9A; (+) strand; PAM type: YTN; PAM sequence: TTC
ttcattctgacaagcccatg

SEQ ID NO: 102016 - DNA, 20 bp, Artificial Sequence
  Description of Artificial Sequence: Synthetic oligonucleotide
  Target: SCN9A; (+) strand; PAM type: YTN; PAM sequence: CTT
cattctgacaagcccatgct

SEQ ID NO: 102017 - DNA, 20 bp, Artificial Sequence
  Description of Artificial Sequence: Synthetic oligonucleotide
  Target: SCN9A; (+) strand; PAM type: YTN; PAM sequence: TTC
attctgacaagcccatgctt

SEQ ID NO: 102018 - DNA, 20 bp, Artificial Sequence
  Description of Artificial Sequence: Synthetic oligonucleotide
  Target: SCN9A; (+) strand; PAM type: YTN; PAM sequence: TTC
tgacaagcccatgcttctca

SEQ ID NO: 102019 - DNA, 20 bp, Artificial Sequence
  Description of Artificial Sequence: Synthetic oligonucleotide
  Target: SCN9A; (+) strand; PAM type: YTN; PAM sequence: CTG
acaagcccatgcttctcagt

SEQ ID NO: 102020 - DNA, 20 bp, Artificial Sequence
  Description of Artificial Sequence: Synthetic oligonucleotide
  Target: SCN9A; (+) strand; PAM type: YTN; PAM sequence: CTT
ctcagtcttcatgtggaaac

SEQ ID NO: 102021 - DNA, 20 bp, Artificial Sequence
  Description of Artificial Sequence: Synthetic oligonucleotide
  Target: SCN9A; (+) strand; PAM type: YTN; PAM sequence: TTC
tcagtcttcatgtggaaact

SEQ ID NO: 102022 - DNA, 20 bp, Artificial Sequence
  Description of Artificial Sequence: Synthetic oligonucleotide
  Target: SCN9A; (+) strand; PAM type: YTN; PAM sequence: CTC
agtcttcatgtggaaactat

SEQ ID NO: 102023 - DNA, 20 bp, Artificial Sequence
  Description of Artificial Sequence: Synthetic oligonucleotide
  Target: SCN9A; (+) strand; PAM type: YTN; PAM sequence: CTT
catgtggaaactatgcattt

SEQ ID NO: 102024 - DNA, 20 bp, Artificial Sequence
  Description of Artificial Sequence: Synthetic oligonucleotide
  Target: SCN9A; (+) strand; PAM type: YTN; PAM sequence: TTC
atgtggaaactatgcatttc

SEQ ID NO: 102025 - DNA, 20 bp, Artificial Sequence
  Description of Artificial Sequence: Synthetic oligonucleotide
  Target: SCN9A; (+) strand; PAM type: YTN; PAM sequence: CTA
tgcatttccagtttttaagc

SEQ ID NO: 102026 - DNA, 20 bp, Artificial Sequence
  Description of Artificial Sequence: Synthetic oligonucleotide
  Target: SCN9A; (+) strand; PAM type: YTN; PAM sequence: TTT
ccagtttttaagcacccaat

SEQ ID NO: 102027 - DNA, 20 bp, Artificial Sequence
  Description of Artificial Sequence: Synthetic oligonucleotide
  Target: SCN9A; (+) strand; PAM type: YTN; PAM sequence: TTC
cagtttttaagcacccaatg

SEQ ID NO: 102028 - DNA, 20 bp, Artificial Sequence
  Description of Artificial Sequence: Synthetic oligonucleotide
  Target: SCN9A; (+) strand; PAM type: YTN; PAM sequence: TTT
ttaagcacccaatgttcaat

SEQ ID NO: 102029 - DNA, 20 bp, Artificial Sequence
  Description of Artificial Sequence: Synthetic oligonucleotide
  Target: SCN9A; (+) strand; PAM type: YTN; PAM sequence: TTT
taagcacccaatgttcaatc

SEQ ID NO: 102030 - DNA, 20 bp, Artificial Sequence
  Description of Artificial Sequence: Synthetic oligonucleotide
  Target: SCN9A; (+) strand; PAM type: YTN; PAM sequence: TTT
aagcacccaatgttcaatcc

SEQ ID NO: 102031 - DNA, 20 bp, Artificial Sequence
  Description of Artificial Sequence: Synthetic oligonucleotide
  Target: SCN9A; (+) strand; PAM type: YTN; PAM sequence: TTA
agcacccaatgttcaatcca

SEQ ID NO: 102032 - DNA, 20 bp, Artificial Sequence
  Description of Artificial Sequence: Synthetic oligonucleotide
  Target: SCN9A; (+) strand; PAM type: YTN; PAM sequence: TTC
aatccatcaacaaatccctt

SEQ ID NO: 102033 - DNA, 20 bp, Artificial Sequence
  Description of Artificial Sequence: Synthetic oligonucleotide
  Target: SCN9A; (+) strand; PAM type: YTN; PAM sequence: CTT
cagctctaacttcaaaatat

SEQ ID NO: 102034 - DNA, 20 bp, Artificial Sequence
  Description of Artificial Sequence: Synthetic oligonucleotide
  Target: SCN9A; (+) strand; PAM type: YTN; PAM sequence: TTC
agctctaacttcaaaatata

SEQ ID NO: 102035 - DNA, 20 bp, Artificial Sequence
  Description of Artificial Sequence: Synthetic oligonucleotide
  Target: SCN9A; (+) strand; PAM type: YTN; PAM sequence: CTC
taacttcaaaatatactcag

SEQ ID NO: 102036 - DNA, 20 bp, Artificial Sequence
  Description of Artificial Sequence: Synthetic oligonucleotide
  Target: SCN9A; (+) strand; PAM type: YTN; PAM sequence: CTA
acttcaaaatatactcagca

SEQ ID NO: 102037 - DNA, 20 bp, Artificial Sequence
  Description of Artificial Sequence: Synthetic oligonucleotide
  Target: SCN9A; (+) strand; PAM type: YTN; PAM sequence: CTT
caaaatatactcagcatgtc

SEQ ID NO: 102038 - DNA, 20 bp, Artificial Sequence
  Description of Artificial Sequence: Synthetic oligonucleotide
  Target: SCN9A; (+) strand; PAM type: YTN; PAM sequence: TTC
aaaatatactcagcatgtca

SEQ ID NO: 102039 - DNA, 20 bp, Artificial Sequence
  Description of Artificial Sequence: Synthetic oligonucleotide
  Target: SCN9A; (+) strand; PAM type: YTN; PAM sequence: CTC
agcatgtcacaccctcacta

SEQ ID NO: 102040 - DNA, 20 bp, Artificial Sequence
  Description of Artificial Sequence: Synthetic oligonucleotide
  Target: SCN9A; (+) strand; PAM type: YTN; PAM sequence: CTC
actatacaaaactctaccat

SEQ ID NO: 102041 - DNA, 20 bp, Artificial Sequence
  Description of Artificial Sequence: Synthetic oligonucleotide
  Target: SCN9A; (+) strand; PAM type: YTN; PAM sequence: CTA
tacaaaactctaccatacta

SEQ ID NO: 102042 - DNA, 20 bp, Artificial Sequence
  Description of Artificial Sequence: Synthetic oligonucleotide
  Target: SCN9A; (+) strand; PAM type: YTN; PAM sequence: CTC
taccatactagtctaagctc

SEQ ID NO: 102043 - DNA, 20 bp, Artificial Sequence
  Description of Artificial Sequence: Synthetic oligonucleotide
  Target: SCN9A; (+) strand; PAM type: YTN; PAM sequence: CTA
ccatactagtctaagctccc

SEQ ID NO: 102044 - DNA, 20 bp, Artificial Sequence
  Description of Artificial Sequence: Synthetic oligonucleotide
  Target: SCN9A; (+) strand; PAM type: YTN; PAM sequence: CTA
gtctaagctcccatcacctc

SEQ ID NO: 102045 - DNA, 20 bp, Artificial Sequence
  Description of Artificial Sequence: Synthetic oligonucleotide
  Target: SCN9A; (+) strand; PAM type: YTN; PAM sequence: CTA
agctcccatcacctctcacc

SEQ ID NO: 102046 - DNA, 20 bp, Artificial Sequence
  Description of Artificial Sequence: Synthetic oligonucleotide
  Target: SCN9A; (+) strand; PAM type: YTN; PAM sequence: CTC
ccatcacctctcacctggat

SEQ ID NO: 102047 - DNA, 20 bp, Artificial Sequence
  Description of Artificial Sequence: Synthetic oligonucleotide
  Target: SCN9A; (+) strand; PAM type: YTN; PAM sequence: CTC
tcacctggatttatgcagaa

SEQ ID NO: 102048 - DNA, 20 bp, Artificial Sequence
  Description of Artificial Sequence: Synthetic oligonucleotide
  Target: SCN9A; (+) strand; PAM type: YTN; PAM sequence: CTC
acctggatttatgcagaaac

SEQ ID NO: 102049 - DNA, 20 bp, Artificial Sequence
  Description of Artificial Sequence: Synthetic oligonucleotide
  Target: SCN9A; (+) strand; PAM type: YTN; PAM sequence: CTG
gatttatgcagaaactccaa

SEQ ID NO: 102050 - DNA, 20 bp, Artificial Sequence
  Description of Artificial Sequence: Synthetic oligonucleotide
  Target: SCN9A; (+) strand; PAM type: YTN; PAM sequence: TTT
atgcagaaactccaagaaat

SEQ ID NO: 102051 - DNA, 20 bp, Artificial Sequence
  Description of Artificial Sequence: Synthetic oligonucleotide
  Target: SCN9A; (+) strand; PAM type: YTN; PAM sequence: TTA
tgcagaaactccaagaaatc

SEQ ID NO: 102052 - DNA, 20 bp, Artificial Sequence
  Description of Artificial Sequence: Synthetic oligonucleotide
  Target: SCN9A; (+) strand; PAM type: YTN; PAM sequence: CTC
caagaaatcttccagcttct

SEQ ID NO: 102053 - DNA, 20 bp, Artificial Sequence
  Description of Artificial Sequence: Synthetic oligonucleotide
  Target: SCN9A; (+) strand; PAM type: YTN; PAM sequence: CTT
ccagcttctgccattgctat

SEQ ID NO: 102054 - DNA, 20 bp, Artificial Sequence
  Description of Artificial Sequence: Synthetic oligonucleotide
  Target: SCN9A; (+) strand; PAM type: YTN; PAM sequence: TTC
cagcttctgccattgctatt

SEQ ID NO: 102055 - DNA, 20 bp, Artificial Sequence
  Description of Artificial Sequence: Synthetic oligonucleotide
  Target: SCN9A; (+) strand; PAM type: YTN; PAM sequence: CTT
ctgccattgctattcgccct

SEQ ID NO: 102056 - DNA, 20 bp, Artificial Sequence
  Description of Artificial Sequence: Synthetic oligonucleotide
  Target: SCN9A; (+) strand; PAM type: YTN; PAM sequence: TTC
tgccattgctattcgccctt

SEQ ID NO: 102057 - DNA, 20 bp, Artificial Sequence
  Description of Artificial Sequence: Synthetic oligonucleotide
  Target: SCN9A; (+) strand; PAM type: YTN; PAM sequence: CTG
ccattgctattcgcccttcc

SEQ ID NO: 102058 - DNA, 20 bp, Artificial Sequence
  Description of Artificial Sequence: Synthetic oligonucleotide
  Target: SCN9A; (+) strand; PAM type: YTN; PAM sequence: TTG
ctattcgcccttccactctt

SEQ ID NO: 102059 - DNA, 20 bp, Artificial Sequence
  Description of Artificial Sequence: Synthetic oligonucleotide
  Target: SCN9A; (+) strand; PAM type: YTN; PAM sequence: CTA
ttcgcccttccactcttaag

SEQ ID NO: 102060 - DNA, 20 bp, Artificial Sequence
  Description of Artificial Sequence: Synthetic oligonucleotide
  Target: SCN9A; (+) strand; PAM type: YTN; PAM sequence: TTC
gcccttccactcttaagatt

SEQ ID NO: 102061 - DNA, 20 bp, Artificial Sequence
  Description of Artificial Sequence: Synthetic oligonucleotide
  Target: SCN9A; (+) strand; PAM type: YTN; PAM sequence: CTT
ccactcttaagattgcacat

SEQ ID NO: 102062 - DNA, 20 bp, Artificial Sequence
  Description of Artificial Sequence: Synthetic oligonucleotide
  Target: SCN9A; (+) strand; PAM type: YTN; PAM sequence: TTC
cactcttaagattgcacatt

SEQ ID NO: 102063 - DNA, 20 bp, Artificial Sequence
  Description of Artificial Sequence: Synthetic oligonucleotide
  Target: SCN9A; (+) strand; PAM type: YTN; PAM sequence: CTC
ttaagattgcacattgtgag

SEQ ID NO: 102064 - DNA, 20 bp, Artificial Sequence
  Description of Artificial Sequence: Synthetic oligonucleotide
  Target: SCN9A; (+) strand; PAM type: YTN; PAM sequence: CTT
aagattgcacattgtgagat

SEQ ID NO: 102065 - DNA, 20 bp, Artificial Sequence
  Description of Artificial Sequence: Synthetic oligonucleotide
  Target: SCN9A; (+) strand; PAM type: YTN; PAM sequence: TTA
agattgcacattgtgagatt

SEQ ID NO: 102066 - DNA, 20 bp, Artificial Sequence
  Description of Artificial Sequence: Synthetic oligonucleotide
  Target: SCN9A; (+) strand; PAM type: YTN; PAM sequence: TTG
cacattgtgagattttaaaa

SEQ ID NO: 102067 - DNA, 20 bp, Artificial Sequence
  Description of Artificial Sequence: Synthetic oligonucleotide
  Target: SCN9A; (+) strand; PAM type: YTN; PAM sequence: TTG
tgagattttaaaatcacatc

SEQ ID NO: 102068 - DNA, 20 bp, Artificial Sequence
  Description of Artificial Sequence: Synthetic oligonucleotide
  Target: SCN9A; (+) strand; PAM type: YTN; PAM sequence: TTT
taaaatcacatccttataat

SEQ ID NO: 102069 - DNA, 20 bp, Artificial Sequence
  Description of Artificial Sequence: Synthetic oligonucleotide
  Target: SCN9A; (+) strand; PAM type: YTN; PAM sequence: TTT
aaaatcacatccttataatg

SEQ ID NO: 102070 - DNA, 20 bp, Artificial Sequence
  Description of Artificial Sequence: Synthetic oligonucleotide
  Target: SCN9A; (+) strand; PAM type: YTN; PAM sequence: TTA
aaatcacatccttataatgt

SEQ ID NO: 102071 - DNA, 20 bp, Artificial Sequence
  Description of Artificial Sequence: Synthetic oligonucleotide
  Target: SCN9A; (+) strand; PAM type: YTN; PAM sequence: CTT
ataatgttcttcaaatgtct

SEQ ID NO: 102072 - DNA, 20 bp, Artificial Sequence
  Description of Artificial Sequence: Synthetic oligonucleotide
  Target: SCN9A; (+) strand; PAM type: YTN; PAM sequence: TTA
taatgttcttcaaatgtctt

SEQ ID NO: 102073 - DNA, 20 bp, Artificial Sequence
  Description of Artificial Sequence: Synthetic oligonucleotide
  Target: SCN9A; (+) strand; PAM type: YTN; PAM sequence: TTC
ttcaaatgtcttataatctg

SEQ ID NO: 102074 - DNA, 20 bp, Artificial Sequence
  Description of Artificial Sequence: Synthetic oligonucleotide
  Target: SCN9A; (+) strand; PAM type: YTN; PAM sequence: CTT
caaatgtcttataatctggc

SEQ ID NO: 102075 - DNA, 20 bp, Artificial Sequence
  Description of Artificial Sequence: Synthetic oligonucleotide
  Target: SCN9A; (+) strand; PAM type: YTN; PAM sequence: TTC
aaatgtcttataatctggcc

SEQ ID NO: 102076 - DNA, 20 bp, Artificial Sequence
  Description of Artificial Sequence: Synthetic oligonucleotide
  Target: SCN9A; (+) strand; PAM type: YTN; PAM sequence: CTT
ataatctggcctctactaca

SEQ ID NO: 102077 - DNA, 20 bp, Artificial Sequence
  Description of Artificial Sequence: Synthetic oligonucleotide
  Target: SCN9A; (+) strand; PAM type: YTN; PAM sequence: TTA
taatctggcctctactacat

SEQ ID NO: 102078 - DNA, 20 bp, Artificial Sequence
  Description of Artificial Sequence: Synthetic oligonucleotide
  Target: SCN9A; (+) strand; PAM type: YTN; PAM sequence: CTG
gcctctactacatctctgat

SEQ ID NO: 102079 - DNA, 20 bp, Artificial Sequence
  Description of Artificial Sequence: Synthetic oligonucleotide
  Target: SCN9A; (+) strand; PAM type: YTN; PAM sequence: CTC
tactacatctctgatctaca

SEQ ID NO: 102080 - DNA, 20 bp, Artificial Sequence
  Description of Artificial Sequence: Synthetic oligonucleotide
  Target: SCN9A; (+) strand; PAM type: YTN; PAM sequence: CTA
ctacatctctgatctacact

SEQ ID NO: 102081 - DNA, 20 bp, Artificial Sequence
  Description of Artificial Sequence: Synthetic oligonucleotide
  Target: SCN9A; (+) strand; PAM type: YTN; PAM sequence: CTA
catctctgatctacactttt

SEQ ID NO: 102082 - DNA, 20 bp, Artificial Sequence
  Description of Artificial Sequence: Synthetic oligonucleotide
  Target: SCN9A; (+) strand; PAM type: YTN; PAM sequence: CTC
tgatctacactttttaaaaa

SEQ ID NO: 102083 - DNA, 20 bp, Artificial Sequence
  Description of Artificial Sequence: Synthetic oligonucleotide
  Target: SCN9A; (+) strand; PAM type: YTN; PAM sequence: CTG
atctacactttttaaaaata

SEQ ID NO: 102084 - DNA, 20 bp, Artificial Sequence
  Description of Artificial Sequence: Synthetic oligonucleotide
  Target: SCN9A; (+) strand; PAM type: YTN; PAM sequence: CTA
cactttttaaaaataatgtc

SEQ ID NO: 102085 - DNA, 20 bp, Artificial Sequence
  Description of Artificial Sequence: Synthetic oligonucleotide
  Target: SCN9A; (+) strand; PAM type: YTN; PAM sequence: CTT
tttaaaaataatgtcatttg

SEQ ID NO: 102086 - DNA, 20 bp, Artificial Sequence
  Description of Artificial Sequence: Synthetic oligonucleotide
  Target: SCN9A; (+) strand; PAM type: YTN; PAM sequence: TTT
ttaaaaataatgtcatttgt

SEQ ID NO: 102087 - DNA, 20 bp, Artificial Sequence
  Description of Artificial Sequence: Synthetic oligonucleotide
  Target: SCN9A; (+) strand; PAM type: YTN; PAM sequence: TTT
taaaaataatgtcatttgtt

SEQ ID NO: 102088 - DNA, 20 bp, Artificial Sequence
  Description of Artificial Sequence: Synthetic oligonucleotide
  Target: SCN9A; (+) strand; PAM type: YTN; PAM sequence: TTT
aaaaataatgtcatttgttt

SEQ ID NO: 102089 - DNA, 20 bp, Artificial Sequence
  Description of Artificial Sequence: Synthetic oligonucleotide
  Target: SCN9A; (+) strand; PAM type: YTN; PAM sequence: TTA
aaaataatgtcatttgtttt

SEQ ID NO: 102090 - DNA, 20 bp, Artificial Sequence
  Description of Artificial Sequence: Synthetic oligonucleotide
  Target: SCN9A; (+) strand; PAM type: YTN; PAM sequence: TTT
gttttatttgtttgtttgtt

SEQ ID NO: 102091 - DNA, 20 bp, Artificial Sequence
  Description of Artificial Sequence: Synthetic oligonucleotide
  Target: SCN9A; (+) strand; PAM type: YTN; PAM sequence: TTG
ttttatttgtttgtttgttg

SEQ ID NO: 102092 - DNA, 20 bp, Artificial Sequence
  Description of Artificial Sequence: Synthetic oligonucleotide
  Target: SCN9A; (+) strand; PAM type: YTN; PAM sequence: TTT
tatttgtttgtttgttggag

SEQ ID NO: 102093 - DNA, 20 bp, Artificial Sequence
  Description of Artificial Sequence: Synthetic oligonucleotide
  Target: SCN9A; (+) strand; PAM type: YTN; PAM sequence: TTT
atttgtttgtttgttggaga

SEQ ID NO: 102094 - DNA, 20 bp, Artificial Sequence
  Description of Artificial Sequence: Synthetic oligonucleotide
  Target: SCN9A; (+) strand; PAM type: YTN; PAM sequence: TTA
tttgtttgtttgttggagac

SEQ ID NO: 102095 - DNA, 20 bp, Artificial Sequence
  Description of Artificial Sequence: Synthetic oligonucleotide
  Target: SCN9A; (+) strand; PAM type: YTN; PAM sequence: TTT
gtttgtttgttggagacaga

SEQ ID NO: 102096 - DNA, 20 bp, Artificial Sequence
  Description of Artificial Sequence: Synthetic oligonucleotide
  Target: SCN9A; (+) strand; PAM type: YTN; PAM sequence: TTG
tttgtttgttggagacagag

SEQ ID NO: 102097 - DNA, 20 bp, Artificial Sequence
  Description of Artificial Sequence: Synthetic oligonucleotide
  Target: SCN9A; (+) strand; PAM type: YTN; PAM sequence: TTT
gtttgttggagacagagtct

SEQ ID NO: 102098 - DNA, 20 bp, Artificial Sequence
  Description of Artificial Sequence: Synthetic oligonucleotide
  Target: SCN9A; (+) strand; PAM type: YTN; PAM sequence: TTG
tttgttggagacagagtctt

SEQ ID NO: 102099 - DNA, 20 bp, Artificial Sequence
  Description of Artificial Sequence: Synthetic oligonucleotide
  Target: SCN9A; (+) strand; PAM type: YTN; PAM sequence: TTT
gttggagacagagtcttcct

SEQ ID NO: 102100 - DNA, 20 bp, Artificial Sequence
  Description of Artificial Sequence: Synthetic oligonucleotide
  Target: SCN9A; (+) strand; PAM type: YTN; PAM sequence: TTG
ttggagacagagtcttcctc

SEQ ID NO: 102101 - DNA, 20 bp, Artificial Sequence
  Description of Artificial Sequence: Synthetic oligonucleotide
  Target: SCN9A; (+) strand; PAM type: YTN; PAM sequence: TTG
gagacagagtcttcctctgt

SEQ ID NO: 102102 - DNA, 20 bp, Artificial Sequence
  Description of Artificial Sequence: Synthetic oligonucleotide
  Target: SCN9A; (+) strand; PAM type: YTN; PAM sequence: CTT
cctctgtcgtccaggctgga

SEQ ID NO: 102103 - DNA, 20 bp, Artificial Sequence
  Description of Artificial Sequence: Synthetic oligonucleotide
  Target: SCN9A; (+) strand; PAM type: YTN; PAM sequence: TTC
ctctgtcgtccaggctggag

SEQ ID NO: 102104 - DNA, 20 bp, Artificial Sequence
  Description of Artificial Sequence: Synthetic oligonucleotide
  Target: SCN9A; (+) strand; PAM type: YTN; PAM sequence: CTC
tgtcgtccaggctggagtgc

SEQ ID NO: 102105 - DNA, 20 bp, Artificial Sequence
  Description of Artificial Sequence: Synthetic oligonucleotide
  Target: SCN9A; (+) strand; PAM type: YTN; PAM sequence: CTG
tcgtccaggctggagtgcag

SEQ ID NO: 102106 - DNA, 20 bp, Artificial Sequence
  Description of Artificial Sequence: Synthetic oligonucleotide
  Target: SCN9A; (+) strand; PAM type: YTN; PAM sequence: CTG
gagtgcagtggcacaatctt

SEQ ID NO: 102107 - DNA, 20 bp, Artificial Sequence
  Description of Artificial Sequence: Synthetic oligonucleotide
  Target: SCN9A; (+) strand; PAM type: YTN; PAM sequence: CTT
ggctcactgcaacctctgcc

SEQ ID NO: 102108 - DNA, 20 bp, Artificial Sequence
  Description of Artificial Sequence: Synthetic oligonucleotide
  Target: SCN9A; (+) strand; PAM type: YTN; PAM sequence: TTG
gctcactgcaacctctgcct

SEQ ID NO: 102109 - DNA, 20 bp, Artificial Sequence
  Description of Artificial Sequence: Synthetic oligonucleotide
  Target: SCN9A; (+) strand; PAM type: YTN; PAM sequence: CTC
actgcaacctctgcctcctg

SEQ ID NO: 102110 - DNA, 20 bp, Artificial Sequence
  Description of Artificial Sequence: Synthetic oligonucleotide
  Target: SCN9A; (+) strand; PAM type: YTN; PAM sequence: CTG
caacctctgcctcctggatt

SEQ ID NO: 102111 - DNA, 20 bp, Artificial Sequence
  Description of Artificial Sequence: Synthetic oligonucleotide
  Target: SCN9A; (+) strand; PAM type: YTN; PAM sequence: CTC
tgcctcctggattcaagtaa

SEQ ID NO: 102112 - DNA, 20 bp, Artificial Sequence
  Description of Artificial Sequence: Synthetic oligonucleotide
  Target: SCN9A; (+) strand; PAM type: YTN; PAM sequence: CTG
cctcctggattcaagtaatt

SEQ ID NO: 102113 - DNA, 20 bp, Artificial Sequence
  Description of Artificial Sequence: Synthetic oligonucleotide
  Target: SCN9A; (+) strand; PAM type: YTN; PAM sequence: CTC
ctggattcaagtaattctcg

SEQ ID NO: 102114 - DNA, 20 bp, Artificial Sequence
  Description of Artificial Sequence: Synthetic oligonucleotide
  Target: SCN9A; (+) strand; PAM type: YTN; PAM sequence: CTG
gattcaagtaattctcgtgc

SEQ ID NO: 102115 - DNA, 20 bp, Artificial Sequence
  Description of Artificial Sequence: Synthetic oligonucleotide
  Target: SCN9A; (+) strand; PAM type: YTN; PAM sequence: TTC
aagtaattctcgtgcctcag

SEQ ID NO: 102116 - DNA, 20 bp, Artificial Sequence
  Description of Artificial Sequence: Synthetic oligonucleotide
  Target: SCN9A; (+) strand; PAM type: YTN; PAM sequence: TTC
tcgtgcctcagcctcacaag

SEQ ID NO: 102117 - DNA, 20 bp, Artificial Sequence
  Description of Artificial Sequence: Synthetic oligonucleotide
  Target: SCN9A; (+) strand; PAM type: YTN; PAM sequence: CTC
gtgcctcagcctcacaagta

SEQ ID NO: 102118 - DNA, 20 bp, Artificial Sequence
  Description of Artificial Sequence: Synthetic oligonucleotide
  Target: SCN9A; (+) strand; PAM type: YTN; PAM sequence: CTC
agcctcacaagtagctggga

SEQ ID NO: 102119 - DNA, 20 bp, Artificial Sequence
  Description of Artificial Sequence: Synthetic oligonucleotide
  Target: SCN9A; (+) strand; PAM type: YTN; PAM sequence: CTC
acaagtagctgggattatag

SEQ ID NO: 102120 - DNA, 20 bp, Artificial Sequence
  Description of Artificial Sequence: Synthetic oligonucleotide
  Target: SCN9A; (+) strand; PAM type: YTN; PAM sequence: CTG
ggattataggcatgtatcac

SEQ ID NO: 102121 - DNA, 20 bp, Artificial Sequence
  Description of Artificial Sequence: Synthetic oligonucleotide
  Target: SCN9A; (+) strand; PAM type: YTN; PAM sequence: TTA
taggcatgtatcaccaagat

SEQ ID NO: 102122 - DNA, 20 bp, Artificial Sequence
  Description of Artificial Sequence: Synthetic oligonucleotide
  Target: SCN9A; (+) strand; PAM type: YTN; PAM sequence: TTA
atttttttttcattttcagt

SEQ ID NO: 102123 - DNA, 20 bp, Artificial Sequence
  Description of Artificial Sequence: Synthetic oligonucleotide
  Target: SCN9A; (+) strand; PAM type: YTN; PAM sequence: TTT
ttttttcattttcagtaaaa

SEQ ID NO: 102124 - DNA, 20 bp, Artificial Sequence
  Description of Artificial Sequence: Synthetic oligonucleotide
  Target: SCN9A; (+) strand; PAM type: YTN; PAM sequence: TTT
tttttcattttcagtaaaaa

SEQ ID NO: 102125 - DNA, 20 bp, Artificial Sequence
  Description of Artificial Sequence: Synthetic oligonucleotide
  Target: SCN9A; (+) strand; PAM type: YTN; PAM sequence: TTT
ttttcattttcagtaaaaat

SEQ ID NO: 102126 - DNA, 20 bp, Artificial Sequence
  Description of Artificial Sequence: Synthetic oligonucleotide
  Target: SCN9A; (+) strand; PAM type: YTN; PAM sequence: TTT
tttcattttcagtaaaaatg

SEQ ID NO: 102127 - DNA, 20 bp, Artificial Sequence
  Description of Artificial Sequence: Synthetic oligonucleotide
  Target: SCN9A; (+) strand; PAM type: YTN; PAM sequence: TTT
ttcattttcagtaaaaatgg

SEQ ID NO: 102128 - DNA, 20 bp, Artificial Sequence
  Description of Artificial Sequence: Synthetic oligonucleotide
  Target: SCN9A; (+) strand; PAM type: YTN; PAM sequence: TTT
tcattttcagtaaaaatggg

SEQ ID NO: 102129 - DNA, 20 bp, Artificial Sequence
  Description of Artificial Sequence: Synthetic oligonucleotide
  Target: SCN9A; (+) strand; PAM type: YTN; PAM sequence: TTT
cattttcagtaaaaatgggg

SEQ ID NO: 102130 - DNA, 20 bp, Artificial Sequence
  Description of Artificial Sequence: Synthetic oligonucleotide
  Target: SCN9A; (+) strand; PAM type: YTN; PAM sequence: TTC
attttcagtaaaaatggggt

SEQ ID NO: 102131 - DNA, 20 bp, Artificial Sequence
  Description of Artificial Sequence: Synthetic oligonucleotide
  Target: SCN9A; (+) strand; PAM type: YTN; PAM sequence: TTT
tcagtaaaaatggggtttcg

SEQ ID NO: 102132 - DNA, 20 bp, Artificial Sequence
  Description of Artificial Sequence: Synthetic oligonucleotide
  Target: SCN9A; (+) strand; PAM type: YTN; PAM sequence: TTT
cagtaaaaatggggtttcgc

SEQ ID NO: 102133 - DNA, 20 bp, Artificial Sequence
  Description of Artificial Sequence: Synthetic oligonucleotide
  Target: SCN9A; (+) strand; PAM type: YTN; PAM sequence: TTC
agtaaaaatggggtttcgct

SEQ ID NO: 102134 - DNA, 20 bp, Artificial Sequence
  Description of Artificial Sequence: Synthetic oligonucleotide
  Target: SCN9A; (+) strand; PAM type: YTN; PAM sequence: TTT
cgctacgttggccaggctgg

SEQ ID NO: 102135 - DNA, 20 bp, Artificial Sequence
  Description of Artificial Sequence: Synthetic oligonucleotide
  Target: SCN9A; (+) strand; PAM type: YTN; PAM sequence: TTC
gctacgttggccaggctggt

SEQ ID NO: 102136 - DNA, 20 bp, Artificial Sequence
  Description of Artificial Sequence: Synthetic oligonucleotide
  Target: SCN9A; (+) strand; PAM type: YTN; PAM sequence: CTA
cgttggccaggctggtcttg

SEQ ID NO: 102137 - DNA, 20 bp, Artificial Sequence
  Description of Artificial Sequence: Synthetic oligonucleotide
  Target: SCN9A; (+) strand; PAM type: YTN; PAM sequence: TTG
gccaggctggtcttgaactc

SEQ ID NO: 102138 - DNA, 20 bp, Artificial Sequence
  Description of Artificial Sequence: Synthetic oligonucleotide
  Target: SCN9A; (+) strand; PAM type: YTN; PAM sequence: CTG
gtcttgaactcctggcctca

SEQ ID NO: 102139 - DNA, 20 bp, Artificial Sequence
  Description of Artificial Sequence: Synthetic oligonucleotide
  Target: SCN9A; (+) strand; PAM type: YTN; PAM sequence: CTT
gaactcctggcctcaagtga

SEQ ID NO: 102140 - DNA, 20 bp, Artificial Sequence
  Description of Artificial Sequence: Synthetic oligonucleotide
  Target: SCN9A; (+) strand; PAM type: YTN; PAM sequence: TTG
aactcctggcctcaagtgat

SEQ ID NO: 102141 - DNA, 20 bp, Artificial Sequence
  Description of Artificial Sequence: Synthetic oligonucleotide
  Target: SCN9A; (+) strand; PAM type: YTN; PAM sequence: CTC
ctggcctcaagtgatcgccc

SEQ ID NO: 102142 - DNA, 20 bp, Artificial Sequence
  Description of Artificial Sequence: Synthetic oligonucleotide
  Target: SCN9A; (+) strand; PAM type: YTN; PAM sequence: CTG
gcctcaagtgatcgcccacc

SEQ ID NO: 102143 - DNA, 20 bp, Artificial Sequence
  Description of Artificial Sequence: Synthetic oligonucleotide
  Target: SCN9A; (+) strand; PAM type: YTN; PAM sequence: CTC
aagtgatcgcccacctcggc

SEQ ID NO: 102144 - DNA, 20 bp, Artificial Sequence
  Description of Artificial Sequence: Synthetic oligonucleotide
  Target: SCN9A; (+) strand; PAM type: YTN; PAM sequence: CTC
ggcctcccaaagtactggaa

SEQ ID NO: 102145 - DNA, 20 bp, Artificial Sequence
  Description of Artificial Sequence: Synthetic oligonucleotide
  Target: SCN9A; (+) strand; PAM type: YTN; PAM sequence: CTC
ccaaagtactggaattatag

SEQ ID NO: 102146 - DNA, 20 bp, Artificial Sequence
  Description of Artificial Sequence: Synthetic oligonucleotide
  Target: SCN9A; (+) strand; PAM type: YTN; PAM sequence: CTG
gaattataggtgtgagccac

SEQ ID NO: 102147 - DNA, 20 bp, Artificial Sequence
  Description of Artificial Sequence: Synthetic oligonucleotide
  Target: SCN9A; (+) strand; PAM type: YTN; PAM sequence: TTA
taggtgtgagccacttcacc

SEQ ID NO: 102148 - DNA, 20 bp, Artificial Sequence
  Description of Artificial Sequence: Synthetic oligonucleotide
  Target: SCN9A; (+) strand; PAM type: YTN; PAM sequence: CTT
cacccagcctctgaccttaa

SEQ ID NO: 102149 - DNA, 20 bp, Artificial Sequence
  Description of Artificial Sequence: Synthetic oligonucleotide
  Target: SCN9A; (+) strand; PAM type: YTN; PAM sequence: TTC
acccagcctctgaccttaac

SEQ ID NO: 102150 - DNA, 20 bp, Artificial Sequence
  Description of Artificial Sequence: Synthetic oligonucleotide
  Target: SCN9A; (+) strand; PAM type: YTN; PAM sequence: CTC
tgaccttaacttttaatcct

SEQ ID NO: 102151 - DNA, 20 bp, Artificial Sequence
  Description of Artificial Sequence: Synthetic oligonucleotide
  Target: SCN9A; (+) strand; PAM type: YTN; PAM sequence: CTG
accttaacttttaatcctct

SEQ ID NO: 102152 - DNA, 20 bp, Artificial Sequence
  Description of Artificial Sequence: Synthetic oligonucleotide
  Target: SCN9A; (+) strand; PAM type: YTN; PAM sequence: CTT
aacttttaatcctcttccca

SEQ ID NO: 102153 - DNA, 20 bp, Artificial Sequence
  Description of Artificial Sequence: Synthetic oligonucleotide
  Target: SCN9A; (+) strand; PAM type: YTN; PAM sequence: TTA
acttttaatcctcttcccat

SEQ ID NO: 102154 - DNA, 20 bp, Artificial Sequence
  Description of Artificial Sequence: Synthetic oligonucleotide
  Target: SCN9A; (+) strand; PAM type: YTN; PAM sequence: CTT
ttaatcctcttcccatcttt

SEQ ID NO: 102155 - DNA, 20 bp, Artificial Sequence
  Description of Artificial Sequence: Synthetic oligonucleotide
  Target: SCN9A; (+) strand; PAM type: YTN; PAM sequence: TTT
taatcctcttcccatctttc

SEQ ID NO: 102156 - DNA, 20 bp, Artificial Sequence
  Description of Artificial Sequence: Synthetic oligonucleotide
  Target: SCN9A; (+) strand; PAM type: YTN; PAM sequence: TTT
aatcctcttcccatctttca

SEQ ID NO: 102157 - DNA, 20 bp, Artificial Sequence
  Description of Artificial Sequence: Synthetic oligonucleotide
  Target: SCN9A; (+) strand; PAM type: YTN; PAM sequence: TTA
atcctcttcccatctttcat

SEQ ID NO: 102158 - DNA, 20 bp, Artificial Sequence
  Description of Artificial Sequence: Synthetic oligonucleotide
  Target: SCN9A; (+) strand; PAM type: YTN; PAM sequence: CTC
ttcccatctttcattattct

SEQ ID NO: 102159 - DNA, 20 bp, Artificial Sequence
  Description of Artificial Sequence: Synthetic oligonucleotide
  Target: SCN9A; (+) strand; PAM type: YTN; PAM sequence: CTT
cccatctttcattattctcc

SEQ ID NO: 102160 - DNA, 20 bp, Artificial Sequence
  Description of Artificial Sequence: Synthetic oligonucleotide
  Target: SCN9A; (+) strand; PAM type: YTN; PAM sequence: TTC
ccatctttcattattctcca

SEQ ID NO: 102161 - DNA, 20 bp, Artificial Sequence
  Description of Artificial Sequence: Synthetic oligonucleotide
  Target: SCN9A; (+) strand; PAM type: YTN; PAM sequence: CTT
tcattattctccatctattt

SEQ ID NO: 102162 - DNA, 20 bp, Artificial Sequence
  Description of Artificial Sequence: Synthetic oligonucleotide
  Target: SCN9A; (+) strand; PAM type: YTN; PAM sequence: TTT
cattattctccatctatttt

SEQ ID NO: 102163 - DNA, 20 bp, Artificial Sequence
  Description of Artificial Sequence: Synthetic oligonucleotide
  Target: SCN9A; (+) strand; PAM type: YTN; PAM sequence: TTC
attattctccatctattttg

SEQ ID NO: 102164 - DNA, 20 bp, Artificial Sequence
  Description of Artificial Sequence: Synthetic oligonucleotide
  Target: SCN9A; (+) strand; PAM type: YTN; PAM sequence: TTA
ttctccatctattttggcct

SEQ ID NO: 102165 - DNA, 20 bp, Artificial Sequence
  Description of Artificial Sequence: Synthetic oligonucleotide
  Target: SCN9A; (+) strand; PAM type: YTN; PAM sequence: TTC
tccatctattttggcctctt

SEQ ID NO: 102166 - DNA, 20 bp, Artificial Sequence
  Description of Artificial Sequence: Synthetic oligonucleotide
  Target: SCN9A; (+) strand; PAM type: YTN; PAM sequence: CTC
catctattttggcctcttgg

SEQ ID NO: 102167 - DNA, 20 bp, Artificial Sequence
  Description of Artificial Sequence: Synthetic oligonucleotide
  Target: SCN9A; (+) strand; PAM type: YTN; PAM sequence: CTA
ttttggcctcttggtttttc

SEQ ID NO: 102168 - DNA, 20 bp, Artificial Sequence
  Description of Artificial Sequence: Synthetic oligonucleotide
  Target: SCN9A; (+) strand; PAM type: YTN; PAM sequence: TTT
tggcctcttggtttttccca

SEQ ID NO: 102169 - DNA, 20 bp, Artificial Sequence
  Description of Artificial Sequence: Synthetic oligonucleotide
  Target: SCN9A; (+) strand; PAM type: YTN; PAM sequence: TTT
ggcctcttggtttttcccaa

SEQ ID NO: 102170 - DNA, 20 bp, Artificial Sequence
  Description of Artificial Sequence: Synthetic oligonucleotide
  Target: SCN9A; (+) strand; PAM type: YTN; PAM sequence: TTG
gcctcttggtttttcccaaa

SEQ ID NO: 102171 - DNA, 20 bp, Artificial Sequence
  Description of Artificial Sequence: Synthetic oligonucleotide
  Target: SCN9A; (+) strand; PAM type: YTN; PAM sequence: CTC
ttggtttttcccaaatgtta

SEQ ID NO: 102172 - DNA, 20 bp, Artificial Sequence
  Description of Artificial Sequence: Synthetic oligonucleotide
  Target: SCN9A; (+) strand; PAM type: YTN; PAM sequence: CTT
ggtttttcccaaatgttatg

SEQ ID NO: 102173 - DNA, 20 bp, Artificial Sequence
  Description of Artificial Sequence: Synthetic oligonucleotide
  Target: SCN9A; (+) strand; PAM type: YTN; PAM sequence: TTG
gtttttcccaaatgttatgc

SEQ ID NO: 102174 - DNA, 20 bp, Artificial Sequence
  Description of Artificial Sequence: Synthetic oligonucleotide
  Target: SCN9A; (+) strand; PAM type: YTN; PAM sequence: TTT
ttcccaaatgttatgcatat

SEQ ID NO: 102175 - DNA, 20 bp, Artificial Sequence
  Description of Artificial Sequence: Synthetic oligonucleotide
  Target: SCN9A; (+) strand; PAM type: YTN; PAM sequence: TTT
tcccaaatgttatgcatatc

SEQ ID NO: 102176 - DNA, 20 bp, Artificial Sequence
  Description of Artificial Sequence: Synthetic oligonucleotide
  Target: SCN9A; (+) strand; PAM type: YTN; PAM sequence: TTT
cccaaatgttatgcatatcc

SEQ ID NO: 102177 - DNA, 20 bp, Artificial Sequence
  Description of Artificial Sequence: Synthetic oligonucleotide
  Target: SCN9A; (+) strand; PAM type: YTN; PAM sequence: TTC
ccaaatgttatgcatatcct

SEQ ID NO: 102178 - DNA, 20 bp, Artificial Sequence
  Description of Artificial Sequence: Synthetic oligonucleotide
  Target: SCN9A; (+) strand; PAM type: YTN; PAM sequence: TTA
tgcatatcctcaccttgggg

SEQ ID NO: 102179 - DNA, 20 bp, Artificial Sequence
  Description of Artificial Sequence: Synthetic oligonucleotide
  Target: SCN9A; (+) strand; PAM type: YTN; PAM sequence: CTC
accttggggcatgtgccttc

SEQ ID NO: 102180 - DNA, 20 bp, Artificial Sequence
  Description of Artificial Sequence: Synthetic oligonucleotide
  Target: SCN9A; (+) strand; PAM type: YTN; PAM sequence: CTT
ggggcatgtgccttcattac

SEQ ID NO: 102181 - DNA, 20 bp, Artificial Sequence
  Description of Artificial Sequence: Synthetic oligonucleotide
  Target: SCN9A; (+) strand; PAM type: YTN; PAM sequence: TTG
gggcatgtgccttcattact

SEQ ID NO: 102182 - DNA, 20 bp, Artificial Sequence
  Description of Artificial Sequence: Synthetic oligonucleotide
  Target: SCN9A; (+) strand; PAM type: YTN; PAM sequence: CTT
cattactctgcctaaaatac

SEQ ID NO: 102183 - DNA, 20 bp, Artificial Sequence
  Description of Artificial Sequence: Synthetic oligonucleotide
  Target: SCN9A; (+) strand; PAM type: YTN; PAM sequence: TTC
attactctgcctaaaatact

SEQ ID NO: 102184 - DNA, 20 bp, Artificial Sequence
  Description of Artificial Sequence: Synthetic oligonucleotide
  Target: SCN9A; (+) strand; PAM type: YTN; PAM sequence: TTA
ctctgcctaaaatactttcc

SEQ ID NO: 102185 - DNA, 20 bp, Artificial Sequence
  Description of Artificial Sequence: Synthetic oligonucleotide
  Target: SCN9A; (+) strand; PAM type: YTN; PAM sequence: CTC
tgcctaaaatactttccctc

SEQ ID NO: 102186 - DNA, 20 bp, Artificial Sequence
  Description of Artificial Sequence: Synthetic oligonucleotide
  Target: SCN9A; (+) strand; PAM type: YTN; PAM sequence: CTG
cctaaaatactttccctcca

SEQ ID NO: 102187 - DNA, 20 bp, Artificial Sequence
  Description of Artificial Sequence: Synthetic oligonucleotide
  Target: SCN9A; (+) strand; PAM type: YTN; PAM sequence: CTA
aaatactttccctccatata

SEQ ID NO: 102188 - DNA, 20 bp, Artificial Sequence
  Description of Artificial Sequence: Synthetic oligonucleotide
  Target: SCN9A; (+) strand; PAM type: YTN; PAM sequence: CTT
tccctccatatatttgcacg

SEQ ID NO: 102189 - DNA, 20 bp, Artificial Sequence
  Description of Artificial Sequence: Synthetic oligonucleotide
  Target: SCN9A; (+) strand; PAM type: YTN; PAM sequence: TTT
ccctccatatatttgcacgg

SEQ ID NO: 102190 - DNA, 20 bp, Artificial Sequence
  Description of Artificial Sequence: Synthetic oligonucleotide
  Target: SCN9A; (+) strand; PAM type: YTN; PAM sequence: TTC
cctccatatatttgcacggc

SEQ ID NO: 102191 - DNA, 20 bp, Artificial Sequence
  Description of Artificial Sequence: Synthetic oligonucleotide
  Target: SCN9A; (+) strand; PAM type: YTN; PAM sequence: CTC
catatatttgcacggccccc

SEQ ID NO: 102192 - DNA, 20 bp, Artificial Sequence
  Description of Artificial Sequence: Synthetic oligonucleotide
  Target: SCN9A; (+) strand; PAM type: YTN; PAM sequence: TTT
gcacggcccccttcaatttt

SEQ ID NO: 102193 - DNA, 20 bp, Artificial Sequence
  Description of Artificial Sequence: Synthetic oligonucleotide
  Target: SCN9A; (+) strand; PAM type: YTN; PAM sequence: TTG
cacggcccccttcaattttc

SEQ ID NO: 102194 - DNA, 20 bp, Artificial Sequence
  Description of Artificial Sequence: Synthetic oligonucleotide
  Target: SCN9A; (+) strand; PAM type: YTN; PAM sequence: CTT
caattttctttacatcacgg

SEQ ID NO: 102195 - DNA, 20 bp, Artificial Sequence
  Description of Artificial Sequence: Synthetic oligonucleotide
  Target: SCN9A; (+) strand; PAM type: YTN; PAM sequence: TTC
aattttctttacatcacgga

SEQ ID NO: 102196 - DNA, 20 bp, Artificial Sequence
  Description of Artificial Sequence: Synthetic oligonucleotide
  Target: SCN9A; (+) strand; PAM type: YTN; PAM sequence: TTT
tctttacatcacggaagaaa

SEQ ID NO: 102197 - DNA, 20 bp, Artificial Sequence
  Description of Artificial Sequence: Synthetic oligonucleotide
  Target: SCN9A; (+) strand; PAM type: YTN; PAM sequence: TTT
ctttacatcacggaagaaac

SEQ ID NO: 102198 - DNA, 20 bp, Artificial Sequence
  Description of Artificial Sequence: Synthetic oligonucleotide
  Target: SCN9A; (+) strand; PAM type: YTN; PAM sequence: TTC
tttacatcacggaagaaacg

SEQ ID NO: 102199 - DNA, 20 bp, Artificial Sequence
  Description of Artificial Sequence: Synthetic oligonucleotide
  Target: SCN9A; (+) strand; PAM type: YTN; PAM sequence: CTT
tacatcacggaagaaacgcc

SEQ ID NO: 102200 - DNA, 20 bp, Artificial Sequence
  Description of Artificial Sequence: Synthetic oligonucleotide
  Target: SCN9A; (+) strand; PAM type: YTN; PAM sequence: TTT
acatcacggaagaaacgcca

SEQ ID NO: 102201 - DNA, 20 bp, Artificial Sequence
  Description of Artificial Sequence: Synthetic oligonucleotide
  Target: SCN9A; (+) strand; PAM type: YTN; PAM sequence: TTA
catcacggaagaaacgccac

SEQ ID NO: 102202 - DNA, 20 bp, Artificial Sequence
  Description of Artificial Sequence: Synthetic oligonucleotide
  Target: SCN9A; (+) strand; PAM type: YTN; PAM sequence: CTT
tataggcaggctttctctga

SEQ ID NO: 102203 - DNA, 20 bp, Artificial Sequence
  Description of Artificial Sequence: Synthetic oligonucleotide
  Target: SCN9A; (+) strand; PAM type: YTN; PAM sequence: TTT
ataggcaggctttctctgac

SEQ ID NO: 102204 - DNA, 20 bp, Artificial Sequence
  Description of Artificial Sequence: Synthetic oligonucleotide
  Target: SCN9A; (+) strand; PAM type: YTN; PAM sequence: TTA
taggcaggctttctctgacc

SEQ ID NO: 102205 - DNA, 20 bp, Artificial Sequence
  Description of Artificial Sequence: Synthetic oligonucleotide
  Target: SCN9A; (+) strand; PAM type: YTN; PAM sequence: CTT
tctctgaccaatcattcatt

SEQ ID NO: 102206 - DNA, 20 bp, Artificial Sequence
  Description of Artificial Sequence: Synthetic oligonucleotide
  Target: SCN9A; (+) strand; PAM type: YTN; PAM sequence: TTT
ctctgaccaatcattcattg

SEQ ID NO: 102207 - DNA, 20 bp, Artificial Sequence
  Description of Artificial Sequence: Synthetic oligonucleotide
  Target: SCN9A; (+) strand; PAM type: YTN; PAM sequence: TTC
tctgaccaatcattcattga

SEQ ID NO: 102208 - DNA, 20 bp, Artificial Sequence
  Description of Artificial Sequence: Synthetic oligonucleotide
  Target: SCN9A; (+) strand; PAM type: YTN; PAM sequence: CTC
tgaccaatcattcattgata

SEQ ID NO: 102209 - DNA, 20 bp, Artificial Sequence
  Description of Artificial Sequence: Synthetic oligonucleotide
  Target: SCN9A; (+) strand; PAM type: YTN; PAM sequence: CTG
accaatcattcattgatagc

SEQ ID NO: 102210 - DNA, 20 bp, Artificial Sequence
  Description of Artificial Sequence: Synthetic oligonucleotide
  Target: SCN9A; (+) strand; PAM type: YTN; PAM sequence: TTC
attgatagcatatttatgtg

SEQ ID NO: 102211 - DNA, 20 bp, Artificial Sequence
  Description of Artificial Sequence: Synthetic oligonucleotide
  Target: SCN9A; (+) strand; PAM type: YTN; PAM sequence: TTG
atagcatatttatgtgctag

SEQ ID NO: 102212 - DNA, 20 bp, Artificial Sequence
  Description of Artificial Sequence: Synthetic oligonucleotide
  Target: SCN9A; (+) strand; PAM type: YTN; PAM sequence: TTT
atgtgctagtaagttcttcc

SEQ ID NO: 102213 - DNA, 20 bp, Artificial Sequence
  Description of Artificial Sequence: Synthetic oligonucleotide
  Target: SCN9A; (+) strand; PAM type: YTN; PAM sequence: TTA
tgtgctagtaagttcttccc

SEQ ID NO: 102214 - DNA, 20 bp, Artificial Sequence
  Description of Artificial Sequence: Synthetic oligonucleotide
  Target: SCN9A; (+) strand; PAM type: YTN; PAM sequence: CTA
gtaagttcttccccctcact

SEQ ID NO: 102215 - DNA, 20 bp, Artificial Sequence
  Description of Artificial Sequence: Synthetic oligonucleotide
  Target: SCN9A; (+) strand; PAM type: YTN; PAM sequence: TTC
ttccccctcactcttggtat

SEQ ID NO: 102216 - DNA, 20 bp, Artificial Sequence
  Description of Artificial Sequence: Synthetic oligonucleotide
  Target: SCN9A; (+) strand; PAM type: YTN; PAM sequence: CTT
ccccctcactcttggtattc

SEQ ID NO: 102217 - DNA, 20 bp, Artificial Sequence
  Description of Artificial Sequence: Synthetic oligonucleotide
  Target: SCN9A; (+) strand; PAM type: YTN; PAM sequence: TTC
cccctcactcttggtattcc

SEQ ID NO: 102218 - DNA, 20 bp, Artificial Sequence
  Description of Artificial Sequence: Synthetic oligonucleotide
  Target: SCN9A; (+) strand; PAM type: YTN; PAM sequence: CTC
actcttggtattcctctttt

SEQ ID NO: 102219 - DNA, 20 bp, Artificial Sequence
  Description of Artificial Sequence: Synthetic oligonucleotide
  Target: SCN9A; (+) strand; PAM type: YTN; PAM sequence: CTC
ttggtattcctcttttccat

SEQ ID NO: 102220 - DNA, 20 bp, Artificial Sequence
  Description of Artificial Sequence: Synthetic oligonucleotide
  Target: SCN9A; (+) strand; PAM type: YTN; PAM sequence: CTT
ggtattcctcttttccatat

SEQ ID NO: 102221 - DNA, 20 bp, Artificial Sequence
  Description of Artificial Sequence: Synthetic oligonucleotide
  Target: SCN9A; (+) strand; PAM type: YTN; PAM sequence: TTG
gtattcctcttttccatata

SEQ ID NO: 102222 - DNA, 20 bp, Artificial Sequence
  Description of Artificial Sequence: Synthetic oligonucleotide
  Target: SCN9A; (+) strand; PAM type: YTN; PAM sequence: TTC
ctcttttccatataccttct

SEQ ID NO: 102223 - DNA, 20 bp, Artificial Sequence
  Description of Artificial Sequence: Synthetic oligonucleotide
  Target: SCN9A; (+) strand; PAM type: YTN; PAM sequence: CTC
ttttccatataccttctcca

SEQ ID NO: 102224 - DNA, 20 bp, Artificial Sequence
  Description of Artificial Sequence: Synthetic oligonucleotide
  Target: SCN9A; (+) strand; PAM type: YTN; PAM sequence: CTT
ttccatataccttctccata

SEQ ID NO: 102225 - DNA, 20 bp, Artificial Sequence
  Description of Artificial Sequence: Synthetic oligonucleotide
  Target: SCN9A; (+) strand; PAM type: YTN; PAM sequence: TTT
tccatataccttctccatag

SEQ ID NO: 102226 - DNA, 20 bp, Artificial Sequence
  Description of Artificial Sequence: Synthetic oligonucleotide
  Target: SCN9A; (+) strand; PAM type: YTN; PAM sequence: TTT
ccatataccttctccatagc

SEQ ID NO: 102227 - DNA, 20 bp, Artificial Sequence
  Description of Artificial Sequence: Synthetic oligonucleotide
  Target: SCN9A; (+) strand; PAM type: YTN; PAM sequence: TTC
catataccttctccatagca

SEQ ID NO: 102228 - DNA, 20 bp, Artificial Sequence
  Description of Artificial Sequence: Synthetic oligonucleotide
  Target: SCN9A; (+) strand; PAM type: YTN; PAM sequence: CTT
ctccatagcacttttcactt

SEQ ID NO: 102229 - DNA, 20 bp, Artificial Sequence
  Description of Artificial Sequence: Synthetic oligonucleotide
  Target: SCN9A; (+) strand; PAM type: YTN; PAM sequence: TTC
tccatagcacttttcactta

SEQ ID NO: 102230 - DNA, 20 bp, Artificial Sequence
  Description of Artificial Sequence: Synthetic oligonucleotide
  Target: SCN9A; (+) strand; PAM type: YTN; PAM sequence: CTC
catagcacttttcacttatc

SEQ ID NO: 102231 - DNA, 20 bp, Artificial Sequence
  Description of Artificial Sequence: Synthetic oligonucleotide
  Target: SCN9A; (+) strand; PAM type: YTN; PAM sequence: CTT
ttcacttatctgacctgcta

SEQ ID NO: 102232 - DNA, 20 bp, Artificial Sequence
  Description of Artificial Sequence: Synthetic oligonucleotide
  Target: SCN9A; (+) strand; PAM type: YTN; PAM sequence: TTT
tcacttatctgacctgctac

SEQ ID NO: 102233 - DNA, 20 bp, Artificial Sequence
  Description of Artificial Sequence: Synthetic oligonucleotide
  Target: SCN9A; (+) strand; PAM type: YTN; PAM sequence: TTT
cacttatctgacctgctaca

SEQ ID NO: 102234 - DNA, 20 bp, Artificial Sequence
  Description of Artificial Sequence: Synthetic oligonucleotide
  Target: SCN9A; (+) strand; PAM type: YTN; PAM sequence: TTC
acttatctgacctgctacat

SEQ ID NO: 102235 - DNA, 20 bp, Artificial Sequence
  Description of Artificial Sequence: Synthetic oligonucleotide
  Target: SCN9A; (+) strand; PAM type: YTN; PAM sequence: CTT
atctgacctgctacatcttg

SEQ ID NO: 102236 - DNA, 20 bp, Artificial Sequence
  Description of Artificial Sequence: Synthetic oligonucleotide
  Target: SCN9A; (+) strand; PAM type: YTN; PAM sequence: TTA
tctgacctgctacatcttga

SEQ ID NO: 102237 - DNA, 20 bp, Artificial Sequence
  Description of Artificial Sequence: Synthetic oligonucleotide
  Target: SCN9A; (+) strand; PAM type: YTN; PAM sequence: CTG
acctgctacatcttgatatg

SEQ ID NO: 102238 - DNA, 20 bp, Artificial Sequence
  Description of Artificial Sequence: Synthetic oligonucleotide
  Target: SCN9A; (+) strand; PAM type: YTN; PAM sequence: CTG
ctacatcttgatatgtttct

SEQ ID NO: 102239 - DNA, 20 bp, Artificial Sequence
  Description of Artificial Sequence: Synthetic oligonucleotide
  Target: SCN9A; (+) strand; PAM type: YTN; PAM sequence: CTA
catcttgatatgtttcttca

SEQ ID NO: 102240 - DNA, 20 bp, Artificial Sequence
  Description of Artificial Sequence: Synthetic oligonucleotide
  Target: SCN9A; (+) strand; PAM type: YTN; PAM sequence: CTT
gatatgtttcttcagcaagg

SEQ ID NO: 102241 - DNA, 20 bp, Artificial Sequence
  Description of Artificial Sequence: Synthetic oligonucleotide
  Target: SCN9A; (+) strand; PAM type: YTN; PAM sequence: TTG
atatgtttcttcagcaaggg

SEQ ID NO: 102242 - DNA, 20 bp, Artificial Sequence
  Description of Artificial Sequence: Synthetic oligonucleotide
  Target: SCN9A; (+) strand; PAM type: YTN; PAM sequence: TTT
cttcagcaaggggtattgtt

SEQ ID NO: 102243 - DNA, 20 bp, Artificial Sequence
  Description of Artificial Sequence: Synthetic oligonucleotide
  Target: SCN9A; (+) strand; PAM type: YTN; PAM sequence: TTC
ttcagcaaggggtattgttt

SEQ ID NO: 102244 - DNA, 20 bp, Artificial Sequence
  Description of Artificial Sequence: Synthetic oligonucleotide
  Target: SCN9A; (+) strand; PAM type: YTN; PAM sequence: CTT
cagcaaggggtattgttttg

SEQ ID NO: 102245 - DNA, 20 bp, Artificial Sequence
  Description of Artificial Sequence: Synthetic oligonucleotide
  Target: SCN9A; (+) strand; PAM type: YTN; PAM sequence: TTC
agcaaggggtattgttttgt

SEQ ID NO: 102246 - DNA, 20 bp, Artificial Sequence
  Description of Artificial Sequence: Synthetic oligonucleotide
  Target: SCN9A; (+) strand; PAM type: YTN; PAM sequence: TTG
ttttgttcacagctccatct

SEQ ID NO: 102247 - DNA, 20 bp, Artificial Sequence
  Description of Artificial Sequence: Synthetic oligonucleotide
  Target: SCN9A; (+) strand; PAM type: YTN; PAM sequence: TTT
tgttcacagctccatctccc

SEQ ID NO: 102248 - DNA, 20 bp, Artificial Sequence
  Description of Artificial Sequence: Synthetic oligonucleotide
  Target: SCN9A; (+) strand; PAM type: YTN; PAM sequence: TTT
gttcacagctccatctccct

SEQ ID NO: 102249 - DNA, 20 bp, Artificial Sequence
  Description of Artificial Sequence: Synthetic oligonucleotide
  Target: SCN9A; (+) strand; PAM type: YTN; PAM sequence: TTG
ttcacagctccatctccctc

SEQ ID NO: 102250 - DNA, 20 bp, Artificial Sequence
  Description of Artificial Sequence: Synthetic oligonucleotide
  Target: SCN9A; (+) strand; PAM type: YTN; PAM sequence: TTC
acagctccatctccctccag

SEQ ID NO: 102251 - DNA, 20 bp, Artificial Sequence
  Description of Artificial Sequence: Synthetic oligonucleotide
  Target: SCN9A; (+) strand; PAM type: YTN; PAM sequence: CTC
catctccctccagtgcctgg

SEQ ID NO: 102252 - DNA, 20 bp, Artificial Sequence
  Description of Artificial Sequence: Synthetic oligonucleotide
  Target: SCN9A; (+) strand; PAM type: YTN; PAM sequence: CTC
cctccagtgcctggaactgg

SEQ ID NO: 102253 - DNA, 20 bp, Artificial Sequence
  Description of Artificial Sequence: Synthetic oligonucleotide
  Target: SCN9A; (+) strand; PAM type: YTN; PAM sequence: CTC
cagtgcctggaactggacct

SEQ ID NO: 102254 - DNA, 20 bp, Artificial Sequence
  Description of Artificial Sequence: Synthetic oligonucleotide
  Target: SCN9A; (+) strand; PAM type: YTN; PAM sequence: CTG
gaactggacctggcacacag

SEQ ID NO: 102255 - DNA, 20 bp, Artificial Sequence
  Description of Artificial Sequence: Synthetic oligonucleotide
  Target: SCN9A; (+) strand; PAM type: YTN; PAM sequence: CTG
gacctggcacacaggtattt

SEQ ID NO: 102256 - DNA, 20 bp, Artificial Sequence
  Description of Artificial Sequence: Synthetic oligonucleotide
  Target: SCN9A; (+) strand; PAM type: YTN; PAM sequence: CTG
gcacacaggtatttaataat

SEQ ID NO: 102257 - DNA, 20 bp, Artificial Sequence
  Description of Artificial Sequence: Synthetic oligonucleotide
  Target: SCN9A; (+) strand; PAM type: YTN; PAM sequence: TTT
aataattatttgtttactgg

SEQ ID NO: 102258 - DNA, 20 bp, Artificial Sequence
  Description of Artificial Sequence: Synthetic oligonucleotide
  Target: SCN9A; (+) strand; PAM type: YTN; PAM sequence: TTA
ataattatttgtttactgga

SEQ ID NO: 102259 - DNA, 20 bp, Artificial Sequence
  Description of Artificial Sequence: Synthetic oligonucleotide
  Target: SCN9A; (+) strand; PAM type: YTN; PAM sequence: TTA
tttgtttactggaataaaga

SEQ ID NO: 102260 - DNA, 20 bp, Artificial Sequence
  Description of Artificial Sequence: Synthetic oligonucleotide
  Target: SCN9A; (+) strand; PAM type: YTN; PAM sequence: TTT
gtttactggaataaagaatg

SEQ ID NO: 102261 - DNA, 20 bp, Artificial Sequence
  Description of Artificial Sequence: Synthetic oligonucleotide
  Target: SCN9A; (+) strand; PAM type: YTN; PAM sequence: TTG
tttactggaataaagaatga

SEQ ID NO: 102262 - DNA, 20 bp, Artificial Sequence
  Description of Artificial Sequence: Synthetic oligonucleotide
  Target: SCN9A; (+) strand; PAM type: YTN; PAM sequence: TTT
actggaataaagaatgatta

SEQ ID NO: 102263 - DNA, 20 bp, Artificial Sequence
  Description of Artificial Sequence: Synthetic oligonucleotide
  Target: SCN9A; (+) strand; PAM type: YTN; PAM sequence: TTA
ctggaataaagaatgattat

SEQ ID NO: 102264 - DNA, 20 bp, Artificial Sequence
  Description of Artificial Sequence: Synthetic oligonucleotide
  Target: SCN9A; (+) strand; PAM type: YTN; PAM sequence: CTG
gaataaagaatgattatgtg

SEQ ID NO: 102265 - DNA, 20 bp, Artificial Sequence
  Description of Artificial Sequence: Synthetic oligonucleotide
  Target: SCN9A; (+) strand; PAM type: YTN; PAM sequence: TTA
tgtgaatacacggttgaaag

SEQ ID NO: 102266 - DNA, 20 bp, Artificial Sequence
  Description of Artificial Sequence: Synthetic oligonucleotide
  Target: SCN9A; (+) strand; PAM type: YTN; PAM sequence: TTG
aaaggctaagcaaattggct

SEQ ID NO: 102267 - DNA, 20 bp, Artificial Sequence
  Description of Artificial Sequence: Synthetic oligonucleotide
  Target: SCN9A; (+) strand; PAM type: YTN; PAM sequence: CTA
agcaaattggctgcttcact

SEQ ID NO: 102268 - DNA, 20 bp, Artificial Sequence
  Description of Artificial Sequence: Synthetic oligonucleotide
  Target: SCN9A; (+) strand; PAM type: YTN; PAM sequence: TTG
gctgcttcactgaatttatt

SEQ ID NO: 102269 - DNA, 20 bp, Artificial Sequence
  Description of Artificial Sequence: Synthetic oligonucleotide
  Target: SCN9A; (+) strand; PAM type: YTN; PAM sequence: CTG
cttcactgaatttattaggc

SEQ ID NO: 102270 - DNA, 20 bp, Artificial Sequence
  Description of Artificial Sequence: Synthetic oligonucleotide
  Target: SCN9A; (+) strand; PAM type: YTN; PAM sequence: CTT
cactgaatttattaggctac

SEQ ID NO: 102271 - DNA, 20 bp, Artificial Sequence
  Description of Artificial Sequence: Synthetic oligonucleotide
  Target: SCN9A; (+) strand; PAM type: YTN; PAM sequence: TTC
actgaatttattaggctaca

SEQ ID NO: 102272 - DNA, 20 bp, Artificial Sequence
  Description of Artificial Sequence: Synthetic oligonucleotide
  Target: SCN9A; (+) strand; PAM type: YTN; PAM sequence: CTG
aatttattaggctacagatc

SEQ ID NO: 102273 - DNA, 20 bp, Artificial Sequence
  Description of Artificial Sequence: Synthetic oligonucleotide
  Target: SCN9A; (+) strand; PAM type: YTN; PAM sequence: TTT
attaggctacagatccagag

SEQ ID NO: 102274 - DNA, 20 bp, Artificial Sequence
  Description of Artificial Sequence: Synthetic oligonucleotide
  Target: SCN9A; (+) strand; PAM type: YTN; PAM sequence: TTA
ttaggctacagatccagaga

SEQ ID NO: 102275 - DNA, 20 bp, Artificial Sequence
  Description of Artificial Sequence: Synthetic oligonucleotide
  Target: SCN9A; (+) strand; PAM type: YTN; PAM sequence: TTA
ggctacagatccagagactg

SEQ ID NO: 102276 - DNA, 20 bp, Artificial Sequence
  Description of Artificial Sequence: Synthetic oligonucleotide
  Target: SCN9A; (+) strand; PAM type: YTN; PAM sequence: CTA
cagatccagagactgtatga

SEQ ID NO: 102277 - DNA, 20 bp, Artificial Sequence
  Description of Artificial Sequence: Synthetic oligonucleotide
  Target: SCN9A; (+) strand; PAM type: YTN; PAM sequence: CTG
tatgaagtctctgctggagc

SEQ ID NO: 102278 - DNA, 20 bp, Artificial Sequence
  Description of Artificial Sequence: Synthetic oligonucleotide
  Target: SCN9A; (+) strand; PAM type: YTN; PAM sequence: CTC
tgctggagcacataaaaggg

SEQ ID NO: 102279 - DNA, 20 bp, Artificial Sequence
  Description of Artificial Sequence: Synthetic oligonucleotide
  Target: SCN9A; (+) strand; PAM type: YTN; PAM sequence: CTG
ctggagcacataaaagggat

SEQ ID NO: 102280 - DNA, 20 bp, Artificial Sequence
  Description of Artificial Sequence: Synthetic oligonucleotide
  Target: SCN9A; (+) strand; PAM type: YTN; PAM sequence: CTG
gagcacataaaagggatgtg

SEQ ID NO: 102281 - DNA, 20 bp, Artificial Sequence
  Description of Artificial Sequence: Synthetic oligonucleotide
  Target: SCN9A; (+) strand; PAM type: YTN; PAM sequence: CTC
agagatatatgctccctcag

SEQ ID NO: 102282 - DNA, 20 bp, Artificial Sequence
  Description of Artificial Sequence: Synthetic oligonucleotide
  Target: SCN9A; (+) strand; PAM type: YTN; PAM sequence: CTC
cctcagtaaatttcaatggt

SEQ ID NO: 102283 - DNA, 20 bp, Artificial Sequence
  Description of Artificial Sequence: Synthetic oligonucleotide
  Target: SCN9A; (+) strand; PAM type: YTN; PAM sequence: CTC
agtaaatttcaatggtccaa

SEQ ID NO: 102284 - DNA, 20 bp, Artificial Sequence
  Description of Artificial Sequence: Synthetic oligonucleotide
  Target: SCN9A; (+) strand; PAM type: YTN; PAM sequence: TTT
caatggtccaagcccaggtt

SEQ ID NO: 102285 - DNA, 20 bp, Artificial Sequence
  Description of Artificial Sequence: Synthetic oligonucleotide
  Target: SCN9A; (+) strand; PAM type: YTN; PAM sequence: TTC
aatggtccaagcccaggttc

SEQ ID NO: 102286 - DNA, 20 bp, Artificial Sequence
  Description of Artificial Sequence: Synthetic oligonucleotide
  Target: SCN9A; (+) strand; PAM type: YTN; PAM sequence: TTC
attggaaaatgtgtttccat

SEQ ID NO: 102287 - DNA, 20 bp, Artificial Sequence
  Description of Artificial Sequence: Synthetic oligonucleotide
  Target: SCN9A; (+) strand; PAM type: YTN; PAM sequence: TTG
gaaaatgtgtttccataata

SEQ ID NO: 102288 - DNA, 20 bp, Artificial Sequence
  Description of Artificial Sequence: Synthetic oligonucleotide
  Target: SCN9A; (+) strand; PAM type: YTN; PAM sequence: TTT
ccataatatttcttctatac

SEQ ID NO: 102289 - DNA, 20 bp, Artificial Sequence
  Description of Artificial Sequence: Synthetic oligonucleotide
  Target: SCN9A; (+) strand; PAM type: YTN; PAM sequence: TTC
cataatatttcttctatact

SEQ ID NO: 102290 - DNA, 20 bp, Artificial Sequence
  Description of Artificial Sequence: Synthetic oligonucleotide
  Target: SCN9A; (+) strand; PAM type: YTN; PAM sequence: TTT
cttctatactggcctcagtt

SEQ ID NO: 102291 - DNA, 20 bp, Artificial Sequence
  Description of Artificial Sequence: Synthetic oligonucleotide
  Target: SCN9A; (+) strand; PAM type: YTN; PAM sequence: TTC
ttctatactggcctcagttt

SEQ ID NO: 102292 - DNA, 20 bp, Artificial Sequence
  Description of Artificial Sequence: Synthetic oligonucleotide
  Target: SCN9A; (+) strand; PAM type: YTN; PAM sequence: CTT
ctatactggcctcagtttgg

SEQ ID NO: 102293 - DNA, 20 bp, Artificial Sequence
  Description of Artificial Sequence: Synthetic oligonucleotide
  Target: SCN9A; (+) strand; PAM type: YTN; PAM sequence: TTC
tatactggcctcagtttgga

SEQ ID NO: 102294 - DNA, 20 bp, Artificial Sequence
  Description of Artificial Sequence: Synthetic oligonucleotide
  Target: SCN9A; (+) strand; PAM type: YTN; PAM sequence: CTA
tactggcctcagtttggaag

SEQ ID NO: 102295 - DNA, 20 bp, Artificial Sequence
  Description of Artificial Sequence: Synthetic oligonucleotide
  Target: SCN9A; (+) strand; PAM type: YTN; PAM sequence: CTG
gcctcagtttggaagcaatg

SEQ ID NO: 102296 - DNA, 20 bp, Artificial Sequence
  Description of Artificial Sequence: Synthetic oligonucleotide
  Target: SCN9A; (+) strand; PAM type: YTN; PAM sequence: CTC
agtttggaagcaatgaataa

SEQ ID NO: 102297 - DNA, 20 bp, Artificial Sequence
  Description of Artificial Sequence: Synthetic oligonucleotide
  Target: SCN9A; (+) strand; PAM type: YTN; PAM sequence: TTT
ggaagcaatgaataatctca

SEQ ID NO: 102298 - DNA, 20 bp, Artificial Sequence
  Description of Artificial Sequence: Synthetic oligonucleotide
  Target: SCN9A; (+) strand; PAM type: YTN; PAM sequence: TTG
gaagcaatgaataatctcag

SEQ ID NO: 102299 - DNA, 20 bp, Artificial Sequence
  Description of Artificial Sequence: Synthetic oligonucleotide
  Target: SCN9A; (+) strand; PAM type: YTN; PAM sequence: CTC
agagtattcacaaaagtatt

SEQ ID NO: 102300 - DNA, 20 bp, Artificial Sequence
  Description of Artificial Sequence: Synthetic oligonucleotide
  Target: SCN9A; (+) strand; PAM type: YTN; PAM sequence: TTC
acaaaagtattttcattgat

SEQ ID NO: 102301 - DNA, 20 bp, Artificial Sequence
  Description of Artificial Sequence: Synthetic oligonucleotide
  Target: SCN9A; (+) strand; PAM type: YTN; PAM sequence: TTT
tcattgatgtttataggatt

SEQ ID NO: 102302 - DNA, 20 bp, Artificial Sequence
  Description of Artificial Sequence: Synthetic oligonucleotide
  Target: SCN9A; (+) strand; PAM type: YTN; PAM sequence: TTT
cattgatgtttataggatta

SEQ ID NO: 102303 - DNA, 20 bp, Artificial Sequence
  Description of Artificial Sequence: Synthetic oligonucleotide
  Target: SCN9A; (+) strand; PAM type: YTN; PAM sequence: TTC
attgatgtttataggattaa

SEQ ID NO: 102304 - DNA, 20 bp, Artificial Sequence
  Description of Artificial Sequence: Synthetic oligonucleotide
  Target: SCN9A; (+) strand; PAM type: YTN; PAM sequence: TTG
atgtttataggattaaaaaa

SEQ ID NO: 102305 - DNA, 20 bp, Artificial Sequence
  Description of Artificial Sequence: Synthetic oligonucleotide
  Target: SCN9A; (+) strand; PAM type: YTN; PAM sequence: TTT
ataggattaaaaaaactttg

SEQ ID NO: 102306 - DNA, 20 bp, Artificial Sequence
  Description of Artificial Sequence: Synthetic oligonucleotide
  Target: SCN9A; (+) strand; PAM type: YTN; PAM sequence: TTA
taggattaaaaaaactttgt

SEQ ID NO: 102307 - DNA, 20 bp, Artificial Sequence
  Description of Artificial Sequence: Synthetic oligonucleotide
  Target: SCN9A; (+) strand; PAM type: YTN; PAM sequence: TTA
aaaaaactttgtattatatc

SEQ ID NO: 102308 - DNA, 20 bp, Artificial Sequence
  Description of Artificial Sequence: Synthetic oligonucleotide
  Target: SCN9A; (+) strand; PAM type: YTN; PAM sequence: CTT
tgtattatatcttattataa

SEQ ID NO: 102309 - DNA, 20 bp, Artificial Sequence
  Description of Artificial Sequence: Synthetic oligonucleotide
  Target: SCN9A; (+) strand; PAM type: YTN; PAM sequence: TTT
gtattatatcttattataac

SEQ ID NO: 102310 - DNA, 20 bp, Artificial Sequence
  Description of Artificial Sequence: Synthetic oligonucleotide
  Target: SCN9A; (+) strand; PAM type: YTN; PAM sequence: TTG
tattatatcttattataaca

SEQ ID NO: 102311 - DNA, 20 bp, Artificial Sequence
  Description of Artificial Sequence: Synthetic oligonucleotide
  Target: SCN9A; (+) strand; PAM type: YTN; PAM sequence: TTA
tatcttattataacagcacc

SEQ ID NO: 102312 - DNA, 20 bp, Artificial Sequence
  Description of Artificial Sequence: Synthetic oligonucleotide
  Target: SCN9A; (+) strand; PAM type: YTN; PAM sequence: CTT
attataacagcacctacagt

SEQ ID NO: 102313 - DNA, 20 bp, Artificial Sequence
  Description of Artificial Sequence: Synthetic oligonucleotide
  Target: SCN9A; (+) strand; PAM type: YTN; PAM sequence: TTA
ttataacagcacctacagtc

SEQ ID NO: 102314 - DNA, 20 bp, Artificial Sequence
  Description of Artificial Sequence: Synthetic oligonucleotide
  Target: SCN9A; (+) strand; PAM type: YTN; PAM sequence: TTA
taacagcacctacagtctga

SEQ ID NO: 102315 - DNA, 20 bp, Artificial Sequence
  Description of Artificial Sequence: Synthetic oligonucleotide
  Target: SCN9A; (+) strand; PAM type: YTN; PAM sequence: CTA
cagtctgaaatagcatagta

SEQ ID NO: 102316 - DNA, 20 bp, Artificial Sequence
  Description of Artificial Sequence: Synthetic oligonucleotide
  Target: SCN9A; (+) strand; PAM type: YTN; PAM sequence: CTG
aaatagcatagtattaatac

SEQ ID NO: 102317 - DNA, 20 bp, Artificial Sequence
  Description of Artificial Sequence: Synthetic oligonucleotide
  Target: SCN9A; (+) strand; PAM type: YTN; PAM sequence: TTA
atactttctgtaagagttta

SEQ ID NO: 102318 - DNA, 20 bp, Artificial Sequence
  Description of Artificial Sequence: Synthetic oligonucleotide
  Target: SCN9A; (+) strand; PAM type: YTN; PAM sequence: CTT
tctgtaagagtttaagtttt

SEQ ID NO: 102319 - DNA, 20 bp, Artificial Sequence
  Description of Artificial Sequence: Synthetic oligonucleotide
  Target: SCN9A; (+) strand; PAM type: YTN; PAM sequence: TTT
ctgtaagagtttaagttttt

SEQ ID NO: 102320 - DNA, 20 bp, Artificial Sequence
  Description of Artificial Sequence: Synthetic oligonucleotide
  Target: SCN9A; (+) strand; PAM type: YTN; PAM sequence: TTC
tgtaagagtttaagtttttt

SEQ ID NO: 102321 - DNA, 20 bp, Artificial Sequence
  Description of Artificial Sequence: Synthetic oligonucleotide
  Target: SCN9A; (+) strand; PAM type: YTN; PAM sequence: CTG
taagagtttaagttttttga

SEQ ID NO: 102322 - DNA, 20 bp, Artificial Sequence
  Description of Artificial Sequence: Synthetic oligonucleotide
  Target: SCN9A; (+) strand; PAM type: YTN; PAM sequence: TTT
aagttttttgaagtcatttt

SEQ ID NO: 102323 - DNA, 20 bp, Artificial Sequence
  Description of Artificial Sequence: Synthetic oligonucleotide
  Target: SCN9A; (+) strand; PAM type: YTN; PAM sequence: TTA
agttttttgaagtcattttt

SEQ ID NO: 102324 - DNA, 20 bp, Artificial Sequence
  Description of Artificial Sequence: Synthetic oligonucleotide
  Target: SCN9A; (+) strand; PAM type: YTN; PAM sequence: TTT
tttgaagtcattttttggtt

SEQ ID NO: 102325 - DNA, 20 bp, Artificial Sequence
  Description of Artificial Sequence: Synthetic oligonucleotide
  Target: SCN9A; (+) strand; PAM type: YTN; PAM sequence: TTT
ttgaagtcattttttggttt

SEQ ID NO: 102326 - DNA, 20 bp, Artificial Sequence
  Description of Artificial Sequence: Synthetic oligonucleotide
  Target: SCN9A; (+) strand; PAM type: YTN; PAM sequence: TTT
tgaagtcattttttggtttg

SEQ ID NO: 102327 - DNA, 20 bp, Artificial Sequence
  Description of Artificial Sequence: Synthetic oligonucleotide
  Target: SCN9A; (+) strand; PAM type: YTN; PAM sequence: TTT
gaagtcattttttggtttga

SEQ ID NO: 102328 - DNA, 20 bp, Artificial Sequence
  Description of Artificial Sequence: Synthetic oligonucleotide
  Target: SCN9A; (+) strand; PAM type: YTN; PAM sequence: TTG
aagtcattttttggtttgaa

SEQ ID NO: 102329 - DNA, 20 bp, Artificial Sequence
  Description of Artificial Sequence: Synthetic oligonucleotide
  Target: SCN9A; (+) strand; PAM type: YTN; PAM sequence: TTT
tttggtttgaaactttaagt

SEQ ID NO: 102330 - DNA, 20 bp, Artificial Sequence
  Description of Artificial Sequence: Synthetic oligonucleotide
  Target: SCN9A; (+) strand; PAM type: YTN; PAM sequence: TTT
ttggtttgaaactttaagtt

SEQ ID NO: 102331 - DNA, 20 bp, Artificial Sequence
  Description of Artificial Sequence: Synthetic oligonucleotide
  Target: SCN9A; (+) strand; PAM type: YTN; PAM sequence: TTT
tggtttgaaactttaagttg

SEQ ID NO: 102332 - DNA, 20 bp, Artificial Sequence
  Description of Artificial Sequence: Synthetic oligonucleotide
  Target: SCN9A; (+) strand; PAM type: YTN; PAM sequence: TTT
ggtttgaaactttaagttga

SEQ ID NO: 102333 - DNA, 20 bp, Artificial Sequence
  Description of Artificial Sequence: Synthetic oligonucleotide
  Target: SCN9A; (+) strand; PAM type: YTN; PAM sequence: TTG
gtttgaaactttaagttgat

SEQ ID NO: 102334 - DNA, 20 bp, Artificial Sequence
  Description of Artificial Sequence: Synthetic oligonucleotide
  Target: SCN9A; (+) strand; PAM type: YTN; PAM sequence: TTT
gaaactttaagttgattgat

SEQ ID NO: 102335 - DNA, 20 bp, Artificial Sequence
  Description of Artificial Sequence: Synthetic oligonucleotide
  Target: SCN9A; (+) strand; PAM type: YTN; PAM sequence: TTG
aaactttaagttgattgata

SEQ ID NO: 102336 - DNA, 20 bp, Artificial Sequence
  Description of Artificial Sequence: Synthetic oligonucleotide
  Target: SCN9A; (+) strand; PAM type: YTN; PAM sequence: CTT
taagttgattgataagccca

SEQ ID NO: 102337 - DNA, 20 bp, Artificial Sequence
  Description of Artificial Sequence: Synthetic oligonucleotide
  Target: SCN9A; (+) strand; PAM type: YTN; PAM sequence: TTT
aagttgattgataagcccaa

SEQ ID NO: 102338 - DNA, 20 bp, Artificial Sequence
  Description of Artificial Sequence: Synthetic oligonucleotide
  Target: SCN9A; (+) strand; PAM type: YTN; PAM sequence: TTA
agttgattgataagcccaac

SEQ ID NO: 102339 - DNA, 20 bp, Artificial Sequence
  Description of Artificial Sequence: Synthetic oligonucleotide
  Target: SCN9A; (+) strand; PAM type: YTN; PAM sequence: TTG
attgataagcccaacttctt

SEQ ID NO: 102340 - DNA, 20 bp, Artificial Sequence
  Description of Artificial Sequence: Synthetic oligonucleotide
  Target: SCN9A; (+) strand; PAM type: YTN; PAM sequence: TTG
ataagcccaacttctttcta

SEQ ID NO: 102341 - DNA, 20 bp, Artificial Sequence
  Description of Artificial Sequence: Synthetic oligonucleotide
  Target: SCN9A; (+) strand; PAM type: YTN; PAM sequence: CTT
ctttctagttatcctagaat

SEQ ID NO: 102342 - DNA, 20 bp, Artificial Sequence
  Description of Artificial Sequence: Synthetic oligonucleotide
  Target: SCN9A; (+) strand; PAM type: YTN; PAM sequence: TTC
tttctagttatcctagaatt

SEQ ID NO: 102343 - DNA, 20 bp, Artificial Sequence
  Description of Artificial Sequence: Synthetic oligonucleotide
  Target: SCN9A; (+) strand; PAM type: YTN; PAM sequence: CTT
tctagttatcctagaatttt

SEQ ID NO: 102344 - DNA, 20 bp, Artificial Sequence
  Description of Artificial Sequence: Synthetic oligonucleotide
  Target: SCN9A; (+) strand; PAM type: YTN; PAM sequence: TTT
ctagttatcctagaatttta

SEQ ID NO: 102345 - DNA, 20 bp, Artificial Sequence
  Description of Artificial Sequence: Synthetic oligonucleotide
  Target: SCN9A; (+) strand; PAM type: YTN; PAM sequence: TTC
tagttatcctagaattttaa

SEQ ID NO: 102346 - DNA, 20 bp, Artificial Sequence
  Description of Artificial Sequence: Synthetic oligonucleotide
  Target: SCN9A; (+) strand; PAM type: YTN; PAM sequence: CTA
gttatcctagaattttaagt

SEQ ID NO: 102347 - DNA, 20 bp, Artificial Sequence
  Description of Artificial Sequence: Synthetic oligonucleotide
  Target: SCN9A; (+) strand; PAM type: YTN; PAM sequence: TTA
tcctagaattttaagtcatg

SEQ ID NO: 102348 - DNA, 20 bp, Artificial Sequence
  Description of Artificial Sequence: Synthetic oligonucleotide
  Target: SCN9A; (+) strand; PAM type: YTN; PAM sequence: CTA
gaattttaagtcatgatcat

SEQ ID NO: 102349 - DNA, 20 bp, Artificial Sequence
  Description of Artificial Sequence: Synthetic oligonucleotide
  Target: SCN9A; (+) strand; PAM type: YTN; PAM sequence: TTT
taagtcatgatcattcataa

SEQ ID NO: 102350 - DNA, 20 bp, Artificial Sequence
  Description of Artificial Sequence: Synthetic oligonucleotide
  Target: SCN9A; (+) strand; PAM type: YTN; PAM sequence: TTT
aagtcatgatcattcataaa

SEQ ID NO: 102351 - DNA, 20 bp, Artificial Sequence
  Description of Artificial Sequence: Synthetic oligonucleotide
  Target: SCN9A; (+) strand; PAM type: YTN; PAM sequence: TTA
agtcatgatcattcataaaa

SEQ ID NO: 102352 - DNA, 20 bp, Artificial Sequence
  Description of Artificial Sequence: Synthetic oligonucleotide
  Target: SCN9A; (+) strand; PAM type: YTN; PAM sequence: TTC
ataaaatgaatagggaaaat

SEQ ID NO: 102353 - DNA, 20 bp, Artificial Sequence
  Description of Artificial Sequence: Synthetic oligonucleotide
  Target: SCN9A; (+) strand; PAM type: YTN; PAM sequence: CTT
ggtagcatcaatacaaattt

SEQ ID NO: 102354 - DNA, 20 bp, Artificial Sequence
  Description of Artificial Sequence: Synthetic oligonucleotide
  Target: SCN9A; (+) strand; PAM type: YTN; PAM sequence: TTG
gtagcatcaatacaaattta

SEQ ID NO: 102355 - DNA, 20 bp, Artificial Sequence
  Description of Artificial Sequence: Synthetic oligonucleotide
  Target: SCN9A; (+) strand; PAM type: YTN; PAM sequence: TTT
aagtctatatactgctaata

SEQ ID NO: 102356 - DNA, 20 bp, Artificial Sequence
  Description of Artificial Sequence: Synthetic oligonucleotide
  Target: SCN9A; (+) strand; PAM type: YTN; PAM sequence: TTA
agtctatatactgctaataa

SEQ ID NO: 102357 - DNA, 20 bp, Artificial Sequence
  Description of Artificial Sequence: Synthetic oligonucleotide
  Target: SCN9A; (+) strand; PAM type: YTN; PAM sequence: CTA
tatactgctaataaatttct

SEQ ID NO: 102358 - DNA, 20 bp, Artificial Sequence
  Description of Artificial Sequence: Synthetic oligonucleotide
  Target: SCN9A; (+) strand; PAM type: YTN; PAM sequence: CTG
ctaataaatttcttgaggag

SEQ ID NO: 102359 - DNA, 20 bp, Artificial Sequence
  Description of Artificial Sequence: Synthetic oligonucleotide
  Target: SCN9A; (+) strand; PAM type: YTN; PAM sequence: CTA
ataaatttcttgaggagcag

SEQ ID NO: 102360 - DNA, 20 bp, Artificial Sequence
  Description of Artificial Sequence: Synthetic oligonucleotide
  Target: SCN9A; (+) strand; PAM type: YTN; PAM sequence: TTT
cttgaggagcaggccataca

SEQ ID NO: 102361 - DNA, 20 bp, Artificial Sequence
  Description of Artificial Sequence: Synthetic oligonucleotide
  Target: SCN9A; (+) strand; PAM type: YTN; PAM sequence: TTC
ttgaggagcaggccatacat

SEQ ID NO: 102362 - DNA, 20 bp, Artificial Sequence
  Description of Artificial Sequence: Synthetic oligonucleotide
  Target: SCN9A; (+) strand; PAM type: YTN; PAM sequence: CTT
gaggagcaggccatacatgt

SEQ ID NO: 102363 - DNA, 20 bp, Artificial Sequence
  Description of Artificial Sequence: Synthetic oligonucleotide
  Target: SCN9A; (+) strand; PAM type: YTN; PAM sequence: TTG
aggagcaggccatacatgtt

SEQ ID NO: 102364 - DNA, 20 bp, Artificial Sequence
  Description of Artificial Sequence: Synthetic oligonucleotide
  Target: SCN9A; (+) strand; PAM type: YTN; PAM sequence: TTG
atgaaattcttaaatctctg

SEQ ID NO: 102365 - DNA, 20 bp, Artificial Sequence
  Description of Artificial Sequence: Synthetic oligonucleotide
  Target: SCN9A; (+) strand; PAM type: YTN; PAM sequence: TTC
ttaaatctctgtaacatgga

SEQ ID NO: 102366 - DNA, 20 bp, Artificial Sequence
  Description of Artificial Sequence: Synthetic oligonucleotide
  Target: SCN9A; (+) strand; PAM type: YTN; PAM sequence: CTT
aaatctctgtaacatggaca

SEQ ID NO: 102367 - DNA, 20 bp, Artificial Sequence
  Description of Artificial Sequence: Synthetic oligonucleotide
  Target: SCN9A; (+) strand; PAM type: YTN; PAM sequence: TTA
aatctctgtaacatggacac

SEQ ID NO: 102368 - DNA, 20 bp, Artificial Sequence
  Description of Artificial Sequence: Synthetic oligonucleotide
  Target: SCN9A; (+) strand; PAM type: YTN; PAM sequence: CTC
tgtaacatggacacttttaa

SEQ ID NO: 102369 - DNA, 20 bp, Artificial Sequence
  Description of Artificial Sequence: Synthetic oligonucleotide
  Target: SCN9A; (+) strand; PAM type: YTN; PAM sequence: CTG
taacatggacacttttaaag

SEQ ID NO: 102370 - DNA, 20 bp, Artificial Sequence
  Description of Artificial Sequence: Synthetic oligonucleotide
  Target: SCN9A; (+) strand; PAM type: YTN; PAM sequence: CTT
ttaaaggaaactgtgcattt

SEQ ID NO: 102371 - DNA, 20 bp, Artificial Sequence
  Description of Artificial Sequence: Synthetic oligonucleotide
  Target: SCN9A; (+) strand; PAM type: YTN; PAM sequence: TTT
taaaggaaactgtgcatttg

SEQ ID NO: 102372 - DNA, 20 bp, Artificial Sequence
  Description of Artificial Sequence: Synthetic oligonucleotide
  Target: SCN9A; (+) strand; PAM type: YTN; PAM sequence: TTT
aaaggaaactgtgcatttgc

SEQ ID NO: 102373 - DNA, 20 bp, Artificial Sequence
  Description of Artificial Sequence: Synthetic oligonucleotide
  Target: SCN9A; (+) strand; PAM type: YTN; PAM sequence: TTA
aaggaaactgtgcatttgct

SEQ ID NO: 102374 - DNA, 20 bp, Artificial Sequence
  Description of Artificial Sequence: Synthetic oligonucleotide
  Target: SCN9A; (+) strand; PAM type: YTN; PAM sequence: CTG
tgcatttgcttatagcacta

SEQ ID NO: 102375 - DNA, 20 bp, Artificial Sequence
  Description of Artificial Sequence: Synthetic oligonucleotide
  Target: SCN9A; (+) strand; PAM type: YTN; PAM sequence: TTT
gcttatagcactaatttcag

SEQ ID NO: 102376 - DNA, 20 bp, Artificial Sequence
  Description of Artificial Sequence: Synthetic oligonucleotide
  Target: SCN9A; (+) strand; PAM type: YTN; PAM sequence: TTG
cttatagcactaatttcagc

SEQ ID NO: 102377 - DNA, 20 bp, Artificial Sequence
  Description of Artificial Sequence: Synthetic oligonucleotide
  Target: SCN9A; (+) strand; PAM type: YTN; PAM sequence: CTT
atagcactaatttcagcaag

SEQ ID NO: 102378 - DNA, 20 bp, Artificial Sequence
  Description of Artificial Sequence: Synthetic oligonucleotide
  Target: SCN9A; (+) strand; PAM type: YTN; PAM sequence: TTA
tagcactaatttcagcaagc

SEQ ID NO: 102379 - DNA, 20 bp, Artificial Sequence
  Description of Artificial Sequence: Synthetic oligonucleotide
  Target: SCN9A; (+) strand; PAM type: YTN; PAM sequence: CTA
atttcagcaagcacaaaatt

SEQ ID NO: 102380 - DNA, 20 bp, Artificial Sequence
  Description of Artificial Sequence: Synthetic oligonucleotide
  Target: SCN9A; (+) strand; PAM type: YTN; PAM sequence: TTT
cagcaagcacaaaatttata

SEQ ID NO: 102381 - DNA, 20 bp, Artificial Sequence
  Description of Artificial Sequence: Synthetic oligonucleotide
  Target: SCN9A; (+) strand; PAM type: YTN; PAM sequence: TTC
agcaagcacaaaatttatat

SEQ ID NO: 102382 - DNA, 20 bp, Artificial Sequence
  Description of Artificial Sequence: Synthetic oligonucleotide
  Target: SCN9A; (+) strand; PAM type: YTN; PAM sequence: TTT
atattgactggatgtcgtac

SEQ ID NO: 102383 - DNA, 20 bp, Artificial Sequence
  Description of Artificial Sequence: Synthetic oligonucleotide
  Target: SCN9A; (+) strand; PAM type: YTN; PAM sequence: TTA
tattgactggatgtcgtaca

SEQ ID NO: 102384 - DNA, 20 bp, Artificial Sequence
  Description of Artificial Sequence: Synthetic oligonucleotide
  Target: SCN9A; (+) strand; PAM type: YTN; PAM sequence: TTG
actggatgtcgtacaccttt

SEQ ID NO: 102385 - DNA, 20 bp, Artificial Sequence
  Description of Artificial Sequence: Synthetic oligonucleotide
  Target: SCN9A; (+) strand; PAM type: YTN; PAM sequence: CTG
gatgtcgtacacctttgctt

SEQ ID NO: 102386 - DNA, 20 bp, Artificial Sequence
  Description of Artificial Sequence: Synthetic oligonucleotide
  Target: SCN9A; (+) strand; PAM type: YTN; PAM sequence: CTT
tgcttcttacataaaatgat

SEQ ID NO: 102387 - DNA, 20 bp, Artificial Sequence
  Description of Artificial Sequence: Synthetic oligonucleotide
  Target: SCN9A; (+) strand; PAM type: YTN; PAM sequence: TTT
gcttcttacataaaatgata

SEQ ID NO: 102388 - DNA, 20 bp, Artificial Sequence
  Description of Artificial Sequence: Synthetic oligonucleotide
  Target: SCN9A; (+) strand; PAM type: YTN; PAM sequence: TTG
cttcttacataaaatgatat

SEQ ID NO: 102389 - DNA, 20 bp, Artificial Sequence
  Description of Artificial Sequence: Synthetic oligonucleotide
  Target: SCN9A; (+) strand; PAM type: YTN; PAM sequence: CTT
cttacataaaatgatatttg

SEQ ID NO: 102390 - DNA, 20 bp, Artificial Sequence
  Description of Artificial Sequence: Synthetic oligonucleotide
  Target: SCN9A; (+) strand; PAM type: YTN; PAM sequence: TTC
ttacataaaatgatatttgg

SEQ ID NO: 102391 - DNA, 20 bp, Artificial Sequence
  Description of Artificial Sequence: Synthetic oligonucleotide
  Target: SCN9A; (+) strand; PAM type: YTN; PAM sequence: CTT
acataaaatgatatttggtg

SEQ ID NO: 102392 - DNA, 20 bp, Artificial Sequence
  Description of Artificial Sequence: Synthetic oligonucleotide
  Target: SCN9A; (+) strand; PAM type: YTN; PAM sequence: TTA
cataaaatgatatttggtgt

SEQ ID NO: 102393 - DNA, 20 bp, Artificial Sequence
  Description of Artificial Sequence: Synthetic oligonucleotide
  Target: SCN9A; (+) strand; PAM type: YTN; PAM sequence: TTT
ggtgtgtatttaaagaaaat

SEQ ID NO: 102394 - DNA, 20 bp, Artificial Sequence
  Description of Artificial Sequence: Synthetic oligonucleotide
  Target: SCN9A; (+) strand; PAM type: YTN; PAM sequence: TTG
gtgtgtatttaaagaaaatc

SEQ ID NO: 102395 - DNA, 20 bp, Artificial Sequence
  Description of Artificial Sequence: Synthetic oligonucleotide
  Target: SCN9A; (+) strand; PAM type: YTN; PAM sequence: TTT
aaagaaaatccatgcactct

SEQ ID NO: 102396 - DNA, 20 bp, Artificial Sequence
  Description of Artificial Sequence: Synthetic oligonucleotide
  Target: SCN9A; (+) strand; PAM type: YTN; PAM sequence: TTA
aagaaaatccatgcactctt

SEQ ID NO: 102397 - DNA, 20 bp, Artificial Sequence
  Description of Artificial Sequence: Synthetic oligonucleotide
  Target: SCN9A; (+) strand; PAM type: YTN; PAM sequence: CTC
tttgtagtttgctgatgtct

SEQ ID NO: 102398 - DNA, 20 bp, Artificial Sequence
  Description of Artificial Sequence: Synthetic oligonucleotide
  Target: SCN9A; (+) strand; PAM type: YTN; PAM sequence: CTT
tgtagtttgctgatgtcttt

SEQ ID NO: 102399 - DNA, 20 bp, Artificial Sequence
  Description of Artificial Sequence: Synthetic oligonucleotide
  Target: SCN9A; (+) strand; PAM type: YTN; PAM sequence: TTT
gtagtttgctgatgtcttta

SEQ ID NO: 102400 - DNA, 20 bp, Artificial Sequence
  Description of Artificial Sequence: Synthetic oligonucleotide
  Target: SCN9A; (+) strand; PAM type: YTN; PAM sequence: TTG
tagtttgctgatgtctttat

SEQ ID NO: 102401 - DNA, 20 bp, Artificial Sequence
  Description of Artificial Sequence: Synthetic oligonucleotide
  Target: SCN9A; (+) strand; PAM type: YTN; PAM sequence: TTT
gctgatgtctttattttcca

SEQ ID NO: 102402 - DNA, 20 bp, Artificial Sequence
  Description of Artificial Sequence: Synthetic oligonucleotide
  Target: SCN9A; (+) strand; PAM type: YTN; PAM sequence: TTG
ctgatgtctttattttccaa

SEQ ID NO: 102403 - DNA, 20 bp, Artificial Sequence
  Description of Artificial Sequence: Synthetic oligonucleotide
  Target: SCN9A; (+) strand; PAM type: YTN; PAM sequence: CTG
atgtctttattttccaatca

SEQ ID NO: 102404 - DNA, 20 bp, Artificial Sequence
  Description of Artificial Sequence: Synthetic oligonucleotide
  Target: SCN9A; (+) strand; PAM type: YTN; PAM sequence: CTT
tattttccaatcattttgct

SEQ ID NO: 102405 - DNA, 20 bp, Artificial Sequence
  Description of Artificial Sequence: Synthetic oligonucleotide
  Target: SCN9A; (+) strand; PAM type: YTN; PAM sequence: TTT
attttccaatcattttgctt

SEQ ID NO: 102406 - DNA, 20 bp, Artificial Sequence
  Description of Artificial Sequence: Synthetic oligonucleotide
  Target: SCN9A; (+) strand; PAM type: YTN; PAM sequence: TTA
ttttccaatcattttgctta

SEQ ID NO: 102407 - DNA, 20 bp, Artificial Sequence
  Description of Artificial Sequence: Synthetic oligonucleotide
  Target: SCN9A; (+) strand; PAM type: YTN; PAM sequence: TTT
tccaatcattttgcttaacc

SEQ ID NO: 102408 - DNA, 20 bp, Artificial Sequence
  Description of Artificial Sequence: Synthetic oligonucleotide
  Target: SCN9A; (+) strand; PAM type: YTN; PAM sequence: TTT
ccaatcattttgcttaaccc

SEQ ID NO: 102409 - DNA, 20 bp, Artificial Sequence
  Description of Artificial Sequence: Synthetic oligonucleotide
  Target: SCN9A; (+) strand; PAM type: YTN; PAM sequence: TTC
caatcattttgcttaaccca

SEQ ID NO: 102410 - DNA, 20 bp, Artificial Sequence
  Description of Artificial Sequence: Synthetic oligonucleotide
  Target: SCN9A; (+) strand; PAM type: YTN; PAM sequence: TTT
tgcttaacccatgaatgtta

SEQ ID NO: 102411 - DNA, 20 bp, Artificial Sequence
  Description of Artificial Sequence: Synthetic oligonucleotide
  Target: SCN9A; (+) strand; PAM type: YTN; PAM sequence: TTT
gcttaacccatgaatgttat

SEQ ID NO: 102412 - DNA, 20 bp, Artificial Sequence
  Description of Artificial Sequence: Synthetic oligonucleotide
  Target: SCN9A; (+) strand; PAM type: YTN; PAM sequence: TTG
cttaacccatgaatgttata

SEQ ID NO: 102413 - DNA, 20 bp, Artificial Sequence
  Description of Artificial Sequence: Synthetic oligonucleotide
  Target: SCN9A; (+) strand; PAM type: YTN; PAM sequence: CTT
aacccatgaatgttataaga

SEQ ID NO: 102414 - DNA, 20 bp, Artificial Sequence
  Description of Artificial Sequence: Synthetic oligonucleotide
  Target: SCN9A; (+) strand; PAM type: YTN; PAM sequence: TTA
acccatgaatgttataagaa

SEQ ID NO: 102415 - DNA, 20 bp, Artificial Sequence
  Description of Artificial Sequence: Synthetic oligonucleotide
  Target: SCN9A; (+) strand; PAM type: YTN; PAM sequence: TTA
taagaaaccagttgagaaaa

SEQ ID NO: 102416 - DNA, 20 bp, Artificial Sequence
  Description of Artificial Sequence: Synthetic oligonucleotide
  Target: SCN9A; (+) strand; PAM type: YTN; PAM sequence: TTG
agaaaatcttggacactgaa

SEQ ID NO: 102417 - DNA, 20 bp, Artificial Sequence
  Description of Artificial Sequence: Synthetic oligonucleotide
  Target: SCN9A; (+) strand; PAM type: YTN; PAM sequence: CTT
ggacactgaaagcaagtcga

SEQ ID NO: 102418 - DNA, 20 bp, Artificial Sequence
  Description of Artificial Sequence: Synthetic oligonucleotide
  Target: SCN9A; (+) strand; PAM type: YTN; PAM sequence: TTG
gacactgaaagcaagtcgat

SEQ ID NO: 102419 - DNA, 20 bp, Artificial Sequence
  Description of Artificial Sequence: Synthetic oligonucleotide
  Target: SCN9A; (+) strand; PAM type: YTN; PAM sequence: CTG
aaagcaagtcgatgattttt

SEQ ID NO: 102420 - DNA, 20 bp, Artificial Sequence
  Description of Artificial Sequence: Synthetic oligonucleotide
  Target: SCN9A; (+) strand; PAM type: YTN; PAM sequence: TTT
ttcaaaaaatactaatgctg

SEQ ID NO: 102421 - DNA, 20 bp, Artificial Sequence
  Description of Artificial Sequence: Synthetic oligonucleotide
  Target: SCN9A; (+) strand; PAM type: YTN; PAM sequence: TTT
tcaaaaaatactaatgctga

SEQ ID NO: 102422 - DNA, 20 bp, Artificial Sequence
  Description of Artificial Sequence: Synthetic oligonucleotide
  Target: SCN9A; (+) strand; PAM type: YTN; PAM sequence: TTT
caaaaaatactaatgctgag

SEQ ID NO: 102423 - DNA, 20 bp, Artificial Sequence
  Description of Artificial Sequence: Synthetic oligonucleotide
  Target: SCN9A; (+) strand; PAM type: YTN; PAM sequence: TTC
aaaaaatactaatgctgagg

SEQ ID NO: 102424 - DNA, 20 bp, Artificial Sequence
  Description of Artificial Sequence: Synthetic oligonucleotide
  Target: SCN9A; (+) strand; PAM type: YTN; PAM sequence: CTA
atgctgagggtaagcccatg

SEQ ID NO: 102425 - DNA, 20 bp, Artificial Sequence
  Description of Artificial Sequence: Synthetic oligonucleotide
  Target: SCN9A; (+) strand; PAM type: YTN; PAM sequence: CTG
agggtaagcccatgactaga

SEQ ID NO: 102426 - DNA, 20 bp, Artificial Sequence
  Description of Artificial Sequence: Synthetic oligonucleotide
  Target: SCN9A; (+) strand; PAM type: YTN; PAM sequence: CTA
gataagtcattagcatctgt

SEQ ID NO: 102427 - DNA, 20 bp, Artificial Sequence
  Description of Artificial Sequence: Synthetic oligonucleotide
  Target: SCN9A; (+) strand; PAM type: YTN; PAM sequence: TTA
gcatctgtgctatcataact

SEQ ID NO: 102428 - DNA, 20 bp, Artificial Sequence
  Description of Artificial Sequence: Synthetic oligonucleotide
  Target: SCN9A; (+) strand; PAM type: YTN; PAM sequence: CTG
tgctatcataacttctgtat

SEQ ID NO: 102429 - DNA, 20 bp, Artificial Sequence
  Description of Artificial Sequence: Synthetic oligonucleotide
  Target: SCN9A; (+) strand; PAM type: YTN; PAM sequence: CTA
tcataacttctgtataagat

SEQ ID NO: 102430 - DNA, 20 bp, Artificial Sequence
  Description of Artificial Sequence: Synthetic oligonucleotide
  Target: SCN9A; (+) strand; PAM type: YTN; PAM sequence: CTT
ctgtataagattgttaacag

SEQ ID NO: 102431 - DNA, 20 bp, Artificial Sequence
  Description of Artificial Sequence: Synthetic oligonucleotide
  Target: SCN9A; (+) strand; PAM type: YTN; PAM sequence: TTC
tgtataagattgttaacaga

SEQ ID NO: 102432 - DNA, 20 bp, Artificial Sequence
  Description of Artificial Sequence: Synthetic oligonucleotide
  Target: SCN9A; (+) strand; PAM type: YTN; PAM sequence: CTG
tataagattgttaacagaat

SEQ ID NO: 102433 - DNA, 20 bp, Artificial Sequence
  Description of Artificial Sequence: Synthetic oligonucleotide
  Target: SCN9A; (+) strand; PAM type: YTN; PAM sequence: TTG
ttaacagaatccttgaagaa

SEQ ID NO: 102434 - DNA, 20 bp, Artificial Sequence
  Description of Artificial Sequence: Synthetic oligonucleotide
  Target: SCN9A; (+) strand; PAM type: YTN; PAM sequence: TTA
acagaatccttgaagaataa

SEQ ID NO: 102435 - DNA, 20 bp, Artificial Sequence
  Description of Artificial Sequence: Synthetic oligonucleotide
  Target: SCN9A; (+) strand; PAM type: YTN; PAM sequence: CTT
gaagaataagaaaagtagaa

SEQ ID NO: 102436 - DNA, 20 bp, Artificial Sequence
  Description of Artificial Sequence: Synthetic oligonucleotide
  Target: SCN9A; (+) strand; PAM type: YTN; PAM sequence: TTG
aagaataagaaaagtagaag

SEQ ID NO: 102437 - DNA, 20 bp, Artificial Sequence
  Description of Artificial Sequence: Synthetic oligonucleotide
  Target: SCN9A; (+) strand; PAM type: YTN; PAM sequence: CTG
tgctagtaagtttataatca

SEQ ID NO: 102438 - DNA, 20 bp, Artificial Sequence
  Description of Artificial Sequence: Synthetic oligonucleotide
  Target: SCN9A; (+) strand; PAM type: YTN; PAM sequence: CTA
gtaagtttataatcattatc

SEQ ID NO: 102439 - DNA, 20 bp, Artificial Sequence
  Description of Artificial Sequence: Synthetic oligonucleotide
  Target: SCN9A; (+) strand; PAM type: YTN; PAM sequence: TTT
ataatcattatcttatttga

SEQ ID NO: 102440 - DNA, 20 bp, Artificial Sequence
  Description of Artificial Sequence: Synthetic oligonucleotide
  Target: SCN9A; (+) strand; PAM type: YTN; PAM sequence: TTA
taatcattatcttatttgat

SEQ ID NO: 102441 - DNA, 20 bp, Artificial Sequence
  Description of Artificial Sequence: Synthetic oligonucleotide
  Target: SCN9A; (+) strand; PAM type: YTN; PAM sequence: TTA
tcttatttgatcctcttagc

SEQ ID NO: 102442 - DNA, 20 bp, Artificial Sequence
  Description of Artificial Sequence: Synthetic oligonucleotide
  Target: SCN9A; (+) strand; PAM type: YTN; PAM sequence: CTT
atttgatcctcttagcatcg

SEQ ID NO: 102443 - DNA, 20 bp, Artificial Sequence
  Description of Artificial Sequence: Synthetic oligonucleotide
  Target: SCN9A; (+) strand; PAM type: YTN; PAM sequence: TTA
tttgatcctcttagcatcgc

SEQ ID NO: 102444 - DNA, 20 bp, Artificial Sequence
  Description of Artificial Sequence: Synthetic oligonucleotide
  Target: SCN9A; (+) strand; PAM type: YTN; PAM sequence: TTT
gatcctcttagcatcgctgt

SEQ ID NO: 102445 - DNA, 20 bp, Artificial Sequence
  Description of Artificial Sequence: Synthetic oligonucleotide
  Target: SCN9A; (+) strand; PAM type: YTN; PAM sequence: TTG
atcctcttagcatcgctgtg

SEQ ID NO: 102446 - DNA, 20 bp, Artificial Sequence
  Description of Artificial Sequence: Synthetic oligonucleotide
  Target: SCN9A; (+) strand; PAM type: YTN; PAM sequence: CTC
ttagcatcgctgtgatgtgg

SEQ ID NO: 102447 - DNA, 20 bp, Artificial Sequence
  Description of Artificial Sequence: Synthetic oligonucleotide
  Target: SCN9A; (+) strand; PAM type: YTN; PAM sequence: CTT
agcatcgctgtgatgtggat

SEQ ID NO: 102448 - DNA, 20 bp, Artificial Sequence
  Description of Artificial Sequence: Synthetic oligonucleotide
  Target: SCN9A; (+) strand; PAM type: YTN; PAM sequence: TTA
gcatcgctgtgatgtggatg

SEQ ID NO: 102449 - DNA, 20 bp, Artificial Sequence
  Description of Artificial Sequence: Synthetic oligonucleotide
  Target: SCN9A; (+) strand; PAM type: YTN; PAM sequence: CTG
tgatgtggatgctgatatcc

SEQ ID NO: 102450 - DNA, 20 bp, Artificial Sequence
  Description of Artificial Sequence: Synthetic oligonucleotide
  Target: SCN9A; (+) strand; PAM type: YTN; PAM sequence: CTG
atatccccattttacagatg

SEQ ID NO: 102451 - DNA, 20 bp, Artificial Sequence
  Description of Artificial Sequence: Synthetic oligonucleotide
  Target: SCN9A; (+) strand; PAM type: YTN; PAM sequence: TTT
tacagatgagatatctgaag

SEQ ID NO: 102452 - DNA, 20 bp, Artificial Sequence
  Description of Artificial Sequence: Synthetic oligonucleotide
  Target: SCN9A; (+) strand; PAM type: YTN; PAM sequence: TTT
acagatgagatatctgaaga

SEQ ID NO: 102453 - DNA, 20 bp, Artificial Sequence
  Description of Artificial Sequence: Synthetic oligonucleotide
  Target: SCN9A; (+) strand; PAM type: YTN; PAM sequence: TTA
cagatgagatatctgaagaa

SEQ ID NO: 102454 - DNA, 20 bp, Artificial Sequence
  Description of Artificial Sequence: Synthetic oligonucleotide
  Target: SCN9A; (+) strand; PAM type: YTN; PAM sequence: CTG
aagaacaagattttaaattg

SEQ ID NO: 102455 - DNA, 20 bp, Artificial Sequence
  Description of Artificial Sequence: Synthetic oligonucleotide
  Target: SCN9A; (+) strand; PAM type: YTN; PAM sequence: TTT
taaattgtgcacaagttctc

SEQ ID NO: 102456 - DNA, 20 bp, Artificial Sequence
  Description of Artificial Sequence: Synthetic oligonucleotide
  Target: SCN9A; (+) strand; PAM type: YTN; PAM sequence: TTT
aaattgtgcacaagttctca

SEQ ID NO: 102457 - DNA, 20 bp, Artificial Sequence
  Description of Artificial Sequence: Synthetic oligonucleotide
  Target: SCN9A; (+) strand; PAM type: YTN; PAM sequence: TTA
aattgtgcacaagttctcac

SEQ ID NO: 102458 - DNA, 20 bp, Artificial Sequence
  Description of Artificial Sequence: Synthetic oligonucleotide
  Target: SCN9A; (+) strand; PAM type: YTN; PAM sequence: TTG
tgcacaagttctcacaggca

SEQ ID NO: 102459 - DNA, 20 bp, Artificial Sequence
  Description of Artificial Sequence: Synthetic oligonucleotide
  Target: SCN9A; (+) strand; PAM type: YTN; PAM sequence: TTC
tcacaggcagataagtcggc

SEQ ID NO: 102460 - DNA, 20 bp, Artificial Sequence
  Description of Artificial Sequence: Synthetic oligonucleotide
  Target: SCN9A; (+) strand; PAM type: YTN; PAM sequence: CTC
acaggcagataagtcggcaa

SEQ ID NO: 102461 - DNA, 20 bp, Artificial Sequence
  Description of Artificial Sequence: Synthetic oligonucleotide
  Target: SCN9A; (+) strand; PAM type: YTN; PAM sequence: TTA
gaacatatgtttatcaggct

SEQ ID NO: 102462 - DNA, 20 bp, Artificial Sequence
  Description of Artificial Sequence: Synthetic oligonucleotide
  Target: SCN9A; (+) strand; PAM type: YTN; PAM sequence: TTT
atcaggctccaaagtttgaa

SEQ ID NO: 102463 - DNA, 20 bp, Artificial Sequence
  Description of Artificial Sequence: Synthetic oligonucleotide
  Target: SCN9A; (+) strand; PAM type: YTN; PAM sequence: TTA
tcaggctccaaagtttgaac

SEQ ID NO: 102464 - DNA, 20 bp, Artificial Sequence
  Description of Artificial Sequence: Synthetic oligonucleotide
  Target: SCN9A; (+) strand; PAM type: YTN; PAM sequence: CTC
caaagtttgaactttgtatt

SEQ ID NO: 102465 - DNA, 20 bp, Artificial Sequence
  Description of Artificial Sequence: Synthetic oligonucleotide
  Target: SCN9A; (+) strand; PAM type: YTN; PAM sequence: TTT
gaactttgtattactgtatt

SEQ ID NO: 102466 - DNA, 20 bp, Artificial Sequence
  Description of Artificial Sequence: Synthetic oligonucleotide
  Target: SCN9A; (+) strand; PAM type: YTN; PAM sequence: TTG
aactttgtattactgtatta

SEQ ID NO: 102467 - DNA, 20 bp, Artificial Sequence
  Description of Artificial Sequence: Synthetic oligonucleotide
  Target: SCN9A; (+) strand; PAM type: YTN; PAM sequence: CTT
tgtattactgtattacattg

SEQ ID NO: 102468 - DNA, 20 bp, Artificial Sequence
  Description of Artificial Sequence: Synthetic oligonucleotide
  Target: SCN9A; (+) strand; PAM type: YTN; PAM sequence: TTT
gtattactgtattacattgc

SEQ ID NO: 102469 - DNA, 20 bp, Artificial Sequence
  Description of Artificial Sequence: Synthetic oligonucleotide
  Target: SCN9A; (+) strand; PAM type: YTN; PAM sequence: TTG
tattactgtattacattgca

SEQ ID NO: 102470 - DNA, 20 bp, Artificial Sequence
  Description of Artificial Sequence: Synthetic oligonucleotide
  Target: SCN9A; (+) strand; PAM type: YTN; PAM sequence: TTA
ctgtattacattgcagccct

SEQ ID NO: 102471 - DNA, 20 bp, Artificial Sequence
  Description of Artificial Sequence: Synthetic oligonucleotide
  Target: SCN9A; (+) strand; PAM type: YTN; PAM sequence: CTG
tattacattgcagccctact

SEQ ID NO: 102472 - DNA, 20 bp, Artificial Sequence
  Description of Artificial Sequence: Synthetic oligonucleotide
  Target: SCN9A; (+) strand; PAM type: YTN; PAM sequence: TTA
cattgcagccctactctggg

SEQ ID NO: 102473 - DNA, 20 bp, Artificial Sequence
  Description of Artificial Sequence: Synthetic oligonucleotide
  Target: SCN9A; (+) strand; PAM type: YTN; PAM sequence: TTG
cagccctactctgggcttgt

SEQ ID NO: 102474 - DNA, 20 bp, Artificial Sequence
  Description of Artificial Sequence: Synthetic oligonucleotide
  Target: SCN9A; (+) strand; PAM type: YTN; PAM sequence: CTA
ctctgggcttgtatttttac

SEQ ID NO: 102475 - DNA, 20 bp, Artificial Sequence
  Description of Artificial Sequence: Synthetic oligonucleotide
  Target: SCN9A; (+) strand; PAM type: YTN; PAM sequence: CTC
tgggcttgtatttttaccta

SEQ ID NO: 102476 - DNA, 20 bp, Artificial Sequence
  Description of Artificial Sequence: Synthetic oligonucleotide
  Target: SCN9A; (+) strand; PAM type: YTN; PAM sequence: CTG
ggcttgtatttttacctaga

SEQ ID NO: 102477 - DNA, 20 bp, Artificial Sequence
  Description of Artificial Sequence: Synthetic oligonucleotide
  Target: SCN9A; (+) strand; PAM type: YTN; PAM sequence: CTT
gtatttttacctagatgata

SEQ ID NO: 102478 - DNA, 20 bp, Artificial Sequence
  Description of Artificial Sequence: Synthetic oligonucleotide
  Target: SCN9A; (+) strand; PAM type: YTN; PAM sequence: TTG
tatttttacctagatgatac

SEQ ID NO: 102479 - DNA, 20 bp, Artificial Sequence
  Description of Artificial Sequence: Synthetic oligonucleotide
  Target: SCN9A; (+) strand; PAM type: YTN; PAM sequence: TTT
ttacctagatgatacaatac

SEQ ID NO: 102480 - DNA, 20 bp, Artificial Sequence
  Description of Artificial Sequence: Synthetic oligonucleotide
  Target: SCN9A; (+) strand; PAM type: YTN; PAM sequence: TTT
tacctagatgatacaatact

SEQ ID NO: 102481 - DNA, 20 bp, Artificial Sequence
  Description of Artificial Sequence: Synthetic oligonucleotide
  Target: SCN9A; (+) strand; PAM type: YTN; PAM sequence: TTT
acctagatgatacaatactt

SEQ ID NO: 102482 - DNA, 20 bp, Artificial Sequence
  Description of Artificial Sequence: Synthetic oligonucleotide
  Target: SCN9A; (+) strand; PAM type: YTN; PAM sequence: TTA
cctagatgatacaatacttg

SEQ ID NO: 102483 - DNA, 20 bp, Artificial Sequence
  Description of Artificial Sequence: Synthetic oligonucleotide
  Target: SCN9A; (+) strand; PAM type: YTN; PAM sequence: CTA
gatgatacaatacttgttca

SEQ ID NO: 102484 - DNA, 20 bp, Artificial Sequence
  Description of Artificial Sequence: Synthetic oligonucleotide
  Target: SCN9A; (+) strand; PAM type: YTN; PAM sequence: CTT
gttcagacaatactgcatta

SEQ ID NO: 102485 - DNA, 20 bp, Artificial Sequence
  Description of Artificial Sequence: Synthetic oligonucleotide
  Target: SCN9A; (+) strand; PAM type: YTN; PAM sequence: TTG
ttcagacaatactgcattat

SEQ ID NO: 102486 - DNA, 20 bp, Artificial Sequence
  Description of Artificial Sequence: Synthetic oligonucleotide
  Target: SCN9A; (+) strand; PAM type: YTN; PAM sequence: TTC
agacaatactgcattatccc

SEQ ID NO: 102487 - DNA, 20 bp, Artificial Sequence
  Description of Artificial Sequence: Synthetic oligonucleotide
  Target: SCN9A; (+) strand; PAM type: YTN; PAM sequence: CTG
cattatccctgacaaattcc

SEQ ID NO: 102488 - DNA, 20 bp, Artificial Sequence
  Description of Artificial Sequence: Synthetic oligonucleotide
  Target: SCN9A; (+) strand; PAM type: YTN; PAM sequence: TTA
tccctgacaaattccagaag

SEQ ID NO: 102489 - DNA, 20 bp, Artificial Sequence
  Description of Artificial Sequence: Synthetic oligonucleotide
  Target: SCN9A; (+) strand; PAM type: YTN; PAM sequence: CTG
acaaattccagaagtagtaa

SEQ ID NO: 102490 - DNA, 20 bp, Artificial Sequence
  Description of Artificial Sequence: Synthetic oligonucleotide
  Target: SCN9A; (+) strand; PAM type: YTN; PAM sequence: TTC
cagaagtagtaagaaattca

SEQ ID NO: 102491 - DNA, 20 bp, Artificial Sequence
  Description of Artificial Sequence: Synthetic oligonucleotide
  Target: SCN9A; (+) strand; PAM type: YTN; PAM sequence: TTC
agcatatcagaaagcataca

SEQ ID NO: 102492 - DNA, 20 bp, Artificial Sequence
  Description of Artificial Sequence: Synthetic oligonucleotide
  Target: SCN9A; (+) strand; PAM type: YTN; PAM sequence: CTG
ttacaaaacaagagactaag

SEQ ID NO: 102493 - DNA, 20 bp, Artificial Sequence
  Description of Artificial Sequence: Synthetic oligonucleotide
  Target: SCN9A; (+) strand; PAM type: YTN; PAM sequence: TTA
caaaacaagagactaaggcc

SEQ ID NO: 102494 - DNA, 20 bp, Artificial Sequence
  Description of Artificial Sequence: Synthetic oligonucleotide
  Target: SCN9A; (+) strand; PAM type: YTN; PAM sequence: CTA
aggccaaatgtaaagaactt

SEQ ID NO: 102495 - DNA, 20 bp, Artificial Sequence
  Description of Artificial Sequence: Synthetic oligonucleotide
  Target: SCN9A; (+) strand; PAM type: YTN; PAM sequence: CTT
tacatgtcaagttaaggact

SEQ ID NO: 102496 - DNA, 20 bp, Artificial Sequence
  Description of Artificial Sequence: Synthetic oligonucleotide
  Target: SCN9A; (+) strand; PAM type: YTN; PAM sequence: TTT
acatgtcaagttaaggactt

SEQ ID NO: 102497 - DNA, 20 bp, Artificial Sequence
  Description of Artificial Sequence: Synthetic oligonucleotide
  Target: SCN9A; (+) strand; PAM type: YTN; PAM sequence: TTA
catgtcaagttaaggacttc

SEQ ID NO: 102498 - DNA, 20 bp, Artificial Sequence
  Description of Artificial Sequence: Synthetic oligonucleotide
  Target: SCN9A; (+) strand; PAM type: YTN; PAM sequence: TTA
aggacttcagactttaccct

SEQ ID NO: 102499 - DNA, 20 bp, Artificial Sequence
  Description of Artificial Sequence: Synthetic oligonucleotide
  Target: SCN9A; (+) strand; PAM type: YTN; PAM sequence: CTT
cagactttaccctagaggcc

SEQ ID NO: 102500 - DNA, 20 bp, Artificial Sequence
  Description of Artificial Sequence: Synthetic oligonucleotide
  Target: SCN9A; (+) strand; PAM type: YTN; PAM sequence: TTC
agactttaccctagaggcca

SEQ ID NO: 102501 - DNA, 20 bp, Artificial Sequence
  Description of Artificial Sequence: Synthetic oligonucleotide
  Target: SCN9A; (+) strand; PAM type: YTN; PAM sequence: CTT
taccctagaggccaaggatt

SEQ ID NO: 102502 - DNA, 20 bp, Artificial Sequence
  Description of Artificial Sequence: Synthetic oligonucleotide
  Target: SCN9A; (+) strand; PAM type: YTN; PAM sequence: TTT
accctagaggccaaggattc

SEQ ID NO: 102503 - DNA, 20 bp, Artificial Sequence
  Description of Artificial Sequence: Synthetic oligonucleotide
  Target: SCN9A; (+) strand; PAM type: YTN; PAM sequence: TTA
ccctagaggccaaggattct

SEQ ID NO: 102504 - DNA, 20 bp, Artificial Sequence
  Description of Artificial Sequence: Synthetic oligonucleotide
  Target: SCN9A; (+) strand; PAM type: YTN; PAM sequence: CTA
gaggccaaggattctcacat

SEQ ID NO: 102505 - DNA, 20 bp, Artificial Sequence
  Description of Artificial Sequence: Synthetic oligonucleotide
  Target: SCN9A; (+) strand; PAM type: YTN; PAM sequence: TTC
tcacattttagtgtgcatgc

SEQ ID NO: 102506 - DNA, 20 bp, Artificial Sequence
  Description of Artificial Sequence: Synthetic oligonucleotide
  Target: SCN9A; (+) strand; PAM type: YTN; PAM sequence: CTC
acattttagtgtgcatgcaa

SEQ ID NO: 102507 - DNA, 20 bp, Artificial Sequence
  Description of Artificial Sequence: Synthetic oligonucleotide
  Target: SCN9A; (+) strand; PAM type: YTN; PAM sequence: TTT
tagtgtgcatgcaaatcctc

SEQ ID NO: 102508 - DNA, 20 bp, Artificial Sequence
  Description of Artificial Sequence: Synthetic oligonucleotide
  Target: SCN9A; (+) strand; PAM type: YTN; PAM sequence: TTT
agtgtgcatgcaaatcctct

SEQ ID NO: 102509 - DNA, 20 bp, Artificial Sequence
  Description of Artificial Sequence: Synthetic oligonucleotide
  Target: SCN9A; (+) strand; PAM type: YTN; PAM sequence: TTA
gtgtgcatgcaaatcctctt

SEQ ID NO: 102510 - DNA, 20 bp, Artificial Sequence
  Description of Artificial Sequence: Synthetic oligonucleotide
  Target: SCN9A; (+) strand; PAM type: YTN; PAM sequence: CTC
ttaagggcttgggccctatc

SEQ ID NO: 102511 - DNA, 20 bp, Artificial Sequence
  Description of Artificial Sequence: Synthetic oligonucleotide
  Target: SCN9A; (+) strand; PAM type: YTN; PAM sequence: CTT
aagggcttgggccctatctc

SEQ ID NO: 102512 - DNA, 20 bp, Artificial Sequence
  Description of Artificial Sequence: Synthetic oligonucleotide
  Target: SCN9A; (+) strand; PAM type: YTN; PAM sequence: TTA
agggcttgggccctatctcc

SEQ ID NO: 102513 - DNA, 20 bp, Artificial Sequence
  Description of Artificial Sequence: Synthetic oligonucleotide
  Target: SCN9A; (+) strand; PAM type: YTN; PAM sequence: CTT
gggccctatctccagagttc

SEQ ID NO: 102514 - DNA, 20 bp, Artificial Sequence
  Description of Artificial Sequence: Synthetic oligonucleotide
  Target: SCN9A; (+) strand; PAM type: YTN; PAM sequence: TTG
ggccctatctccagagttcc

SEQ ID NO: 102515 - DNA, 20 bp, Artificial Sequence
  Description of Artificial Sequence: Synthetic oligonucleotide
  Target: SCN9A; (+) strand; PAM type: YTN; PAM sequence: CTA
tctccagagttcctgatgaa

SEQ ID NO: 102516 - DNA, 20 bp, Artificial Sequence
  Description of Artificial Sequence: Synthetic oligonucleotide
  Target: SCN9A; (+) strand; PAM type: YTN; PAM sequence: CTC
cagagttcctgatgaacttg

SEQ ID NO: 102517 - DNA, 20 bp, Artificial Sequence
  Description of Artificial Sequence: Synthetic oligonucleotide
  Target: SCN9A; (+) strand; PAM type: YTN; PAM sequence: TTC
ctgatgaacttgtgactagc

SEQ ID NO: 102518 - DNA, 20 bp, Artificial Sequence
  Description of Artificial Sequence: Synthetic oligonucleotide
  Target: SCN9A; (+) strand; PAM type: YTN; PAM sequence: CTG
atgaacttgtgactagcaag

SEQ ID NO: 102519 - DNA, 20 bp, Artificial Sequence
  Description of Artificial Sequence: Synthetic oligonucleotide
  Target: SCN9A; (+) strand; PAM type: YTN; PAM sequence: CTT
gtgactagcaaggaaaactt

SEQ ID NO: 102520 - DNA, 20 bp, Artificial Sequence
  Description of Artificial Sequence: Synthetic oligonucleotide
  Target: SCN9A; (+) strand; PAM type: YTN; PAM sequence: TTG
tgactagcaaggaaaacttt

SEQ ID NO: 102521 - DNA, 20 bp, Artificial Sequence
  Description of Artificial Sequence: Synthetic oligonucleotide
  Target: SCN9A; (+) strand; PAM type: YTN; PAM sequence: CTA
gcaaggaaaactttaagggt

SEQ ID NO: 102522 - DNA, 20 bp, Artificial Sequence
  Description of Artificial Sequence: Synthetic oligonucleotide
  Target: SCN9A; (+) strand; PAM type: YTN; PAM sequence: CTT
taagggtctctcaaagtctt

SEQ ID NO: 102523 - DNA, 20 bp, Artificial Sequence
  Description of Artificial Sequence: Synthetic oligonucleotide
  Target: SCN9A; (+) strand; PAM type: YTN; PAM sequence: TTT
aagggtctctcaaagtcttt

SEQ ID NO: 102524 - DNA, 20 bp, Artificial Sequence
  Description of Artificial Sequence: Synthetic oligonucleotide
  Target: SCN9A; (+) strand; PAM type: YTN; PAM sequence: TTA
agggtctctcaaagtcttta

SEQ ID NO: 102525 - DNA, 20 bp, Artificial Sequence
  Description of Artificial Sequence: Synthetic oligonucleotide
  Target: SCN9A; (+) strand; PAM type: YTN; PAM sequence: CTC
tcaaagtctttagcttgagg

SEQ ID NO: 102526 - DNA, 20 bp, Artificial Sequence
  Description of Artificial Sequence: Synthetic oligonucleotide
  Target: SCN9A; (+) strand; PAM type: YTN; PAM sequence: CTC
aaagtctttagcttgagggt

SEQ ID NO: 102527 - DNA, 20 bp, Artificial Sequence
  Description of Artificial Sequence: Synthetic oligonucleotide
  Target: SCN9A; (+) strand; PAM type: YTN; PAM sequence: CTT
tagcttgagggtaaggtaga

SEQ ID NO: 102528 - DNA, 20 bp, Artificial Sequence
  Description of Artificial Sequence: Synthetic oligonucleotide
  Target: SCN9A; (+) strand; PAM type: YTN; PAM sequence: TTT
agcttgagggtaaggtagat

SEQ ID NO: 102529 - DNA, 20 bp, Artificial Sequence
  Description of Artificial Sequence: Synthetic oligonucleotide
  Target: SCN9A; (+) strand; PAM type: YTN; PAM sequence: TTA
gcttgagggtaaggtagatc

SEQ ID NO: 102530 - DNA, 20 bp, Artificial Sequence
  Description of Artificial Sequence: Synthetic oligonucleotide
  Target: SCN9A; (+) strand; PAM type: YTN; PAM sequence: CTT
gagggtaaggtagatcatga

SEQ ID NO: 102531 - DNA, 20 bp, Artificial Sequence
  Description of Artificial Sequence: Synthetic oligonucleotide
  Target: SCN9A; (+) strand; PAM type: YTN; PAM sequence: TTG
agggtaaggtagatcatgaa

SEQ ID NO: 102532 - DNA, 20 bp, Artificial Sequence
  Description of Artificial Sequence: Synthetic oligonucleotide
  Target: SCN9A; (+) strand; PAM type: YTN; PAM sequence: TTA
ctaataaagactggaggaag

SEQ ID NO: 102533 - DNA, 20 bp, Artificial Sequence
  Description of Artificial Sequence: Synthetic oligonucleotide
  Target: SCN9A; (+) strand; PAM type: YTN; PAM sequence: CTA
ataaagactggaggaagctg

SEQ ID NO: 102534 - DNA, 20 bp, Artificial Sequence
  Description of Artificial Sequence: Synthetic oligonucleotide
  Target: SCN9A; (+) strand; PAM type: YTN; PAM sequence: CTG
gaggaagctgtaaaccatac

SEQ ID NO: 102535 - DNA, 20 bp, Artificial Sequence
  Description of Artificial Sequence: Synthetic oligonucleotide
  Target: SCN9A; (+) strand; PAM type: YTN; PAM sequence: CTG
taaaccatactaaagttttg

SEQ ID NO: 102536 - DNA, 20 bp, Artificial Sequence
  Description of Artificial Sequence: Synthetic oligonucleotide
  Target: SCN9A; (+) strand; PAM type: YTN; PAM sequence: CTA
aagttttgtttttgtttttg

SEQ ID NO: 102537 - DNA, 20 bp, Artificial Sequence
  Description of Artificial Sequence: Synthetic oligonucleotide
  Target: SCN9A; (+) strand; PAM type: YTN; PAM sequence: TTT
tgtttttgtttttgcttttc

SEQ ID NO: 102538 - DNA, 20 bp, Artificial Sequence
  Description of Artificial Sequence: Synthetic oligonucleotide
  Target: SCN9A; (+) strand; PAM type: YTN; PAM sequence: TTT
gtttttgtttttgcttttca

SEQ ID NO: 102539 - DNA, 20 bp, Artificial Sequence
  Description of Artificial Sequence: Synthetic oligonucleotide
  Target: SCN9A; (+) strand; PAM type: YTN; PAM sequence: TTG
tttttgtttttgcttttcaa

SEQ ID NO: 102540 - DNA, 20 bp, Artificial Sequence
  Description of Artificial Sequence: Synthetic oligonucleotide
  Target: SCN9A; (+) strand; PAM type: YTN; PAM sequence: TTT
ttgtttttgcttttcaaaaa

SEQ ID NO: 102541 - DNA, 20 bp, Artificial Sequence
  Description of Artificial Sequence: Synthetic oligonucleotide
  Target: SCN9A; (+) strand; PAM type: YTN; PAM sequence: TTT
tgtttttgcttttcaaaaaa

SEQ ID NO: 102542 - DNA, 20 bp, Artificial Sequence
  Description of Artificial Sequence: Synthetic oligonucleotide
  Target: SCN9A; (+) strand; PAM type: YTN; PAM sequence: TTT
gtttttgcttttcaaaaaaa

SEQ ID NO: 102543 - DNA, 20 bp, Artificial Sequence
  Description of Artificial Sequence: Synthetic oligonucleotide
  Target: SCN9A; (+) strand; PAM type: YTN; PAM sequence: TTG
tttttgcttttcaaaaaaaa

SEQ ID NO: 102544 - DNA, 20 bp, Artificial Sequence
  Description of Artificial Sequence: Synthetic oligonucleotide
  Target: SCN9A; (+) strand; PAM type: YTN; PAM sequence: TTT
ttgcttttcaaaaaaaaaaa

SEQ ID NO: 102545 - DNA, 20 bp, Artificial Sequence
  Description of Artificial Sequence: Synthetic oligonucleotide
  Target: SCN9A; (+) strand; PAM type: YTN; PAM sequence: TTT
tgcttttcaaaaaaaaaaaa

SEQ ID NO: 102546 - DNA, 20 bp, Artificial Sequence
  Description of Artificial Sequence: Synthetic oligonucleotide
  Target: SCN9A; (+) strand; PAM type: YTN; PAM sequence: TTT
gcttttcaaaaaaaaaaaaa

SEQ ID NO: 102547 - DNA, 20 bp, Artificial Sequence
  Description of Artificial Sequence: Synthetic oligonucleotide
  Target: SCN9A; (+) strand; PAM type: YTN; PAM sequence: TTG
cttttcaaaaaaaaaaaaac

SEQ ID NO: 102548 - DNA, 20 bp, Artificial Sequence
  Description of Artificial Sequence: Synthetic oligonucleotide
  Target: SCN9A; (+) strand; PAM type: YTN; PAM sequence: CTT
ttcaaaaaaaaaaaaactta

SEQ ID NO: 102549 - DNA, 20 bp, Artificial Sequence
  Description of Artificial Sequence: Synthetic oligonucleotide
  Target: SCN9A; (+) strand; PAM type: YTN; PAM sequence: TTT
tcaaaaaaaaaaaaacttat

SEQ ID NO: 102550 - DNA, 20 bp, Artificial Sequence
  Description of Artificial Sequence: Synthetic oligonucleotide
  Target: SCN9A; (+) strand; PAM type: YTN; PAM sequence: TTT
caaaaaaaaaaaaacttatt

SEQ ID NO: 102551 - DNA, 20 bp, Artificial Sequence
  Description of Artificial Sequence: Synthetic oligonucleotide
  Target: SCN9A; (+) strand; PAM type: YTN; PAM sequence: TTC
aaaaaaaaaaaaacttatta

SEQ ID NO: 102552 - DNA, 20 bp, Artificial Sequence
  Description of Artificial Sequence: Synthetic oligonucleotide
  Target: SCN9A; (+) strand; PAM type: YTN; PAM sequence: CTT
attaaacttggaatgtttta

SEQ ID NO: 102553 - DNA, 20 bp, Artificial Sequence
  Description of Artificial Sequence: Synthetic oligonucleotide
  Target: SCN9A; (+) strand; PAM type: YTN; PAM sequence: TTA
ttaaacttggaatgttttac

SEQ ID NO: 102554 - DNA, 20 bp, Artificial Sequence
  Description of Artificial Sequence: Synthetic oligonucleotide
  Target: SCN9A; (+) strand; PAM type: YTN; PAM sequence: TTA
aacttggaatgttttacaaa

SEQ ID NO: 102555 - DNA, 20 bp, Artificial Sequence
  Description of Artificial Sequence: Synthetic oligonucleotide
  Target: SCN9A; (+) strand; PAM type: YTN; PAM sequence: CTT
ggaatgttttacaaacaaca

SEQ ID NO: 102556 - DNA, 20 bp, Artificial Sequence
  Description of Artificial Sequence: Synthetic oligonucleotide
  Target: SCN9A; (+) strand; PAM type: YTN; PAM sequence: TTG
gaatgttttacaaacaacag

SEQ ID NO: 102557 - DNA, 20 bp, Artificial Sequence
  Description of Artificial Sequence: Synthetic oligonucleotide
  Target: SCN9A; (+) strand; PAM type: YTN; PAM sequence: TTT
tacaaacaacagatggtgat

SEQ ID NO: 102558 - DNA, 20 bp, Artificial Sequence
  Description of Artificial Sequence: Synthetic oligonucleotide
  Target: SCN9A; (+) strand; PAM type: YTN; PAM sequence: TTT
acaaacaacagatggtgatg

SEQ ID NO: 102559 - DNA, 20 bp, Artificial Sequence
  Description of Artificial Sequence: Synthetic oligonucleotide
  Target: SCN9A; (+) strand; PAM type: YTN; PAM sequence: TTA
caaacaacagatggtgatga

SEQ ID NO: 102560 - DNA, 20 bp, Artificial Sequence
  Description of Artificial Sequence: Synthetic oligonucleotide
  Target: SCN9A; (+) strand; PAM type: YTN; PAM sequence: TTG
taagcagatctgggactcaa

SEQ ID NO: 102561 - DNA, 20 bp, Artificial Sequence
  Description of Artificial Sequence: Synthetic oligonucleotide
  Target: SCN9A; (+) strand; PAM type: YTN; PAM sequence: CTG
ggactcaagagtgaggttag

SEQ ID NO: 102562 - DNA, 20 bp, Artificial Sequence
  Description of Artificial Sequence: Synthetic oligonucleotide
  Target: SCN9A; (+) strand; PAM type: YTN; PAM sequence: CTC
aagagtgaggttagaggtaa

SEQ ID NO: 102563 - DNA, 20 bp, Artificial Sequence
  Description of Artificial Sequence: Synthetic oligonucleotide
  Target: SCN9A; (+) strand; PAM type: YTN; PAM sequence: TTA
gaggtaaagacattgatgtt

SEQ ID NO: 102564 - DNA, 20 bp, Artificial Sequence
  Description of Artificial Sequence: Synthetic oligonucleotide
  Target: SCN9A; (+) strand; PAM type: YTN; PAM sequence: TTG
atgttaagagtcaatagcac

SEQ ID NO: 102565 - DNA, 20 bp, Artificial Sequence
  Description of Artificial Sequence: Synthetic oligonucleotide
  Target: SCN9A; (+) strand; PAM type: YTN; PAM sequence: TTA
agagtcaatagcacagaaat

SEQ ID NO: 102566 - DNA, 20 bp, Artificial Sequence
  Description of Artificial Sequence: Synthetic oligonucleotide
  Target: SCN9A; (+) strand; PAM type: YTN; PAM sequence: CTT
ttcaagccacaggcatgcat

SEQ ID NO: 102567 - DNA, 20 bp, Artificial Sequence
  Description of Artificial Sequence: Synthetic oligonucleotide
  Target: SCN9A; (+) strand; PAM type: YTN; PAM sequence: TTT
tcaagccacaggcatgcatg

SEQ ID NO: 102568 - DNA, 20 bp, Artificial Sequence
  Description of Artificial Sequence: Synthetic oligonucleotide
  Target: SCN9A; (+) strand; PAM type: YTN; PAM sequence: TTT
caagccacaggcatgcatga

SEQ ID NO: 102569 - DNA, 20 bp, Artificial Sequence
  Description of Artificial Sequence: Synthetic oligonucleotide
  Target: SCN9A; (+) strand; PAM type: YTN; PAM sequence: TTC
aagccacaggcatgcatgaa

SEQ ID NO: 102570 - DNA, 20 bp, Artificial Sequence
  Description of Artificial Sequence: Synthetic oligonucleotide
  Target: SCN9A; (+) strand; PAM type: YTN; PAM sequence: CTC
agagcttcagaataagaaaa

SEQ ID NO: 102571 - DNA, 20 bp, Artificial Sequence
  Description of Artificial Sequence: Synthetic oligonucleotide
  Target: SCN9A; (+) strand; PAM type: YTN; PAM sequence: CTT
cagaataagaaaagataact

SEQ ID NO: 102572 - DNA, 20 bp, Artificial Sequence
  Description of Artificial Sequence: Synthetic oligonucleotide
  Target: SCN9A; (+) strand; PAM type: YTN; PAM sequence: TTC
agaataagaaaagataactg

SEQ ID NO: 102573 - DNA, 20 bp, Artificial Sequence
  Description of Artificial Sequence: Synthetic oligonucleotide
  Target: SCN9A; (+) strand; PAM type: YTN; PAM sequence: CTG
aagattgaacatgtggggag

SEQ ID NO: 102574 - DNA, 20 bp, Artificial Sequence
  Description of Artificial Sequence: Synthetic oligonucleotide
  Target: SCN9A; (+) strand; PAM type: YTN; PAM sequence: TTG
aacatgtggggagaaatcat

SEQ ID NO: 102575 - DNA, 20 bp, Artificial Sequence
  Description of Artificial Sequence: Synthetic oligonucleotide
  Target: SCN9A; (+) strand; PAM type: YTN; PAM sequence: TTA
tttacaggatgtgcagaaaa

SEQ ID NO: 102576 - DNA, 20 bp, Artificial Sequence
  Description of Artificial Sequence: Synthetic oligonucleotide
  Target: SCN9A; (+) strand; PAM type: YTN; PAM sequence: TTT
acaggatgtgcagaaaaaat

SEQ ID NO: 102577 - DNA, 20 bp, Artificial Sequence
  Description of Artificial Sequence: Synthetic oligonucleotide
  Target: SCN9A; (+) strand; PAM type: YTN; PAM sequence: TTA
caggatgtgcagaaaaaata

SEQ ID NO: 102578 - DNA, 20 bp, Artificial Sequence
  Description of Artificial Sequence: Synthetic oligonucleotide
  Target: SCN9A; (+) strand; PAM type: YTN; PAM sequence: CTC
attaaagaaatagagagagg

SEQ ID NO: 102579 - DNA, 20 bp, Artificial Sequence
  Description of Artificial Sequence: Synthetic oligonucleotide
  Target: SCN9A; (+) strand; PAM type: YTN; PAM sequence: TTA
aagaaatagagagaggaact

SEQ ID NO: 102580 - DNA, 20 bp, Artificial Sequence
  Description of Artificial Sequence: Synthetic oligonucleotide
  Target: SCN9A; (+) strand; PAM type: YTN; PAM sequence: CTC
agaactctaagacaaataaa

SEQ ID NO: 102581 - DNA, 20 bp, Artificial Sequence
  Description of Artificial Sequence: Synthetic oligonucleotide
  Target: SCN9A; (+) strand; PAM type: YTN; PAM sequence: CTC
taagacaaataaaagaccaa

SEQ ID NO: 102582 - DNA, 20 bp, Artificial Sequence
  Description of Artificial Sequence: Synthetic oligonucleotide
  Target: SCN9A; (+) strand; PAM type: YTN; PAM sequence: CTA
agacaaataaaagaccaaag

SEQ ID NO: 102583 - DNA, 20 bp, Artificial Sequence
  Description of Artificial Sequence: Synthetic oligonucleotide
  Target: SCN9A; (+) strand; PAM type: YTN; PAM sequence: CTA
tggcctctgaaactaaggaa

SEQ ID NO: 102584 - DNA, 20 bp, Artificial Sequence
  Description of Artificial Sequence: Synthetic oligonucleotide
  Target: SCN9A; (+) strand; PAM type: YTN; PAM sequence: CTC
tgaaactaaggaaaggaaga

SEQ ID NO: 102585 - DNA, 20 bp, Artificial Sequence
  Description of Artificial Sequence: Synthetic oligonucleotide
  Target: SCN9A; (+) strand; PAM type: YTN; PAM sequence: CTG
aaactaaggaaaggaagaat

SEQ ID NO: 102586 - DNA, 20 bp, Artificial Sequence
  Description of Artificial Sequence: Synthetic oligonucleotide
  Target: SCN9A; (+) strand; PAM type: YTN; PAM sequence: CTA
aggaaaggaagaattttgag

SEQ ID NO: 102587 - DNA, 20 bp, Artificial Sequence
  Description of Artificial Sequence: Synthetic oligonucleotide
  Target: SCN9A; (+) strand; PAM type: YTN; PAM sequence: TTT
tgagagagactgtagtcaac

SEQ ID NO: 102588 - DNA, 20 bp, Artificial Sequence
  Description of Artificial Sequence: Synthetic oligonucleotide
  Target: SCN9A; (+) strand; PAM type: YTN; PAM sequence: TTT
gagagagactgtagtcaaca

SEQ ID NO: 102589 - DNA, 20 bp, Artificial Sequence
  Description of Artificial Sequence: Synthetic oligonucleotide
  Target: SCN9A; (+) strand; PAM type: YTN; PAM sequence: TTG
agagagactgtagtcaacag

SEQ ID NO: 102590 - DNA, 20 bp, Artificial Sequence
  Description of Artificial Sequence: Synthetic oligonucleotide
  Target: SCN9A; (+) strand; PAM type: YTN; PAM sequence: CTG
tagtcaacagtatcaaacag

SEQ ID NO: 102591 - DNA, 20 bp, Artificial Sequence
  Description of Artificial Sequence: Synthetic oligonucleotide
  Target: SCN9A; (+) strand; PAM type: YTN; PAM sequence: TTT
tctgagagttagtgagtaga

SEQ ID NO: 102592 - DNA, 20 bp, Artificial Sequence
  Description of Artificial Sequence: Synthetic oligonucleotide
  Target: SCN9A; (+) strand; PAM type: YTN; PAM sequence: TTT
ctgagagttagtgagtagat

SEQ ID NO: 102593 - DNA, 20 bp, Artificial Sequence
  Description of Artificial Sequence: Synthetic oligonucleotide
  Target: SCN9A; (+) strand; PAM type: YTN; PAM sequence: TTC
tgagagttagtgagtagatt

SEQ ID NO: 102594 - DNA, 20 bp, Artificial Sequence
  Description of Artificial Sequence: Synthetic oligonucleotide
  Target: SCN9A; (+) strand; PAM type: YTN; PAM sequence: CTG
agagttagtgagtagattcc

SEQ ID NO: 102595 - DNA, 20 bp, Artificial Sequence
  Description of Artificial Sequence: Synthetic oligonucleotide
  Target: SCN9A; (+) strand; PAM type: YTN; PAM sequence: TTA
gtgagtagattccatttttg

SEQ ID NO: 102596 - DNA, 20 bp, Artificial Sequence
  Description of Artificial Sequence: Synthetic oligonucleotide
  Target: SCN9A; (+) strand; PAM type: YTN; PAM sequence: TTC
catttttgattaaaaggacc

SEQ ID NO: 102597 - DNA, 20 bp, Artificial Sequence
  Description of Artificial Sequence: Synthetic oligonucleotide
  Target: SCN9A; (+) strand; PAM type: YTN; PAM sequence: TTT
ttgattaaaaggaccagagt

SEQ ID NO: 102598 - DNA, 20 bp, Artificial Sequence
  Description of Artificial Sequence: Synthetic oligonucleotide
  Target: SCN9A; (+) strand; PAM type: YTN; PAM sequence: TTT
tgattaaaaggaccagagta

SEQ ID NO: 102599 - DNA, 20 bp, Artificial Sequence
  Description of Artificial Sequence: Synthetic oligonucleotide
  Target: SCN9A; (+) strand; PAM type: YTN; PAM sequence: TTT
gattaaaaggaccagagtac

SEQ ID NO: 102600 - DNA, 20 bp, Artificial Sequence
  Description of Artificial Sequence: Synthetic oligonucleotide
  Target: SCN9A; (+) strand; PAM type: YTN; PAM sequence: TTG
attaaaaggaccagagtaca

SEQ ID NO: 102601 - DNA, 20 bp, Artificial Sequence
  Description of Artificial Sequence: Synthetic oligonucleotide
  Target: SCN9A; (+) strand; PAM type: YTN; PAM sequence: TTA
aaaggaccagagtacagact

SEQ ID NO: 102602 - DNA, 20 bp, Artificial Sequence
  Description of Artificial Sequence: Synthetic oligonucleotide
  Target: SCN9A; (+) strand; PAM type: YTN; PAM sequence: CTC
tttcattaacttgtattctg

SEQ ID NO: 102603 - DNA, 20 bp, Artificial Sequence
  Description of Artificial Sequence: Synthetic oligonucleotide
  Target: SCN9A; (+) strand; PAM type: YTN; PAM sequence: CTT
tcattaacttgtattctggt

SEQ ID NO: 102604 - DNA, 20 bp, Artificial Sequence
  Description of Artificial Sequence: Synthetic oligonucleotide
  Target: SCN9A; (+) strand; PAM type: YTN; PAM sequence: TTT
cattaacttgtattctggtg

SEQ ID NO: 102605 - DNA, 20 bp, Artificial Sequence
  Description of Artificial Sequence: Synthetic oligonucleotide
  Target: SCN9A; (+) strand; PAM type: YTN; PAM sequence: TTC
attaacttgtattctggtgg

SEQ ID NO: 102606 - DNA, 20 bp, Artificial Sequence
  Description of Artificial Sequence: Synthetic oligonucleotide
  Target: SCN9A; (+) strand; PAM type: YTN; PAM sequence: TTA
acttgtattctggtggttcc

SEQ ID NO: 102607 - DNA, 20 bp, Artificial Sequence
  Description of Artificial Sequence: Synthetic oligonucleotide
  Target: SCN9A; (+) strand; PAM type: YTN; PAM sequence: CTT
gtattctggtggttccattg

SEQ ID NO: 102608 - DNA, 20 bp, Artificial Sequence
  Description of Artificial Sequence: Synthetic oligonucleotide
  Target: SCN9A; (+) strand; PAM type: YTN; PAM sequence: TTG
tattctggtggttccattga

SEQ ID NO: 102609 - DNA, 20 bp, Artificial Sequence
  Description of Artificial Sequence: Synthetic oligonucleotide
  Target: SCN9A; (+) strand; PAM type: YTN; PAM sequence: TTC
tggtggttccattgatctgg

SEQ ID NO: 102610 - DNA, 20 bp, Artificial Sequence
  Description of Artificial Sequence: Synthetic oligonucleotide
  Target: SCN9A; (+) strand; PAM type: YTN; PAM sequence: CTG
gtggttccattgatctggga

SEQ ID NO: 102611 - DNA, 20 bp, Artificial Sequence
  Description of Artificial Sequence: Synthetic oligonucleotide
  Target: SCN9A; (+) strand; PAM type: YTN; PAM sequence: TTC
cattgatctgggaatacgaa

SEQ ID NO: 102612 - DNA, 20 bp, Artificial Sequence
  Description of Artificial Sequence: Synthetic oligonucleotide
  Target: SCN9A; (+) strand; PAM type: YTN; PAM sequence: TTG
atctgggaatacgaattaag

SEQ ID NO: 102613 - DNA, 20 bp, Artificial Sequence
  Description of Artificial Sequence: Synthetic oligonucleotide
  Target: SCN9A; (+) strand; PAM type: YTN; PAM sequence: CTG
ggaatacgaattaaggctct

SEQ ID NO: 102614 - DNA, 20 bp, Artificial Sequence
  Description of Artificial Sequence: Synthetic oligonucleotide
  Target: SCN9A; (+) strand; PAM type: YTN; PAM sequence: TTA
aggctctaaaataagaagta

SEQ ID NO: 102615 - DNA, 20 bp, Artificial Sequence
  Description of Artificial Sequence: Synthetic oligonucleotide
  Target: SCN9A; (+) strand; PAM type: YTN; PAM sequence: CTC
taaaataagaagtagtagca

SEQ ID NO: 102616 - DNA, 20 bp, Artificial Sequence
  Description of Artificial Sequence: Synthetic oligonucleotide
  Target: SCN9A; (+) strand; PAM type: YTN; PAM sequence: CTA
aaataagaagtagtagcatg

SEQ ID NO: 102617 - DNA, 20 bp, Artificial Sequence
  Description of Artificial Sequence: Synthetic oligonucleotide
  Target: SCN9A; (+) strand; PAM type: YTN; PAM sequence: CTT
acagtctaacatacagtgat

SEQ ID NO: 102618 - DNA, 20 bp, Artificial Sequence
  Description of Artificial Sequence: Synthetic oligonucleotide
  Target: SCN9A; (+) strand; PAM type: YTN; PAM sequence: TTA
cagtctaacatacagtgata

SEQ ID NO: 102619 - DNA, 20 bp, Artificial Sequence
  Description of Artificial Sequence: Synthetic oligonucleotide
  Target: SCN9A; (+) strand; PAM type: YTN; PAM sequence: CTA
acatacagtgataggaaatt

SEQ ID NO: 102620 - DNA, 20 bp, Artificial Sequence
  Description of Artificial Sequence: Synthetic oligonucleotide
  Target: SCN9A; (+) strand; PAM type: YTN; PAM sequence: TTA
ctgttagtcaagtgccatag

SEQ ID NO: 102621 - DNA, 20 bp, Artificial Sequence
  Description of Artificial Sequence: Synthetic oligonucleotide
  Target: SCN9A; (+) strand; PAM type: YTN; PAM sequence: CTG
ttagtcaagtgccatagatg

SEQ ID NO: 102622 - DNA, 20 bp, Artificial Sequence
  Description of Artificial Sequence: Synthetic oligonucleotide
  Target: SCN9A; (+) strand; PAM type: YTN; PAM sequence: TTA
gtcaagtgccatagatgtgg

SEQ ID NO: 102623 - DNA, 20 bp, Artificial Sequence
  Description of Artificial Sequence: Synthetic oligonucleotide
  Target: SCN9A; (+) strand; PAM type: YTN; PAM sequence: CTC
aagcttagagagctctagtg

SEQ ID NO: 102624 - DNA, 20 bp, Artificial Sequence
  Description of Artificial Sequence: Synthetic oligonucleotide
  Target: SCN9A; (+) strand; PAM type: YTN; PAM sequence: CTT
agagagctctagtgacttgc

SEQ ID NO: 102625 - DNA, 20 bp, Artificial Sequence
  Description of Artificial Sequence: Synthetic oligonucleotide
  Target: SCN9A; (+) strand; PAM type: YTN; PAM sequence: TTA
gagagctctagtgacttgcc

SEQ ID NO: 102626 - DNA, 20 bp, Artificial Sequence
  Description of Artificial Sequence: Synthetic oligonucleotide
  Target: SCN9A; (+) strand; PAM type: YTN; PAM sequence: CTC
tagtgacttgcccttaatca

SEQ ID NO: 102627 - DNA, 20 bp, Artificial Sequence
  Description of Artificial Sequence: Synthetic oligonucleotide
  Target: SCN9A; (+) strand; PAM type: YTN; PAM sequence: CTA
gtgacttgcccttaatcatc

SEQ ID NO: 102628 - DNA, 20 bp, Artificial Sequence
  Description of Artificial Sequence: Synthetic oligonucleotide
  Target: SCN9A; (+) strand; PAM type: YTN; PAM sequence: CTT
gcccttaatcatcatacagc

SEQ ID NO: 102629 - DNA, 20 bp, Artificial Sequence
  Description of Artificial Sequence: Synthetic oligonucleotide
  Target: SCN9A; (+) strand; PAM type: YTN; PAM sequence: TTG
cccttaatcatcatacagct

SEQ ID NO: 102630 - DNA, 20 bp, Artificial Sequence
  Description of Artificial Sequence: Synthetic oligonucleotide
  Target: SCN9A; (+) strand; PAM type: YTN; PAM sequence: CTT
aatcatcatacagctatagc

SEQ ID NO: 102631 - DNA, 20 bp, Artificial Sequence
  Description of Artificial Sequence: Synthetic oligonucleotide
  Target: SCN9A; (+) strand; PAM type: YTN; PAM sequence: TTA
atcatcatacagctatagct

SEQ ID NO: 102632 - DNA, 20 bp, Artificial Sequence
  Description of Artificial Sequence: Synthetic oligonucleotide
  Target: SCN9A; (+) strand; PAM type: YTN; PAM sequence: CTA
tagctgaatcagcatggaat

SEQ ID NO: 102633 - DNA, 20 bp, Artificial Sequence
  Description of Artificial Sequence: Synthetic oligonucleotide
  Target: SCN9A; (+) strand; PAM type: YTN; PAM sequence: CTG
aatcagcatggaatggagtc

SEQ ID NO: 102634 - DNA, 20 bp, Artificial Sequence
  Description of Artificial Sequence: Synthetic oligonucleotide
  Target: SCN9A; (+) strand; PAM type: YTN; PAM sequence: CTT
ctgacttaccgacaacctct

SEQ ID NO: 102635 - DNA, 20 bp, Artificial Sequence
  Description of Artificial Sequence: Synthetic oligonucleotide
  Target: SCN9A; (+) strand; PAM type: YTN; PAM sequence: TTC
tgacttaccgacaacctctg

SEQ ID NO: 102636 - DNA, 20 bp, Artificial Sequence
  Description of Artificial Sequence: Synthetic oligonucleotide
  Target: SCN9A; (+) strand; PAM type: YTN; PAM sequence: CTG
acttaccgacaacctctggt

SEQ ID NO: 102637 - DNA, 20 bp, Artificial Sequence
  Description of Artificial Sequence: Synthetic oligonucleotide
  Target: SCN9A; (+) strand; PAM type: YTN; PAM sequence: CTT
accgacaacctctggtaagt

SEQ ID NO: 102638 - DNA, 20 bp, Artificial Sequence
  Description of Artificial Sequence: Synthetic oligonucleotide
  Target: SCN9A; (+) strand; PAM type: YTN; PAM sequence: TTA
ccgacaacctctggtaagta

SEQ ID NO: 102639 - DNA, 20 bp, Artificial Sequence
  Description of Artificial Sequence: Synthetic oligonucleotide
  Target: SCN9A; (+) strand; PAM type: YTN; PAM sequence: CTC
tggtaagtattaggcgttaa

SEQ ID NO: 102640 - DNA, 20 bp, Artificial Sequence
  Description of Artificial Sequence: Synthetic oligonucleotide
  Target: SCN9A; (+) strand; PAM type: YTN; PAM sequence: CTG
gtaagtattaggcgttaaga

SEQ ID NO: 102641 - DNA, 20 bp, Artificial Sequence
  Description of Artificial Sequence: Synthetic oligonucleotide
  Target: SCN9A; (+) strand; PAM type: YTN; PAM sequence: TTA
ggcgttaagacaaaccccag

SEQ ID NO: 102642 - DNA, 20 bp, Artificial Sequence
  Description of Artificial Sequence: Synthetic oligonucleotide
  Target: SCN9A; (+) strand; PAM type: YTN; PAM sequence: TTA
agacaaaccccagaacacta

SEQ ID NO: 102643 - DNA, 20 bp, Artificial Sequence
  Description of Artificial Sequence: Synthetic oligonucleotide
  Target: SCN9A; (+) strand; PAM type: YTN; PAM sequence: CTA
attaaggaatgctaaccaag

SEQ ID NO: 102644 - DNA, 20 bp, Artificial Sequence
  Description of Artificial Sequence: Synthetic oligonucleotide
  Target: SCN9A; (+) strand; PAM type: YTN; PAM sequence: TTA
aggaatgctaaccaaggtct

SEQ ID NO: 102645 - DNA, 20 bp, Artificial Sequence
  Description of Artificial Sequence: Synthetic oligonucleotide
  Target: SCN9A; (+) strand; PAM type: YTN; PAM sequence: CTA
accaaggtctcaatttttgt

SEQ ID NO: 102646 - DNA, 20 bp, Artificial Sequence
  Description of Artificial Sequence: Synthetic oligonucleotide
  Target: SCN9A; (+) strand; PAM type: YTN; PAM sequence: CTC
aatttttgtcttaccatctg

SEQ ID NO: 102647 - DNA, 20 bp, Artificial Sequence
  Description of Artificial Sequence: Synthetic oligonucleotide
  Target: SCN9A; (+) strand; PAM type: YTN; PAM sequence: TTT
ttgtcttaccatctgtgaaa

SEQ ID NO: 102648 - DNA, 20 bp, Artificial Sequence
  Description of Artificial Sequence: Synthetic oligonucleotide
  Target: SCN9A; (+) strand; PAM type: YTN; PAM sequence: TTT
tgtcttaccatctgtgaaac

SEQ ID NO: 102649 - DNA, 20 bp, Artificial Sequence
  Description of Artificial Sequence: Synthetic oligonucleotide
  Target: SCN9A; (+) strand; PAM type: YTN; PAM sequence: TTT
gtcttaccatctgtgaaaca

SEQ ID NO: 102650 - DNA, 20 bp, Artificial Sequence
  Description of Artificial Sequence: Synthetic oligonucleotide
  Target: SCN9A; (+) strand; PAM type: YTN; PAM sequence: TTG
tcttaccatctgtgaaacag

SEQ ID NO: 102651 - DNA, 20 bp, Artificial Sequence
  Description of Artificial Sequence: Synthetic oligonucleotide
  Target: SCN9A; (+) strand; PAM type: YTN; PAM sequence: CTT
accatctgtgaaacaggcct

SEQ ID NO: 102652 - DNA, 20 bp, Artificial Sequence
  Description of Artificial Sequence: Synthetic oligonucleotide
  Target: SCN9A; (+) strand; PAM type: YTN; PAM sequence: TTA
ccatctgtgaaacaggcctc

SEQ ID NO: 102653 - DNA, 20 bp, Artificial Sequence
  Description of Artificial Sequence: Synthetic oligonucleotide
  Target: SCN9A; (+) strand; PAM type: YTN; PAM sequence: CTG
tgaaacaggcctctggctca

SEQ ID NO: 102654 - DNA, 20 bp, Artificial Sequence
  Description of Artificial Sequence: Synthetic oligonucleotide
  Target: SCN9A; (+) strand; PAM type: YTN; PAM sequence: CTC
tggctcatcggaattcatag

SEQ ID NO: 102655 - DNA, 20 bp, Artificial Sequence
  Description of Artificial Sequence: Synthetic oligonucleotide
  Target: SCN9A; (+) strand; PAM type: YTN; PAM sequence: CTG
gctcatcggaattcataggt

SEQ ID NO: 102656 - DNA, 20 bp, Artificial Sequence
  Description of Artificial Sequence: Synthetic oligonucleotide
  Target: SCN9A; (+) strand; PAM type: YTN; PAM sequence: CTC
atcggaattcataggttcag

SEQ ID NO: 102657 - DNA, 20 bp, Artificial Sequence
  Description of Artificial Sequence: Synthetic oligonucleotide
  Target: SCN9A; (+) strand; PAM type: YTN; PAM sequence: TTC
ataggttcagcctctgcttc

SEQ ID NO: 102658 - DNA, 20 bp, Artificial Sequence
  Description of Artificial Sequence: Synthetic oligonucleotide
  Target: SCN9A; (+) strand; PAM type: YTN; PAM sequence: TTC
agcctctgcttcttctcctt

SEQ ID NO: 102659 - DNA, 20 bp, Artificial Sequence
  Description of Artificial Sequence: Synthetic oligonucleotide
  Target: SCN9A; (+) strand; PAM type: YTN; PAM sequence: CTC
tgcttcttctccttctccag

SEQ ID NO: 102660 - DNA, 20 bp, Artificial Sequence
  Description of Artificial Sequence: Synthetic oligonucleotide
  Target: SCN9A; (+) strand; PAM type: YTN; PAM sequence: CTG
cttcttctccttctccaggc

SEQ ID NO: 102661 - DNA, 20 bp, Artificial Sequence
  Description of Artificial Sequence: Synthetic oligonucleotide
  Target: SCN9A; (+) strand; PAM type: YTN; PAM sequence: CTT
cttctccttctccaggcaaa

SEQ ID NO: 102662 - DNA, 20 bp, Artificial Sequence
  Description of Artificial Sequence: Synthetic oligonucleotide
  Target: SCN9A; (+) strand; PAM type: YTN; PAM sequence: TTC
ttctccttctccaggcaaag

SEQ ID NO: 102663 - DNA, 20 bp, Artificial Sequence
  Description of Artificial Sequence: Synthetic oligonucleotide
  Target: SCN9A; (+) strand; PAM type: YTN; PAM sequence: CTT
ctccttctccaggcaaaggg

SEQ ID NO: 102664 - DNA, 20 bp, Artificial Sequence
  Description of Artificial Sequence: Synthetic oligonucleotide
  Target: SCN9A; (+) strand; PAM type: YTN; PAM sequence: TTC
tccttctccaggcaaagggt

SEQ ID NO: 102665 - DNA, 20 bp, Artificial Sequence
  Description of Artificial Sequence: Synthetic oligonucleotide
  Target: SCN9A; (+) strand; PAM type: YTN; PAM sequence: CTC
cttctccaggcaaagggtta

SEQ ID NO: 102666 - DNA, 20 bp, Artificial Sequence
  Description of Artificial Sequence: Synthetic oligonucleotide
  Target: SCN9A; (+) strand; PAM type: YTN; PAM sequence: CTT
ctccaggcaaagggttatca

SEQ ID NO: 102667 - DNA, 20 bp, Artificial Sequence
  Description of Artificial Sequence: Synthetic oligonucleotide
  Target: SCN9A; (+) strand; PAM type: YTN; PAM sequence: TTC
tccaggcaaagggttatcaa

SEQ ID NO: 102668 - DNA, 20 bp, Artificial Sequence
  Description of Artificial Sequence: Synthetic oligonucleotide
  Target: SCN9A; (+) strand; PAM type: YTN; PAM sequence: CTC
caggcaaagggttatcaact

SEQ ID NO: 102669 - DNA, 20 bp, Artificial Sequence
  Description of Artificial Sequence: Synthetic oligonucleotide
  Target: SCN9A; (+) strand; PAM type: YTN; PAM sequence: TTA
tcaactgtgctgcactctga

SEQ ID NO: 102670 - DNA, 20 bp, Artificial Sequence
  Description of Artificial Sequence: Synthetic oligonucleotide
  Target: SCN9A; (+) strand; PAM type: YTN; PAM sequence: CTG
tgctgcactctgaggagctt

SEQ ID NO: 102671 - DNA, 20 bp, Artificial Sequence
  Description of Artificial Sequence: Synthetic oligonucleotide
  Target: SCN9A; (+) strand; PAM type: YTN; PAM sequence: CTG
cactctgaggagcttgaccg

SEQ ID NO: 102672 - DNA, 20 bp, Artificial Sequence
  Description of Artificial Sequence: Synthetic oligonucleotide
  Target: SCN9A; (+) strand; PAM type: YTN; PAM sequence: CTC
tgaggagcttgaccggttta

SEQ ID NO: 102673 - DNA, 20 bp, Artificial Sequence
  Description of Artificial Sequence: Synthetic oligonucleotide
  Target: SCN9A; (+) strand; PAM type: YTN; PAM sequence: CTG
aggagcttgaccggtttaat

SEQ ID NO: 102674 - DNA, 20 bp, Artificial Sequence
  Description of Artificial Sequence: Synthetic oligonucleotide
  Target: SCN9A; (+) strand; PAM type: YTN; PAM sequence: CTT
gaccggtttaatctctagaa

SEQ ID NO: 102675 - DNA, 20 bp, Artificial Sequence
  Description of Artificial Sequence: Synthetic oligonucleotide
  Target: SCN9A; (+) strand; PAM type: YTN; PAM sequence: TTG
accggtttaatctctagaaa

SEQ ID NO: 102676 - DNA, 20 bp, Artificial Sequence
  Description of Artificial Sequence: Synthetic oligonucleotide
  Target: SCN9A; (+) strand; PAM type: YTN; PAM sequence: TTT
aatctctagaaaggaattca

SEQ ID NO: 102677 - DNA, 20 bp, Artificial Sequence
  Description of Artificial Sequence: Synthetic oligonucleotide
  Target: SCN9A; (+) strand; PAM type: YTN; PAM sequence: TTA
atctctagaaaggaattcac

SEQ ID NO: 102678 - DNA, 20 bp, Artificial Sequence
  Description of Artificial Sequence: Synthetic oligonucleotide
  Target: SCN9A; (+) strand; PAM type: YTN; PAM sequence: CTC
tagaaaggaattcaccaccc

SEQ ID NO: 102679 - DNA, 20 bp, Artificial Sequence
  Description of Artificial Sequence: Synthetic oligonucleotide
  Target: SCN9A; (+) strand; PAM type: YTN; PAM sequence: CTA
gaaaggaattcaccacccca

SEQ ID NO: 102680 - DNA, 20 bp, Artificial Sequence
  Description of Artificial Sequence: Synthetic oligonucleotide
  Target: SCN9A; (+) strand; PAM type: YTN; PAM sequence: TTC
accaccccaccaggtagttc

SEQ ID NO: 102681 - DNA, 20 bp, Artificial Sequence
  Description of Artificial Sequence: Synthetic oligonucleotide
  Target: SCN9A; (+) strand; PAM type: YTN; PAM sequence: TTC
atttagagttcattcaaata

SEQ ID NO: 102682 - DNA, 20 bp, Artificial Sequence
  Description of Artificial Sequence: Synthetic oligonucleotide
  Target: SCN9A; (+) strand; PAM type: YTN; PAM sequence: TTT
agagttcattcaaatatgat

SEQ ID NO: 102683 - DNA, 20 bp, Artificial Sequence
  Description of Artificial Sequence: Synthetic oligonucleotide
  Target: SCN9A; (+) strand; PAM type: YTN; PAM sequence: TTA
gagttcattcaaatatgata

SEQ ID NO: 102684 - DNA, 20 bp, Artificial Sequence
  Description of Artificial Sequence: Synthetic oligonucleotide
  Target: SCN9A; (+) strand; PAM type: YTN; PAM sequence: TTC
attcaaatatgatatttaag

SEQ ID NO: 102685 - DNA, 20 bp, Artificial Sequence
  Description of Artificial Sequence: Synthetic oligonucleotide
  Target: SCN9A; (+) strand; PAM type: YTN; PAM sequence: TTC
aaatatgatatttaagcctt

SEQ ID NO: 102686 - DNA, 20 bp, Artificial Sequence
  Description of Artificial Sequence: Synthetic oligonucleotide
  Target: SCN9A; (+) strand; PAM type: YTN; PAM sequence: TTT
aagccttatttaataatcag

SEQ ID NO: 102687 - DNA, 20 bp, Artificial Sequence
  Description of Artificial Sequence: Synthetic oligonucleotide
  Target: SCN9A; (+) strand; PAM type: YTN; PAM sequence: TTA
agccttatttaataatcaga

SEQ ID NO: 102688 - DNA, 20 bp, Artificial Sequence
  Description of Artificial Sequence: Synthetic oligonucleotide
  Target: SCN9A; (+) strand; PAM type: YTN; PAM sequence: CTT
atttaataatcagactcatg

SEQ ID NO: 102689 - DNA, 20 bp, Artificial Sequence
  Description of Artificial Sequence: Synthetic oligonucleotide
  Target: SCN9A; (+) strand; PAM type: YTN; PAM sequence: TTA
tttaataatcagactcatgc

SEQ ID NO: 102690 - DNA, 20 bp, Artificial Sequence
  Description of Artificial Sequence: Synthetic oligonucleotide
  Target: SCN9A; (+) strand; PAM type: YTN; PAM sequence: TTT
aataatcagactcatgcaaa

SEQ ID NO: 102691 - DNA, 20 bp, Artificial Sequence
  Description of Artificial Sequence: Synthetic oligonucleotide
  Target: SCN9A; (+) strand; PAM type: YTN; PAM sequence: TTA
ataatcagactcatgcaaag

SEQ ID NO: 102692 - DNA, 20 bp, Artificial Sequence
  Description of Artificial Sequence: Synthetic oligonucleotide
  Target: SCN9A; (+) strand; PAM type: YTN; PAM sequence: CTC
atgcaaagtattatgaaaaa

SEQ ID NO: 102693 - DNA, 20 bp, Artificial Sequence
  Description of Artificial Sequence: Synthetic oligonucleotide
  Target: SCN9A; (+) strand; PAM type: YTN; PAM sequence: TTA
tgaaaaaagattaatagtat

SEQ ID NO: 102694 - DNA, 20 bp, Artificial Sequence
  Description of Artificial Sequence: Synthetic oligonucleotide
  Target: SCN9A; (+) strand; PAM type: YTN; PAM sequence: TTA
atagtatgatggccataaaa

SEQ ID NO: 102695 - DNA, 20 bp, Artificial Sequence
  Description of Artificial Sequence: Synthetic oligonucleotide
  Target: SCN9A; (+) strand; PAM type: YTN; PAM sequence: TTG
aggtcaagtaaccttaaatg

SEQ ID NO: 102696 - DNA, 20 bp, Artificial Sequence
  Description of Artificial Sequence: Synthetic oligonucleotide
  Target: SCN9A; (+) strand; PAM type: YTN; PAM sequence: CTT
aaatgtatctatacttgatc

SEQ ID NO: 102697 - DNA, 20 bp, Artificial Sequence
  Description of Artificial Sequence: Synthetic oligonucleotide
  Target: SCN9A; (+) strand; PAM type: YTN; PAM sequence: TTA
aatgtatctatacttgatct

SEQ ID NO: 102698 - DNA, 20 bp, Artificial Sequence
  Description of Artificial Sequence: Synthetic oligonucleotide
  Target: SCN9A; (+) strand; PAM type: YTN; PAM sequence: CTA
tacttgatctttctatctac

SEQ ID NO: 102699 - DNA, 20 bp, Artificial Sequence
  Description of Artificial Sequence: Synthetic oligonucleotide
  Target: SCN9A; (+) strand; PAM type: YTN; PAM sequence: CTT
gatctttctatctacaccat

SEQ ID NO: 102700 - DNA, 20 bp, Artificial Sequence
  Description of Artificial Sequence: Synthetic oligonucleotide
  Target: SCN9A; (+) strand; PAM type: YTN; PAM sequence: TTG
atctttctatctacaccatc

SEQ ID NO: 102701 - DNA, 20 bp, Artificial Sequence
  Description of Artificial Sequence: Synthetic oligonucleotide
  Target: SCN9A; (+) strand; PAM type: YTN; PAM sequence: CTT
tctatctacaccatcctgta

SEQ ID NO: 102702 - DNA, 20 bp, Artificial Sequence
  Description of Artificial Sequence: Synthetic oligonucleotide
  Target: SCN9A; (+) strand; PAM type: YTN; PAM sequence: TTT
ctatctacaccatcctgtaa

SEQ ID NO: 102703 - DNA, 20 bp, Artificial Sequence
  Description of Artificial Sequence: Synthetic oligonucleotide
  Target: SCN9A; (+) strand; PAM type: YTN; PAM sequence: TTC
tatctacaccatcctgtaaa

SEQ ID NO: 102704 - DNA, 20 bp, Artificial Sequence
  Description of Artificial Sequence: Synthetic oligonucleotide
  Target: SCN9A; (+) strand; PAM type: YTN; PAM sequence: CTA
tctacaccatcctgtaaaat

SEQ ID NO: 102705 - DNA, 20 bp, Artificial Sequence
  Description of Artificial Sequence: Synthetic oligonucleotide
  Target: SCN9A; (+) strand; PAM type: YTN; PAM sequence: CTA
caccatcctgtaaaataata

SEQ ID NO: 102706 - DNA, 20 bp, Artificial Sequence
  Description of Artificial Sequence: Synthetic oligonucleotide
  Target: SCN9A; (+) strand; PAM type: YTN; PAM sequence: CTG
taaaataataaactttatta

SEQ ID NO: 102707 - DNA, 20 bp, Artificial Sequence
  Description of Artificial Sequence: Synthetic oligonucleotide
  Target: SCN9A; (+) strand; PAM type: YTN; PAM sequence: CTT
tattatgtttattatactaa

SEQ ID NO: 102708 - DNA, 20 bp, Artificial Sequence
  Description of Artificial Sequence: Synthetic oligonucleotide
  Target: SCN9A; (+) strand; PAM type: YTN; PAM sequence: TTT
attatgtttattatactaac

SEQ ID NO: 102709 - DNA, 20 bp, Artificial Sequence
  Description of Artificial Sequence: Synthetic oligonucleotide
  Target: SCN9A; (+) strand; PAM type: YTN; PAM sequence: TTA
ttatgtttattatactaaca

SEQ ID NO: 102710 - DNA, 20 bp, Artificial Sequence
  Description of Artificial Sequence: Synthetic oligonucleotide
  Target: SCN9A; (+) strand; PAM type: YTN; PAM sequence: TTA
tgtttattatactaacaagt

SEQ ID NO: 102711 - DNA, 20 bp, Artificial Sequence
  Description of Artificial Sequence: Synthetic oligonucleotide
  Target: SCN9A; (+) strand; PAM type: YTN; PAM sequence: TTT
attatactaacaagtacgtg

SEQ ID NO: 102712 - DNA, 20 bp, Artificial Sequence
  Description of Artificial Sequence: Synthetic oligonucleotide
  Target: SCN9A; (+) strand; PAM type: YTN; PAM sequence: TTA
ttatactaacaagtacgtgg

SEQ ID NO: 102713 - DNA, 20 bp, Artificial Sequence
  Description of Artificial Sequence: Synthetic oligonucleotide
  Target: SCN9A; (+) strand; PAM type: YTN; PAM sequence: TTA
tactaacaagtacgtggcca

SEQ ID NO: 102714 - DNA, 20 bp, Artificial Sequence
  Description of Artificial Sequence: Synthetic oligonucleotide
  Target: SCN9A; (+) strand; PAM type: YTN; PAM sequence: CTA
acaagtacgtggccaaaatt

SEQ ID NO: 102715 - DNA, 20 bp, Artificial Sequence
  Description of Artificial Sequence: Synthetic oligonucleotide
  Target: SCN9A; (+) strand; PAM type: YTN; PAM sequence: TTA
gataaggtaatatattgatg

SEQ ID NO: 102716 - DNA, 20 bp, Artificial Sequence
  Description of Artificial Sequence: Synthetic oligonucleotide
  Target: SCN9A; (+) strand; PAM type: YTN; PAM sequence: TTG
atgttaactatcacttttgg

SEQ ID NO: 102717 - DNA, 20 bp, Artificial Sequence
  Description of Artificial Sequence: Synthetic oligonucleotide
  Target: SCN9A; (+) strand; PAM type: YTN; PAM sequence: TTA
actatcacttttggaaagta

SEQ ID NO: 102718 - DNA, 20 bp, Artificial Sequence
  Description of Artificial Sequence: Synthetic oligonucleotide
  Target: SCN9A; (+) strand; PAM type: YTN; PAM sequence: CTA
tcacttttggaaagtattga

SEQ ID NO: 102719 - DNA, 20 bp, Artificial Sequence
  Description of Artificial Sequence: Synthetic oligonucleotide
  Target: SCN9A; (+) strand; PAM type: YTN; PAM sequence: CTT
ttggaaagtattgaccacat

SEQ ID NO: 102720 - DNA, 20 bp, Artificial Sequence
  Description of Artificial Sequence: Synthetic oligonucleotide
  Target: SCN9A; (+) strand; PAM type: YTN; PAM sequence: TTT
tggaaagtattgaccacatc

SEQ ID NO: 102721 - DNA, 20 bp, Artificial Sequence
  Description of Artificial Sequence: Synthetic oligonucleotide
  Target: SCN9A; (+) strand; PAM type: YTN; PAM sequence: TTT
ggaaagtattgaccacatct

SEQ ID NO: 102722 - DNA, 20 bp, Artificial Sequence
  Description of Artificial Sequence: Synthetic oligonucleotide
  Target: SCN9A; (+) strand; PAM type: YTN; PAM sequence: TTG
gaaagtattgaccacatctt

SEQ ID NO: 102723 - DNA, 20 bp, Artificial Sequence
  Description of Artificial Sequence: Synthetic oligonucleotide
  Target: SCN9A; (+) strand; PAM type: YTN; PAM sequence: TTG
accacatcttattttttaaa

SEQ ID NO: 102724 - DNA, 20 bp, Artificial Sequence
  Description of Artificial Sequence: Synthetic oligonucleotide
  Target: SCN9A; (+) strand; PAM type: YTN; PAM sequence: CTT
attttttaaatttttaatat

SEQ ID NO: 102725 - DNA, 20 bp, Artificial Sequence
  Description of Artificial Sequence: Synthetic oligonucleotide
  Target: SCN9A; (+) strand; PAM type: YTN; PAM sequence: TTA
ttttttaaatttttaatata

SEQ ID NO: 102726 - DNA, 20 bp, Artificial Sequence
  Description of Artificial Sequence: Synthetic oligonucleotide
  Target: SCN9A; (+) strand; PAM type: YTN; PAM sequence: TTT
tttaaatttttaatataaat

SEQ ID NO: 102727 - DNA, 20 bp, Artificial Sequence
  Description of Artificial Sequence: Synthetic oligonucleotide
  Target: SCN9A; (+) strand; PAM type: YTN; PAM sequence: TTT
ttaaatttttaatataaatt

SEQ ID NO: 102728 - DNA, 20 bp, Artificial Sequence
  Description of Artificial Sequence: Synthetic oligonucleotide
  Target: SCN9A; (+) strand; PAM type: YTN; PAM sequence: TTT
taaatttttaatataaattt

SEQ ID NO: 102729 - DNA, 20 bp, Artificial Sequence
  Description of Artificial Sequence: Synthetic oligonucleotide
  Target: SCN9A; (+) strand; PAM type: YTN; PAM sequence: TTT
aaatttttaatataaattta

SEQ ID NO: 102730 - DNA, 20 bp, Artificial Sequence
  Description of Artificial Sequence: Synthetic oligonucleotide
  Target: SCN9A; (+) strand; PAM type: YTN; PAM sequence: TTA
aatttttaatataaatttat

SEQ ID NO: 102731 - DNA, 20 bp, Artificial Sequence
  Description of Artificial Sequence: Synthetic oligonucleotide
  Target: SCN9A; (+) strand; PAM type: YTN; PAM sequence: TTT
ttaatataaatttatggaca

SEQ ID NO: 102732 - DNA, 20 bp, Artificial Sequence
  Description of Artificial Sequence: Synthetic oligonucleotide
  Target: SCN9A; (+) strand; PAM type: YTN; PAM sequence: TTT
taatataaatttatggacac

SEQ ID NO: 102733 - DNA, 20 bp, Artificial Sequence
  Description of Artificial Sequence: Synthetic oligonucleotide
  Target: SCN9A; (+) strand; PAM type: YTN; PAM sequence: TTT
aatataaatttatggacact

SEQ ID NO: 102734 - DNA, 20 bp, Artificial Sequence
  Description of Artificial Sequence: Synthetic oligonucleotide
  Target: SCN9A; (+) strand; PAM type: YTN; PAM sequence: TTA
atataaatttatggacactg

SEQ ID NO: 102735 - DNA, 20 bp, Artificial Sequence
  Description of Artificial Sequence: Synthetic oligonucleotide
  Target: SCN9A; (+) strand; PAM type: YTN; PAM sequence: TTT
atggacactgacaatcatta

SEQ ID NO: 102736 - DNA, 20 bp, Artificial Sequence
  Description of Artificial Sequence: Synthetic oligonucleotide
  Target: SCN9A; (+) strand; PAM type: YTN; PAM sequence: TTA
tggacactgacaatcattat

SEQ ID NO: 102737 - DNA, 20 bp, Artificial Sequence
  Description of Artificial Sequence: Synthetic oligonucleotide
  Target: SCN9A; (+) strand; PAM type: YTN; PAM sequence: CTG
acaatcattatttgaggaca

SEQ ID NO: 102738 - DNA, 20 bp, Artificial Sequence
  Description of Artificial Sequence: Synthetic oligonucleotide
  Target: SCN9A; (+) strand; PAM type: YTN; PAM sequence: TTA
tttgaggacaacctataccc

SEQ ID NO: 102739 - DNA, 20 bp, Artificial Sequence
  Description of Artificial Sequence: Synthetic oligonucleotide
  Target: SCN9A; (+) strand; PAM type: YTN; PAM sequence: TTT
gaggacaacctataccctat

SEQ ID NO: 102740 - DNA, 20 bp, Artificial Sequence
  Description of Artificial Sequence: Synthetic oligonucleotide
  Target: SCN9A; (+) strand; PAM type: YTN; PAM sequence: TTG
aggacaacctataccctatt

SEQ ID NO: 102741 - DNA, 20 bp, Artificial Sequence
  Description of Artificial Sequence: Synthetic oligonucleotide
  Target: SCN9A; (+) strand; PAM type: YTN; PAM sequence: CTA
taccctatttgcaatataat

SEQ ID NO: 102742 - DNA, 20 bp, Artificial Sequence
  Description of Artificial Sequence: Synthetic oligonucleotide
  Target: SCN9A; (+) strand; PAM type: YTN; PAM sequence: CTA
tttgcaatataatacaagtg

SEQ ID NO: 102743 - DNA, 20 bp, Artificial Sequence
  Description of Artificial Sequence: Synthetic oligonucleotide
  Target: SCN9A; (+) strand; PAM type: YTN; PAM sequence: TTT
gcaatataatacaagtgtca

SEQ ID NO: 102744 - DNA, 20 bp, Artificial Sequence
  Description of Artificial Sequence: Synthetic oligonucleotide
  Target: SCN9A; (+) strand; PAM type: YTN; PAM sequence: TTG
caatataatacaagtgtcaa

SEQ ID NO: 102745 - DNA, 20 bp, Artificial Sequence
  Description of Artificial Sequence: Synthetic oligonucleotide
  Target: SCN9A; (+) strand; PAM type: YTN; PAM sequence: TTA
ctaatgcctgatcattgaaa

SEQ ID NO: 102746 - DNA, 20 bp, Artificial Sequence
  Description of Artificial Sequence: Synthetic oligonucleotide
  Target: SCN9A; (+) strand; PAM type: YTN; PAM sequence: CTA
atgcctgatcattgaaagct

SEQ ID NO: 102747 - DNA, 20 bp, Artificial Sequence
  Description of Artificial Sequence: Synthetic oligonucleotide
  Target: SCN9A; (+) strand; PAM type: YTN; PAM sequence: CTG
atcattgaaagctcagatca

SEQ ID NO: 102748 - DNA, 20 bp, Artificial Sequence
  Description of Artificial Sequence: Synthetic oligonucleotide
  Target: SCN9A; (+) strand; PAM type: YTN; PAM sequence: TTG
aaagctcagatcaaatagtt

SEQ ID NO: 102749 - DNA, 20 bp, Artificial Sequence
  Description of Artificial Sequence: Synthetic oligonucleotide
  Target: SCN9A; (+) strand; PAM type: YTN; PAM sequence: CTC
agatcaaatagttggcaaaa

SEQ ID NO: 102750 - DNA, 20 bp, Artificial Sequence
  Description of Artificial Sequence: Synthetic oligonucleotide
  Target: SCN9A; (+) strand; PAM type: YTN; PAM sequence: TTG
gcaaaaaacttattgatagt

SEQ ID NO: 102751 - DNA, 20 bp, Artificial Sequence
  Description of Artificial Sequence: Synthetic oligonucleotide
  Target: SCN9A; (+) strand; PAM type: YTN; PAM sequence: CTT
attgatagttaaaatttttt

SEQ ID NO: 102752 - DNA, 20 bp, Artificial Sequence
  Description of Artificial Sequence: Synthetic oligonucleotide
  Target: SCN9A; (+) strand; PAM type: YTN; PAM sequence: TTA
ttgatagttaaaatttttta

SEQ ID NO: 102753 - DNA, 20 bp, Artificial Sequence
  Description of Artificial Sequence: Synthetic oligonucleotide
  Target: SCN9A; (+) strand; PAM type: YTN; PAM sequence: TTG
atagttaaaattttttaaaa

SEQ ID NO: 102754 - DNA, 20 bp, Artificial Sequence
  Description of Artificial Sequence: Synthetic oligonucleotide
  Target: SCN9A; (+) strand; PAM type: YTN; PAM sequence: TTA
aaattttttaaaaagataag

SEQ ID NO: 102755 - DNA, 20 bp, Artificial Sequence
  Description of Artificial Sequence: Synthetic oligonucleotide
  Target: SCN9A; (+) strand; PAM type: YTN; PAM sequence: TTT
tttaaaaagataagtgcaag

SEQ ID NO: 102756 - DNA, 20 bp, Artificial Sequence
  Description of Artificial Sequence: Synthetic oligonucleotide
  Target: SCN9A; (+) strand; PAM type: YTN; PAM sequence: TTT
ttaaaaagataagtgcaaga

SEQ ID NO: 102757 - DNA, 20 bp, Artificial Sequence
  Description of Artificial Sequence: Synthetic oligonucleotide
  Target: SCN9A; (+) strand; PAM type: YTN; PAM sequence: TTT
taaaaagataagtgcaagat

SEQ ID NO: 102758 - DNA, 20 bp, Artificial Sequence
  Description of Artificial Sequence: Synthetic oligonucleotide
  Target: SCN9A; (+) strand; PAM type: YTN; PAM sequence: TTT
aaaaagataagtgcaagata

SEQ ID NO: 102759 - DNA, 20 bp, Artificial Sequence
  Description of Artificial Sequence: Synthetic oligonucleotide
  Target: SCN9A; (+) strand; PAM type: YTN; PAM sequence: TTA
aaaagataagtgcaagataa

SEQ ID NO: 102760 - DNA, 20 bp, Artificial Sequence
  Description of Artificial Sequence: Synthetic oligonucleotide
  Target: SCN9A; (+) strand; PAM type: YTN; PAM sequence: TTT
tttattatctcttgaattta

SEQ ID NO: 102761 - DNA, 20 bp, Artificial Sequence
  Description of Artificial Sequence: Synthetic oligonucleotide
  Target: SCN9A; (+) strand; PAM type: YTN; PAM sequence: TTT
ttattatctcttgaatttaa

SEQ ID NO: 102762 - DNA, 20 bp, Artificial Sequence
  Description of Artificial Sequence: Synthetic oligonucleotide
  Target: SCN9A; (+) strand; PAM type: YTN; PAM sequence: TTT
tattatctcttgaatttaaa

SEQ ID NO: 102763 - DNA, 20 bp, Artificial Sequence
  Description of Artificial Sequence: Synthetic oligonucleotide
  Target: SCN9A; (+) strand; PAM type: YTN; PAM sequence: TTT
attatctcttgaatttaaat

SEQ ID NO: 102764 - DNA, 20 bp, Artificial Sequence
  Description of Artificial Sequence: Synthetic oligonucleotide
  Target: SCN9A; (+) strand; PAM type: YTN; PAM sequence: TTA
ttatctcttgaatttaaata

SEQ ID NO: 102765 - DNA, 20 bp, Artificial Sequence
  Description of Artificial Sequence: Synthetic oligonucleotide
  Target: SCN9A; (+) strand; PAM type: YTN; PAM sequence: TTA
tctcttgaatttaaatatat

SEQ ID NO: 102766 - DNA, 20 bp, Artificial Sequence
  Description of Artificial Sequence: Synthetic oligonucleotide
  Target: SCN9A; (+) strand; PAM type: YTN; PAM sequence: CTC
ttgaatttaaatatatgtag

SEQ ID NO: 102767 - DNA, 20 bp, Artificial Sequence
  Description of Artificial Sequence: Synthetic oligonucleotide
  Target: SCN9A; (+) strand; PAM type: YTN; PAM sequence: CTT
gaatttaaatatatgtagca

SEQ ID NO: 102768 - DNA, 20 bp, Artificial Sequence
  Description of Artificial Sequence: Synthetic oligonucleotide
  Target: SCN9A; (+) strand; PAM type: YTN; PAM sequence: TTG
aatttaaatatatgtagcag

SEQ ID NO: 102769 - DNA, 20 bp, Artificial Sequence
  Description of Artificial Sequence: Synthetic oligonucleotide
  Target: SCN9A; (+) strand; PAM type: YTN; PAM sequence: TTT
aaatatatgtagcaggatga

SEQ ID NO: 102770 - DNA, 20 bp, Artificial Sequence
  Description of Artificial Sequence: Synthetic oligonucleotide
  Target: SCN9A; (+) strand; PAM type: YTN; PAM sequence: TTA
aatatatgtagcaggatgat

SEQ ID NO: 102771 - DNA, 20 bp, Artificial Sequence
  Description of Artificial Sequence: Synthetic oligonucleotide
  Target: SCN9A; (+) strand; PAM type: YTN; PAM sequence: TTC
tttgatcaagaccacaaaat

SEQ ID NO: 102772 - DNA, 20 bp, Artificial Sequence
  Description of Artificial Sequence: Synthetic oligonucleotide
  Target: SCN9A; (+) strand; PAM type: YTN; PAM sequence: CTT
tgatcaagaccacaaaatca

SEQ ID NO: 102773 - DNA, 20 bp, Artificial Sequence
  Description of Artificial Sequence: Synthetic oligonucleotide
  Target: SCN9A; (+) strand; PAM type: YTN; PAM sequence: TTT
gatcaagaccacaaaatcaa

SEQ ID NO: 102774 - DNA, 20 bp, Artificial Sequence
  Description of Artificial Sequence: Synthetic oligonucleotide
  Target: SCN9A; (+) strand; PAM type: YTN; PAM sequence: TTG
atcaagaccacaaaatcaaa

SEQ ID NO: 102775 - DNA, 20 bp, Artificial Sequence
  Description of Artificial Sequence: Synthetic oligonucleotide
  Target: SCN9A; (+) strand; PAM type: YTN; PAM sequence: TTT
tgaaatcaaaatgccaatga

SEQ ID NO: 102776 - DNA, 20 bp, Artificial Sequence
  Description of Artificial Sequence: Synthetic oligonucleotide
  Target: SCN9A; (+) strand; PAM type: YTN; PAM sequence: TTT
gaaatcaaaatgccaatgac

SEQ ID NO: 102777 - DNA, 20 bp, Artificial Sequence
  Description of Artificial Sequence: Synthetic oligonucleotide
  Target: SCN9A; (+) strand; PAM type: YTN; PAM sequence: TTG
aaatcaaaatgccaatgacc

SEQ ID NO: 102778 - DNA, 20 bp, Artificial Sequence
  Description of Artificial Sequence: Synthetic oligonucleotide
  Target: SCN9A; (+) strand; PAM type: YTN; PAM sequence: TTT
tgtatataacattttagtat

SEQ ID NO: 102779 - DNA, 20 bp, Artificial Sequence
  Description of Artificial Sequence: Synthetic oligonucleotide
  Target: SCN9A; (+) strand; PAM type: YTN; PAM sequence: TTT
gtatataacattttagtata

SEQ ID NO: 102780 - DNA, 20 bp, Artificial Sequence
  Description of Artificial Sequence: Synthetic oligonucleotide
  Target: SCN9A; (+) strand; PAM type: YTN; PAM sequence: TTG
tatataacattttagtatat

SEQ ID NO: 102781 - DNA, 20 bp, Artificial Sequence
  Description of Artificial Sequence: Synthetic oligonucleotide
  Target: SCN9A; (+) strand; PAM type: YTN; PAM sequence: TTT
tagtatatagtagaaaagat

SEQ ID NO: 102782 - DNA, 20 bp, Artificial Sequence
  Description of Artificial Sequence: Synthetic oligonucleotide
  Target: SCN9A; (+) strand; PAM type: YTN; PAM sequence: TTT
agtatatagtagaaaagatc

SEQ ID NO: 102783 - DNA, 20 bp, Artificial Sequence
  Description of Artificial Sequence: Synthetic oligonucleotide
  Target: SCN9A; (+) strand; PAM type: YTN; PAM sequence: TTA
gtatatagtagaaaagatca

SEQ ID NO: 102784 - DNA, 20 bp, Artificial Sequence
  Description of Artificial Sequence: Synthetic oligonucleotide
  Target: SCN9A; (+) strand; PAM type: YTN; PAM sequence: TTA
tttataatgtcaagaaagtg

SEQ ID NO: 102785 - DNA, 20 bp, Artificial Sequence
  Description of Artificial Sequence: Synthetic oligonucleotide
  Target: SCN9A; (+) strand; PAM type: YTN; PAM sequence: TTT
ataatgtcaagaaagtggct

SEQ ID NO: 102786 - DNA, 20 bp, Artificial Sequence
  Description of Artificial Sequence: Synthetic oligonucleotide
  Target: SCN9A; (+) strand; PAM type: YTN; PAM sequence: TTA
taatgtcaagaaagtggcta

SEQ ID NO: 102787 - DNA, 20 bp, Artificial Sequence
  Description of Artificial Sequence: Synthetic oligonucleotide
  Target: SCN9A; (+) strand; PAM type: YTN; PAM sequence: CTA
ctaaagtaagcaccacatgc

SEQ ID NO: 102788 - DNA, 20 bp, Artificial Sequence
  Description of Artificial Sequence: Synthetic oligonucleotide
  Target: SCN9A; (+) strand; PAM type: YTN; PAM sequence: CTA
aagtaagcaccacatgcaaa

SEQ ID NO: 102789 - DNA, 20 bp, Artificial Sequence
  Description of Artificial Sequence: Synthetic oligonucleotide
  Target: SCN9A; (+) strand; PAM type: YTN; PAM sequence: CTC
tgaaacaaagatcgaagaaa

SEQ ID NO: 102790 - DNA, 20 bp, Artificial Sequence
  Description of Artificial Sequence: Synthetic oligonucleotide
  Target: SCN9A; (+) strand; PAM type: YTN; PAM sequence: CTG
aaacaaagatcgaagaaaat

SEQ ID NO: 102791 - DNA, 20 bp, Artificial Sequence
  Description of Artificial Sequence: Synthetic oligonucleotide
  Target: SCN9A; (+) strand; PAM type: YTN; PAM sequence: TTA
aacatggcagacttacacat

SEQ ID NO: 102792 - DNA, 20 bp, Artificial Sequence
  Description of Artificial Sequence: Synthetic oligonucleotide
  Target: SCN9A; (+) strand; PAM type: YTN; PAM sequence: CTT
acacatggaataatgaattc

SEQ ID NO: 102793 - DNA, 20 bp, Artificial Sequence
  Description of Artificial Sequence: Synthetic oligonucleotide
  Target: SCN9A; (+) strand; PAM type: YTN; PAM sequence: TTA
cacatggaataatgaattca

SEQ ID NO: 102794 - DNA, 20 bp, Artificial Sequence
  Description of Artificial Sequence: Synthetic oligonucleotide
  Target: SCN9A; (+) strand; PAM type: YTN; PAM sequence: TTC
attgtcattatgatcatata

SEQ ID NO: 102795 - DNA, 20 bp, Artificial Sequence
  Description of Artificial Sequence: Synthetic oligonucleotide
  Target: SCN9A; (+) strand; PAM type: YTN; PAM sequence: TTG
tcattatgatcatataagtg

SEQ ID NO: 102796 - DNA, 20 bp, Artificial Sequence
  Description of Artificial Sequence: Synthetic oligonucleotide
  Target: SCN9A; (+) strand; PAM type: YTN; PAM sequence: TTA
tgatcatataagtgatcata

SEQ ID NO: 102797 - DNA, 20 bp, Artificial Sequence
  Description of Artificial Sequence: Synthetic oligonucleotide
  Target: SCN9A; (+) strand; PAM type: YTN; PAM sequence: TTT
ttctcacccagagctttatg

SEQ ID NO: 102798 - DNA, 20 bp, Artificial Sequence
  Description of Artificial Sequence: Synthetic oligonucleotide
  Target: SCN9A; (+) strand; PAM type: YTN; PAM sequence: TTT
tctcacccagagctttatga

SEQ ID NO: 102799 - DNA, 20 bp, Artificial Sequence
  Description of Artificial Sequence: Synthetic oligonucleotide
  Target: SCN9A; (+) strand; PAM type: YTN; PAM sequence: TTT
ctcacccagagctttatgag

SEQ ID NO: 102800 - DNA, 20 bp, Artificial Sequence
  Description of Artificial Sequence: Synthetic oligonucleotide
  Target: SCN9A; (+) strand; PAM type: YTN; PAM sequence: TTC
tcacccagagctttatgagt

SEQ ID NO: 102801 - DNA, 20 bp, Artificial Sequence
  Description of Artificial Sequence: Synthetic oligonucleotide
  Target: SCN9A; (+) strand; PAM type: YTN; PAM sequence: CTC
acccagagctttatgagtaa

SEQ ID NO: 102802 - DNA, 20 bp, Artificial Sequence
  Description of Artificial Sequence: Synthetic oligonucleotide
  Target: SCN9A; (+) strand; PAM type: YTN; PAM sequence: CTT
tatgagtaaccatgatgttt

SEQ ID NO: 102803 - DNA, 20 bp, Artificial Sequence
  Description of Artificial Sequence: Synthetic oligonucleotide
  Target: SCN9A; (+) strand; PAM type: YTN; PAM sequence: TTT
atgagtaaccatgatgttta

SEQ ID NO: 102804 - DNA, 20 bp, Artificial Sequence
  Description of Artificial Sequence: Synthetic oligonucleotide
  Target: SCN9A; (+) strand; PAM type: YTN; PAM sequence: TTA
tgagtaaccatgatgtttac

SEQ ID NO: 102805 - DNA, 20 bp, Artificial Sequence
  Description of Artificial Sequence: Synthetic oligonucleotide
  Target: SCN9A; (+) strand; PAM type: YTN; PAM sequence: TTT
acacatacacacacacacac

SEQ ID NO: 102806 - DNA, 20 bp, Artificial Sequence
  Description of Artificial Sequence: Synthetic oligonucleotide
  Target: SCN9A; (+) strand; PAM type: YTN; PAM sequence: TTA
cacatacacacacacacacg

SEQ ID NO: 102807 - DNA, 20 bp, Artificial Sequence
  Description of Artificial Sequence: Synthetic oligonucleotide
  Target: SCN9A; (+) strand; PAM type: YTN; PAM sequence: CTT
tacaaaaaatacatacagca

SEQ ID NO: 102808 - DNA, 20 bp, Artificial Sequence
  Description of Artificial Sequence: Synthetic oligonucleotide
  Target: SCN9A; (+) strand; PAM type: YTN; PAM sequence: TTT
acaaaaaatacatacagcaa

SEQ ID NO: 102809 - DNA, 20 bp, Artificial Sequence
  Description of Artificial Sequence: Synthetic oligonucleotide
  Target: SCN9A; (+) strand; PAM type: YTN; PAM sequence: TTA
caaaaaatacatacagcaac

SEQ ID NO: 102810 - DNA, 20 bp, Artificial Sequence
  Description of Artificial Sequence: Synthetic oligonucleotide
  Target: SCN9A; (+) strand; PAM type: YTN; PAM sequence: CTG
tagcaaaactctgtcaaatt

SEQ ID NO: 102811 - DNA, 20 bp, Artificial Sequence
  Description of Artificial Sequence: Synthetic oligonucleotide
  Target: SCN9A; (+) strand; PAM type: YTN; PAM sequence: CTC
tgtcaaatttcccaaatatt

SEQ ID NO: 102812 - DNA, 20 bp, Artificial Sequence
  Description of Artificial Sequence: Synthetic oligonucleotide
  Target: SCN9A; (+) strand; PAM type: YTN; PAM sequence: CTG
tcaaatttcccaaatattgt

SEQ ID NO: 102813 - DNA, 20 bp, Artificial Sequence
  Description of Artificial Sequence: Synthetic oligonucleotide
  Target: SCN9A; (+) strand; PAM type: YTN; PAM sequence: TTT
cccaaatattgttttataaa

SEQ ID NO: 102814 - DNA, 20 bp, Artificial Sequence
  Description of Artificial Sequence: Synthetic oligonucleotide
  Target: SCN9A; (+) strand; PAM type: YTN; PAM sequence: TTC
ccaaatattgttttataaag

SEQ ID NO: 102815 - DNA, 20 bp, Artificial Sequence
  Description of Artificial Sequence: Synthetic oligonucleotide
  Target: SCN9A; (+) strand; PAM type: YTN; PAM sequence: TTG
ttttataaaggagtaaagca

SEQ ID NO: 102816 - DNA, 20 bp, Artificial Sequence
  Description of Artificial Sequence: Synthetic oligonucleotide
  Target: SCN9A; (+) strand; PAM type: YTN; PAM sequence: TTT
tataaaggagtaaagcagca

SEQ ID NO: 102817 - DNA, 20 bp, Artificial Sequence
  Description of Artificial Sequence: Synthetic oligonucleotide
  Target: SCN9A; (+) strand; PAM type: YTN; PAM sequence: TTT
ataaaggagtaaagcagcat

SEQ ID NO: 102818 - DNA, 20 bp, Artificial Sequence
  Description of Artificial Sequence: Synthetic oligonucleotide
  Target: SCN9A; (+) strand; PAM type: YTN; PAM sequence: TTA
taaaggagtaaagcagcata

SEQ ID NO: 102819 - DNA, 20 bp, Artificial Sequence
  Description of Artificial Sequence: Synthetic oligonucleotide
  Target: SCN9A; (+) strand; PAM type: YTN; PAM sequence: TTA
atttttcattctcatttgct

SEQ ID NO: 102820 - DNA, 20 bp, Artificial Sequence
  Description of Artificial Sequence: Synthetic oligonucleotide
  Target: SCN9A; (+) strand; PAM type: YTN; PAM sequence: TTT
ttcattctcatttgctaaat

SEQ ID NO: 102821 - DNA, 20 bp, Artificial Sequence
  Description of Artificial Sequence: Synthetic oligonucleotide
  Target: SCN9A; (+) strand; PAM type: YTN; PAM sequence: TTT
tcattctcatttgctaaatg

SEQ ID NO: 102822 - DNA, 20 bp, Artificial Sequence
  Description of Artificial Sequence: Synthetic oligonucleotide
  Target: SCN9A; (+) strand; PAM type: YTN; PAM sequence: TTT
cattctcatttgctaaatga

SEQ ID NO: 102823 - DNA, 20 bp, Artificial Sequence
  Description of Artificial Sequence: Synthetic oligonucleotide
  Target: SCN9A; (+) strand; PAM type: YTN; PAM sequence: TTC
attctcatttgctaaatgac

SEQ ID NO: 102824 - DNA, 20 bp, Artificial Sequence
  Description of Artificial Sequence: Synthetic oligonucleotide
  Target: SCN9A; (+) strand; PAM type: YTN; PAM sequence: TTC
tcatttgctaaatgacatgt

SEQ ID NO: 102825 - DNA, 20 bp, Artificial Sequence
  Description of Artificial Sequence: Synthetic oligonucleotide
  Target: SCN9A; (+) strand; PAM type: YTN; PAM sequence: CTC
atttgctaaatgacatgtga

SEQ ID NO: 102826 - DNA, 20 bp, Artificial Sequence
  Description of Artificial Sequence: Synthetic oligonucleotide
  Target: SCN9A; (+) strand; PAM type: YTN; PAM sequence: TTT
gctaaatgacatgtgaatat

SEQ ID NO: 102827 - DNA, 20 bp, Artificial Sequence
  Description of Artificial Sequence: Synthetic oligonucleotide
  Target: SCN9A; (+) strand; PAM type: YTN; PAM sequence: TTG
ctaaatgacatgtgaatatt

SEQ ID NO: 102828 - DNA, 20 bp, Artificial Sequence
  Description of Artificial Sequence: Synthetic oligonucleotide
  Target: SCN9A; (+) strand; PAM type: YTN; PAM sequence: CTA
aatgacatgtgaatattgaa

SEQ ID NO: 102829 - DNA, 20 bp, Artificial Sequence
  Description of Artificial Sequence: Synthetic oligonucleotide
  Target: SCN9A; (+) strand; PAM type: YTN; PAM sequence: TTG
aaagctactagttactacaa

SEQ ID NO: 102830 - DNA, 20 bp, Artificial Sequence
  Description of Artificial Sequence: Synthetic oligonucleotide
  Target: SCN9A; (+) strand; PAM type: YTN; PAM sequence: CTA
ctagttactacaacacaatt

SEQ ID NO: 102831 - DNA, 20 bp, Artificial Sequence
  Description of Artificial Sequence: Synthetic oligonucleotide
  Target: SCN9A; (+) strand; PAM type: YTN; PAM sequence: CTA
gttactacaacacaattctc

SEQ ID NO: 102832 - DNA, 20 bp, Artificial Sequence
  Description of Artificial Sequence: Synthetic oligonucleotide
  Target: SCN9A; (+) strand; PAM type: YTN; PAM sequence: TTA
ctacaacacaattctcttat

SEQ ID NO: 102833 - DNA, 20 bp, Artificial Sequence
  Description of Artificial Sequence: Synthetic oligonucleotide
  Target: SCN9A; (+) strand; PAM type: YTN; PAM sequence: CTA
caacacaattctcttattaa

SEQ ID NO: 102834 - DNA, 20 bp, Artificial Sequence
  Description of Artificial Sequence: Synthetic oligonucleotide
  Target: SCN9A; (+) strand; PAM type: YTN; PAM sequence: TTC
tcttattaagttacaacttt

SEQ ID NO: 102835 - DNA, 20 bp, Artificial Sequence
  Description of Artificial Sequence: Synthetic oligonucleotide
  Target: SCN9A; (+) strand; PAM type: YTN; PAM sequence: CTC
ttattaagttacaactttat

SEQ ID NO: 102836 - DNA, 20 bp, Artificial Sequence
  Description of Artificial Sequence: Synthetic oligonucleotide
  Target: SCN9A; (+) strand; PAM type: YTN; PAM sequence: CTT
attaagttacaactttatct

SEQ ID NO: 102837 - DNA, 20 bp, Artificial Sequence
  Description of Artificial Sequence: Synthetic oligonucleotide
  Target: SCN9A; (+) strand; PAM type: YTN; PAM sequence: TTA
ttaagttacaactttatctt

SEQ ID NO: 102838 - DNA, 20 bp, Artificial Sequence
  Description of Artificial Sequence: Synthetic oligonucleotide
  Target: SCN9A; (+) strand; PAM type: YTN; PAM sequence: TTA
agttacaactttatcttttt

SEQ ID NO: 102839 - DNA, 20 bp, Artificial Sequence
  Description of Artificial Sequence: Synthetic oligonucleotide
  Target: SCN9A; (+) strand; PAM type: YTN; PAM sequence: TTA
caactttatcttttttagag

SEQ ID NO: 102840 - DNA, 20 bp, Artificial Sequence
  Description of Artificial Sequence: Synthetic oligonucleotide
  Target: SCN9A; (+) strand; PAM type: YTN; PAM sequence: CTT
tatcttttttagagtagttc

SEQ ID NO: 102841 - DNA, 20 bp, Artificial Sequence
  Description of Artificial Sequence: Synthetic oligonucleotide
  Target: SCN9A; (+) strand; PAM type: YTN; PAM sequence: TTT
atcttttttagagtagttca

SEQ ID NO: 102842 - DNA, 20 bp, Artificial Sequence
  Description of Artificial Sequence: Synthetic oligonucleotide
  Target: SCN9A; (+) strand; PAM type: YTN; PAM sequence: TTA
tcttttttagagtagttcaa

SEQ ID NO: 102843 - DNA, 20 bp, Artificial Sequence
  Description of Artificial Sequence: Synthetic oligonucleotide
  Target: SCN9A; (+) strand; PAM type: YTN; PAM sequence: CTT
ttttagagtagttcaagcaa

SEQ ID NO: 102844 - DNA, 20 bp, Artificial Sequence
  Description of Artificial Sequence: Synthetic oligonucleotide
  Target: SCN9A; (+) strand; PAM type: YTN; PAM sequence: TTT
tttagagtagttcaagcaag

SEQ ID NO: 102845 - DNA, 20 bp, Artificial Sequence
  Description of Artificial Sequence: Synthetic oligonucleotide
  Target: SCN9A; (+) strand; PAM type: YTN; PAM sequence: TTT
ttagagtagttcaagcaagt

SEQ ID NO: 102846 - DNA, 20 bp, Artificial Sequence
  Description of Artificial Sequence: Synthetic oligonucleotide
  Target: SCN9A; (+) strand; PAM type: YTN; PAM sequence: TTT
tagagtagttcaagcaagtg

SEQ ID NO: 102847 - DNA, 20 bp, Artificial Sequence
  Description of Artificial Sequence: Synthetic oligonucleotide
  Target: SCN9A; (+) strand; PAM type: YTN; PAM sequence: TTT
agagtagttcaagcaagtgc

SEQ ID NO: 102848 - DNA, 20 bp, Artificial Sequence
  Description of Artificial Sequence: Synthetic oligonucleotide
  Target: SCN9A; (+) strand; PAM type: YTN; PAM sequence: TTA
gagtagttcaagcaagtgca

SEQ ID NO: 102849 - DNA, 20 bp, Artificial Sequence
  Description of Artificial Sequence: Synthetic oligonucleotide
  Target: SCN9A; (+) strand; PAM type: YTN; PAM sequence: TTC
aagcaagtgcaagtgctaaa

SEQ ID NO: 102850 - DNA, 20 bp, Artificial Sequence
  Description of Artificial Sequence: Synthetic oligonucleotide
  Target: SCN9A; (+) strand; PAM type: YTN; PAM sequence: CTA
aaaataataaaatacttatt

SEQ ID NO: 102851 - DNA, 20 bp, Artificial Sequence
  Description of Artificial Sequence: Synthetic oligonucleotide
  Target: SCN9A; (+) strand; PAM type: YTN; PAM sequence: CTT
atttcagataaattgattct

SEQ ID NO: 102852 - DNA, 20 bp, Artificial Sequence
  Description of Artificial Sequence: Synthetic oligonucleotide
  Target: SCN9A; (+) strand; PAM type: YTN; PAM sequence: TTA
tttcagataaattgattctc

SEQ ID NO: 102853 - DNA, 20 bp, Artificial Sequence
  Description of Artificial Sequence: Synthetic oligonucleotide
  Target: SCN9A; (+) strand; PAM type: YTN; PAM sequence: TTT
cagataaattgattctcaat

SEQ ID NO: 102854 - DNA, 20 bp, Artificial Sequence
  Description of Artificial Sequence: Synthetic oligonucleotide
  Target: SCN9A; (+) strand; PAM type: YTN; PAM sequence: TTC
agataaattgattctcaatc

SEQ ID NO: 102855 - DNA, 20 bp, Artificial Sequence
  Description of Artificial Sequence: Synthetic oligonucleotide
  Target: SCN9A; (+) strand; PAM type: YTN; PAM sequence: TTG
attctcaatctatgaatttg

SEQ ID NO: 102856 - DNA, 20 bp, Artificial Sequence
  Description of Artificial Sequence: Synthetic oligonucleotide
  Target: SCN9A; (+) strand; PAM type: YTN; PAM sequence: TTC
tcaatctatgaatttgtatt

SEQ ID NO: 102857 - DNA, 20 bp, Artificial Sequence
  Description of Artificial Sequence: Synthetic oligonucleotide
  Target: SCN9A; (+) strand; PAM type: YTN; PAM sequence: CTC
aatctatgaatttgtattaa

SEQ ID NO: 102858 - DNA, 20 bp, Artificial Sequence
  Description of Artificial Sequence: Synthetic oligonucleotide
  Target: SCN9A; (+) strand; PAM type: YTN; PAM sequence: CTA
tgaatttgtattaatatgat

SEQ ID NO: 102859 - DNA, 20 bp, Artificial Sequence
  Description of Artificial Sequence: Synthetic oligonucleotide
  Target: SCN9A; (+) strand; PAM type: YTN; PAM sequence: TTT
gtattaatatgatagcccaa

SEQ ID NO: 102860 - DNA, 20 bp, Artificial Sequence
  Description of Artificial Sequence: Synthetic oligonucleotide
  Target: SCN9A; (+) strand; PAM type: YTN; PAM sequence: TTG
tattaatatgatagcccaat

SEQ ID NO: 102861 - DNA, 20 bp, Artificial Sequence
  Description of Artificial Sequence: Synthetic oligonucleotide
  Target: SCN9A; (+) strand; PAM type: YTN; PAM sequence: TTA
atatgatagcccaatctaaa

SEQ ID NO: 102862 - DNA, 20 bp, Artificial Sequence
  Description of Artificial Sequence: Synthetic oligonucleotide
  Target: SCN9A; (+) strand; PAM type: YTN; PAM sequence: CTA
aaggtttgacttttagagat

SEQ ID NO: 102863 - DNA, 20 bp, Artificial Sequence
  Description of Artificial Sequence: Synthetic oligonucleotide
  Target: SCN9A; (+) strand; PAM type: YTN; PAM sequence: TTT
gacttttagagattgacttg

SEQ ID NO: 102864 - DNA, 20 bp, Artificial Sequence
  Description of Artificial Sequence: Synthetic oligonucleotide
  Target: SCN9A; (+) strand; PAM type: YTN; PAM sequence: TTG
acttttagagattgacttgg

SEQ ID NO: 102865 - DNA, 20 bp, Artificial Sequence
  Description of Artificial Sequence: Synthetic oligonucleotide
  Target: SCN9A; (+) strand; PAM type: YTN; PAM sequence: CTT
ttagagattgacttggaagc

SEQ ID NO: 102866 - DNA, 20 bp, Artificial Sequence
  Description of Artificial Sequence: Synthetic oligonucleotide
  Target: SCN9A; (+) strand; PAM type: YTN; PAM sequence: TTT
tagagattgacttggaagct

SEQ ID NO: 102867 - DNA, 20 bp, Artificial Sequence
  Description of Artificial Sequence: Synthetic oligonucleotide
  Target: SCN9A; (+) strand; PAM type: YTN; PAM sequence: TTT
agagattgacttggaagcta

SEQ ID NO: 102868 - DNA, 20 bp, Artificial Sequence
  Description of Artificial Sequence: Synthetic oligonucleotide
  Target: SCN9A; (+) strand; PAM type: YTN; PAM sequence: TTA
gagattgacttggaagctag

SEQ ID NO: 102869 - DNA, 20 bp, Artificial Sequence
  Description of Artificial Sequence: Synthetic oligonucleotide
  Target: SCN9A; (+) strand; PAM type: YTN; PAM sequence: TTG
acttggaagctagaagtatt

SEQ ID NO: 102870 - DNA, 20 bp, Artificial Sequence
  Description of Artificial Sequence: Synthetic oligonucleotide
  Target: SCN9A; (+) strand; PAM type: YTN; PAM sequence: CTT
ggaagctagaagtattcttg

SEQ ID NO: 102871 - DNA, 20 bp, Artificial Sequence
  Description of Artificial Sequence: Synthetic oligonucleotide
  Target: SCN9A; (+) strand; PAM type: YTN; PAM sequence: TTG
gaagctagaagtattcttga

SEQ ID NO: 102872 - DNA, 20 bp, Artificial Sequence
  Description of Artificial Sequence: Synthetic oligonucleotide
  Target: SCN9A; (+) strand; PAM type: YTN; PAM sequence: CTA
gaagtattcttgatgggtac

SEQ ID NO: 102873 - DNA, 20 bp, Artificial Sequence
  Description of Artificial Sequence: Synthetic oligonucleotide
  Target: SCN9A; (+) strand; PAM type: YTN; PAM sequence: TTC
ttgatgggtaccacattaaa

SEQ ID NO: 102874 - DNA, 20 bp, Artificial Sequence
  Description of Artificial Sequence: Synthetic oligonucleotide
  Target: SCN9A; (+) strand; PAM type: YTN; PAM sequence: CTT
gatgggtaccacattaaatt

SEQ ID NO: 102875 - DNA, 20 bp, Artificial Sequence
  Description of Artificial Sequence: Synthetic oligonucleotide
  Target: SCN9A; (+) strand; PAM type: YTN; PAM sequence: TTG
atgggtaccacattaaattc

SEQ ID NO: 102876 - DNA, 20 bp, Artificial Sequence
  Description of Artificial Sequence: Synthetic oligonucleotide
  Target: SCN9A; (+) strand; PAM type: YTN; PAM sequence: TTA
aattctcaatgctattatta

SEQ ID NO: 102877 - DNA, 20 bp, Artificial Sequence
  Description of Artificial Sequence: Synthetic oligonucleotide
  Target: SCN9A; (+) strand; PAM type: YTN; PAM sequence: TTC
tcaatgctattattatcacc

SEQ ID NO: 102878 - DNA, 20 bp, Artificial Sequence
  Description of Artificial Sequence: Synthetic oligonucleotide
  Target: SCN9A; (+) strand; PAM type: YTN; PAM sequence: CTC
aatgctattattatcaccta

SEQ ID NO: 102879 - DNA, 20 bp, Artificial Sequence
  Description of Artificial Sequence: Synthetic oligonucleotide
  Target: SCN9A; (+) strand; PAM type: YTN; PAM sequence: CTA
ttattatcacctagtataca

SEQ ID NO: 102880 - DNA, 20 bp, Artificial Sequence
  Description of Artificial Sequence: Synthetic oligonucleotide
  Target: SCN9A; (+) strand; PAM type: YTN; PAM sequence: TTA
ttatcacctagtatacaaca

SEQ ID NO: 102881 - DNA, 20 bp, Artificial Sequence
  Description of Artificial Sequence: Synthetic oligonucleotide
  Target: SCN9A; (+) strand; PAM type: YTN; PAM sequence: TTA
tcacctagtatacaacatca

SEQ ID NO: 102882 - DNA, 20 bp, Artificial Sequence
  Description of Artificial Sequence: Synthetic oligonucleotide
  Target: SCN9A; (+) strand; PAM type: YTN; PAM sequence: CTA
gtatacaacatcataaaaat

SEQ ID NO: 102883 - DNA, 20 bp, Artificial Sequence
  Description of Artificial Sequence: Synthetic oligonucleotide
  Target: SCN9A; (+) strand; PAM type: YTN; PAM sequence: TTG
tacataaggaatgatgtaag

SEQ ID NO: 102884 - DNA, 20 bp, Artificial Sequence
  Description of Artificial Sequence: Synthetic oligonucleotide
  Target: SCN9A; (+) strand; PAM type: YTN; PAM sequence: CTT
tcttataactggagtaaata

SEQ ID NO: 102885 - DNA, 20 bp, Artificial Sequence
  Description of Artificial Sequence: Synthetic oligonucleotide
  Target: SCN9A; (+) strand; PAM type: YTN; PAM sequence: TTT
cttataactggagtaaataa

SEQ ID NO: 102886 - DNA, 20 bp, Artificial Sequence
  Description of Artificial Sequence: Synthetic oligonucleotide
  Target: SCN9A; (+) strand; PAM type: YTN; PAM sequence: TTC
ttataactggagtaaataat

SEQ ID NO: 102887 - DNA, 20 bp, Artificial Sequence
  Description of Artificial Sequence: Synthetic oligonucleotide
  Target: SCN9A; (+) strand; PAM type: YTN; PAM sequence: CTT
ataactggagtaaataatta

SEQ ID NO: 102888 - DNA, 20 bp, Artificial Sequence
  Description of Artificial Sequence: Synthetic oligonucleotide
  Target: SCN9A; (+) strand; PAM type: YTN; PAM sequence: TTA
taactggagtaaataattat

SEQ ID NO: 102889 - DNA, 20 bp, Artificial Sequence
  Description of Artificial Sequence: Synthetic oligonucleotide
  Target: SCN9A; (+) strand; PAM type: YTN; PAM sequence: CTG
gagtaaataattatgaacaa

SEQ ID NO: 102890 - DNA, 20 bp, Artificial Sequence
  Description of Artificial Sequence: Synthetic oligonucleotide
  Target: SCN9A; (+) strand; PAM type: YTN; PAM sequence: TTA
tgaacaacctattaagagaa

SEQ ID NO: 102891 - DNA, 20 bp, Artificial Sequence
  Description of Artificial Sequence: Synthetic oligonucleotide
  Target: SCN9A; (+) strand; PAM type: YTN; PAM sequence: CTA
ttaagagaactcctccaatc

SEQ ID NO: 102892 - DNA, 20 bp, Artificial Sequence
  Description of Artificial Sequence: Synthetic oligonucleotide
  Target: SCN9A; (+) strand; PAM type: YTN; PAM sequence: TTA
agagaactcctccaatctat

SEQ ID NO: 102893 - DNA, 20 bp, Artificial Sequence
  Description of Artificial Sequence: Synthetic oligonucleotide
  Target: SCN9A; (+) strand; PAM type: YTN; PAM sequence: CTC
ctccaatctatgttggccta

SEQ ID NO: 102894 - DNA, 20 bp, Artificial Sequence
  Description of Artificial Sequence: Synthetic oligonucleotide
  Target: SCN9A; (+) strand; PAM type: YTN; PAM sequence: CTC
caatctatgttggcctagag

SEQ ID NO: 102895 - DNA, 20 bp, Artificial Sequence
  Description of Artificial Sequence: Synthetic oligonucleotide
  Target: SCN9A; (+) strand; PAM type: YTN; PAM sequence: CTA
tgttggcctagaggcattat

SEQ ID NO: 102896 - DNA, 20 bp, Artificial Sequence
  Description of Artificial Sequence: Synthetic oligonucleotide
  Target: SCN9A; (+) strand; PAM type: YTN; PAM sequence: TTG
gcctagaggcattattccca

SEQ ID NO: 102897 - DNA, 20 bp, Artificial Sequence
  Description of Artificial Sequence: Synthetic oligonucleotide
  Target: SCN9A; (+) strand; PAM type: YTN; PAM sequence: CTA
gaggcattattcccaccagg

SEQ ID NO: 102898 - DNA, 20 bp, Artificial Sequence
  Description of Artificial Sequence: Synthetic oligonucleotide
  Target: SCN9A; (+) strand; PAM type: YTN; PAM sequence: TTA
ttcccaccaggtccaggagt

SEQ ID NO: 102899 - DNA, 20 bp, Artificial Sequence
  Description of Artificial Sequence: Synthetic oligonucleotide
  Target: SCN9A; (+) strand; PAM type: YTN; PAM sequence: TTC
ccaccaggtccaggagtttg

SEQ ID NO: 102900 - DNA, 20 bp, Artificial Sequence
  Description of Artificial Sequence: Synthetic oligonucleotide
  Target: SCN9A; (+) strand; PAM type: YTN; PAM sequence: TTT
gataacagtttcagttatga

SEQ ID NO: 102901 - DNA, 20 bp, Artificial Sequence
  Description of Artificial Sequence: Synthetic oligonucleotide
  Target: SCN9A; (+) strand; PAM type: YTN; PAM sequence: TTG
ataacagtttcagttatgaa

SEQ ID NO: 102902 - DNA, 20 bp, Artificial Sequence
  Description of Artificial Sequence: Synthetic oligonucleotide
  Target: SCN9A; (+) strand; PAM type: YTN; PAM sequence: TTT
cagttatgaaagtatcagta

SEQ ID NO: 102903 - DNA, 20 bp, Artificial Sequence
  Description of Artificial Sequence: Synthetic oligonucleotide
  Target: SCN9A; (+) strand; PAM type: YTN; PAM sequence: TTC
agttatgaaagtatcagtac

SEQ ID NO: 102904 - DNA, 20 bp, Artificial Sequence
  Description of Artificial Sequence: Synthetic oligonucleotide
  Target: SCN9A; (+) strand; PAM type: YTN; PAM sequence: TTA
tgaaagtatcagtacaaaat

SEQ ID NO: 102905 - DNA, 20 bp, Artificial Sequence
  Description of Artificial Sequence: Synthetic oligonucleotide
  Target: SCN9A; (+) strand; PAM type: YTN; PAM sequence: TTT
cactcaaaaacatgttattt

SEQ ID NO: 102906 - DNA, 20 bp, Artificial Sequence
  Description of Artificial Sequence: Synthetic oligonucleotide
  Target: SCN9A; (+) strand; PAM type: YTN; PAM sequence: TTC
actcaaaaacatgttattta

SEQ ID NO: 102907 - DNA, 20 bp, Artificial Sequence
  Description of Artificial Sequence: Synthetic oligonucleotide
  Target: SCN9A; (+) strand; PAM type: YTN; PAM sequence: CTC
aaaaacatgttatttaaact

SEQ ID NO: 102908 - DNA, 20 bp, Artificial Sequence
  Description of Artificial Sequence: Synthetic oligonucleotide
  Target: SCN9A; (+) strand; PAM type: YTN; PAM sequence: TTA
tttaaactgattgaattcat

SEQ ID NO: 102909 - DNA, 20 bp, Artificial Sequence
  Description of Artificial Sequence: Synthetic oligonucleotide
  Target: SCN9A; (+) strand; PAM type: YTN; PAM sequence: TTT
aaactgattgaattcatcta

SEQ ID NO: 102910 - DNA, 20 bp, Artificial Sequence
  Description of Artificial Sequence: Synthetic oligonucleotide
  Target: SCN9A; (+) strand; PAM type: YTN; PAM sequence: TTA
aactgattgaattcatctaa

SEQ ID NO: 102911 - DNA, 20 bp, Artificial Sequence
  Description of Artificial Sequence: Synthetic oligonucleotide
  Target: SCN9A; (+) strand; PAM type: YTN; PAM sequence: CTG
attgaattcatctaaattag

SEQ ID NO: 102912 - DNA, 20 bp, Artificial Sequence
  Description of Artificial Sequence: Synthetic oligonucleotide
  Target: SCN9A; (+) strand; PAM type: YTN; PAM sequence: TTG
aattcatctaaattagttta

SEQ ID NO: 102913 - DNA, 20 bp, Artificial Sequence
  Description of Artificial Sequence: Synthetic oligonucleotide
  Target: SCN9A; (+) strand; PAM type: YTN; PAM sequence: TTC
atctaaattagtttaattta

SEQ ID NO: 102914 - DNA, 20 bp, Artificial Sequence
  Description of Artificial Sequence: Synthetic oligonucleotide
  Target: SCN9A; (+) strand; PAM type: YTN; PAM sequence: CTA
aattagtttaatttaaaata

SEQ ID NO: 102915 - DNA, 20 bp, Artificial Sequence
  Description of Artificial Sequence: Synthetic oligonucleotide
  Target: SCN9A; (+) strand; PAM type: YTN; PAM sequence: TTA
gtttaatttaaaataagata

SEQ ID NO: 102916 - DNA, 20 bp, Artificial Sequence
  Description of Artificial Sequence: Synthetic oligonucleotide
  Target: SCN9A; (+) strand; PAM type: YTN; PAM sequence: TTT
aatttaaaataagataatag

SEQ ID NO: 102917 - DNA, 20 bp, Artificial Sequence
  Description of Artificial Sequence: Synthetic oligonucleotide
  Target: SCN9A; (+) strand; PAM type: YTN; PAM sequence: TTA
atttaaaataagataataga

SEQ ID NO: 102918 - DNA, 20 bp, Artificial Sequence
  Description of Artificial Sequence: Synthetic oligonucleotide
  Target: SCN9A; (+) strand; PAM type: YTN; PAM sequence: TTT
aaaataagataatagaaatt

SEQ ID NO: 102919 - DNA, 20 bp, Artificial Sequence
  Description of Artificial Sequence: Synthetic oligonucleotide
  Target: SCN9A; (+) strand; PAM type: YTN; PAM sequence: TTA
aaataagataatagaaatta

SEQ ID NO: 102920 - DNA, 20 bp, Artificial Sequence
  Description of Artificial Sequence: Synthetic oligonucleotide
  Target: SCN9A; (+) strand; PAM type: YTN; PAM sequence: TTA
attataactgaatattctat

SEQ ID NO: 102921 - DNA, 20 bp, Artificial Sequence
  Description of Artificial Sequence: Synthetic oligonucleotide
  Target: SCN9A; (+) strand; PAM type: YTN; PAM sequence: TTA
taactgaatattctataaaa

SEQ ID NO: 102922 - DNA, 20 bp, Artificial Sequence
  Description of Artificial Sequence: Synthetic oligonucleotide
  Target: SCN9A; (+) strand; PAM type: YTN; PAM sequence: CTG
aatattctataaaactatag

SEQ ID NO: 102923 - DNA, 20 bp, Artificial Sequence
  Description of Artificial Sequence: Synthetic oligonucleotide
  Target: SCN9A; (+) strand; PAM type: YTN; PAM sequence: TTC
tataaaactatagaataggc

SEQ ID NO: 102924 - DNA, 20 bp, Artificial Sequence
  Description of Artificial Sequence: Synthetic oligonucleotide
  Target: SCN9A; (+) strand; PAM type: YTN; PAM sequence: CTA
taaaactatagaataggctt

SEQ ID NO: 102925 - DNA, 20 bp, Artificial Sequence
  Description of Artificial Sequence: Synthetic oligonucleotide
  Target: SCN9A; (+) strand; PAM type: YTN; PAM sequence: CTA
tagaataggctttaaagtat

SEQ ID NO: 102926 - DNA, 20 bp, Artificial Sequence
  Description of Artificial Sequence: Synthetic oligonucleotide
  Target: SCN9A; (+) strand; PAM type: YTN; PAM sequence: CTT
taaagtataaactatagaat

SEQ ID NO: 102927 - DNA, 20 bp, Artificial Sequence
  Description of Artificial Sequence: Synthetic oligonucleotide
  Target: SCN9A; (+) strand; PAM type: YTN; PAM sequence: TTT
aaagtataaactatagaatg

SEQ ID NO: 102928 - DNA, 20 bp, Artificial Sequence
  Description of Artificial Sequence: Synthetic oligonucleotide
  Target: SCN9A; (+) strand; PAM type: YTN; PAM sequence: TTA
aagtataaactatagaatga

SEQ ID NO: 102929 - DNA, 20 bp, Artificial Sequence
  Description of Artificial Sequence: Synthetic oligonucleotide
  Target: SCN9A; (+) strand; PAM type: YTN; PAM sequence: CTA
tagaatgagttttaaaatat

SEQ ID NO: 102930 - DNA, 20 bp, Artificial Sequence
  Description of Artificial Sequence: Synthetic oligonucleotide
  Target: SCN9A; (+) strand; PAM type: YTN; PAM sequence: TTT
taaaatatataagttttaaa

SEQ ID NO: 102931 - DNA, 20 bp, Artificial Sequence
  Description of Artificial Sequence: Synthetic oligonucleotide
  Target: SCN9A; (+) strand; PAM type: YTN; PAM sequence: TTT
aaaatatataagttttaaaa

SEQ ID NO: 102932 - DNA, 20 bp, Artificial Sequence
  Description of Artificial Sequence: Synthetic oligonucleotide
  Target: SCN9A; (+) strand; PAM type: YTN; PAM sequence: TTA
aaatatataagttttaaaat

SEQ ID NO: 102933 - DNA, 20 bp, Artificial Sequence
  Description of Artificial Sequence: Synthetic oligonucleotide
  Target: SCN9A; (+) strand; PAM type: YTN; PAM sequence: TTT
taaaatacagattaatccag

SEQ ID NO: 102934 - DNA, 20 bp, Artificial Sequence
  Description of Artificial Sequence: Synthetic oligonucleotide
  Target: SCN9A; (+) strand; PAM type: YTN; PAM sequence: TTT
aaaatacagattaatccagg

SEQ ID NO: 102935 - DNA, 20 bp, Artificial Sequence
  Description of Artificial Sequence: Synthetic oligonucleotide
  Target: SCN9A; (+) strand; PAM type: YTN; PAM sequence: TTA
aaatacagattaatccagga

SEQ ID NO: 102936 - DNA, 20 bp, Artificial Sequence
  Description of Artificial Sequence: Synthetic oligonucleotide
  Target: SCN9A; (+) strand; PAM type: YTN; PAM sequence: TTA
atccaggaaacgatgttgga

SEQ ID NO: 102937 - DNA, 20 bp, Artificial Sequence
  Description of Artificial Sequence: Synthetic oligonucleotide
  Target: SCN9A; (+) strand; PAM type: YTN; PAM sequence: TTG
gataaacttataattactaa

SEQ ID NO: 102938 - DNA, 20 bp, Artificial Sequence
  Description of Artificial Sequence: Synthetic oligonucleotide
  Target: SCN9A; (+) strand; PAM type: YTN; PAM sequence: CTT
ataattactaatatgtattt

SEQ ID NO: 102939 - DNA, 20 bp, Artificial Sequence
  Description of Artificial Sequence: Synthetic oligonucleotide
  Target: SCN9A; (+) strand; PAM type: YTN; PAM sequence: TTA
taattactaatatgtatttt

SEQ ID NO: 102940 - DNA, 20 bp, Artificial Sequence
  Description of Artificial Sequence: Synthetic oligonucleotide
  Target: SCN9A; (+) strand; PAM type: YTN; PAM sequence: TTA
ctaatatgtattttgtgcca

SEQ ID NO: 102941 - DNA, 20 bp, Artificial Sequence
  Description of Artificial Sequence: Synthetic oligonucleotide
  Target: SCN9A; (+) strand; PAM type: YTN; PAM sequence: CTA
atatgtattttgtgccaatt

SEQ ID NO: 102942 - DNA, 20 bp, Artificial Sequence
  Description of Artificial Sequence: Synthetic oligonucleotide
  Target: SCN9A; (+) strand; PAM type: YTN; PAM sequence: TTT
tgtgccaattgccacaaaat

SEQ ID NO: 102943 - DNA, 20 bp, Artificial Sequence
  Description of Artificial Sequence: Synthetic oligonucleotide
  Target: SCN9A; (+) strand; PAM type: YTN; PAM sequence: TTT
gtgccaattgccacaaaatc

SEQ ID NO: 102944 - DNA, 20 bp, Artificial Sequence
  Description of Artificial Sequence: Synthetic oligonucleotide
  Target: SCN9A; (+) strand; PAM type: YTN; PAM sequence: TTG
tgccaattgccacaaaatcc

SEQ ID NO: 102945 - DNA, 20 bp, Artificial Sequence
  Description of Artificial Sequence: Synthetic oligonucleotide
  Target: SCN9A; (+) strand; PAM type: YTN; PAM sequence: TTG
ccacaaaatccaaagtacca

SEQ ID NO: 102946 - DNA, 20 bp, Artificial Sequence
  Description of Artificial Sequence: Synthetic oligonucleotide
  Target: SCN9A; (+) strand; PAM type: YTN; PAM sequence: TTT
agaagactacagttttaatg

SEQ ID NO: 102947 - DNA, 20 bp, Artificial Sequence
  Description of Artificial Sequence: Synthetic oligonucleotide
  Target: SCN9A; (+) strand; PAM type: YTN; PAM sequence: TTA
gaagactacagttttaatgg

SEQ ID NO: 102948 - DNA, 20 bp, Artificial Sequence
  Description of Artificial Sequence: Synthetic oligonucleotide
  Target: SCN9A; (+) strand; PAM type: YTN; PAM sequence: CTA
cagttttaatggcttcaatt

SEQ ID NO: 102949 - DNA, 20 bp, Artificial Sequence
  Description of Artificial Sequence: Synthetic oligonucleotide
  Target: SCN9A; (+) strand; PAM type: YTN; PAM sequence: TTT
taatggcttcaattcctgac

SEQ ID NO: 102950 - DNA, 20 bp, Artificial Sequence
  Description of Artificial Sequence: Synthetic oligonucleotide
  Target: SCN9A; (+) strand; PAM type: YTN; PAM sequence: TTT
aatggcttcaattcctgacc

SEQ ID NO: 102951 - DNA, 20 bp, Artificial Sequence
  Description of Artificial Sequence: Synthetic oligonucleotide
  Target: SCN9A; (+) strand; PAM type: YTN; PAM sequence: TTA
atggcttcaattcctgacct

SEQ ID NO: 102952 - DNA, 20 bp, Artificial Sequence
  Description of Artificial Sequence: Synthetic oligonucleotide
  Target: SCN9A; (+) strand; PAM type: YTN; PAM sequence: CTT
caattcctgacctctcggct

SEQ ID NO: 102953 - DNA, 20 bp, Artificial Sequence
  Description of Artificial Sequence: Synthetic oligonucleotide
  Target: SCN9A; (+) strand; PAM type: YTN; PAM sequence: TTC
aattcctgacctctcggctg

SEQ ID NO: 102954 - DNA, 20 bp, Artificial Sequence
  Description of Artificial Sequence: Synthetic oligonucleotide
  Target: SCN9A; (+) strand; PAM type: YTN; PAM sequence: TTC
ctgacctctcggctgcacgt

SEQ ID NO: 102955 - DNA, 20 bp, Artificial Sequence
  Description of Artificial Sequence: Synthetic oligonucleotide
  Target: SCN9A; (+) strand; PAM type: YTN; PAM sequence: CTG
acctctcggctgcacgtgaa

SEQ ID NO: 102956 - DNA, 20 bp, Artificial Sequence
  Description of Artificial Sequence: Synthetic oligonucleotide
  Target: SCN9A; (+) strand; PAM type: YTN; PAM sequence: CTC
tcggctgcacgtgaactatc

SEQ ID NO: 102957 - DNA, 20 bp, Artificial Sequence
  Description of Artificial Sequence: Synthetic oligonucleotide
  Target: SCN9A; (+) strand; PAM type: YTN; PAM sequence: CTC
ggctgcacgtgaactatcac

SEQ ID NO: 102958 - DNA, 20 bp, Artificial Sequence
  Description of Artificial Sequence: Synthetic oligonucleotide
  Target: SCN9A; (+) strand; PAM type: YTN; PAM sequence: CTG
cacgtgaactatcaccagag

SEQ ID NO: 102959 - DNA, 20 bp, Artificial Sequence
  Description of Artificial Sequence: Synthetic oligonucleotide
  Target: SCN9A; (+) strand; PAM type: YTN; PAM sequence: CTA
tcaccagagaagtgaaagac

SEQ ID NO: 102960 - DNA, 20 bp, Artificial Sequence
  Description of Artificial Sequence: Synthetic oligonucleotide
  Target: SCN9A; (+) strand; PAM type: YTN; PAM sequence: CTA
ttattctgtgaagttaagac

SEQ ID NO: 102961 - DNA, 20 bp, Artificial Sequence
  Description of Artificial Sequence: Synthetic oligonucleotide
  Target: SCN9A; (+) strand; PAM type: YTN; PAM sequence: TTA
ttctgtgaagttaagaccag

SEQ ID NO: 102962 - DNA, 20 bp, Artificial Sequence
  Description of Artificial Sequence: Synthetic oligonucleotide
  Target: SCN9A; (+) strand; PAM type: YTN; PAM sequence: TTC
tgtgaagttaagaccaggcc

SEQ ID NO: 102963 - DNA, 20 bp, Artificial Sequence
  Description of Artificial Sequence: Synthetic oligonucleotide
  Target: SCN9A; (+) strand; PAM type: YTN; PAM sequence: CTG
tgaagttaagaccaggccct

SEQ ID NO: 102964 - DNA, 20 bp, Artificial Sequence
  Description of Artificial Sequence: Synthetic oligonucleotide
  Target: SCN9A; (+) strand; PAM type: YTN; PAM sequence: TTA
agaccaggcccttcatttct

SEQ ID NO: 102965 - DNA, 20 bp, Artificial Sequence
  Description of Artificial Sequence: Synthetic oligonucleotide
  Target: SCN9A; (+) strand; PAM type: YTN; PAM sequence: CTT
catttctgaaaaaagaatta

SEQ ID NO: 102966 - DNA, 20 bp, Artificial Sequence
  Description of Artificial Sequence: Synthetic oligonucleotide
  Target: SCN9A; (+) strand; PAM type: YTN; PAM sequence: TTC
atttctgaaaaaagaattat

SEQ ID NO: 102967 - DNA, 20 bp, Artificial Sequence
  Description of Artificial Sequence: Synthetic oligonucleotide
  Target: SCN9A; (+) strand; PAM type: YTN; PAM sequence: TTT
ctgaaaaaagaattattggc

SEQ ID NO: 102968 - DNA, 20 bp, Artificial Sequence
  Description of Artificial Sequence: Synthetic oligonucleotide
  Target: SCN9A; (+) strand; PAM type: YTN; PAM sequence: TTC
tgaaaaaagaattattggcc

SEQ ID NO: 102969 - DNA, 20 bp, Artificial Sequence
  Description of Artificial Sequence: Synthetic oligonucleotide
  Target: SCN9A; (+) strand; PAM type: YTN; PAM sequence: CTG
aaaaaagaattattggcctg

SEQ ID NO: 102970 - DNA, 20 bp, Artificial Sequence
  Description of Artificial Sequence: Synthetic oligonucleotide
  Target: SCN9A; (+) strand; PAM type: YTN; PAM sequence: TTA
ttggcctgggttttgaggta

SEQ ID NO: 102971 - DNA, 20 bp, Artificial Sequence
  Description of Artificial Sequence: Synthetic oligonucleotide
  Target: SCN9A; (+) strand; PAM type: YTN; PAM sequence: TTG
gcctgggttttgaggtaaag

SEQ ID NO: 102972 - DNA, 20 bp, Artificial Sequence
  Description of Artificial Sequence: Synthetic oligonucleotide
  Target: SCN9A; (+) strand; PAM type: YTN; PAM sequence: CTG
ggttttgaggtaaagcagtg

SEQ ID NO: 102973 - DNA, 20 bp, Artificial Sequence
  Description of Artificial Sequence: Synthetic oligonucleotide
  Target: SCN9A; (+) strand; PAM type: YTN; PAM sequence: TTT
tgaggtaaagcagtgagagg

SEQ ID NO: 102974 - DNA, 20 bp, Artificial Sequence
  Description of Artificial Sequence: Synthetic oligonucleotide
  Target: SCN9A; (+) strand; PAM type: YTN; PAM sequence: TTT
gaggtaaagcagtgagagga

SEQ ID NO: 102975 - DNA, 20 bp, Artificial Sequence
  Description of Artificial Sequence: Synthetic oligonucleotide
  Target: SCN9A; (+) strand; PAM type: YTN; PAM sequence: TTG
aggtaaagcagtgagaggaa

SEQ ID NO: 102976 - DNA, 20 bp, Artificial Sequence
  Description of Artificial Sequence: Synthetic oligonucleotide
  Target: SCN9A; (+) strand; PAM type: YTN; PAM sequence: TTG
ctgatagaaagaatacaaag

SEQ ID NO: 102977 - DNA, 20 bp, Artificial Sequence
  Description of Artificial Sequence: Synthetic oligonucleotide
  Target: SCN9A; (+) strand; PAM type: YTN; PAM sequence: CTG
atagaaagaatacaaagcac

SEQ ID NO: 102978 - DNA, 20 bp, Artificial Sequence
  Description of Artificial Sequence: Synthetic oligonucleotide
  Target: SCN9A; (+) strand; PAM type: YTN; PAM sequence: CTG
ctattagacacaatattaac

SEQ ID NO: 102979 - DNA, 20 bp, Artificial Sequence
  Description of Artificial Sequence: Synthetic oligonucleotide
  Target: SCN9A; (+) strand; PAM type: YTN; PAM sequence: CTA
ttagacacaatattaacaat

SEQ ID NO: 102980 - DNA, 20 bp, Artificial Sequence
  Description of Artificial Sequence: Synthetic oligonucleotide
  Target: SCN9A; (+) strand; PAM type: YTN; PAM sequence: TTA
gacacaatattaacaatagg

SEQ ID NO: 102981 - DNA, 20 bp, Artificial Sequence
  Description of Artificial Sequence: Synthetic oligonucleotide
  Target: SCN9A; (+) strand; PAM type: YTN; PAM sequence: TTA
acaataggaaatagttataa

SEQ ID NO: 102982 - DNA, 20 bp, Artificial Sequence
  Description of Artificial Sequence: Synthetic oligonucleotide
  Target: SCN9A; (+) strand; PAM type: YTN; PAM sequence: TTA
taatggtttttctctgagct

SEQ ID NO: 102983 - DNA, 20 bp, Artificial Sequence
  Description of Artificial Sequence: Synthetic oligonucleotide
  Target: SCN9A; (+) strand; PAM type: YTN; PAM sequence: TTT
ttctctgagctggtaacaac

SEQ ID NO: 102984 - DNA, 20 bp, Artificial Sequence
  Description of Artificial Sequence: Synthetic oligonucleotide
  Target: SCN9A; (+) strand; PAM type: YTN; PAM sequence: TTT
tctctgagctggtaacaact

SEQ ID NO: 102985 - DNA, 20 bp, Artificial Sequence
  Description of Artificial Sequence: Synthetic oligonucleotide
  Target: SCN9A; (+) strand; PAM type: YTN; PAM sequence: TTT
ctctgagctggtaacaactt

SEQ ID NO: 102986 - DNA, 20 bp, Artificial Sequence
  Description of Artificial Sequence: Synthetic oligonucleotide
  Target: SCN9A; (+) strand; PAM type: YTN; PAM sequence: TTC
tctgagctggtaacaacttt

SEQ ID NO: 102987 - DNA, 20 bp, Artificial Sequence
  Description of Artificial Sequence: Synthetic oligonucleotide
  Target: SCN9A; (+) strand; PAM type: YTN; PAM sequence: CTC
tgagctggtaacaactttta

SEQ ID NO: 102988 - DNA, 20 bp, Artificial Sequence
  Description of Artificial Sequence: Synthetic oligonucleotide
  Target: SCN9A; (+) strand; PAM type: YTN; PAM sequence: CTG
agctggtaacaacttttaaa

SEQ ID NO: 102989 - DNA, 20 bp, Artificial Sequence
  Description of Artificial Sequence: Synthetic oligonucleotide
  Target: SCN9A; (+) strand; PAM type: YTN; PAM sequence: CTG
gtaacaacttttaaataaaa

SEQ ID NO: 102990 - DNA, 20 bp, Artificial Sequence
  Description of Artificial Sequence: Synthetic oligonucleotide
  Target: SCN9A; (+) strand; PAM type: YTN; PAM sequence: CTT
ttaaataaaatgattcttat

SEQ ID NO: 102991 - DNA, 20 bp, Artificial Sequence
  Description of Artificial Sequence: Synthetic oligonucleotide
  Target: SCN9A; (+) strand; PAM type: YTN; PAM sequence: TTT
taaataaaatgattcttatt

SEQ ID NO: 102992 - DNA, 20 bp, Artificial Sequence
  Description of Artificial Sequence: Synthetic oligonucleotide
  Target: SCN9A; (+) strand; PAM type: YTN; PAM sequence: TTT
aaataaaatgattcttattt

SEQ ID NO: 102993 - DNA, 20 bp, Artificial Sequence
  Description of Artificial Sequence: Synthetic oligonucleotide
  Target: SCN9A; (+) strand; PAM type: YTN; PAM sequence: TTA
aataaaatgattcttatttg

SEQ ID NO: 102994 - DNA, 20 bp, Artificial Sequence
  Description of Artificial Sequence: Synthetic oligonucleotide
  Target: SCN9A; (+) strand; PAM type: YTN; PAM sequence: TTC
ttatttgcagaattctgact

SEQ ID NO: 102995 - DNA, 20 bp, Artificial Sequence
  Description of Artificial Sequence: Synthetic oligonucleotide
  Target: SCN9A; (+) strand; PAM type: YTN; PAM sequence: CTT
atttgcagaattctgacttt

SEQ ID NO: 102996 - DNA, 20 bp, Artificial Sequence
  Description of Artificial Sequence: Synthetic oligonucleotide
  Target: SCN9A; (+) strand; PAM type: YTN; PAM sequence: TTA
tttgcagaattctgacttta

SEQ ID NO: 102997 - DNA, 20 bp, Artificial Sequence
  Description of Artificial Sequence: Synthetic oligonucleotide
  Target: SCN9A; (+) strand; PAM type: YTN; PAM sequence: TTT
gcagaattctgactttagct

SEQ ID NO: 102998 - DNA, 20 bp, Artificial Sequence
  Description of Artificial Sequence: Synthetic oligonucleotide
  Target: SCN9A; (+) strand; PAM type: YTN; PAM sequence: TTG
cagaattctgactttagcta

SEQ ID NO: 102999 - DNA, 20 bp, Artificial Sequence
  Description of Artificial Sequence: Synthetic oligonucleotide
  Target: SCN9A; (+) strand; PAM type: YTN; PAM sequence: TTC
tgactttagctaaattcatg

SEQ ID NO: 103000 - DNA, 20 bp, Artificial Sequence
  Description of Artificial Sequence: Synthetic oligonucleotide
  Target: SCN9A; (+) strand; PAM type: YTN; PAM sequence: CTG
actttagctaaattcatgaa

SEQ ID NO: 103001 - DNA, 20 bp, Artificial Sequence
  Description of Artificial Sequence: Synthetic oligonucleotide
  Target: SCN9A; (+) strand; PAM type: YTN; PAM sequence: CTT
tagctaaattcatgaaagca

SEQ ID NO: 103002 - DNA, 20 bp, Artificial Sequence
  Description of Artificial Sequence: Synthetic oligonucleotide
  Target: SCN9A; (+) strand; PAM type: YTN; PAM sequence: TTT
agctaaattcatgaaagcat

SEQ ID NO: 103003 - DNA, 20 bp, Artificial Sequence
  Description of Artificial Sequence: Synthetic oligonucleotide
  Target: SCN9A; (+) strand; PAM type: YTN; PAM sequence: TTA
gctaaattcatgaaagcatc

SEQ ID NO: 103004 - DNA, 20 bp, Artificial Sequence
  Description of Artificial Sequence: Synthetic oligonucleotide
  Target: SCN9A; (+) strand; PAM type: YTN; PAM sequence: CTA
aattcatgaaagcatcttca

SEQ ID NO: 103005 - DNA, 20 bp, Artificial Sequence
  Description of Artificial Sequence: Synthetic oligonucleotide
  Target: SCN9A; (+) strand; PAM type: YTN; PAM sequence: TTC
atgaaagcatcttcaaacat

SEQ ID NO: 103006 - DNA, 20 bp, Artificial Sequence
  Description of Artificial Sequence: Synthetic oligonucleotide
  Target: SCN9A; (+) strand; PAM type: YTN; PAM sequence: CTT
caaacatcaataattggttt

SEQ ID NO: 103007 - DNA, 20 bp, Artificial Sequence
  Description of Artificial Sequence: Synthetic oligonucleotide
  Target: SCN9A; (+) strand; PAM type: YTN; PAM sequence: TTC
aaacatcaataattggtttt

SEQ ID NO: 103008 - DNA, 20 bp, Artificial Sequence
  Description of Artificial Sequence: Synthetic oligonucleotide
  Target: SCN9A; (+) strand; PAM type: YTN; PAM sequence: TTG
gttttctcactgtttaagag

SEQ ID NO: 103009 - DNA, 20 bp, Artificial Sequence
  Description of Artificial Sequence: Synthetic oligonucleotide
  Target: SCN9A; (+) strand; PAM type: YTN; PAM sequence: TTT
tctcactgtttaagagagca

SEQ ID NO: 103010 - DNA, 20 bp, Artificial Sequence
  Description of Artificial Sequence: Synthetic oligonucleotide
  Target: SCN9A; (+) strand; PAM type: YTN; PAM sequence: TTT
ctcactgtttaagagagcat

SEQ ID NO: 103011 - DNA, 20 bp, Artificial Sequence
  Description of Artificial Sequence: Synthetic oligonucleotide
  Target: SCN9A; (+) strand; PAM type: YTN; PAM sequence: TTC
tcactgtttaagagagcatt

SEQ ID NO: 103012 - DNA, 20 bp, Artificial Sequence
  Description of Artificial Sequence: Synthetic oligonucleotide
  Target: SCN9A; (+) strand; PAM type: YTN; PAM sequence: CTC
actgtttaagagagcattaa

SEQ ID NO: 103013 - DNA, 20 bp, Artificial Sequence
  Description of Artificial Sequence: Synthetic oligonucleotide
  Target: SCN9A; (+) strand; PAM type: YTN; PAM sequence: CTG
tttaagagagcattaacaaa

SEQ ID NO: 103014 - DNA, 20 bp, Artificial Sequence
  Description of Artificial Sequence: Synthetic oligonucleotide
  Target: SCN9A; (+) strand; PAM type: YTN; PAM sequence: TTT
aagagagcattaacaaagat

SEQ ID NO: 103015 - DNA, 20 bp, Artificial Sequence
  Description of Artificial Sequence: Synthetic oligonucleotide
  Target: SCN9A; (+) strand; PAM type: YTN; PAM sequence: TTA
agagagcattaacaaagatt

SEQ ID NO: 103016 - DNA, 20 bp, Artificial Sequence
  Description of Artificial Sequence: Synthetic oligonucleotide
  Target: SCN9A; (+) strand; PAM type: YTN; PAM sequence: TTA
acaaagatttatgccaaatt

SEQ ID NO: 103017 - DNA, 20 bp, Artificial Sequence
  Description of Artificial Sequence: Synthetic oligonucleotide
  Target: SCN9A; (+) strand; PAM type: YTN; PAM sequence: TTT
atgccaaattagattatgag

SEQ ID NO: 103018 - DNA, 20 bp, Artificial Sequence
  Description of Artificial Sequence: Synthetic oligonucleotide
  Target: SCN9A; (+) strand; PAM type: YTN; PAM sequence: TTA
tgccaaattagattatgagc

SEQ ID NO: 103019 - DNA, 20 bp, Artificial Sequence
  Description of Artificial Sequence: Synthetic oligonucleotide
  Target: SCN9A; (+) strand; PAM type: YTN; PAM sequence: TTA
gattatgagcaagtaaaaat

SEQ ID NO: 103020 - DNA, 20 bp, Artificial Sequence
  Description of Artificial Sequence: Synthetic oligonucleotide
  Target: SCN9A; (+) strand; PAM type: YTN; PAM sequence: TTA
tgagcaagtaaaaattcacg

SEQ ID NO: 103021 - DNA, 20 bp, Artificial Sequence
  Description of Artificial Sequence: Synthetic oligonucleotide
  Target: SCN9A; (+) strand; PAM type: YTN; PAM sequence: TTC
acgtgattttatatagtgta

SEQ ID NO: 103022 - DNA, 20 bp, Artificial Sequence
  Description of Artificial Sequence: Synthetic oligonucleotide
  Target: SCN9A; (+) strand; PAM type: YTN; PAM sequence: TTT
tatatagtgtatcttgttgt

SEQ ID NO: 103023 - DNA, 20 bp, Artificial Sequence
  Description of Artificial Sequence: Synthetic oligonucleotide
  Target: SCN9A; (+) strand; PAM type: YTN; PAM sequence: TTT
atatagtgtatcttgttgtt

SEQ ID NO: 103024 - DNA, 20 bp, Artificial Sequence
  Description of Artificial Sequence: Synthetic oligonucleotide
  Target: SCN9A; (+) strand; PAM type: YTN; PAM sequence: TTA
tatagtgtatcttgttgttg

SEQ ID NO: 103025 - DNA, 20 bp, Artificial Sequence
  Description of Artificial Sequence: Synthetic oligonucleotide
  Target: SCN9A; (+) strand; PAM type: YTN; PAM sequence: CTT
gttgttgaaactttttttca

SEQ ID NO: 103026 - DNA, 20 bp, Artificial Sequence
  Description of Artificial Sequence: Synthetic oligonucleotide
  Target: SCN9A; (+) strand; PAM type: YTN; PAM sequence: TTG
ttgttgaaactttttttcat

SEQ ID NO: 103027 - DNA, 20 bp, Artificial Sequence
  Description of Artificial Sequence: Synthetic oligonucleotide
  Target: SCN9A; (+) strand; PAM type: YTN; PAM sequence: TTG
ttgaaactttttttcatatg

SEQ ID NO: 103028 - DNA, 20 bp, Artificial Sequence
  Description of Artificial Sequence: Synthetic oligonucleotide
  Target: SCN9A; (+) strand; PAM type: YTN; PAM sequence: TTG
aaactttttttcatatgcag

SEQ ID NO: 103029 - DNA, 20 bp, Artificial Sequence
  Description of Artificial Sequence: Synthetic oligonucleotide
  Target: SCN9A; (+) strand; PAM type: YTN; PAM sequence: CTT
tttttcatatgcaggtttta

SEQ ID NO: 103030 - DNA, 20 bp, Artificial Sequence
  Description of Artificial Sequence: Synthetic oligonucleotide
  Target: SCN9A; (+) strand; PAM type: YTN; PAM sequence: TTT
ttttcatatgcaggttttat

SEQ ID NO: 103031 - DNA, 20 bp, Artificial Sequence
  Description of Artificial Sequence: Synthetic oligonucleotide
  Target: SCN9A; (+) strand; PAM type: YTN; PAM sequence: TTT
tttcatatgcaggttttatg

SEQ ID NO: 103032 - DNA, 20 bp, Artificial Sequence
  Description of Artificial Sequence: Synthetic oligonucleotide
  Target: SCN9A; (+) strand; PAM type: YTN; PAM sequence: TTT
ttcatatgcaggttttatgt

SEQ ID NO: 103033 - DNA, 20 bp, Artificial Sequence
  Description of Artificial Sequence: Synthetic oligonucleotide
  Target: SCN9A; (+) strand; PAM type: YTN; PAM sequence: TTT
tcatatgcaggttttatgtt

SEQ ID NO: 103034 - DNA, 20 bp, Artificial Sequence
  Description of Artificial Sequence: Synthetic oligonucleotide
  Target: SCN9A; (+) strand; PAM type: YTN; PAM sequence: TTT
catatgcaggttttatgttt

SEQ ID NO: 103035 - DNA, 20 bp, Artificial Sequence
  Description of Artificial Sequence: Synthetic oligonucleotide
  Target: SCN9A; (+) strand; PAM type: YTN; PAM sequence: TTC
atatgcaggttttatgtttt

SEQ ID NO: 103036 - DNA, 20 bp, Artificial Sequence
  Description of Artificial Sequence: Synthetic oligonucleotide
  Target: SCN9A; (+) strand; PAM type: YTN; PAM sequence: TTT
tatgtttttttaatggtcaa

SEQ ID NO: 103037 - DNA, 20 bp, Artificial Sequence
  Description of Artificial Sequence: Synthetic oligonucleotide
  Target: SCN9A; (+) strand; PAM type: YTN; PAM sequence: TTT
atgtttttttaatggtcaat

SEQ ID NO: 103038 - DNA, 20 bp, Artificial Sequence
  Description of Artificial Sequence: Synthetic oligonucleotide
  Target: SCN9A; (+) strand; PAM type: YTN; PAM sequence: TTA
tgtttttttaatggtcaatt

SEQ ID NO: 103039 - DNA, 20 bp, Artificial Sequence
  Description of Artificial Sequence: Synthetic oligonucleotide
  Target: SCN9A; (+) strand; PAM type: YTN; PAM sequence: TTT
ttttaatggtcaattgaatt

SEQ ID NO: 103040 - DNA, 20 bp, Artificial Sequence
  Description of Artificial Sequence: Synthetic oligonucleotide
  Target: SCN9A; (+) strand; PAM type: YTN; PAM sequence: TTT
tttaatggtcaattgaattc

SEQ ID NO: 103041 - DNA, 20 bp, Artificial Sequence
  Description of Artificial Sequence: Synthetic oligonucleotide
  Target: SCN9A; (+) strand; PAM type: YTN; PAM sequence: TTT
ttaatggtcaattgaattca

SEQ ID NO: 103042 - DNA, 20 bp, Artificial Sequence
  Description of Artificial Sequence: Synthetic oligonucleotide
  Target: SCN9A; (+) strand; PAM type: YTN; PAM sequence: TTT
taatggtcaattgaattcag

SEQ ID NO: 103043 - DNA, 20 bp, Artificial Sequence
  Description of Artificial Sequence: Synthetic oligonucleotide
  Target: SCN9A; (+) strand; PAM type: YTN; PAM sequence: TTT
aatggtcaattgaattcagc

SEQ ID NO: 103044 - DNA, 20 bp, Artificial Sequence
  Description of Artificial Sequence: Synthetic oligonucleotide
  Target: SCN9A; (+) strand; PAM type: YTN; PAM sequence: TTA
atggtcaattgaattcagct

SEQ ID NO: 103045 - DNA, 20 bp, Artificial Sequence
  Description of Artificial Sequence: Synthetic oligonucleotide
  Target: SCN9A; (+) strand; PAM type: YTN; PAM sequence: TTG
aattcagcttggcacagaat

SEQ ID NO: 103046 - DNA, 20 bp, Artificial Sequence
  Description of Artificial Sequence: Synthetic oligonucleotide
  Target: SCN9A; (+) strand; PAM type: YTN; PAM sequence: TTC
agcttggcacagaattttac

SEQ ID NO: 103047 - DNA, 20 bp, Artificial Sequence
  Description of Artificial Sequence: Synthetic oligonucleotide
  Target: SCN9A; (+) strand; PAM type: YTN; PAM sequence: CTT
ggcacagaattttacatcat

SEQ ID NO: 103048 - DNA, 20 bp, Artificial Sequence
  Description of Artificial Sequence: Synthetic oligonucleotide
  Target: SCN9A; (+) strand; PAM type: YTN; PAM sequence: TTG
gcacagaattttacatcata

SEQ ID NO: 103049 - DNA, 20 bp, Artificial Sequence
  Description of Artificial Sequence: Synthetic oligonucleotide
  Target: SCN9A; (+) strand; PAM type: YTN; PAM sequence: TTT
tacatcataaagttattcaa

SEQ ID NO: 103050 - DNA, 20 bp, Artificial Sequence
  Description of Artificial Sequence: Synthetic oligonucleotide
  Target: SCN9A; (+) strand; PAM type: YTN; PAM sequence: TTT
acatcataaagttattcaat

SEQ ID NO: 103051 - DNA, 20 bp, Artificial Sequence
  Description of Artificial Sequence: Synthetic oligonucleotide
  Target: SCN9A; (+) strand; PAM type: YTN; PAM sequence: TTA
catcataaagttattcaata

SEQ ID NO: 103052 - DNA, 20 bp, Artificial Sequence
  Description of Artificial Sequence: Synthetic oligonucleotide
  Target: SCN9A; (+) strand; PAM type: YTN; PAM sequence: TTA
ttcaatattattgttcaatg

SEQ ID NO: 103053 - DNA, 20 bp, Artificial Sequence
  Description of Artificial Sequence: Synthetic oligonucleotide
  Target: SCN9A; (+) strand; PAM type: YTN; PAM sequence: TTC
aatattattgttcaatggga

SEQ ID NO: 103054 - DNA, 20 bp, Artificial Sequence
  Description of Artificial Sequence: Synthetic oligonucleotide
  Target: SCN9A; (+) strand; PAM type: YTN; PAM sequence: TTA
ttgttcaatgggacagaaat

SEQ ID NO: 103055 - DNA, 20 bp, Artificial Sequence
  Description of Artificial Sequence: Synthetic oligonucleotide
  Target: SCN9A; (+) strand; PAM type: YTN; PAM sequence: TTG
ttcaatgggacagaaattat

SEQ ID NO: 103056 - DNA, 20 bp, Artificial Sequence
  Description of Artificial Sequence: Synthetic oligonucleotide
  Target: SCN9A; (+) strand; PAM type: YTN; PAM sequence: TTC
aatgggacagaaattatcaa

SEQ ID NO: 103057 - DNA, 20 bp, Artificial Sequence
  Description of Artificial Sequence: Synthetic oligonucleotide
  Target: SCN9A; (+) strand; PAM type: YTN; PAM sequence: TTA
tcaaaatatttaacatgaac

SEQ ID NO: 103058 - DNA, 20 bp, Artificial Sequence
  Description of Artificial Sequence: Synthetic oligonucleotide
  Target: SCN9A; (+) strand; PAM type: YTN; PAM sequence: TTT
aacatgaactattattaatt

SEQ ID NO: 103059 - DNA, 20 bp, Artificial Sequence
  Description of Artificial Sequence: Synthetic oligonucleotide
  Target: SCN9A; (+) strand; PAM type: YTN; PAM sequence: TTA
acatgaactattattaatta

SEQ ID NO: 103060 - DNA, 20 bp, Artificial Sequence
  Description of Artificial Sequence: Synthetic oligonucleotide
  Target: SCN9A; (+) strand; PAM type: YTN; PAM sequence: CTA
ttattaattaatttgtattt

SEQ ID NO: 103061 - DNA, 20 bp, Artificial Sequence
  Description of Artificial Sequence: Synthetic oligonucleotide
  Target: SCN9A; (+) strand; PAM type: YTN; PAM sequence: TTA
ttaattaatttgtatttaca

SEQ ID NO: 103062 - DNA, 20 bp, Artificial Sequence
  Description of Artificial Sequence: Synthetic oligonucleotide
  Target: SCN9A; (+) strand; PAM type: YTN; PAM sequence: TTA
attaatttgtatttacagac

SEQ ID NO: 103063 - DNA, 20 bp, Artificial Sequence
  Description of Artificial Sequence: Synthetic oligonucleotide
  Target: SCN9A; (+) strand; PAM type: YTN; PAM sequence: TTA
atttgtatttacagacaaat

SEQ ID NO: 103064 - DNA, 20 bp, Artificial Sequence
  Description of Artificial Sequence: Synthetic oligonucleotide
  Target: SCN9A; (+) strand; PAM type: YTN; PAM sequence: TTT
gtatttacagacaaattatt

SEQ ID NO: 103065 - DNA, 20 bp, Artificial Sequence
  Description of Artificial Sequence: Synthetic oligonucleotide
  Target: SCN9A; (+) strand; PAM type: YTN; PAM sequence: TTG
tatttacagacaaattatta

SEQ ID NO: 103066 - DNA, 20 bp, Artificial Sequence
  Description of Artificial Sequence: Synthetic oligonucleotide
  Target: SCN9A; (+) strand; PAM type: YTN; PAM sequence: TTT
acagacaaattattatggct

SEQ ID NO: 103067 - DNA, 20 bp, Artificial Sequence
  Description of Artificial Sequence: Synthetic oligonucleotide
  Target: SCN9A; (+) strand; PAM type: YTN; PAM sequence: TTA
cagacaaattattatggcta

SEQ ID NO: 103068 - DNA, 20 bp, Artificial Sequence
  Description of Artificial Sequence: Synthetic oligonucleotide
  Target: SCN9A; (+) strand; PAM type: YTN; PAM sequence: TTA
ttatggctaatagattctta

SEQ ID NO: 103069 - DNA, 20 bp, Artificial Sequence
  Description of Artificial Sequence: Synthetic oligonucleotide
  Target: SCN9A; (+) strand; PAM type: YTN; PAM sequence: TTA
tggctaatagattcttagac

SEQ ID NO: 103070 - DNA, 20 bp, Artificial Sequence
  Description of Artificial Sequence: Synthetic oligonucleotide
  Target: SCN9A; (+) strand; PAM type: YTN; PAM sequence: CTA
atagattcttagacattcaa

SEQ ID NO: 103071 - DNA, 20 bp, Artificial Sequence
  Description of Artificial Sequence: Synthetic oligonucleotide
  Target: SCN9A; (+) strand; PAM type: YTN; PAM sequence: TTC
ttagacattcaatgttttct

SEQ ID NO: 103072 - DNA, 20 bp, Artificial Sequence
  Description of Artificial Sequence: Synthetic oligonucleotide
  Target: SCN9A; (+) strand; PAM type: YTN; PAM sequence: CTT
agacattcaatgttttcttg

SEQ ID NO: 103073 - DNA, 20 bp, Artificial Sequence
  Description of Artificial Sequence: Synthetic oligonucleotide
  Target: SCN9A; (+) strand; PAM type: YTN; PAM sequence: TTA
gacattcaatgttttcttgg

SEQ ID NO: 103074 - DNA, 20 bp, Artificial Sequence
  Description of Artificial Sequence: Synthetic oligonucleotide
  Target: SCN9A; (+) strand; PAM type: YTN; PAM sequence: TTC
aatgttttcttgggaatgca

SEQ ID NO: 103075 - DNA, 20 bp, Artificial Sequence
  Description of Artificial Sequence: Synthetic oligonucleotide
  Target: SCN9A; (+) strand; PAM type: YTN; PAM sequence: TTT
tcttgggaatgcattaagta

SEQ ID NO: 103076 - DNA, 20 bp, Artificial Sequence
  Description of Artificial Sequence: Synthetic oligonucleotide
  Target: SCN9A; (+) strand; PAM type: YTN; PAM sequence: TTT
cttgggaatgcattaagtat

SEQ ID NO: 103077 - DNA, 20 bp, Artificial Sequence
  Description of Artificial Sequence: Synthetic oligonucleotide
  Target: SCN9A; (+) strand; PAM type: YTN; PAM sequence: TTC
ttgggaatgcattaagtatt

SEQ ID NO: 103078 - DNA, 20 bp, Artificial Sequence
  Description of Artificial Sequence: Synthetic oligonucleotide
  Target: SCN9A; (+) strand; PAM type: YTN; PAM sequence: CTT
gggaatgcattaagtattca

SEQ ID NO: 103079 - DNA, 20 bp, Artificial Sequence
  Description of Artificial Sequence: Synthetic oligonucleotide
  Target: SCN9A; (+) strand; PAM type: YTN; PAM sequence: TTG
ggaatgcattaagtattcaa

SEQ ID NO: 103080 - DNA, 20 bp, Artificial Sequence
  Description of Artificial Sequence: Synthetic oligonucleotide
  Target: SCN9A; (+) strand; PAM type: YTN; PAM sequence: TTA
agtattcaaacagtaactat

SEQ ID NO: 103081 - DNA, 20 bp, Artificial Sequence
  Description of Artificial Sequence: Synthetic oligonucleotide
  Target: SCN9A; (+) strand; PAM type: YTN; PAM sequence: TTC
aaacagtaactatttccata

SEQ ID NO: 103082 - DNA, 20 bp, Artificial Sequence
  Description of Artificial Sequence: Synthetic oligonucleotide
  Target: SCN9A; (+) strand; PAM type: YTN; PAM sequence: CTA
tttccatactgtatataaaa

SEQ ID NO: 103083 - DNA, 20 bp, Artificial Sequence
  Description of Artificial Sequence: Synthetic oligonucleotide
  Target: SCN9A; (+) strand; PAM type: YTN; PAM sequence: TTT
ccatactgtatataaaatta

SEQ ID NO: 103084 - DNA, 20 bp, Artificial Sequence
  Description of Artificial Sequence: Synthetic oligonucleotide
  Target: SCN9A; (+) strand; PAM type: YTN; PAM sequence: TTC
catactgtatataaaattaa

SEQ ID NO: 103085 - DNA, 20 bp, Artificial Sequence
  Description of Artificial Sequence: Synthetic oligonucleotide
  Target: SCN9A; (+) strand; PAM type: YTN; PAM sequence: CTG
tatataaaattaaatgttta

SEQ ID NO: 103086 - DNA, 20 bp, Artificial Sequence
  Description of Artificial Sequence: Synthetic oligonucleotide
  Target: SCN9A; (+) strand; PAM type: YTN; PAM sequence: TTA
aatgtttataagcatgcttt

SEQ ID NO: 103087 - DNA, 20 bp, Artificial Sequence
  Description of Artificial Sequence: Synthetic oligonucleotide
  Target: SCN9A; (+) strand; PAM type: YTN; PAM sequence: TTT
ataagcatgctttagcaata

SEQ ID NO: 103088 - DNA, 20 bp, Artificial Sequence
  Description of Artificial Sequence: Synthetic oligonucleotide
  Target: SCN9A; (+) strand; PAM type: YTN; PAM sequence: TTA
taagcatgctttagcaatat

SEQ ID NO: 103089 - DNA, 20 bp, Artificial Sequence
  Description of Artificial Sequence: Synthetic oligonucleotide
  Target: SCN9A; (+) strand; PAM type: YTN; PAM sequence: CTT
tagcaatatagacagttcta

SEQ ID NO: 103090 - DNA, 20 bp, Artificial Sequence
  Description of Artificial Sequence: Synthetic oligonucleotide
  Target: SCN9A; (+) strand; PAM type: YTN; PAM sequence: TTT
agcaatatagacagttctag

SEQ ID NO: 103091 - DNA, 20 bp, Artificial Sequence
  Description of Artificial Sequence: Synthetic oligonucleotide
  Target: SCN9A; (+) strand; PAM type: YTN; PAM sequence: TTA
gcaatatagacagttctagt

SEQ ID NO: 103092 - DNA, 20 bp, Artificial Sequence
  Description of Artificial Sequence: Synthetic oligonucleotide
  Target: SCN9A; (+) strand; PAM type: YTN; PAM sequence: TTC
tagtcaattcagcctttgaa

SEQ ID NO: 103093 - DNA, 20 bp, Artificial Sequence
  Description of Artificial Sequence: Synthetic oligonucleotide
  Target: SCN9A; (+) strand; PAM type: YTN; PAM sequence: CTA
gtcaattcagcctttgaaat

SEQ ID NO: 103094 - DNA, 20 bp, Artificial Sequence
  Description of Artificial Sequence: Synthetic oligonucleotide
  Target: SCN9A; (+) strand; PAM type: YTN; PAM sequence: TTC
agcctttgaaatctatactt

SEQ ID NO: 103095 - DNA, 20 bp, Artificial Sequence
  Description of Artificial Sequence: Synthetic oligonucleotide
  Target: SCN9A; (+) strand; PAM type: YTN; PAM sequence: CTT
tgaaatctatacttgctaca

SEQ ID NO: 103096 - DNA, 20 bp, Artificial Sequence
  Description of Artificial Sequence: Synthetic oligonucleotide
  Target: SCN9A; (+) strand; PAM type: YTN; PAM sequence: TTT
gaaatctatacttgctacag

SEQ ID NO: 103097 - DNA, 20 bp, Artificial Sequence
  Description of Artificial Sequence: Synthetic oligonucleotide
  Target: SCN9A; (+) strand; PAM type: YTN; PAM sequence: TTG
aaatctatacttgctacagt

SEQ ID NO: 103098 - DNA, 20 bp, Artificial Sequence
  Description of Artificial Sequence: Synthetic oligonucleotide
  Target: SCN9A; (+) strand; PAM type: YTN; PAM sequence: CTA
tacttgctacagtataagct

SEQ ID NO: 103099 - DNA, 20 bp, Artificial Sequence
  Description of Artificial Sequence: Synthetic oligonucleotide
  Target: SCN9A; (+) strand; PAM type: YTN; PAM sequence: CTT
gctacagtataagcttcttt

SEQ ID NO: 103100 - DNA, 20 bp, Artificial Sequence
  Description of Artificial Sequence: Synthetic oligonucleotide
  Target: SCN9A; (+) strand; PAM type: YTN; PAM sequence: TTG
ctacagtataagcttcttta

SEQ ID NO: 103101 - DNA, 20 bp, Artificial Sequence
  Description of Artificial Sequence: Synthetic oligonucleotide
  Target: SCN9A; (+) strand; PAM type: YTN; PAM sequence: CTA
cagtataagcttctttagca

SEQ ID NO: 103102 - DNA, 20 bp, Artificial Sequence
  Description of Artificial Sequence: Synthetic oligonucleotide
  Target: SCN9A; (+) strand; PAM type: YTN; PAM sequence: CTT
ctttagcagatttctaagag

SEQ ID NO: 103103 - DNA, 20 bp, Artificial Sequence
  Description of Artificial Sequence: Synthetic oligonucleotide
  Target: SCN9A; (+) strand; PAM type: YTN; PAM sequence: TTC
tttagcagatttctaagaga

SEQ ID NO: 103104 - DNA, 20 bp, Artificial Sequence
  Description of Artificial Sequence: Synthetic oligonucleotide
  Target: SCN9A; (+) strand; PAM type: YTN; PAM sequence: CTT
tagcagatttctaagagaat

SEQ ID NO: 103105 - DNA, 20 bp, Artificial Sequence
  Description of Artificial Sequence: Synthetic oligonucleotide
  Target: SCN9A; (+) strand; PAM type: YTN; PAM sequence: TTT
agcagatttctaagagaata

SEQ ID NO: 103106 - DNA, 20 bp, Artificial Sequence
  Description of Artificial Sequence: Synthetic oligonucleotide
  Target: SCN9A; (+) strand; PAM type: YTN; PAM sequence: TTA
gcagatttctaagagaatac

SEQ ID NO: 103107 - DNA, 20 bp, Artificial Sequence
  Description of Artificial Sequence: Synthetic oligonucleotide
  Target: SCN9A; (+) strand; PAM type: YTN; PAM sequence: TTT
ctaagagaatacctttatat

SEQ ID NO: 103108 - DNA, 20 bp, Artificial Sequence
  Description of Artificial Sequence: Synthetic oligonucleotide
  Target: SCN9A; (+) strand; PAM type: YTN; PAM sequence: TTC
taagagaatacctttatata

SEQ ID NO: 103109 - DNA, 20 bp, Artificial Sequence
  Description of Artificial Sequence: Synthetic oligonucleotide
  Target: SCN9A; (+) strand; PAM type: YTN; PAM sequence: CTA
agagaatacctttatataga

SEQ ID NO: 103110 - DNA, 20 bp, Artificial Sequence
  Description of Artificial Sequence: Synthetic oligonucleotide
  Target: SCN9A; (+) strand; PAM type: YTN; PAM sequence: CTT
tatatagaaaggctgatata

SEQ ID NO: 103111 - DNA, 20 bp, Artificial Sequence
  Description of Artificial Sequence: Synthetic oligonucleotide
  Target: SCN9A; (+) strand; PAM type: YTN; PAM sequence: TTT
atatagaaaggctgatatat

SEQ ID NO: 103112 - DNA, 20 bp, Artificial Sequence
  Description of Artificial Sequence: Synthetic oligonucleotide
  Target: SCN9A; (+) strand; PAM type: YTN; PAM sequence: TTA
tatagaaaggctgatatata

SEQ ID NO: 103113 - DNA, 20 bp, Artificial Sequence
  Description of Artificial Sequence: Synthetic oligonucleotide
  Target: SCN9A; (+) strand; PAM type: YTN; PAM sequence: CTG
atatatataataaagttttt

SEQ ID NO: 103114 - DNA, 20 bp, Artificial Sequence
  Description of Artificial Sequence: Synthetic oligonucleotide
  Target: SCN9A; (+) strand; PAM type: YTN; PAM sequence: TTT
ttttttcctgcggtgaaata

SEQ ID NO: 103115 - DNA, 20 bp, Artificial Sequence
  Description of Artificial Sequence: Synthetic oligonucleotide
  Target: SCN9A; (+) strand; PAM type: YTN; PAM sequence: TTT
tttttcctgcggtgaaatat

SEQ ID NO: 103116 - DNA, 20 bp, Artificial Sequence
  Description of Artificial Sequence: Synthetic oligonucleotide
  Target: SCN9A; (+) strand; PAM type: YTN; PAM sequence: TTT
ttttcctgcggtgaaatata

SEQ ID NO: 103117 - DNA, 20 bp, Artificial Sequence
  Description of Artificial Sequence: Synthetic oligonucleotide
  Target: SCN9A; (+) strand; PAM type: YTN; PAM sequence: TTT
tttcctgcggtgaaatatat

SEQ ID NO: 103118 - DNA, 20 bp, Artificial Sequence
  Description of Artificial Sequence: Synthetic oligonucleotide
  Target: SCN9A; (+) strand; PAM type: YTN; PAM sequence: TTT
ttcctgcggtgaaatatatt

SEQ ID NO: 103119 - DNA, 20 bp, Artificial Sequence
  Description of Artificial Sequence: Synthetic oligonucleotide
  Target: SCN9A; (+) strand; PAM type: YTN; PAM sequence: TTT
tcctgcggtgaaatatattg

SEQ ID NO: 103120 - DNA, 20 bp, Artificial Sequence
  Description of Artificial Sequence: Synthetic oligonucleotide
  Target: SCN9A; (+) strand; PAM type: YTN; PAM sequence: TTT
cctgcggtgaaatatattga

SEQ ID NO: 103121 - DNA, 20 bp, Artificial Sequence
  Description of Artificial Sequence: Synthetic oligonucleotide
  Target: SCN9A; (+) strand; PAM type: YTN; PAM sequence: TTC
ctgcggtgaaatatattgaa

SEQ ID NO: 103122 - DNA, 20 bp, Artificial Sequence
  Description of Artificial Sequence: Synthetic oligonucleotide
  Target: SCN9A; (+) strand; PAM type: YTN; PAM sequence: CTG
cggtgaaatatattgaattc

SEQ ID NO: 103123 - DNA, 20 bp, Artificial Sequence
  Description of Artificial Sequence: Synthetic oligonucleotide
  Target: SCN9A; (+) strand; PAM type: YTN; PAM sequence: TTG
aattctcacagtaggcatca

SEQ ID NO: 103124 - DNA, 20 bp, Artificial Sequence
  Description of Artificial Sequence: Synthetic oligonucleotide
  Target: SCN9A; (+) strand; PAM type: YTN; PAM sequence: TTC
tcacagtaggcatcaccata

SEQ ID NO: 103125 - DNA, 20 bp, Artificial Sequence
  Description of Artificial Sequence: Synthetic oligonucleotide
  Target: SCN9A; (+) strand; PAM type: YTN; PAM sequence: CTC
acagtaggcatcaccatatt

SEQ ID NO: 103126 - DNA, 20 bp, Artificial Sequence
  Description of Artificial Sequence: Synthetic oligonucleotide
  Target: SCN9A; (+) strand; PAM type: YTN; PAM sequence: TTT
aagtactttgaatatatgtt

SEQ ID NO: 103127 - DNA, 20 bp, Artificial Sequence
  Description of Artificial Sequence: Synthetic oligonucleotide
  Target: SCN9A; (+) strand; PAM type: YTN; PAM sequence: TTA
agtactttgaatatatgttt

SEQ ID NO: 103128 - DNA, 20 bp, Artificial Sequence
  Description of Artificial Sequence: Synthetic oligonucleotide
  Target: SCN9A; (+) strand; PAM type: YTN; PAM sequence: CTT
tgaatatatgttttttacta

SEQ ID NO: 103129 - DNA, 20 bp, Artificial Sequence
  Description of Artificial Sequence: Synthetic oligonucleotide
  Target: SCN9A; (+) strand; PAM type: YTN; PAM sequence: TTT
gaatatatgttttttactat

SEQ ID NO: 103130 - DNA, 20 bp, Artificial Sequence
  Description of Artificial Sequence: Synthetic oligonucleotide
  Target: SCN9A; (+) strand; PAM type: YTN; PAM sequence: TTG
aatatatgttttttactata

SEQ ID NO: 103131 - DNA, 20 bp, Artificial Sequence
  Description of Artificial Sequence: Synthetic oligonucleotide
  Target: SCN9A; (+) strand; PAM type: YTN; PAM sequence: TTT
tttactatacaaggaagatc

SEQ ID NO: 103132 - DNA, 20 bp, Artificial Sequence
  Description of Artificial Sequence: Synthetic oligonucleotide
  Target: SCN9A; (+) strand; PAM type: YTN; PAM sequence: TTT
ttactatacaaggaagatca

SEQ ID NO: 103133 - DNA, 20 bp, Artificial Sequence
  Description of Artificial Sequence: Synthetic oligonucleotide
  Target: SCN9A; (+) strand; PAM type: YTN; PAM sequence: TTT
tactatacaaggaagatcat

SEQ ID NO: 103134 - DNA, 20 bp, Artificial Sequence
  Description of Artificial Sequence: Synthetic oligonucleotide
  Target: SCN9A; (+) strand; PAM type: YTN; PAM sequence: TTT
actatacaaggaagatcata

SEQ ID NO: 103135 - DNA, 20 bp, Artificial Sequence
  Description of Artificial Sequence: Synthetic oligonucleotide
  Target: SCN9A; (+) strand; PAM type: YTN; PAM sequence: TTA
ctatacaaggaagatcatat

SEQ ID NO: 103136 - DNA, 20 bp, Artificial Sequence
  Description of Artificial Sequence: Synthetic oligonucleotide
  Target: SCN9A; (+) strand; PAM type: YTN; PAM sequence: CTA
tacaaggaagatcatatcaa

SEQ ID NO: 103137 - DNA, 20 bp, Artificial Sequence
  Description of Artificial Sequence: Synthetic oligonucleotide
  Target: SCN9A; (+) strand; PAM type: YTN; PAM sequence: TTA
tttgtattattttatatgat

SEQ ID NO: 103138 - DNA, 20 bp, Artificial Sequence
  Description of Artificial Sequence: Synthetic oligonucleotide
  Target: SCN9A; (+) strand; PAM type: YTN; PAM sequence: TTT
gtattattttatatgattaa

SEQ ID NO: 103139 - DNA, 20 bp, Artificial Sequence
  Description of Artificial Sequence: Synthetic oligonucleotide
  Target: SCN9A; (+) strand; PAM type: YTN; PAM sequence: TTG
tattattttatatgattaat

SEQ ID NO: 103140 - DNA, 20 bp, Artificial Sequence
  Description of Artificial Sequence: Synthetic oligonucleotide
  Target: SCN9A; (+) strand; PAM type: YTN; PAM sequence: TTA
ttttatatgattaatttcta

SEQ ID NO: 103141 - DNA, 20 bp, Artificial Sequence
  Description of Artificial Sequence: Synthetic oligonucleotide
  Target: SCN9A; (+) strand; PAM type: YTN; PAM sequence: TTT
tatatgattaatttctatat

SEQ ID NO: 103142 - DNA, 20 bp, Artificial Sequence
  Description of Artificial Sequence: Synthetic oligonucleotide
  Target: SCN9A; (+) strand; PAM type: YTN; PAM sequence: TTT
atatgattaatttctatatt

SEQ ID NO: 103143 - DNA, 20 bp, Artificial Sequence
  Description of Artificial Sequence: Synthetic oligonucleotide
  Target: SCN9A; (+) strand; PAM type: YTN; PAM sequence: TTA
tatgattaatttctatatta

SEQ ID NO: 103144 - DNA, 20 bp, Artificial Sequence
  Description of Artificial Sequence: Synthetic oligonucleotide
  Target: SCN9A; (+) strand; PAM type: YTN; PAM sequence: TTA
atttctatattatcttcatt

SEQ ID NO: 103145 - DNA, 20 bp, Artificial Sequence
  Description of Artificial Sequence: Synthetic oligonucleotide
  Target: SCN9A; (+) strand; PAM type: YTN; PAM sequence: TTT
ctatattatcttcatttctt

SEQ ID NO: 103146 - DNA, 20 bp, Artificial Sequence
  Description of Artificial Sequence: Synthetic oligonucleotide
  Target: SCN9A; (+) strand; PAM type: YTN; PAM sequence: TTC
tatattatcttcatttcttt

SEQ ID NO: 103147 - DNA, 20 bp, Artificial Sequence
  Description of Artificial Sequence: Synthetic oligonucleotide
  Target: SCN9A; (+) strand; PAM type: YTN; PAM sequence: CTA
tattatcttcatttctttaa

SEQ ID NO: 103148 - DNA, 20 bp, Artificial Sequence
  Description of Artificial Sequence: Synthetic oligonucleotide
  Target: SCN9A; (+) strand; PAM type: YTN; PAM sequence: TTA
tcttcatttctttaaactca

SEQ ID NO: 103149 - DNA, 20 bp, Artificial Sequence
  Description of Artificial Sequence: Synthetic oligonucleotide
  Target: SCN9A; (+) strand; PAM type: YTN; PAM sequence: CTT
catttctttaaactcaatca

SEQ ID NO: 103150 - DNA, 20 bp, Artificial Sequence
  Description of Artificial Sequence: Synthetic oligonucleotide
  Target: SCN9A; (+) strand; PAM type: YTN; PAM sequence: TTC
atttctttaaactcaatcat

SEQ ID NO: 103151 - DNA, 20 bp, Artificial Sequence
  Description of Artificial Sequence: Synthetic oligonucleotide
  Target: SCN9A; (+) strand; PAM type: YTN; PAM sequence: TTT
ctttaaactcaatcatctgt

SEQ ID NO: 103152 - DNA, 20 bp, Artificial Sequence
  Description of Artificial Sequence: Synthetic oligonucleotide
  Target: SCN9A; (+) strand; PAM type: YTN; PAM sequence: TTC
tttaaactcaatcatctgtt

SEQ ID NO: 103153 - DNA, 20 bp, Artificial Sequence
  Description of Artificial Sequence: Synthetic oligonucleotide
  Target: SCN9A; (+) strand; PAM type: YTN; PAM sequence: CTT
taaactcaatcatctgttgt

SEQ ID NO: 103154 - DNA, 20 bp, Artificial Sequence
  Description of Artificial Sequence: Synthetic oligonucleotide
  Target: SCN9A; (+) strand; PAM type: YTN; PAM sequence: TTT
aaactcaatcatctgttgtt

SEQ ID NO: 103155 - DNA, 20 bp, Artificial Sequence
  Description of Artificial Sequence: Synthetic oligonucleotide
  Target: SCN9A; (+) strand; PAM type: YTN; PAM sequence: TTA
aactcaatcatctgttgttt

SEQ ID NO: 103156 - DNA, 20 bp, Artificial Sequence
  Description of Artificial Sequence: Synthetic oligonucleotide
  Target: SCN9A; (+) strand; PAM type: YTN; PAM sequence: CTC
aatcatctgttgtttagttt

SEQ ID NO: 103157 - DNA, 20 bp, Artificial Sequence
  Description of Artificial Sequence: Synthetic oligonucleotide
  Target: SCN9A; (+) strand; PAM type: YTN; PAM sequence: CTG
ttgtttagttttccatgtaa

SEQ ID NO: 103158 - DNA, 20 bp, Artificial Sequence
  Description of Artificial Sequence: Synthetic oligonucleotide
  Target: SCN9A; (+) strand; PAM type: YTN; PAM sequence: TTG
tttagttttccatgtaattt

SEQ ID NO: 103159 - DNA, 20 bp, Artificial Sequence
  Description of Artificial Sequence: Synthetic oligonucleotide
  Target: SCN9A; (+) strand; PAM type: YTN; PAM sequence: TTT
agttttccatgtaattttgg

SEQ ID NO: 103160 - DNA, 20 bp, Artificial Sequence
  Description of Artificial Sequence: Synthetic oligonucleotide
  Target: SCN9A; (+) strand; PAM type: YTN; PAM sequence: TTA
gttttccatgtaattttgga

SEQ ID NO: 103161 - DNA, 20 bp, Artificial Sequence
  Description of Artificial Sequence: Synthetic oligonucleotide
  Target: SCN9A; (+) strand; PAM type: YTN; PAM sequence: TTT
tccatgtaattttggaaatg

SEQ ID NO: 103162 - DNA, 20 bp, Artificial Sequence
  Description of Artificial Sequence: Synthetic oligonucleotide
  Target: SCN9A; (+) strand; PAM type: YTN; PAM sequence: TTT
ccatgtaattttggaaatga

SEQ ID NO: 103163 - DNA, 20 bp, Artificial Sequence
  Description of Artificial Sequence: Synthetic oligonucleotide
  Target: SCN9A; (+) strand; PAM type: YTN; PAM sequence: TTC
catgtaattttggaaatgaa

SEQ ID NO: 103164 - DNA, 20 bp, Artificial Sequence
  Description of Artificial Sequence: Synthetic oligonucleotide
  Target: SCN9A; (+) strand; PAM type: YTN; PAM sequence: TTT
tggaaatgaaagaatgacta

SEQ ID NO: 103165 - DNA, 20 bp, Artificial Sequence
  Description of Artificial Sequence: Synthetic oligonucleotide
  Target: SCN9A; (+) strand; PAM type: YTN; PAM sequence: TTT
ggaaatgaaagaatgactat

SEQ ID NO: 103166 - DNA, 20 bp, Artificial Sequence
  Description of Artificial Sequence: Synthetic oligonucleotide
  Target: SCN9A; (+) strand; PAM type: YTN; PAM sequence: TTG
gaaatgaaagaatgactata

SEQ ID NO: 103167 - DNA, 20 bp, Artificial Sequence
  Description of Artificial Sequence: Synthetic oligonucleotide
  Target: SCN9A; (+) strand; PAM type: YTN; PAM sequence: CTA
tattagagaagtgaaataaa

SEQ ID NO: 103168 - DNA, 20 bp, Artificial Sequence
  Description of Artificial Sequence: Synthetic oligonucleotide
  Target: SCN9A; (+) strand; PAM type: YTN; PAM sequence: TTA
gagaagtgaaataaatgctt

SEQ ID NO: 103169 - DNA, 20 bp, Artificial Sequence
  Description of Artificial Sequence: Synthetic oligonucleotide
  Target: SCN9A; (+) strand; PAM type: YTN; PAM sequence: CTT
tagtatgaaagaaatttctt

SEQ ID NO: 103170 - DNA, 20 bp, Artificial Sequence
  Description of Artificial Sequence: Synthetic oligonucleotide
  Target: SCN9A; (+) strand; PAM type: YTN; PAM sequence: TTT
agtatgaaagaaatttcttt

SEQ ID NO: 103171 - DNA, 20 bp, Artificial Sequence
  Description of Artificial Sequence: Synthetic oligonucleotide
  Target: SCN9A; (+) strand; PAM type: YTN; PAM sequence: TTA
gtatgaaagaaatttctttt

SEQ ID NO: 103172 - DNA, 20 bp, Artificial Sequence
  Description of Artificial Sequence: Synthetic oligonucleotide
  Target: SCN9A; (+) strand; PAM type: YTN; PAM sequence: TTT
cttttgctattataaatagg

SEQ ID NO: 103173 - DNA, 20 bp, Artificial Sequence
  Description of Artificial Sequence: Synthetic oligonucleotide
  Target: SCN9A; (+) strand; PAM type: YTN; PAM sequence: TTC
ttttgctattataaatagga

SEQ ID NO: 103174 - DNA, 20 bp, Artificial Sequence
  Description of Artificial Sequence: Synthetic oligonucleotide
  Target: SCN9A; (+) strand; PAM type: YTN; PAM sequence: CTT
ttgctattataaataggacc

SEQ ID NO: 103175 - DNA, 20 bp, Artificial Sequence
  Description of Artificial Sequence: Synthetic oligonucleotide
  Target: SCN9A; (+) strand; PAM type: YTN; PAM sequence: TTT
tgctattataaataggacct

SEQ ID NO: 103176 - DNA, 20 bp, Artificial Sequence
  Description of Artificial Sequence: Synthetic oligonucleotide
  Target: SCN9A; (+) strand; PAM type: YTN; PAM sequence: TTT
gctattataaataggacctt

SEQ ID NO: 103177 - DNA, 20 bp, Artificial Sequence
  Description of Artificial Sequence: Synthetic oligonucleotide
  Target: SCN9A; (+) strand; PAM type: YTN; PAM sequence: TTG
ctattataaataggaccttc

SEQ ID NO: 103178 - DNA, 20 bp, Artificial Sequence
  Description of Artificial Sequence: Synthetic oligonucleotide
  Target: SCN9A; (+) strand; PAM type: YTN; PAM sequence: CTA
ttataaataggaccttctgt

SEQ ID NO: 103179 - DNA, 20 bp, Artificial Sequence
  Description of Artificial Sequence: Synthetic oligonucleotide
  Target: SCN9A; (+) strand; PAM type: YTN; PAM sequence: TTA
taaataggaccttctgtaat

SEQ ID NO: 103180 - DNA, 20 bp, Artificial Sequence
  Description of Artificial Sequence: Synthetic oligonucleotide
  Target: SCN9A; (+) strand; PAM type: YTN; PAM sequence: CTT
ctgtaattttcacatggatt

SEQ ID NO: 103181 - DNA, 20 bp, Artificial Sequence
  Description of Artificial Sequence: Synthetic oligonucleotide
  Target: SCN9A; (+) strand; PAM type: YTN; PAM sequence: TTC
tgtaattttcacatggattt

SEQ ID NO: 103182 - DNA, 20 bp, Artificial Sequence
  Description of Artificial Sequence: Synthetic oligonucleotide
  Target: SCN9A; (+) strand; PAM type: YTN; PAM sequence: CTG
taattttcacatggatttga

SEQ ID NO: 103183 - DNA, 20 bp, Artificial Sequence
  Description of Artificial Sequence: Synthetic oligonucleotide
  Target: SCN9A; (+) strand; PAM type: YTN; PAM sequence: TTT
tcacatggatttgatttcta

SEQ ID NO: 103184 - DNA, 20 bp, Artificial Sequence
  Description of Artificial Sequence: Synthetic oligonucleotide
  Target: SCN9A; (+) strand; PAM type: YTN; PAM sequence: TTT
cacatggatttgatttctaa

SEQ ID NO: 103185 - DNA, 20 bp, Artificial Sequence
  Description of Artificial Sequence: Synthetic oligonucleotide
  Target: SCN9A; (+) strand; PAM type: YTN; PAM sequence: TTC
acatggatttgatttctaat

SEQ ID NO: 103186 - DNA, 20 bp, Artificial Sequence
  Description of Artificial Sequence: Synthetic oligonucleotide
  Target: SCN9A; (+) strand; PAM type: YTN; PAM sequence: TTT
gatttctaataaaagggaag

SEQ ID NO: 103187 - DNA, 20 bp, Artificial Sequence
  Description of Artificial Sequence: Synthetic oligonucleotide
  Target: SCN9A; (+) strand; PAM type: YTN; PAM sequence: TTG
atttctaataaaagggaagt

SEQ ID NO: 103188 - DNA, 20 bp, Artificial Sequence
  Description of Artificial Sequence: Synthetic oligonucleotide
  Target: SCN9A; (+) strand; PAM type: YTN; PAM sequence: TTT
ctaataaaagggaagtatca

SEQ ID NO: 103189 - DNA, 20 bp, Artificial Sequence
  Description of Artificial Sequence: Synthetic oligonucleotide
  Target: SCN9A; (+) strand; PAM type: YTN; PAM sequence: TTC
taataaaagggaagtatcaa

SEQ ID NO: 103190 - DNA, 20 bp, Artificial Sequence
  Description of Artificial Sequence: Synthetic oligonucleotide
  Target: SCN9A; (+) strand; PAM type: YTN; PAM sequence: CTA
ataaaagggaagtatcaatt

SEQ ID NO: 103191 - DNA, 20 bp, Artificial Sequence
  Description of Artificial Sequence: Synthetic oligonucleotide
  Target: SCN9A; (+) strand; PAM type: YTN; PAM sequence: TTT
ttttcatcattggcagtcta

SEQ ID NO: 103192 - DNA, 20 bp, Artificial Sequence
  Description of Artificial Sequence: Synthetic oligonucleotide
  Target: SCN9A; (+) strand; PAM type: YTN; PAM sequence: TTT
tttcatcattggcagtctag

SEQ ID NO: 103193 - DNA, 20 bp, Artificial Sequence
  Description of Artificial Sequence: Synthetic oligonucleotide
  Target: SCN9A; (+) strand; PAM type: YTN; PAM sequence: TTT
ttcatcattggcagtctagt

SEQ ID NO: 103194 - DNA, 20 bp, Artificial Sequence
  Description of Artificial Sequence: Synthetic oligonucleotide
  Target: SCN9A; (+) strand; PAM type: YTN; PAM sequence: TTT
tcatcattggcagtctagtt

SEQ ID NO: 103195 - DNA, 20 bp, Artificial Sequence
  Description of Artificial Sequence: Synthetic oligonucleotide
  Target: SCN9A; (+) strand; PAM type: YTN; PAM sequence: TTT
catcattggcagtctagtta

SEQ ID NO: 103196 - DNA, 20 bp, Artificial Sequence
  Description of Artificial Sequence: Synthetic oligonucleotide
  Target: SCN9A; (+) strand; PAM type: YTN; PAM sequence: TTC
atcattggcagtctagttat

SEQ ID NO: 103197 - DNA, 20 bp, Artificial Sequence
  Description of Artificial Sequence: Synthetic oligonucleotide
  Target: SCN9A; (+) strand; PAM type: YTN; PAM sequence: TTG
gcagtctagttataaataaa

SEQ ID NO: 103198 - DNA, 20 bp, Artificial Sequence
  Description of Artificial Sequence: Synthetic oligonucleotide
  Target: SCN9A; (+) strand; PAM type: YTN; PAM sequence: CTA
gttataaataaagtaaatat

SEQ ID NO: 103199 - DNA, 20 bp, Artificial Sequence
  Description of Artificial Sequence: Synthetic oligonucleotide
  Target: SCN9A; (+) strand; PAM type: YTN; PAM sequence: TTA
taaataaagtaaatataaat

SEQ ID NO: 103200 - DNA, 20 bp, Artificial Sequence
  Description of Artificial Sequence: Synthetic oligonucleotide
  Target: SCN9A; (+) strand; PAM type: YTN; PAM sequence: CTC
actagtattaggaatcagaa

SEQ ID NO: 103201 - DNA, 20 bp, Artificial Sequence
  Description of Artificial Sequence: Synthetic oligonucleotide
  Target: SCN9A; (+) strand; PAM type: YTN; PAM sequence: CTA
gtattaggaatcagaagtgt

SEQ ID NO: 103202 - DNA, 20 bp, Artificial Sequence
  Description of Artificial Sequence: Synthetic oligonucleotide
  Target: SCN9A; (+) strand; PAM type: YTN; PAM sequence: TTA
ggaatcagaagtgtaccata

SEQ ID NO: 103203 - DNA, 20 bp, Artificial Sequence
  Description of Artificial Sequence: Synthetic oligonucleotide
  Target: SCN9A; (+) strand; PAM type: YTN; PAM sequence: TTA
gcattcctgcctttttattg

SEQ ID NO: 103204 - DNA, 20 bp, Artificial Sequence
  Description of Artificial Sequence: Synthetic oligonucleotide
  Target: SCN9A; (+) strand; PAM type: YTN; PAM sequence: TTC
ctgcctttttattgaataat

SEQ ID NO: 103205 - DNA, 20 bp, Artificial Sequence
  Description of Artificial Sequence: Synthetic oligonucleotide
  Target: SCN9A; (+) strand; PAM type: YTN; PAM sequence: CTG
cctttttattgaataatatg

SEQ ID NO: 103206 - DNA, 20 bp, Artificial Sequence
  Description of Artificial Sequence: Synthetic oligonucleotide
  Target: SCN9A; (+) strand; PAM type: YTN; PAM sequence: CTT
tttattgaataatatgatat

SEQ ID NO: 103207 - DNA, 20 bp, Artificial Sequence
  Description of Artificial Sequence: Synthetic oligonucleotide
  Target: SCN9A; (+) strand; PAM type: YTN; PAM sequence: TTT
ttattgaataatatgatatt

SEQ ID NO: 103208 - DNA, 20 bp, Artificial Sequence
  Description of Artificial Sequence: Synthetic oligonucleotide
  Target: SCN9A; (+) strand; PAM type: YTN; PAM sequence: TTT
tattgaataatatgatattg

SEQ ID NO: 103209 - DNA, 20 bp, Artificial Sequence
  Description of Artificial Sequence: Synthetic oligonucleotide
  Target: SCN9A; (+) strand; PAM type: YTN; PAM sequence: TTT
attgaataatatgatattga

SEQ ID NO: 103210 - DNA, 20 bp, Artificial Sequence
  Description of Artificial Sequence: Synthetic oligonucleotide
  Target: SCN9A; (+) strand; PAM type: YTN; PAM sequence: TTA
ttgaataatatgatattgac

SEQ ID NO: 103211 - DNA, 20 bp, Artificial Sequence
  Description of Artificial Sequence: Synthetic oligonucleotide
  Target: SCN9A; (+) strand; PAM type: YTN; PAM sequence: TTG
aataatatgatattgactgt

SEQ ID NO: 103212 - DNA, 20 bp, Artificial Sequence
  Description of Artificial Sequence: Synthetic oligonucleotide
  Target: SCN9A; (+) strand; PAM type: YTN; PAM sequence: TTG
actgtgccttctaaaagtgt

SEQ ID NO: 103213 - DNA, 20 bp, Artificial Sequence
  Description of Artificial Sequence: Synthetic oligonucleotide
  Target: SCN9A; (+) strand; PAM type: YTN; PAM sequence: CTG
tgccttctaaaagtgtttta

SEQ ID NO: 103214 - DNA, 20 bp, Artificial Sequence
  Description of Artificial Sequence: Synthetic oligonucleotide
  Target: SCN9A; (+) strand; PAM type: YTN; PAM sequence: CTT
ctaaaagtgttttaaaaata

SEQ ID NO: 103215 - DNA, 20 bp, Artificial Sequence
  Description of Artificial Sequence: Synthetic oligonucleotide
  Target: SCN9A; (+) strand; PAM type: YTN; PAM sequence: TTC
taaaagtgttttaaaaatat

SEQ ID NO: 103216 - DNA, 20 bp, Artificial Sequence
  Description of Artificial Sequence: Synthetic oligonucleotide
  Target: SCN9A; (+) strand; PAM type: YTN; PAM sequence: CTA
aaagtgttttaaaaatatga

SEQ ID NO: 103217 - DNA, 20 bp, Artificial Sequence
  Description of Artificial Sequence: Synthetic oligonucleotide
  Target: SCN9A; (+) strand; PAM type: YTN; PAM sequence: TTT
taaaaatatgaaagtgatat

SEQ ID NO: 103218 - DNA, 20 bp, Artificial Sequence
  Description of Artificial Sequence: Synthetic oligonucleotide
  Target: SCN9A; (+) strand; PAM type: YTN; PAM sequence: TTT
aaaaatatgaaagtgatata

SEQ ID NO: 103219 - DNA, 20 bp, Artificial Sequence
  Description of Artificial Sequence: Synthetic oligonucleotide
  Target: SCN9A; (+) strand; PAM type: YTN; PAM sequence: TTA
aaaatatgaaagtgatatag

SEQ ID NO: 103220 - DNA, 20 bp, Artificial Sequence
  Description of Artificial Sequence: Synthetic oligonucleotide
  Target: SCN9A; (+) strand; PAM type: YTN; PAM sequence: TTG
actcaaacattttaaatgta

SEQ ID NO: 103221 - DNA, 20 bp, Artificial Sequence
  Description of Artificial Sequence: Synthetic oligonucleotide
  Target: SCN9A; (+) strand; PAM type: YTN; PAM sequence: CTC
aaacattttaaatgtataat

SEQ ID NO: 103222 - DNA, 20 bp, Artificial Sequence
  Description of Artificial Sequence: Synthetic oligonucleotide
  Target: SCN9A; (+) strand; PAM type: YTN; PAM sequence: TTT
taaatgtataatagtattta

SEQ ID NO: 103223 - DNA, 20 bp, Artificial Sequence
  Description of Artificial Sequence: Synthetic oligonucleotide
  Target: SCN9A; (+) strand; PAM type: YTN; PAM sequence: TTT
aaatgtataatagtatttac

SEQ ID NO: 103224 - DNA, 20 bp, Artificial Sequence
  Description of Artificial Sequence: Synthetic oligonucleotide
  Target: SCN9A; (+) strand; PAM type: YTN; PAM sequence: TTA
aatgtataatagtatttaca

SEQ ID NO: 103225 - DNA, 20 bp, Artificial Sequence
  Description of Artificial Sequence: Synthetic oligonucleotide
  Target: SCN9A; (+) strand; PAM type: YTN; PAM sequence: TTT
acagtgcaaaataaaagttc

SEQ ID NO: 103226 - DNA, 20 bp, Artificial Sequence
  Description of Artificial Sequence: Synthetic oligonucleotide
  Target: SCN9A; (+) strand; PAM type: YTN; PAM sequence: TTA
cagtgcaaaataaaagttcc

SEQ ID NO: 103227 - DNA, 20 bp, Artificial Sequence
  Description of Artificial Sequence: Synthetic oligonucleotide
  Target: SCN9A; (+) strand; PAM type: YTN; PAM sequence: TTC
cctccactatctccttgatt

SEQ ID NO: 103228 - DNA, 20 bp, Artificial Sequence
  Description of Artificial Sequence: Synthetic oligonucleotide
  Target: SCN9A; (+) strand; PAM type: YTN; PAM sequence: CTC
cactatctccttgattcaac

SEQ ID NO: 103229 - DNA, 20 bp, Artificial Sequence
  Description of Artificial Sequence: Synthetic oligonucleotide
  Target: SCN9A; (+) strand; PAM type: YTN; PAM sequence: CTA
tctccttgattcaaccccct

SEQ ID NO: 103230 - DNA, 20 bp, Artificial Sequence
  Description of Artificial Sequence: Synthetic oligonucleotide
  Target: SCN9A; (+) strand; PAM type: YTN; PAM sequence: CTC
cttgattcaacccccttgag

SEQ ID NO: 103231 - DNA, 20 bp, Artificial Sequence
  Description of Artificial Sequence: Synthetic oligonucleotide
  Target: SCN9A; (+) strand; PAM type: YTN; PAM sequence: CTT
gattcaacccccttgaggta

SEQ ID NO: 103232 - DNA, 20 bp, Artificial Sequence
  Description of Artificial Sequence: Synthetic oligonucleotide
  Target: SCN9A; (+) strand; PAM type: YTN; PAM sequence: TTG
attcaacccccttgaggtaa

SEQ ID NO: 103233 - DNA, 20 bp, Artificial Sequence
  Description of Artificial Sequence: Synthetic oligonucleotide
  Target: SCN9A; (+) strand; PAM type: YTN; PAM sequence: TTC
aacccccttgaggtaatcga

SEQ ID NO: 103234 - DNA, 20 bp, Artificial Sequence
  Description of Artificial Sequence: Synthetic oligonucleotide
  Target: SCN9A; (+) strand; PAM type: YTN; PAM sequence: CTT
gaggtaatcgagagagagaa

SEQ ID NO: 103235 - DNA, 20 bp, Artificial Sequence
  Description of Artificial Sequence: Synthetic oligonucleotide
  Target: SCN9A; (+) strand; PAM type: YTN; PAM sequence: TTG
aggtaatcgagagagagaaa

SEQ ID NO: 103236 - DNA, 20 bp, Artificial Sequence
  Description of Artificial Sequence: Synthetic oligonucleotide
  Target: SCN9A; (+) strand; PAM type: YTN; PAM sequence: CTT
tccatatttttcagtgtgca

SEQ ID NO: 103237 - DNA, 20 bp, Artificial Sequence
  Description of Artificial Sequence: Synthetic oligonucleotide
  Target: SCN9A; (+) strand; PAM type: YTN; PAM sequence: TTT
ccatatttttcagtgtgcat

SEQ ID NO: 103238 - DNA, 20 bp, Artificial Sequence
  Description of Artificial Sequence: Synthetic oligonucleotide
  Target: SCN9A; (+) strand; PAM type: YTN; PAM sequence: TTC
catatttttcagtgtgcatc

SEQ ID NO: 103239 - DNA, 20 bp, Artificial Sequence
  Description of Artificial Sequence: Synthetic oligonucleotide
  Target: SCN9A; (+) strand; PAM type: YTN; PAM sequence: TTT
ttcagtgtgcatccatacaa

SEQ ID NO: 103240 - DNA, 20 bp, Artificial Sequence
  Description of Artificial Sequence: Synthetic oligonucleotide
  Target: SCN9A; (+) strand; PAM type: YTN; PAM sequence: TTT
tcagtgtgcatccatacaac

SEQ ID NO: 103241 - DNA, 20 bp, Artificial Sequence
  Description of Artificial Sequence: Synthetic oligonucleotide
  Target: SCN9A; (+) strand; PAM type: YTN; PAM sequence: TTT
cagtgtgcatccatacaaca

SEQ ID NO: 103242 - DNA, 20 bp, Artificial Sequence
  Description of Artificial Sequence: Synthetic oligonucleotide
  Target: SCN9A; (+) strand; PAM type: YTN; PAM sequence: TTC
agtgtgcatccatacaacac

SEQ ID NO: 103243 - DNA, 20 bp, Artificial Sequence
  Description of Artificial Sequence: Synthetic oligonucleotide
  Target: SCN9A; (+) strand; PAM type: YTN; PAM sequence: CTA
tagctgtgaaacaatcctta

SEQ ID NO: 103244 - DNA, 20 bp, Artificial Sequence
  Description of Artificial Sequence: Synthetic oligonucleotide
  Target: SCN9A; (+) strand; PAM type: YTN; PAM sequence: CTG
tgaaacaatccttatcttga

SEQ ID NO: 103245 - DNA, 20 bp, Artificial Sequence
  Description of Artificial Sequence: Synthetic oligonucleotide
  Target: SCN9A; (+) strand; PAM type: YTN; PAM sequence: CTT
atcttgattgtaaacttatg

SEQ ID NO: 103246 - DNA, 20 bp, Artificial Sequence
  Description of Artificial Sequence: Synthetic oligonucleotide
  Target: SCN9A; (+) strand; PAM type: YTN; PAM sequence: TTA
tcttgattgtaaacttatgt

SEQ ID NO: 103247 - DNA, 20 bp, Artificial Sequence
  Description of Artificial Sequence: Synthetic oligonucleotide
  Target: SCN9A; (+) strand; PAM type: YTN; PAM sequence: CTT
gattgtaaacttatgtagct

SEQ ID NO: 103248 - DNA, 20 bp, Artificial Sequence
  Description of Artificial Sequence: Synthetic oligonucleotide
  Target: SCN9A; (+) strand; PAM type: YTN; PAM sequence: TTG
attgtaaacttatgtagcta

SEQ ID NO: 103249 - DNA, 20 bp, Artificial Sequence
  Description of Artificial Sequence: Synthetic oligonucleotide
  Target: SCN9A; (+) strand; PAM type: YTN; PAM sequence: TTG
taaacttatgtagctattta

SEQ ID NO: 103250 - DNA, 20 bp, Artificial Sequence
  Description of Artificial Sequence: Synthetic oligonucleotide
  Target: SCN9A; (+) strand; PAM type: YTN; PAM sequence: CTT
atgtagctatttaagatgct

SEQ ID NO: 103251 - DNA, 20 bp, Artificial Sequence
  Description of Artificial Sequence: Synthetic oligonucleotide
  Target: SCN9A; (+) strand; PAM type: YTN; PAM sequence: TTA
tgtagctatttaagatgctc

SEQ ID NO: 103252 - DNA, 20 bp, Artificial Sequence
  Description of Artificial Sequence: Synthetic oligonucleotide
  Target: SCN9A; (+) strand; PAM type: YTN; PAM sequence: CTA
tttaagatgctccttttcaa

SEQ ID NO: 103253 - DNA, 20 bp, Artificial Sequence
  Description of Artificial Sequence: Synthetic oligonucleotide
  Target: SCN9A; (+) strand; PAM type: YTN; PAM sequence: TTT
aagatgctccttttcaatta

SEQ ID NO: 103254 - DNA, 20 bp, Artificial Sequence
  Description of Artificial Sequence: Synthetic oligonucleotide
  Target: SCN9A; (+) strand; PAM type: YTN; PAM sequence: TTA
agatgctccttttcaattac

SEQ ID NO: 103255 - DNA, 20 bp, Artificial Sequence
  Description of Artificial Sequence: Synthetic oligonucleotide
  Target: SCN9A; (+) strand; PAM type: YTN; PAM sequence: CTC
cttttcaattactgaaaata

SEQ ID NO: 103256 - DNA, 20 bp, Artificial Sequence
  Description of Artificial Sequence: Synthetic oligonucleotide
  Target: SCN9A; (+) strand; PAM type: YTN; PAM sequence: CTT
ttcaattactgaaaatatgt

SEQ ID NO: 103257 - DNA, 20 bp, Artificial Sequence
  Description of Artificial Sequence: Synthetic oligonucleotide
  Target: SCN9A; (+) strand; PAM type: YTN; PAM sequence: TTT
tcaattactgaaaatatgtc

SEQ ID NO: 103258 - DNA, 20 bp, Artificial Sequence
  Description of Artificial Sequence: Synthetic oligonucleotide
  Target: SCN9A; (+) strand; PAM type: YTN; PAM sequence: TTT
caattactgaaaatatgtcc

SEQ ID NO: 103259 - DNA, 20 bp, Artificial Sequence
  Description of Artificial Sequence: Synthetic oligonucleotide
  Target: SCN9A; (+) strand; PAM type: YTN; PAM sequence: TTC
aattactgaaaatatgtcca

SEQ ID NO: 103260 - DNA, 20 bp, Artificial Sequence
  Description of Artificial Sequence: Synthetic oligonucleotide
  Target: SCN9A; (+) strand; PAM type: YTN; PAM sequence: TTA
ctgaaaatatgtccaaatta

SEQ ID NO: 103261 - DNA, 20 bp, Artificial Sequence
  Description of Artificial Sequence: Synthetic oligonucleotide
  Target: SCN9A; (+) strand; PAM type: YTN; PAM sequence: CTG
aaaatatgtccaaattaaaa

SEQ ID NO: 103262 - DNA, 20 bp, Artificial Sequence
  Description of Artificial Sequence: Synthetic oligonucleotide
  Target: SCN9A; (+) strand; PAM type: YTN; PAM sequence: TTA
aaagctttattattcttcat

SEQ ID NO: 103263 - DNA, 20 bp, Artificial Sequence
  Description of Artificial Sequence: Synthetic oligonucleotide
  Target: SCN9A; (+) strand; PAM type: YTN; PAM sequence: CTT
tattattcttcatggttttc

SEQ ID NO: 103264 - DNA, 20 bp, Artificial Sequence
  Description of Artificial Sequence: Synthetic oligonucleotide
  Target: SCN9A; (+) strand; PAM type: YTN; PAM sequence: TTT
attattcttcatggttttcc

SEQ ID NO: 103265 - DNA, 20 bp, Artificial Sequence
  Description of Artificial Sequence: Synthetic oligonucleotide
  Target: SCN9A; (+) strand; PAM type: YTN; PAM sequence: TTA
ttattcttcatggttttccc

SEQ ID NO: 103266 - DNA, 20 bp, Artificial Sequence
  Description of Artificial Sequence: Synthetic oligonucleotide
  Target: SCN9A; (+) strand; PAM type: YTN; PAM sequence: TTA
ttcttcatggttttcccttt

SEQ ID NO: 103267 - DNA, 20 bp, Artificial Sequence
  Description of Artificial Sequence: Synthetic oligonucleotide
  Target: SCN9A; (+) strand; PAM type: YTN; PAM sequence: TTC
ttcatggttttccctttgat

SEQ ID NO: 103268 - DNA, 20 bp, Artificial Sequence
  Description of Artificial Sequence: Synthetic oligonucleotide
  Target: SCN9A; (+) strand; PAM type: YTN; PAM sequence: CTT
catggttttccctttgattg

SEQ ID NO: 103269 - DNA, 20 bp, Artificial Sequence
  Description of Artificial Sequence: Synthetic oligonucleotide
  Target: SCN9A; (+) strand; PAM type: YTN; PAM sequence: TTC
atggttttccctttgattgc

SEQ ID NO: 103270 - DNA, 20 bp, Artificial Sequence
  Description of Artificial Sequence: Synthetic oligonucleotide
  Target: SCN9A; (+) strand; PAM type: YTN; PAM sequence: TTT
tccctttgattgccttgaag

SEQ ID NO: 103271 - DNA, 20 bp, Artificial Sequence
  Description of Artificial Sequence: Synthetic oligonucleotide
  Target: SCN9A; (+) strand; PAM type: YTN; PAM sequence: TTT
ccctttgattgccttgaagc

SEQ ID NO: 103272 - DNA, 20 bp, Artificial Sequence
  Description of Artificial Sequence: Synthetic oligonucleotide
  Target: SCN9A; (+) strand; PAM type: YTN; PAM sequence: TTC
cctttgattgccttgaagct

SEQ ID NO: 103273 - DNA, 20 bp, Artificial Sequence
  Description of Artificial Sequence: Synthetic oligonucleotide
  Target: SCN9A; (+) strand; PAM type: YTN; PAM sequence: CTT
tgattgccttgaagctgtgt

SEQ ID NO: 103274 - DNA, 20 bp, Artificial Sequence
  Description of Artificial Sequence: Synthetic oligonucleotide
  Target: SCN9A; (+) strand; PAM type: YTN; PAM sequence: TTT
gattgccttgaagctgtgtt

SEQ ID NO: 103275 - DNA, 20 bp, Artificial Sequence
  Description of Artificial Sequence: Synthetic oligonucleotide
  Target: SCN9A; (+) strand; PAM type: YTN; PAM sequence: TTG
attgccttgaagctgtgttt

SEQ ID NO: 103276 - DNA, 20 bp, Artificial Sequence
  Description of Artificial Sequence: Synthetic oligonucleotide
  Target: SCN9A; (+) strand; PAM type: YTN; PAM sequence: TTG
ccttgaagctgtgttttcta

SEQ ID NO: 103277 - DNA, 20 bp, Artificial Sequence
  Description of Artificial Sequence: Synthetic oligonucleotide
  Target: SCN9A; (+) strand; PAM type: YTN; PAM sequence: CTT
gaagctgtgttttctactat

SEQ ID NO: 103278 - DNA, 20 bp, Artificial Sequence
  Description of Artificial Sequence: Synthetic oligonucleotide
  Target: SCN9A; (+) strand; PAM type: YTN; PAM sequence: TTG
aagctgtgttttctactata

SEQ ID NO: 103279 - DNA, 20 bp, Artificial Sequence
  Description of Artificial Sequence: Synthetic oligonucleotide
  Target: SCN9A; (+) strand; PAM type: YTN; PAM sequence: CTG
tgttttctactatactgctt

SEQ ID NO: 103280 - DNA, 20 bp, Artificial Sequence
  Description of Artificial Sequence: Synthetic oligonucleotide
  Target: SCN9A; (+) strand; PAM type: YTN; PAM sequence: TTT
tctactatactgcttgagta

SEQ ID NO: 103281 - DNA, 20 bp, Artificial Sequence
  Description of Artificial Sequence: Synthetic oligonucleotide
  Target: SCN9A; (+) strand; PAM type: YTN; PAM sequence: TTT
ctactatactgcttgagtag

SEQ ID NO: 103282 - DNA, 20 bp, Artificial Sequence
  Description of Artificial Sequence: Synthetic oligonucleotide
  Target: SCN9A; (+) strand; PAM type: YTN; PAM sequence: TTC
tactatactgcttgagtaga

SEQ ID NO: 103283 - DNA, 20 bp, Artificial Sequence
  Description of Artificial Sequence: Synthetic oligonucleotide
  Target: SCN9A; (+) strand; PAM type: YTN; PAM sequence: CTA
ctatactgcttgagtagaaa

SEQ ID NO: 103284 - DNA, 20 bp, Artificial Sequence
  Description of Artificial Sequence: Synthetic oligonucleotide
  Target: SCN9A; (+) strand; PAM type: YTN; PAM sequence: CTA
tactgcttgagtagaaattg

SEQ ID NO: 103285 - DNA, 20 bp, Artificial Sequence
  Description of Artificial Sequence: Synthetic oligonucleotide
  Target: SCN9A; (+) strand; PAM type: YTN; PAM sequence: CTG
cttgagtagaaattgtgtta

SEQ ID NO: 103286 - DNA, 20 bp, Artificial Sequence
  Description of Artificial Sequence: Synthetic oligonucleotide
  Target: SCN9A; (+) strand; PAM type: YTN; PAM sequence: CTT
gagtagaaattgtgttaaat

SEQ ID NO: 103287 - DNA, 20 bp, Artificial Sequence
  Description of Artificial Sequence: Synthetic oligonucleotide
  Target: SCN9A; (+) strand; PAM type: YTN; PAM sequence: TTG
agtagaaattgtgttaaata

SEQ ID NO: 103288 - DNA, 20 bp, Artificial Sequence
  Description of Artificial Sequence: Synthetic oligonucleotide
  Target: SCN9A; (+) strand; PAM type: YTN; PAM sequence: TTG
tgttaaatatatgtatcata

SEQ ID NO: 103289 - DNA, 20 bp, Artificial Sequence
  Description of Artificial Sequence: Synthetic oligonucleotide
  Target: SCN9A; (+) strand; PAM type: YTN; PAM sequence: TTA
aatatatgtatcatattaga

SEQ ID NO: 103290 - DNA, 20 bp, Artificial Sequence
  Description of Artificial Sequence: Synthetic oligonucleotide
  Target: SCN9A; (+) strand; PAM type: YTN; PAM sequence: TTA
gaacatgtcctaagttgttc

SEQ ID NO: 103291 - DNA, 20 bp, Artificial Sequence
  Description of Artificial Sequence: Synthetic oligonucleotide
  Target: SCN9A; (+) strand; PAM type: YTN; PAM sequence: CTA
agttgttcacttacaaattt

SEQ ID NO: 103292 - DNA, 20 bp, Artificial Sequence
  Description of Artificial Sequence: Synthetic oligonucleotide
  Target: SCN9A; (+) strand; PAM type: YTN; PAM sequence: TTG
ttcacttacaaatttatcac

SEQ ID NO: 103293 - DNA, 20 bp, Artificial Sequence
  Description of Artificial Sequence: Synthetic oligonucleotide
  Target: SCN9A; (+) strand; PAM type: YTN; PAM sequence: TTC
acttacaaatttatcactgg

SEQ ID NO: 103294 - DNA, 20 bp, Artificial Sequence
  Description of Artificial Sequence: Synthetic oligonucleotide
  Target: SCN9A; (+) strand; PAM type: YTN; PAM sequence: CTT
acaaatttatcactggcatt

SEQ ID NO: 103295 - DNA, 20 bp, Artificial Sequence
  Description of Artificial Sequence: Synthetic oligonucleotide
  Target: SCN9A; (+) strand; PAM type: YTN; PAM sequence: TTA
caaatttatcactggcattt

SEQ ID NO: 103296 - DNA, 20 bp, Artificial Sequence
  Description of Artificial Sequence: Synthetic oligonucleotide
  Target: SCN9A; (+) strand; PAM type: YTN; PAM sequence: TTT
atcactggcatttcctaaga

SEQ ID NO: 103297 - DNA, 20 bp, Artificial Sequence
  Description of Artificial Sequence: Synthetic oligonucleotide
  Target: SCN9A; (+) strand; PAM type: YTN; PAM sequence: TTA
tcactggcatttcctaagat

SEQ ID NO: 103298 - DNA, 20 bp, Artificial Sequence
  Description of Artificial Sequence: Synthetic oligonucleotide
  Target: SCN9A; (+) strand; PAM type: YTN; PAM sequence: CTG
gcatttcctaagataaacat

SEQ ID NO: 103299 - DNA, 20 bp, Artificial Sequence
  Description of Artificial Sequence: Synthetic oligonucleotide
  Target: SCN9A; (+) strand; PAM type: YTN; PAM sequence: TTT
cctaagataaacattaacga

SEQ ID NO: 103300 - DNA, 20 bp, Artificial Sequence
  Description of Artificial Sequence: Synthetic oligonucleotide
  Target: SCN9A; (+) strand; PAM type: YTN; PAM sequence: TTC
ctaagataaacattaacgat

SEQ ID NO: 103301 - DNA, 20 bp, Artificial Sequence
  Description of Artificial Sequence: Synthetic oligonucleotide
  Target: SCN9A; (+) strand; PAM type: YTN; PAM sequence: CTA
agataaacattaacgatgta

SEQ ID NO: 103302 - DNA, 20 bp, Artificial Sequence
  Description of Artificial Sequence: Synthetic oligonucleotide
  Target: SCN9A; (+) strand; PAM type: YTN; PAM sequence: TTA
acgatgtaagcctatttcat

SEQ ID NO: 103303 - DNA, 20 bp, Artificial Sequence
  Description of Artificial Sequence: Synthetic oligonucleotide
  Target: SCN9A; (+) strand; PAM type: YTN; PAM sequence: CTA
tttcatgctatcatggatga

SEQ ID NO: 103304 - DNA, 20 bp, Artificial Sequence
  Description of Artificial Sequence: Synthetic oligonucleotide
  Target: SCN9A; (+) strand; PAM type: YTN; PAM sequence: TTT
catgctatcatggatgatgg

SEQ ID NO: 103305 - DNA, 20 bp, Artificial Sequence
  Description of Artificial Sequence: Synthetic oligonucleotide
  Target: SCN9A; (+) strand; PAM type: YTN; PAM sequence: TTC
atgctatcatggatgatggt

SEQ ID NO: 103306 - DNA, 20 bp, Artificial Sequence
  Description of Artificial Sequence: Synthetic oligonucleotide
  Target: SCN9A; (+) strand; PAM type: YTN; PAM sequence: CTA
tcatggatgatggttaatgc

SEQ ID NO: 103307 - DNA, 20 bp, Artificial Sequence
  Description of Artificial Sequence: Synthetic oligonucleotide
  Target: SCN9A; (+) strand; PAM type: YTN; PAM sequence: TTA
atgctagttatttattgttc

SEQ ID NO: 103308 - DNA, 20 bp, Artificial Sequence
  Description of Artificial Sequence: Synthetic oligonucleotide
  Target: SCN9A; (+) strand; PAM type: YTN; PAM sequence: CTA
gttatttattgttccaagag

SEQ ID NO: 103309 - DNA, 20 bp, Artificial Sequence
  Description of Artificial Sequence: Synthetic oligonucleotide
  Target: SCN9A; (+) strand; PAM type: YTN; PAM sequence: TTA
tttattgttccaagaggtgt

SEQ ID NO: 103310 - DNA, 20 bp, Artificial Sequence
  Description of Artificial Sequence: Synthetic oligonucleotide
  Target: SCN9A; (+) strand; PAM type: YTN; PAM sequence: TTT
attgttccaagaggtgtgag

SEQ ID NO: 103311 - DNA, 20 bp, Artificial Sequence
  Description of Artificial Sequence: Synthetic oligonucleotide
  Target: SCN9A; (+) strand; PAM type: YTN; PAM sequence: TTA
ttgttccaagaggtgtgagg

SEQ ID NO: 103312 - DNA, 20 bp, Artificial Sequence
  Description of Artificial Sequence: Synthetic oligonucleotide
  Target: SCN9A; (+) strand; PAM type: YTN; PAM sequence: TTG
ttccaagaggtgtgaggtag

SEQ ID NO: 103313 - DNA, 20 bp, Artificial Sequence
  Description of Artificial Sequence: Synthetic oligonucleotide
  Target: SCN9A; (+) strand; PAM type: YTN; PAM sequence: TTC
caagaggtgtgaggtaggag

SEQ ID NO: 103314 - DNA, 20 bp, Artificial Sequence
  Description of Artificial Sequence: Synthetic oligonucleotide
  Target: SCN9A; (+) strand; PAM type: YTN; PAM sequence: CTA
atgacttgataatctaacgc

SEQ ID NO: 103315 - DNA, 20 bp, Artificial Sequence
  Description of Artificial Sequence: Synthetic oligonucleotide
  Target: SCN9A; (+) strand; PAM type: YTN; PAM sequence: CTT
gataatctaacgctcaaaag

SEQ ID NO: 103316 - DNA, 20 bp, Artificial Sequence
  Description of Artificial Sequence: Synthetic oligonucleotide
  Target: SCN9A; (+) strand; PAM type: YTN; PAM sequence: TTG
ataatctaacgctcaaaaga

SEQ ID NO: 103317 - DNA, 20 bp, Artificial Sequence
  Description of Artificial Sequence: Synthetic oligonucleotide
  Target: SCN9A; (+) strand; PAM type: YTN; PAM sequence: CTA
acgctcaaaagaagaaacta

SEQ ID NO: 103318 - DNA, 20 bp, Artificial Sequence
  Description of Artificial Sequence: Synthetic oligonucleotide
  Target: SCN9A; (+) strand; PAM type: YTN; PAM sequence: CTC
aaaagaagaaactatcaaac

SEQ ID NO: 103319 - DNA, 20 bp, Artificial Sequence
  Description of Artificial Sequence: Synthetic oligonucleotide
  Target: SCN9A; (+) strand; PAM type: YTN; PAM sequence: CTA
tcaaacacagcagcactgta

SEQ ID NO: 103320 - DNA, 20 bp, Artificial Sequence
  Description of Artificial Sequence: Synthetic oligonucleotide
  Target: SCN9A; (+) strand; PAM type: YTN; PAM sequence: CTG
tacaaaacacagaactcaac

SEQ ID NO: 103321 - DNA, 20 bp, Artificial Sequence
  Description of Artificial Sequence: Synthetic oligonucleotide
  Target: SCN9A; (+) strand; PAM type: YTN; PAM sequence: CTC
aacaaaaaccttactcaaag

SEQ ID NO: 103322 - DNA, 20 bp, Artificial Sequence
  Description of Artificial Sequence: Synthetic oligonucleotide
  Target: SCN9A; (+) strand; PAM type: YTN; PAM sequence: CTT
actcaaagagaatgattgat

SEQ ID NO: 103323 - DNA, 20 bp, Artificial Sequence
  Description of Artificial Sequence: Synthetic oligonucleotide
  Target: SCN9A; (+) strand; PAM type: YTN; PAM sequence: TTA
ctcaaagagaatgattgatg

SEQ ID NO: 103324 - DNA, 20 bp, Artificial Sequence
  Description of Artificial Sequence: Synthetic oligonucleotide
  Target: SCN9A; (+) strand; PAM type: YTN; PAM sequence: CTC
aaagagaatgattgatgctg

SEQ ID NO: 103325 - DNA, 20 bp, Artificial Sequence
  Description of Artificial Sequence: Synthetic oligonucleotide
  Target: SCN9A; (+) strand; PAM type: YTN; PAM sequence: TTG
atgctgaaaagaactgaaaa

SEQ ID NO: 103326 - DNA, 20 bp, Artificial Sequence
  Description of Artificial Sequence: Synthetic oligonucleotide
  Target: SCN9A; (+) strand; PAM type: YTN; PAM sequence: CTG
aaaagaactgaaaaatgtta

SEQ ID NO: 103327 - DNA, 20 bp, Artificial Sequence
  Description of Artificial Sequence: Synthetic oligonucleotide
  Target: SCN9A; (+) strand; PAM type: YTN; PAM sequence: CTG
aaaaatgttacatttcaagt

SEQ ID NO: 103328 - DNA, 20 bp, Artificial Sequence
  Description of Artificial Sequence: Synthetic oligonucleotide
  Target: SCN9A; (+) strand; PAM type: YTN; PAM sequence: TTA
catttcaagtacatactata

SEQ ID NO: 103329 - DNA, 20 bp, Artificial Sequence
  Description of Artificial Sequence: Synthetic oligonucleotide
  Target: SCN9A; (+) strand; PAM type: YTN; PAM sequence: TTT
caagtacatactataaactg

SEQ ID NO: 103330 - DNA, 20 bp, Artificial Sequence
  Description of Artificial Sequence: Synthetic oligonucleotide
  Target: SCN9A; (+) strand; PAM type: YTN; PAM sequence: TTC
aagtacatactataaactgt

SEQ ID NO: 103331 - DNA, 20 bp, Artificial Sequence
  Description of Artificial Sequence: Synthetic oligonucleotide
  Target: SCN9A; (+) strand; PAM type: YTN; PAM sequence: CTA
taaactgtttgcttcacaca

SEQ ID NO: 103332 - DNA, 20 bp, Artificial Sequence
  Description of Artificial Sequence: Synthetic oligonucleotide
  Target: SCN9A; (+) strand; PAM type: YTN; PAM sequence: CTG
tttgcttcacacaacaaaaa

SEQ ID NO: 103333 - DNA, 20 bp, Artificial Sequence
  Description of Artificial Sequence: Synthetic oligonucleotide
  Target: SCN9A; (+) strand; PAM type: YTN; PAM sequence: TTT
gcttcacacaacaaaaaaaa

SEQ ID NO: 103334 - DNA, 20 bp, Artificial Sequence
  Description of Artificial Sequence: Synthetic oligonucleotide
  Target: SCN9A; (+) strand; PAM type: YTN; PAM sequence: TTG
cttcacacaacaaaaaaaaa

SEQ ID NO: 103335 - DNA, 20 bp, Artificial Sequence
  Description of Artificial Sequence: Synthetic oligonucleotide
  Target: SCN9A; (+) strand; PAM type: YTN; PAM sequence: CTT
cacacaacaaaaaaaaagat

SEQ ID NO: 103336 - DNA, 20 bp, Artificial Sequence
  Description of Artificial Sequence: Synthetic oligonucleotide
  Target: SCN9A; (+) strand; PAM type: YTN; PAM sequence: TTC
acacaacaaaaaaaaagata

SEQ ID NO: 103337 - DNA, 20 bp, Artificial Sequence
  Description of Artificial Sequence: Synthetic oligonucleotide
  Target: SCN9A; (+) strand; PAM type: YTN; PAM sequence: TTC
tttaaggagcagagcctaga

SEQ ID NO: 103338 - DNA, 20 bp, Artificial Sequence
  Description of Artificial Sequence: Synthetic oligonucleotide
  Target: SCN9A; (+) strand; PAM type: YTN; PAM sequence: CTT
taaggagcagagcctagaat

SEQ ID NO: 103339 - DNA, 20 bp, Artificial Sequence
  Description of Artificial Sequence: Synthetic oligonucleotide
  Target: SCN9A; (+) strand; PAM type: YTN; PAM sequence: TTT
aaggagcagagcctagaatg

SEQ ID NO: 103340 - DNA, 20 bp, Artificial Sequence
  Description of Artificial Sequence: Synthetic oligonucleotide
  Target: SCN9A; (+) strand; PAM type: YTN; PAM sequence: TTA
aggagcagagcctagaatgg

SEQ ID NO: 103341 - DNA, 20 bp, Artificial Sequence
  Description of Artificial Sequence: Synthetic oligonucleotide
  Target: SCN9A; (+) strand; PAM type: YTN; PAM sequence: CTA
gaatggttatttcacctgag

SEQ ID NO: 103342 - DNA, 20 bp, Artificial Sequence
  Description of Artificial Sequence: Synthetic oligonucleotide
  Target: SCN9A; (+) strand; PAM type: YTN; PAM sequence: TTA
tttcacctgagccttaaaat

SEQ ID NO: 103343 - DNA, 20 bp, Artificial Sequence
  Description of Artificial Sequence: Synthetic oligonucleotide
  Target: SCN9A; (+) strand; PAM type: YTN; PAM sequence: TTT
cacctgagccttaaaatact

SEQ ID NO: 103344 - DNA, 20 bp, Artificial Sequence
  Description of Artificial Sequence: Synthetic oligonucleotide
  Target: SCN9A; (+) strand; PAM type: YTN; PAM sequence: TTC
acctgagccttaaaatactc

SEQ ID NO: 103345 - DNA, 20 bp, Artificial Sequence
  Description of Artificial Sequence: Synthetic oligonucleotide
  Target: SCN9A; (+) strand; PAM type: YTN; PAM sequence: CTG
agccttaaaatactcacaaa

SEQ ID NO: 103346 - DNA, 20 bp, Artificial Sequence
  Description of Artificial Sequence: Synthetic oligonucleotide
  Target: SCN9A; (+) strand; PAM type: YTN; PAM sequence: CTT
aaaatactcacaaaagacag

SEQ ID NO: 103347 - DNA, 20 bp, Artificial Sequence
  Description of Artificial Sequence: Synthetic oligonucleotide
  Target: SCN9A; (+) strand; PAM type: YTN; PAM sequence: TTA
aaatactcacaaaagacagt

SEQ ID NO: 103348 - DNA, 20 bp, Artificial Sequence
  Description of Artificial Sequence: Synthetic oligonucleotide
  Target: SCN9A; (+) strand; PAM type: YTN; PAM sequence: CTC
acaaaagacagtaagaaagt

SEQ ID NO: 103349 - DNA, 20 bp, Artificial Sequence
  Description of Artificial Sequence: Synthetic oligonucleotide
  Target: SCN9A; (+) strand; PAM type: YTN; PAM sequence: TTG
agagaagcaaatcaaaagga

SEQ ID NO: 103350 - DNA, 20 bp, Artificial Sequence
  Description of Artificial Sequence: Synthetic oligonucleotide
  Target: SCN9A; (+) strand; PAM type: YTN; PAM sequence: TTA
tggcagacagtggtaaacta

SEQ ID NO: 103351 - DNA, 20 bp, Artificial Sequence
  Description of Artificial Sequence: Synthetic oligonucleotide
  Target: SCN9A; (+) strand; PAM type: YTN; PAM sequence: CTA
agctccattatctgttaata

SEQ ID NO: 103352 - DNA, 20 bp, Artificial Sequence
  Description of Artificial Sequence: Synthetic oligonucleotide
  Target: SCN9A; (+) strand; PAM type: YTN; PAM sequence: CTC
cattatctgttaataagcaa

SEQ ID NO: 103353 - DNA, 20 bp, Artificial Sequence
  Description of Artificial Sequence: Synthetic oligonucleotide
  Target: SCN9A; (+) strand; PAM type: YTN; PAM sequence: TTA
tctgttaataagcaagaaag

SEQ ID NO: 103354 - DNA, 20 bp, Artificial Sequence
  Description of Artificial Sequence: Synthetic oligonucleotide
  Target: SCN9A; (+) strand; PAM type: YTN; PAM sequence: CTG
ttaataagcaagaaagacat

SEQ ID NO: 103355 - DNA, 20 bp, Artificial Sequence
  Description of Artificial Sequence: Synthetic oligonucleotide
  Target: SCN9A; (+) strand; PAM type: YTN; PAM sequence: TTA
ataagcaagaaagacatttt

SEQ ID NO: 103356 - DNA, 20 bp, Artificial Sequence
  Description of Artificial Sequence: Synthetic oligonucleotide
  Target: SCN9A; (+) strand; PAM type: YTN; PAM sequence: TTT
taaaattagtttcaagttac

SEQ ID NO: 103357 - DNA, 20 bp, Artificial Sequence
  Description of Artificial Sequence: Synthetic oligonucleotide
  Target: SCN9A; (+) strand; PAM type: YTN; PAM sequence: TTT
aaaattagtttcaagttact

SEQ ID NO: 103358 - DNA, 20 bp, Artificial Sequence
  Description of Artificial Sequence: Synthetic oligonucleotide
  Target: SCN9A; (+) strand; PAM type: YTN; PAM sequence: TTA
aaattagtttcaagttacta

SEQ ID NO: 103359 - DNA, 20 bp, Artificial Sequence
  Description of Artificial Sequence: Synthetic oligonucleotide
  Target: SCN9A; (+) strand; PAM type: YTN; PAM sequence: TTA
gtttcaagttactattatcc

SEQ ID NO: 103360 - DNA, 20 bp, Artificial Sequence
  Description of Artificial Sequence: Synthetic oligonucleotide
  Target: SCN9A; (+) strand; PAM type: YTN; PAM sequence: TTT
caagttactattatccatct

SEQ ID NO: 103361 - DNA, 20 bp, Artificial Sequence
  Description of Artificial Sequence: Synthetic oligonucleotide
  Target: SCN9A; (+) strand; PAM type: YTN; PAM sequence: TTC
aagttactattatccatctt

SEQ ID NO: 103362 - DNA, 20 bp, Artificial Sequence
  Description of Artificial Sequence: Synthetic oligonucleotide
  Target: SCN9A; (+) strand; PAM type: YTN; PAM sequence: TTA
ctattatccatcttttaatt

SEQ ID NO: 103363 - DNA, 20 bp, Artificial Sequence
  Description of Artificial Sequence: Synthetic oligonucleotide
  Target: SCN9A; (+) strand; PAM type: YTN; PAM sequence: CTA
ttatccatcttttaatttaa

SEQ ID NO: 103364 - DNA, 20 bp, Artificial Sequence
  Description of Artificial Sequence: Synthetic oligonucleotide
  Target: SCN9A; (+) strand; PAM type: YTN; PAM sequence: TTA
tccatcttttaatttaattg

SEQ ID NO: 103365 - DNA, 20 bp, Artificial Sequence
  Description of Artificial Sequence: Synthetic oligonucleotide
  Target: SCN9A; (+) strand; PAM type: YTN; PAM sequence: CTT
ttaatttaattgtgtagttt

SEQ ID NO: 103366 - DNA, 20 bp, Artificial Sequence
  Description of Artificial Sequence: Synthetic oligonucleotide
  Target: SCN9A; (+) strand; PAM type: YTN; PAM sequence: TTT
taatttaattgtgtagtttt

SEQ ID NO: 103367 - DNA, 20 bp, Artificial Sequence
  Description of Artificial Sequence: Synthetic oligonucleotide
  Target: SCN9A; (+) strand; PAM type: YTN; PAM sequence: TTT
aatttaattgtgtagtttta

SEQ ID NO: 103368 - DNA, 20 bp, Artificial Sequence
  Description of Artificial Sequence: Synthetic oligonucleotide
  Target: SCN9A; (+) strand; PAM type: YTN; PAM sequence: TTA
atttaattgtgtagttttac

SEQ ID NO: 103369 - DNA, 20 bp, Artificial Sequence
  Description of Artificial Sequence: Synthetic oligonucleotide
  Target: SCN9A; (+) strand; PAM type: YTN; PAM sequence: TTT
aattgtgtagttttacggtc

SEQ ID NO: 103370 - DNA, 20 bp, Artificial Sequence
  Description of Artificial Sequence: Synthetic oligonucleotide
  Target: SCN9A; (+) strand; PAM type: YTN; PAM sequence: TTA
attgtgtagttttacggtca

SEQ ID NO: 103371 - DNA, 20 bp, Artificial Sequence
  Description of Artificial Sequence: Synthetic oligonucleotide
  Target: SCN9A; (+) strand; PAM type: YTN; PAM sequence: TTG
tgtagttttacggtcaatat

SEQ ID NO: 103372 - DNA, 20 bp, Artificial Sequence
  Description of Artificial Sequence: Synthetic oligonucleotide
  Target: SCN9A; (+) strand; PAM type: YTN; PAM sequence: TTT
tacggtcaatatctataatt

SEQ ID NO: 103373 - DNA, 20 bp, Artificial Sequence
  Description of Artificial Sequence: Synthetic oligonucleotide
  Target: SCN9A; (+) strand; PAM type: YTN; PAM sequence: TTT
acggtcaatatctataattg

SEQ ID NO: 103374 - DNA, 20 bp, Artificial Sequence
  Description of Artificial Sequence: Synthetic oligonucleotide
  Target: SCN9A; (+) strand; PAM type: YTN; PAM sequence: TTA
cggtcaatatctataattgt

SEQ ID NO: 103375 - DNA, 20 bp, Artificial Sequence
  Description of Artificial Sequence: Synthetic oligonucleotide
  Target: SCN9A; (+) strand; PAM type: YTN; PAM sequence: CTA
taattgtgttcttgaatcat

SEQ ID NO: 103376 - DNA, 20 bp, Artificial Sequence
  Description of Artificial Sequence: Synthetic oligonucleotide
  Target: SCN9A; (+) strand; PAM type: YTN; PAM sequence: TTG
tgttcttgaatcattaagga

SEQ ID NO: 103377 - DNA, 20 bp, Artificial Sequence
  Description of Artificial Sequence: Synthetic oligonucleotide
  Target: SCN9A; (+) strand; PAM type: YTN; PAM sequence: TTC
ttgaatcattaaggagtaaa

SEQ ID NO: 103378 - DNA, 20 bp, Artificial Sequence
  Description of Artificial Sequence: Synthetic oligonucleotide
  Target: SCN9A; (+) strand; PAM type: YTN; PAM sequence: CTT
gaatcattaaggagtaaaat

SEQ ID NO: 103379 - DNA, 20 bp, Artificial Sequence
  Description of Artificial Sequence: Synthetic oligonucleotide
  Target: SCN9A; (+) strand; PAM type: YTN; PAM sequence: TTG
aatcattaaggagtaaaata

SEQ ID NO: 103380 - DNA, 20 bp, Artificial Sequence
  Description of Artificial Sequence: Synthetic oligonucleotide
  Target: SCN9A; (+) strand; PAM type: YTN; PAM sequence: TTA
aggagtaaaatagtaaattt

SEQ ID NO: 103381 - DNA, 20 bp, Artificial Sequence
  Description of Artificial Sequence: Synthetic oligonucleotide
  Target: SCN9A; (+) strand; PAM type: YTN; PAM sequence: TTT
caattaaaggatcaaaggat

SEQ ID NO: 103382 - DNA, 20 bp, Artificial Sequence
  Description of Artificial Sequence: Synthetic oligonucleotide
  Target: SCN9A; (+) strand; PAM type: YTN; PAM sequence: TTC
aattaaaggatcaaaggatc

SEQ ID NO: 103383 - DNA, 20 bp, Artificial Sequence
  Description of Artificial Sequence: Synthetic oligonucleotide
  Target: SCN9A; (+) strand; PAM type: YTN; PAM sequence: TTA
aaggatcaaaggatcctttg

SEQ ID NO: 103384 - DNA, 20 bp, Artificial Sequence
  Description of Artificial Sequence: Synthetic oligonucleotide
  Target: SCN9A; (+) strand; PAM type: YTN; PAM sequence: CTT
tgagaagaaatccacacata

SEQ ID NO: 103385 - DNA, 20 bp, Artificial Sequence
  Description of Artificial Sequence: Synthetic oligonucleotide
  Target: SCN9A; (+) strand; PAM type: YTN; PAM sequence: TTT
gagaagaaatccacacatag

SEQ ID NO: 103386 - DNA, 20 bp, Artificial Sequence
  Description of Artificial Sequence: Synthetic oligonucleotide
  Target: SCN9A; (+) strand; PAM type: YTN; PAM sequence: TTG
agaagaaatccacacatagt

SEQ ID NO: 103387 - DNA, 20 bp, Artificial Sequence
  Description of Artificial Sequence: Synthetic oligonucleotide
  Target: SCN9A; (+) strand; PAM type: YTN; PAM sequence: TTA
ctatgtggcataagagtcca

SEQ ID NO: 103388 - DNA, 20 bp, Artificial Sequence
  Description of Artificial Sequence: Synthetic oligonucleotide
  Target: SCN9A; (+) strand; PAM type: YTN; PAM sequence: CTA
tgtggcataagagtccaata

SEQ ID NO: 103389 - DNA, 20 bp, Artificial Sequence
  Description of Artificial Sequence: Synthetic oligonucleotide
  Target: SCN9A; (+) strand; PAM type: YTN; PAM sequence: TTT
tccaagtttcccattatgtt

SEQ ID NO: 103390 - DNA, 20 bp, Artificial Sequence
  Description of Artificial Sequence: Synthetic oligonucleotide
  Target: SCN9A; (+) strand; PAM type: YTN; PAM sequence: TTT
ccaagtttcccattatgtta

SEQ ID NO: 103391 - DNA, 20 bp, Artificial Sequence
  Description of Artificial Sequence: Synthetic oligonucleotide
  Target: SCN9A; (+) strand; PAM type: YTN; PAM sequence: TTC
caagtttcccattatgttac

SEQ ID NO: 103392 - DNA, 20 bp, Artificial Sequence
  Description of Artificial Sequence: Synthetic oligonucleotide
  Target: SCN9A; (+) strand; PAM type: YTN; PAM sequence: TTT
cccattatgttacaggacaa

SEQ ID NO: 103393 - DNA, 20 bp, Artificial Sequence
  Description of Artificial Sequence: Synthetic oligonucleotide
  Target: SCN9A; (+) strand; PAM type: YTN; PAM sequence: TTC
ccattatgttacaggacaac

SEQ ID NO: 103394 - DNA, 20 bp, Artificial Sequence
  Description of Artificial Sequence: Synthetic oligonucleotide
  Target: SCN9A; (+) strand; PAM type: YTN; PAM sequence: TTA
tgttacaggacaactagatg

SEQ ID NO: 103395 - DNA, 20 bp, Artificial Sequence
  Description of Artificial Sequence: Synthetic oligonucleotide
  Target: SCN9A; (+) strand; PAM type: YTN; PAM sequence: TTA
caggacaactagatgtttaa

SEQ ID NO: 103396 - DNA, 20 bp, Artificial Sequence
  Description of Artificial Sequence: Synthetic oligonucleotide
  Target: SCN9A; (+) strand; PAM type: YTN; PAM sequence: CTA
gatgtttaaatactctcttc

SEQ ID NO: 103397 - DNA, 20 bp, Artificial Sequence
  Description of Artificial Sequence: Synthetic oligonucleotide
  Target: SCN9A; (+) strand; PAM type: YTN; PAM sequence: TTT
aaatactctcttctggtgta

SEQ ID NO: 103398 - DNA, 20 bp, Artificial Sequence
  Description of Artificial Sequence: Synthetic oligonucleotide
  Target: SCN9A; (+) strand; PAM type: YTN; PAM sequence: TTA
aatactctcttctggtgtag

SEQ ID NO: 103399 - DNA, 20 bp, Artificial Sequence
  Description of Artificial Sequence: Synthetic oligonucleotide
  Target: SCN9A; (+) strand; PAM type: YTN; PAM sequence: CTC
tcttctggtgtagaacaaaa

SEQ ID NO: 103400 - DNA, 20 bp, Artificial Sequence
  Description of Artificial Sequence: Synthetic oligonucleotide
  Target: SCN9A; (+) strand; PAM type: YTN; PAM sequence: CTC
ttctggtgtagaacaaaaat

SEQ ID NO: 103401 - DNA, 20 bp, Artificial Sequence
  Description of Artificial Sequence: Synthetic oligonucleotide
  Target: SCN9A; (+) strand; PAM type: YTN; PAM sequence: CTT
ctggtgtagaacaaaaataa

SEQ ID NO: 103402 - DNA, 20 bp, Artificial Sequence
  Description of Artificial Sequence: Synthetic oligonucleotide
  Target: SCN9A; (+) strand; PAM type: YTN; PAM sequence: TTC
tggtgtagaacaaaaataac

SEQ ID NO: 103403 - DNA, 20 bp, Artificial Sequence
  Description of Artificial Sequence: Synthetic oligonucleotide
  Target: SCN9A; (+) strand; PAM type: YTN; PAM sequence: CTG
gtgtagaacaaaaataacct

SEQ ID NO: 103404 - DNA, 20 bp, Artificial Sequence
  Description of Artificial Sequence: Synthetic oligonucleotide
  Target: SCN9A; (+) strand; PAM type: YTN; PAM sequence: CTT
tcttctctcttgcaatcatt

SEQ ID NO: 103405 - DNA, 20 bp, Artificial Sequence
  Description of Artificial Sequence: Synthetic oligonucleotide
  Target: SCN9A; (+) strand; PAM type: YTN; PAM sequence: TTT
cttctctcttgcaatcattc

SEQ ID NO: 103406 - DNA, 20 bp, Artificial Sequence
  Description of Artificial Sequence: Synthetic oligonucleotide
  Target: SCN9A; (+) strand; PAM type: YTN; PAM sequence: TTC
ttctctcttgcaatcattca

SEQ ID NO: 103407 - DNA, 20 bp, Artificial Sequence
  Description of Artificial Sequence: Synthetic oligonucleotide
  Target: SCN9A; (+) strand; PAM type: YTN; PAM sequence: CTT
ctctcttgcaatcattcagg

SEQ ID NO: 103408 - DNA, 20 bp, Artificial Sequence
  Description of Artificial Sequence: Synthetic oligonucleotide
  Target: SCN9A; (+) strand; PAM type: YTN; PAM sequence: TTC
tctcttgcaatcattcaggg

SEQ ID NO: 103409 - DNA, 20 bp, Artificial Sequence
  Description of Artificial Sequence: Synthetic oligonucleotide
  Target: SCN9A; (+) strand; PAM type: YTN; PAM sequence: CTC
tcttgcaatcattcagggcc

SEQ ID NO: 103410 - DNA, 20 bp, Artificial Sequence
  Description of Artificial Sequence: Synthetic oligonucleotide
  Target: SCN9A; (+) strand; PAM type: YTN; PAM sequence: CTC
ttgcaatcattcagggcctt

SEQ ID NO: 103411 - DNA, 20 bp, Artificial Sequence
  Description of Artificial Sequence: Synthetic oligonucleotide
  Target: SCN9A; (+) strand; PAM type: YTN; PAM sequence: CTT
gcaatcattcagggccttta

SEQ ID NO: 103412 - DNA, 20 bp, Artificial Sequence
  Description of Artificial Sequence: Synthetic oligonucleotide
  Target: SCN9A; (+) strand; PAM type: YTN; PAM sequence: TTG
caatcattcagggcctttat

SEQ ID NO: 103413 - DNA, 20 bp, Artificial Sequence
  Description of Artificial Sequence: Synthetic oligonucleotide
  Target: SCN9A; (+) strand; PAM type: YTN; PAM sequence: TTC
agggcctttatttttttcct

SEQ ID NO: 103414 - DNA, 20 bp, Artificial Sequence
  Description of Artificial Sequence: Synthetic oligonucleotide
  Target: SCN9A; (+) strand; PAM type: YTN; PAM sequence: CTT
tatttttttccttctggaga

SEQ ID NO: 103415 - DNA, 20 bp, Artificial Sequence
  Description of Artificial Sequence: Synthetic oligonucleotide
  Target: SCN9A; (+) strand; PAM type: YTN; PAM sequence: TTT
atttttttccttctggagaa

SEQ ID NO: 103416 - DNA, 20 bp, Artificial Sequence
  Description of Artificial Sequence: Synthetic oligonucleotide
  Target: SCN9A; (+) strand; PAM type: YTN; PAM sequence: TTA
tttttttccttctggagaaa

SEQ ID NO: 103417 - DNA, 20 bp, Artificial Sequence
  Description of Artificial Sequence: Synthetic oligonucleotide
  Target: SCN9A; (+) strand; PAM type: YTN; PAM sequence: TTT
ttttccttctggagaaatgt

SEQ ID NO: 103418 - DNA, 20 bp, Artificial Sequence
  Description of Artificial Sequence: Synthetic oligonucleotide
  Target: SCN9A; (+) strand; PAM type: YTN; PAM sequence: TTT
tttccttctggagaaatgtg

SEQ ID NO: 103419 - DNA, 20 bp, Artificial Sequence
  Description of Artificial Sequence: Synthetic oligonucleotide
  Target: SCN9A; (+) strand; PAM type: YTN; PAM sequence: TTT
ttccttctggagaaatgtga

SEQ ID NO: 103420 - DNA, 20 bp, Artificial Sequence
  Description of Artificial Sequence: Synthetic oligonucleotide
  Target: SCN9A; (+) strand; PAM type: YTN; PAM sequence: TTT
tccttctggagaaatgtgaa

SEQ ID NO: 103421 - DNA, 20 bp, Artificial Sequence
  Description of Artificial Sequence: Synthetic oligonucleotide
  Target: SCN9A; (+) strand; PAM type: YTN; PAM sequence: TTT
ccttctggagaaatgtgaac

SEQ ID NO: 103422 - DNA, 20 bp, Artificial Sequence
  Description of Artificial Sequence: Synthetic oligonucleotide
  Target: SCN9A; (+) strand; PAM type: YTN; PAM sequence: TTC
cttctggagaaatgtgaaca

SEQ ID NO: 103423 - DNA, 20 bp, Artificial Sequence
  Description of Artificial Sequence: Synthetic oligonucleotide
  Target: SCN9A; (+) strand; PAM type: YTN; PAM sequence: CTT
ctggagaaatgtgaacatta

SEQ ID NO: 103424 - DNA, 20 bp, Artificial Sequence
  Description of Artificial Sequence: Synthetic oligonucleotide
  Target: SCN9A; (+) strand; PAM type: YTN; PAM sequence: TTC
tggagaaatgtgaacattat

SEQ ID NO: 103425 - DNA, 20 bp, Artificial Sequence
  Description of Artificial Sequence: Synthetic oligonucleotide
  Target: SCN9A; (+) strand; PAM type: YTN; PAM sequence: CTG
gagaaatgtgaacattatcc

SEQ ID NO: 103426 - DNA, 20 bp, Artificial Sequence
  Description of Artificial Sequence: Synthetic oligonucleotide
  Target: SCN9A; (+) strand; PAM type: YTN; PAM sequence: TTA
tcctcttatagagtttttaa

SEQ ID NO: 103427 - DNA, 20 bp, Artificial Sequence
  Description of Artificial Sequence: Synthetic oligonucleotide
  Target: SCN9A; (+) strand; PAM type: YTN; PAM sequence: CTC
ttatagagtttttaaaattg

SEQ ID NO: 103428 - DNA, 20 bp, Artificial Sequence
  Description of Artificial Sequence: Synthetic oligonucleotide
  Target: SCN9A; (+) strand; PAM type: YTN; PAM sequence: CTT
atagagtttttaaaattgga

SEQ ID NO: 103429 - DNA, 20 bp, Artificial Sequence
  Description of Artificial Sequence: Synthetic oligonucleotide
  Target: SCN9A; (+) strand; PAM type: YTN; PAM sequence: TTA
tagagtttttaaaattggag

SEQ ID NO: 103430 - DNA, 20 bp, Artificial Sequence
  Description of Artificial Sequence: Synthetic oligonucleotide
  Target: SCN9A; (+) strand; PAM type: YTN; PAM sequence: TTT
ttaaaattggaggtcattaa

SEQ ID NO: 103431 - DNA, 20 bp, Artificial Sequence
  Description of Artificial Sequence: Synthetic oligonucleotide
  Target: SCN9A; (+) strand; PAM type: YTN; PAM sequence: TTT
taaaattggaggtcattaat

SEQ ID NO: 103432 - DNA, 20 bp, Artificial Sequence
  Description of Artificial Sequence: Synthetic oligonucleotide
  Target: SCN9A; (+) strand; PAM type: YTN; PAM sequence: TTT
aaaattggaggtcattaata

SEQ ID NO: 103433 - DNA, 20 bp, Artificial Sequence
  Description of Artificial Sequence: Synthetic oligonucleotide
  Target: SCN9A; (+) strand; PAM type: YTN; PAM sequence: TTA
aaattggaggtcattaatat

SEQ ID NO: 103434 - DNA, 20 bp, Artificial Sequence
  Description of Artificial Sequence: Synthetic oligonucleotide
  Target: SCN9A; (+) strand; PAM type: YTN; PAM sequence: TTG
gaggtcattaatattattga

SEQ ID NO: 103435 - DNA, 20 bp, Artificial Sequence
  Description of Artificial Sequence: Synthetic oligonucleotide
  Target: SCN9A; (+) strand; PAM type: YTN; PAM sequence: TTA
atattattgatattactatt

SEQ ID NO: 103436 - DNA, 20 bp, Artificial Sequence
  Description of Artificial Sequence: Synthetic oligonucleotide
  Target: SCN9A; (+) strand; PAM type: YTN; PAM sequence: TTA
ttgatattactattagtgct

SEQ ID NO: 103437 - DNA, 20 bp, Artificial Sequence
  Description of Artificial Sequence: Synthetic oligonucleotide
  Target: SCN9A; (+) strand; PAM type: YTN; PAM sequence: TTG
atattactattagtgctttt

SEQ ID NO: 103438 - DNA, 20 bp, Artificial Sequence
  Description of Artificial Sequence: Synthetic oligonucleotide
  Target: SCN9A; (+) strand; PAM type: YTN; PAM sequence: TTA
ctattagtgcttttcatctt

SEQ ID NO: 103439 - DNA, 20 bp, Artificial Sequence
  Description of Artificial Sequence: Synthetic oligonucleotide
  Target: SCN9A; (+) strand; PAM type: YTN; PAM sequence: CTA
ttagtgcttttcatcttgag

SEQ ID NO: 103440 - DNA, 20 bp, Artificial Sequence
  Description of Artificial Sequence: Synthetic oligonucleotide
  Target: SCN9A; (+) strand; PAM type: YTN; PAM sequence: TTA
gtgcttttcatcttgagtgt

SEQ ID NO: 103441 - DNA, 20 bp, Artificial Sequence
  Description of Artificial Sequence: Synthetic oligonucleotide
  Target: SCN9A; (+) strand; PAM type: YTN; PAM sequence: CTT
ttcatcttgagtgtaatcac

SEQ ID NO: 103442 - DNA, 20 bp, Artificial Sequence
  Description of Artificial Sequence: Synthetic oligonucleotide
  Target: SCN9A; (+) strand; PAM type: YTN; PAM sequence: TTT
tcatcttgagtgtaatcaca

SEQ ID NO: 103443 - DNA, 20 bp, Artificial Sequence
  Description of Artificial Sequence: Synthetic oligonucleotide
  Target: SCN9A; (+) strand; PAM type: YTN; PAM sequence: TTT
catcttgagtgtaatcacat

SEQ ID NO: 103444 - DNA, 20 bp, Artificial Sequence
  Description of Artificial Sequence: Synthetic oligonucleotide
  Target: SCN9A; (+) strand; PAM type: YTN; PAM sequence: TTC
atcttgagtgtaatcacatt

SEQ ID NO: 103445 - DNA, 20 bp, Artificial Sequence
  Description of Artificial Sequence: Synthetic oligonucleotide
  Target: SCN9A; (+) strand; PAM type: YTN; PAM sequence: CTT
gagtgtaatcacatttctta

SEQ ID NO: 103446 - DNA, 20 bp, Artificial Sequence
  Description of Artificial Sequence: Synthetic oligonucleotide
  Target: SCN9A; (+) strand; PAM type: YTN; PAM sequence: TTG
agtgtaatcacatttcttaa

SEQ ID NO: 103447 - DNA, 20 bp, Artificial Sequence
  Description of Artificial Sequence: Synthetic oligonucleotide
  Target: SCN9A; (+) strand; PAM type: YTN; PAM sequence: TTT
cttaacatgatttagatttc

SEQ ID NO: 103448 - DNA, 20 bp, Artificial Sequence
  Description of Artificial Sequence: Synthetic oligonucleotide
  Target: SCN9A; (+) strand; PAM type: YTN; PAM sequence: TTC
ttaacatgatttagatttct

SEQ ID NO: 103449 - DNA, 20 bp, Artificial Sequence
  Description of Artificial Sequence: Synthetic oligonucleotide
  Target: SCN9A; (+) strand; PAM type: YTN; PAM sequence: CTT
aacatgatttagatttctgg

SEQ ID NO: 103450 - DNA, 20 bp, Artificial Sequence
  Description of Artificial Sequence: Synthetic oligonucleotide
  Target: SCN9A; (+) strand; PAM type: YTN; PAM sequence: TTA
acatgatttagatttctggg

SEQ ID NO: 103451 - DNA, 20 bp, Artificial Sequence
  Description of Artificial Sequence: Synthetic oligonucleotide
  Target: SCN9A; (+) strand; PAM type: YTN; PAM sequence: TTT
agatttctgggccccttgag

SEQ ID NO: 103452 - DNA, 20 bp, Artificial Sequence
  Description of Artificial Sequence: Synthetic oligonucleotide
  Target: SCN9A; (+) strand; PAM type: YTN; PAM sequence: TTA
gatttctgggccccttgagg

SEQ ID NO: 103453 - DNA, 20 bp, Artificial Sequence
  Description of Artificial Sequence: Synthetic oligonucleotide
  Target: SCN9A; (+) strand; PAM type: YTN; PAM sequence: TTT
ctgggccccttgaggtctct

SEQ ID NO: 103454 - DNA, 20 bp, Artificial Sequence
  Description of Artificial Sequence: Synthetic oligonucleotide
  Target: SCN9A; (+) strand; PAM type: YTN; PAM sequence: TTC
tgggccccttgaggtctcta

SEQ ID NO: 103455 - DNA, 20 bp, Artificial Sequence
  Description of Artificial Sequence: Synthetic oligonucleotide
  Target: SCN9A; (+) strand; PAM type: YTN; PAM sequence: CTG
ggccccttgaggtctctaca

SEQ ID NO: 103456 - DNA, 20 bp, Artificial Sequence
  Description of Artificial Sequence: Synthetic oligonucleotide
  Target: SCN9A; (+) strand; PAM type: YTN; PAM sequence: CTT
gaggtctctacaatcttttt

SEQ ID NO: 103457 - DNA, 20 bp, Artificial Sequence
  Description of Artificial Sequence: Synthetic oligonucleotide
  Target: SCN9A; (+) strand; PAM type: YTN; PAM sequence: TTG
aggtctctacaatctttttt

SEQ ID NO: 103458 - DNA, 20 bp, Artificial Sequence
  Description of Artificial Sequence: Synthetic oligonucleotide
  Target: SCN9A; (+) strand; PAM type: YTN; PAM sequence: CTC
tacaatcttttttttttgat

SEQ ID NO: 103459 - DNA, 20 bp, Artificial Sequence
  Description of Artificial Sequence: Synthetic oligonucleotide
  Target: SCN9A; (+) strand; PAM type: YTN; PAM sequence: CTA
caatcttttttttttgatat

SEQ ID NO: 103460 - DNA, 20 bp, Artificial Sequence
  Description of Artificial Sequence: Synthetic oligonucleotide
  Target: SCN9A; (+) strand; PAM type: YTN; PAM sequence: CTT
ttttttttgatatgaaattt

SEQ ID NO: 103461 - DNA, 20 bp, Artificial Sequence
  Description of Artificial Sequence: Synthetic oligonucleotide
  Target: SCN9A; (+) strand; PAM type: YTN; PAM sequence: TTT
tttttttgatatgaaatttc

SEQ ID NO: 103462 - DNA, 20 bp, Artificial Sequence
  Description of Artificial Sequence: Synthetic oligonucleotide
  Target: SCN9A; (+) strand; PAM type: YTN; PAM sequence: TTT
ttttttgatatgaaatttct

SEQ ID NO: 103463 - DNA, 20 bp, Artificial Sequence
  Description of Artificial Sequence: Synthetic oligonucleotide
  Target: SCN9A; (+) strand; PAM type: YTN; PAM sequence: TTT
tttttgatatgaaatttctc

SEQ ID NO: 103464 - DNA, 20 bp, Artificial Sequence
  Description of Artificial Sequence: Synthetic oligonucleotide
  Target: SCN9A; (+) strand; PAM type: YTN; PAM sequence: TTT
ttttgatatgaaatttctca

SEQ ID NO: 103465 - DNA, 20 bp, Artificial Sequence
  Description of Artificial Sequence: Synthetic oligonucleotide
  Target: SCN9A; (+) strand; PAM type: YTN; PAM sequence: TTT
tttgatatgaaatttctcaa

SEQ ID NO: 103466 - DNA, 20 bp, Artificial Sequence
  Description of Artificial Sequence: Synthetic oligonucleotide
  Target: SCN9A; (+) strand; PAM type: YTN; PAM sequence: TTT
ttgatatgaaatttctcaag

SEQ ID NO: 103467 - DNA, 20 bp, Artificial Sequence
  Description of Artificial Sequence: Synthetic oligonucleotide
  Target: SCN9A; (+) strand; PAM type: YTN; PAM sequence: TTT
tgatatgaaatttctcaaga

SEQ ID NO: 103468 - DNA, 20 bp, Artificial Sequence
  Description of Artificial Sequence: Synthetic oligonucleotide
  Target: SCN9A; (+) strand; PAM type: YTN; PAM sequence: TTT
gatatgaaatttctcaagat

SEQ ID NO: 103469 - DNA, 20 bp, Artificial Sequence
  Description of Artificial Sequence: Synthetic oligonucleotide
  Target: SCN9A; (+) strand; PAM type: YTN; PAM sequence: TTG
atatgaaatttctcaagatt

SEQ ID NO: 103470 - DNA, 20 bp, Artificial Sequence
  Description of Artificial Sequence: Synthetic oligonucleotide
  Target: SCN9A; (+) strand; PAM type: YTN; PAM sequence: TTT
ctcaagattctttttaaaag

SEQ ID NO: 103471 - DNA, 20 bp, Artificial Sequence
  Description of Artificial Sequence: Synthetic oligonucleotide
  Target: SCN9A; (+) strand; PAM type: YTN; PAM sequence: TTC
tcaagattctttttaaaagg

SEQ ID NO: 103472 - DNA, 20 bp, Artificial Sequence
  Description of Artificial Sequence: Synthetic oligonucleotide
  Target: SCN9A; (+) strand; PAM type: YTN; PAM sequence: CTC
aagattctttttaaaaggta

SEQ ID NO: 103473 - DNA, 20 bp, Artificial Sequence
  Description of Artificial Sequence: Synthetic oligonucleotide
  Target: SCN9A; (+) strand; PAM type: YTN; PAM sequence: TTC
tttttaaaaggtaatgcctc

SEQ ID NO: 103474 - DNA, 20 bp, Artificial Sequence
  Description of Artificial Sequence: Synthetic oligonucleotide
  Target: SCN9A; (+) strand; PAM type: YTN; PAM sequence: CTT
tttaaaaggtaatgcctcaa

SEQ ID NO: 103475 - DNA, 20 bp, Artificial Sequence
  Description of Artificial Sequence: Synthetic oligonucleotide
  Target: SCN9A; (+) strand; PAM type: YTN; PAM sequence: TTT
ttaaaaggtaatgcctcaag

SEQ ID NO: 103476 - DNA, 20 bp, Artificial Sequence
  Description of Artificial Sequence: Synthetic oligonucleotide
  Target: SCN9A; (+) strand; PAM type: YTN; PAM sequence: TTT
taaaaggtaatgcctcaagt

SEQ ID NO: 103477 - DNA, 20 bp, Artificial Sequence
  Description of Artificial Sequence: Synthetic oligonucleotide
  Target: SCN9A; (+) strand; PAM type: YTN; PAM sequence: TTT
aaaaggtaatgcctcaagtt

SEQ ID NO: 103478 - DNA, 20 bp, Artificial Sequence
  Description of Artificial Sequence: Synthetic oligonucleotide
  Target: SCN9A; (+) strand; PAM type: YTN; PAM sequence: TTA
aaaggtaatgcctcaagtta

SEQ ID NO: 103479 - DNA, 20 bp, Artificial Sequence
  Description of Artificial Sequence: Synthetic oligonucleotide
  Target: SCN9A; (+) strand; PAM type: YTN; PAM sequence: CTC
aagttaaaaaatcactgaag

SEQ ID NO: 103480 - DNA, 20 bp, Artificial Sequence
  Description of Artificial Sequence: Synthetic oligonucleotide
  Target: SCN9A; (+) strand; PAM type: YTN; PAM sequence: TTA
aaaaatcactgaagctcagg

SEQ ID NO: 103481 - DNA, 20 bp, Artificial Sequence
  Description of Artificial Sequence: Synthetic oligonucleotide
  Target: SCN9A; (+) strand; PAM type: YTN; PAM sequence: CTG
aagctcaggaatttcaggaa

SEQ ID NO: 103482 - DNA, 20 bp, Artificial Sequence
  Description of Artificial Sequence: Synthetic oligonucleotide
  Target: SCN9A; (+) strand; PAM type: YTN; PAM sequence: CTC
aggaatttcaggaaaaaaat

SEQ ID NO: 103483 - DNA, 20 bp, Artificial Sequence
  Description of Artificial Sequence: Synthetic oligonucleotide
  Target: SCN9A; (+) strand; PAM type: YTN; PAM sequence: TTT
caggaaaaaaatggaaataa

SEQ ID NO: 103484 - DNA, 20 bp, Artificial Sequence
  Description of Artificial Sequence: Synthetic oligonucleotide
  Target: SCN9A; (+) strand; PAM type: YTN; PAM sequence: TTC
aggaaaaaaatggaaataat

SEQ ID NO: 103485 - DNA, 20 bp, Artificial Sequence
  Description of Artificial Sequence: Synthetic oligonucleotide
  Target: SCN9A; (+) strand; PAM type: YTN; PAM sequence: TTA
aaaaatactccagatattat

SEQ ID NO: 103486 - DNA, 20 bp, Artificial Sequence
  Description of Artificial Sequence: Synthetic oligonucleotide
  Target: SCN9A; (+) strand; PAM type: YTN; PAM sequence: CTC
cagatattattgatcagtgg

SEQ ID NO: 103487 - DNA, 20 bp, Artificial Sequence
  Description of Artificial Sequence: Synthetic oligonucleotide
  Target: SCN9A; (+) strand; PAM type: YTN; PAM sequence: TTA
ttgatcagtggaaaactcaa

SEQ ID NO: 103488 - DNA, 20 bp, Artificial Sequence
  Description of Artificial Sequence: Synthetic oligonucleotide
  Target: SCN9A; (+) strand; PAM type: YTN; PAM sequence: TTG
atcagtggaaaactcaactg

SEQ ID NO: 103489 - DNA, 20 bp, Artificial Sequence
  Description of Artificial Sequence: Synthetic oligonucleotide
  Target: SCN9A; (+) strand; PAM type: YTN; PAM sequence: CTC
aactgtattttcttctgttg

SEQ ID NO: 103490 - DNA, 20 bp, Artificial Sequence
  Description of Artificial Sequence: Synthetic oligonucleotide
  Target: SCN9A; (+) strand; PAM type: YTN; PAM sequence: CTG
tattttcttctgttgtctaa

SEQ ID NO: 103491 - DNA, 20 bp, Artificial Sequence
  Description of Artificial Sequence: Synthetic oligonucleotide
  Target: SCN9A; (+) strand; PAM type: YTN; PAM sequence: TTT
tcttctgttgtctaagtttt

SEQ ID NO: 103492 - DNA, 20 bp, Artificial Sequence
  Description of Artificial Sequence: Synthetic oligonucleotide
  Target: SCN9A; (+) strand; PAM type: YTN; PAM sequence: TTT
cttctgttgtctaagtttta

SEQ ID NO: 103493 - DNA, 20 bp, Artificial Sequence
  Description of Artificial Sequence: Synthetic oligonucleotide
  Target: SCN9A; (+) strand; PAM type: YTN; PAM sequence: TTC
ttctgttgtctaagttttaa

SEQ ID NO: 103494 - DNA, 20 bp, Artificial Sequence
  Description of Artificial Sequence: Synthetic oligonucleotide
  Target: SCN9A; (+) strand; PAM type: YTN; PAM sequence: CTT
ctgttgtctaagttttaatg

SEQ ID NO: 103495 - DNA, 20 bp, Artificial Sequence
  Description of Artificial Sequence: Synthetic oligonucleotide
  Target: SCN9A; (+) strand; PAM type: YTN; PAM sequence: TTC
tgttgtctaagttttaatgt

SEQ ID NO: 103496 - DNA, 20 bp, Artificial Sequence
  Description of Artificial Sequence: Synthetic oligonucleotide
  Target: SCN9A; (+) strand; PAM type: YTN; PAM sequence: CTG
ttgtctaagttttaatgtta

SEQ ID NO: 103497 - DNA, 20 bp, Artificial Sequence
  Description of Artificial Sequence: Synthetic oligonucleotide
  Target: SCN9A; (+) strand; PAM type: YTN; PAM sequence: TTG
tctaagttttaatgttactt

SEQ ID NO: 103498 - DNA, 20 bp, Artificial Sequence
  Description of Artificial Sequence: Synthetic oligonucleotide
  Target: SCN9A; (+) strand; PAM type: YTN; PAM sequence: CTA
agttttaatgttacttccac

SEQ ID NO: 103499 - DNA, 20 bp, Artificial Sequence
  Description of Artificial Sequence: Synthetic oligonucleotide
  Target: SCN9A; (+) strand; PAM type: YTN; PAM sequence: TTT
taatgttacttccactaatt

SEQ ID NO: 103500 - DNA, 20 bp, Artificial Sequence
  Description of Artificial Sequence: Synthetic oligonucleotide
  Target: SCN9A; (+) strand; PAM type: YTN; PAM sequence: TTT
aatgttacttccactaattt

SEQ ID NO: 103501 - DNA, 20 bp, Artificial Sequence
  Description of Artificial Sequence: Synthetic oligonucleotide
  Target: SCN9A; (+) strand; PAM type: YTN; PAM sequence: TTA
atgttacttccactaattta

SEQ ID NO: 103502 - DNA, 20 bp, Artificial Sequence
  Description of Artificial Sequence: Synthetic oligonucleotide
  Target: SCN9A; (+) strand; PAM type: YTN; PAM sequence: TTA
cttccactaatttagcagaa

SEQ ID NO: 103503 - DNA, 20 bp, Artificial Sequence
  Description of Artificial Sequence: Synthetic oligonucleotide
  Target: SCN9A; (+) strand; PAM type: YTN; PAM sequence: CTT
ccactaatttagcagaaaat

SEQ ID NO: 103504 - DNA, 20 bp, Artificial Sequence
  Description of Artificial Sequence: Synthetic oligonucleotide
  Target: SCN9A; (+) strand; PAM type: YTN; PAM sequence: TTC
cactaatttagcagaaaatt

SEQ ID NO: 103505 - DNA, 20 bp, Artificial Sequence
  Description of Artificial Sequence: Synthetic oligonucleotide
  Target: SCN9A; (+) strand; PAM type: YTN; PAM sequence: CTA
atttagcagaaaattgtcag

SEQ ID NO: 103506 - DNA, 20 bp, Artificial Sequence
  Description of Artificial Sequence: Synthetic oligonucleotide
  Target: SCN9A; (+) strand; PAM type: YTN; PAM sequence: TTT
agcagaaaattgtcagttta

SEQ ID NO: 103507 - DNA, 20 bp, Artificial Sequence
  Description of Artificial Sequence: Synthetic oligonucleotide
  Target: SCN9A; (+) strand; PAM type: YTN; PAM sequence: TTA
gcagaaaattgtcagtttat

SEQ ID NO: 103508 - DNA, 20 bp, Artificial Sequence
  Description of Artificial Sequence: Synthetic oligonucleotide
  Target: SCN9A; (+) strand; PAM type: YTN; PAM sequence: TTG
tcagtttattaactagttgc

SEQ ID NO: 103509 - DNA, 20 bp, Artificial Sequence
  Description of Artificial Sequence: Synthetic oligonucleotide
  Target: SCN9A; (+) strand; PAM type: YTN; PAM sequence: TTT
attaactagttgcaataaat

SEQ ID NO: 103510 - DNA, 20 bp, Artificial Sequence
  Description of Artificial Sequence: Synthetic oligonucleotide
  Target: SCN9A; (+) strand; PAM type: YTN; PAM sequence: TTA
ttaactagttgcaataaatt

SEQ ID NO: 103511 - DNA, 20 bp, Artificial Sequence
  Description of Artificial Sequence: Synthetic oligonucleotide
  Target: SCN9A; (+) strand; PAM type: YTN; PAM sequence: TTA
actagttgcaataaattctg

SEQ ID NO: 103512 - DNA, 20 bp, Artificial Sequence
  Description of Artificial Sequence: Synthetic oligonucleotide
  Target: SCN9A; (+) strand; PAM type: YTN; PAM sequence: CTA
gttgcaataaattctgggct

SEQ ID NO: 103513 - DNA, 20 bp, Artificial Sequence
  Description of Artificial Sequence: Synthetic oligonucleotide
  Target: SCN9A; (+) strand; PAM type: YTN; PAM sequence: TTG
caataaattctgggctcaca

SEQ ID NO: 103514 - DNA, 20 bp, Artificial Sequence
  Description of Artificial Sequence: Synthetic oligonucleotide
  Target: SCN9A; (+) strand; PAM type: YTN; PAM sequence: TTC
tgggctcacattctaattat

SEQ ID NO: 103515 - DNA, 20 bp, Artificial Sequence
  Description of Artificial Sequence: Synthetic oligonucleotide
  Target: SCN9A; (+) strand; PAM type: YTN; PAM sequence: CTG
ggctcacattctaattatgg

SEQ ID NO: 103516 - DNA, 20 bp, Artificial Sequence
  Description of Artificial Sequence: Synthetic oligonucleotide
  Target: SCN9A; (+) strand; PAM type: YTN; PAM sequence: CTC
acattctaattatgggcaac

SEQ ID NO: 103517 - DNA, 20 bp, Artificial Sequence
  Description of Artificial Sequence: Synthetic oligonucleotide
  Target: SCN9A; (+) strand; PAM type: YTN; PAM sequence: TTC
taattatgggcaactaaaac

SEQ ID NO: 103518 - DNA, 20 bp, Artificial Sequence
  Description of Artificial Sequence: Synthetic oligonucleotide
  Target: SCN9A; (+) strand; PAM type: YTN; PAM sequence: CTA
attatgggcaactaaaactt

SEQ ID NO: 103519 - DNA, 20 bp, Artificial Sequence
  Description of Artificial Sequence: Synthetic oligonucleotide
  Target: SCN9A; (+) strand; PAM type: YTN; PAM sequence: TTA
tgggcaactaaaactttagc

SEQ ID NO: 103520 - DNA, 20 bp, Artificial Sequence
  Description of Artificial Sequence: Synthetic oligonucleotide
  Target: SCN9A; (+) strand; PAM type: YTN; PAM sequence: CTA
aaactttagctcttttttta

SEQ ID NO: 103521 - DNA, 20 bp, Artificial Sequence
  Description of Artificial Sequence: Synthetic oligonucleotide
  Target: SCN9A; (+) strand; PAM type: YTN; PAM sequence: CTT
tagctctttttttaaaaaaa

SEQ ID NO: 103522 - DNA, 20 bp, Artificial Sequence
  Description of Artificial Sequence: Synthetic oligonucleotide
  Target: SCN9A; (+) strand; PAM type: YTN; PAM sequence: TTT
agctctttttttaaaaaaag

SEQ ID NO: 103523 - DNA, 20 bp, Artificial Sequence
  Description of Artificial Sequence: Synthetic oligonucleotide
  Target: SCN9A; (+) strand; PAM type: YTN; PAM sequence: TTA
gctctttttttaaaaaaagg

SEQ ID NO: 103524 - DNA, 20 bp, Artificial Sequence
  Description of Artificial Sequence: Synthetic oligonucleotide
  Target: SCN9A; (+) strand; PAM type: YTN; PAM sequence: CTC
tttttttaaaaaaagggcaa

SEQ ID NO: 103525 - DNA, 20 bp, Artificial Sequence
  Description of Artificial Sequence: Synthetic oligonucleotide
  Target: SCN9A; (+) strand; PAM type: YTN; PAM sequence: CTT
tttttaaaaaaagggcaaga

SEQ ID NO: 103526 - DNA, 20 bp, Artificial Sequence
  Description of Artificial Sequence: Synthetic oligonucleotide
  Target: SCN9A; (+) strand; PAM type: YTN; PAM sequence: TTT
ttttaaaaaaagggcaagaa

SEQ ID NO: 103527 - DNA, 20 bp, Artificial Sequence
  Description of Artificial Sequence: Synthetic oligonucleotide
  Target: SCN9A; (+) strand; PAM type: YTN; PAM sequence: TTT
tttaaaaaaagggcaagaaa

SEQ ID NO: 103528 - DNA, 20 bp, Artificial Sequence
  Description of Artificial Sequence: Synthetic oligonucleotide
  Target: SCN9A; (+) strand; PAM type: YTN; PAM sequence: TTT
ttaaaaaaagggcaagaaaa

SEQ ID NO: 103529 - DNA, 20 bp, Artificial Sequence
  Description of Artificial Sequence: Synthetic oligonucleotide
  Target: SCN9A; (+) strand; PAM type: YTN; PAM sequence: TTT
taaaaaaagggcaagaaaac

SEQ ID NO: 103530 - DNA, 20 bp, Artificial Sequence
  Description of Artificial Sequence: Synthetic oligonucleotide
  Target: SCN9A; (+) strand; PAM type: YTN; PAM sequence: TTT
aaaaaaagggcaagaaaacc

SEQ ID NO: 103531 - DNA, 20 bp, Artificial Sequence
  Description of Artificial Sequence: Synthetic oligonucleotide
  Target: SCN9A; (+) strand; PAM type: YTN; PAM sequence: TTA
aaaaaagggcaagaaaacca

SEQ ID NO: 103532 - DNA, 20 bp, Artificial Sequence
  Description of Artificial Sequence: Synthetic oligonucleotide
  Target: SCN9A; (+) strand; PAM type: YTN; PAM sequence: TTT
tttttcctttcctatttttc

SEQ ID NO: 103533 - DNA, 20 bp, Artificial Sequence
  Description of Artificial Sequence: Synthetic oligonucleotide
  Target: SCN9A; (+) strand; PAM type: YTN; PAM sequence: TTT
ttttcctttcctatttttct

SEQ ID NO: 103534 - DNA, 20 bp, Artificial Sequence
  Description of Artificial Sequence: Synthetic oligonucleotide
  Target: SCN9A; (+) strand; PAM type: YTN; PAM sequence: TTT
tttcctttcctatttttctt

SEQ ID NO: 103535 - DNA, 20 bp, Artificial Sequence
  Description of Artificial Sequence: Synthetic oligonucleotide
  Target: SCN9A; (+) strand; PAM type: YTN; PAM sequence: TTT
ttcctttcctatttttcttt

SEQ ID NO: 103536 - DNA, 20 bp, Artificial Sequence
  Description of Artificial Sequence: Synthetic oligonucleotide
  Target: SCN9A; (+) strand; PAM type: YTN; PAM sequence: TTT
tcctttcctatttttctttg

SEQ ID NO: 103537 - DNA, 20 bp, Artificial Sequence
  Description of Artificial Sequence: Synthetic oligonucleotide
  Target: SCN9A; (+) strand; PAM type: YTN; PAM sequence: TTT
cctttcctatttttctttgt

SEQ ID NO: 103538 - DNA, 20 bp, Artificial Sequence
  Description of Artificial Sequence: Synthetic oligonucleotide
  Target: SCN9A; (+) strand; PAM type: YTN; PAM sequence: TTC
ctttcctatttttctttgtc

SEQ ID NO: 103539 - DNA, 20 bp, Artificial Sequence
  Description of Artificial Sequence: Synthetic oligonucleotide
  Target: SCN9A; (+) strand; PAM type: YTN; PAM sequence: CTT
tcctatttttctttgtctat

SEQ ID NO: 103540 - DNA, 20 bp, Artificial Sequence
  Description of Artificial Sequence: Synthetic oligonucleotide
  Target: SCN9A; (+) strand; PAM type: YTN; PAM sequence: TTT
cctatttttctttgtctatt

SEQ ID NO: 103541 - DNA, 20 bp, Artificial Sequence
  Description of Artificial Sequence: Synthetic oligonucleotide
  Target: SCN9A; (+) strand; PAM type: YTN; PAM sequence: TTC
ctatttttctttgtctattg

SEQ ID NO: 103542 - DNA, 20 bp, Artificial Sequence
  Description of Artificial Sequence: Synthetic oligonucleotide
  Target: SCN9A; (+) strand; PAM type: YTN; PAM sequence: CTA
tttttctttgtctattgcta

SEQ ID NO: 103543 - DNA, 20 bp, Artificial Sequence
  Description of Artificial Sequence: Synthetic oligonucleotide
  Target: SCN9A; (+) strand; PAM type: YTN; PAM sequence: TTT
ttctttgtctattgctagca

SEQ ID NO: 103544 - DNA, 20 bp, Artificial Sequence
  Description of Artificial Sequence: Synthetic oligonucleotide
  Target: SCN9A; (+) strand; PAM type: YTN; PAM sequence: TTT
tctttgtctattgctagcag

SEQ ID NO: 103545 - DNA, 20 bp, Artificial Sequence
  Description of Artificial Sequence: Synthetic oligonucleotide
  Target: SCN9A; (+) strand; PAM type: YTN; PAM sequence: TTT
ctttgtctattgctagcaga

SEQ ID NO: 103546 - DNA, 20 bp, Artificial Sequence
  Description of Artificial Sequence: Synthetic oligonucleotide
  Target: SCN9A; (+) strand; PAM type: YTN; PAM sequence: TTC
tttgtctattgctagcagag

SEQ ID NO: 103547 - DNA, 20 bp, Artificial Sequence
  Description of Artificial Sequence: Synthetic oligonucleotide
  Target: SCN9A; (+) strand; PAM type: YTN; PAM sequence: CTT
tgtctattgctagcagagaa

SEQ ID NO: 103548 - DNA, 20 bp, Artificial Sequence
  Description of Artificial Sequence: Synthetic oligonucleotide
  Target: SCN9A; (+) strand; PAM type: YTN; PAM sequence: TTT
gtctattgctagcagagaaa

SEQ ID NO: 103549 - DNA, 20 bp, Artificial Sequence
  Description of Artificial Sequence: Synthetic oligonucleotide
  Target: SCN9A; (+) strand; PAM type: YTN; PAM sequence: TTG
tctattgctagcagagaaat

SEQ ID NO: 103550 - DNA, 20 bp, Artificial Sequence
  Description of Artificial Sequence: Synthetic oligonucleotide
  Target: SCN9A; (+) strand; PAM type: YTN; PAM sequence: CTA
ttgctagcagagaaatattg

SEQ ID NO: 103551 - DNA, 20 bp, Artificial Sequence
  Description of Artificial Sequence: Synthetic oligonucleotide
  Target: SCN9A; (+) strand; PAM type: YTN; PAM sequence: TTG
ctagcagagaaatattgtgt

SEQ ID NO: 103552 - DNA, 20 bp, Artificial Sequence
  Description of Artificial Sequence: Synthetic oligonucleotide
  Target: SCN9A; (+) strand; PAM type: YTN; PAM sequence: CTA
gcagagaaatattgtgtagg

SEQ ID NO: 103553 - DNA, 20 bp, Artificial Sequence
  Description of Artificial Sequence: Synthetic oligonucleotide
  Target: SCN9A; (+) strand; PAM type: YTN; PAM sequence: TTG
tgtaggctctgggaggaata

SEQ ID NO: 103554 - DNA, 20 bp, Artificial Sequence
  Description of Artificial Sequence: Synthetic oligonucleotide
  Target: SCN9A; (+) strand; PAM type: YTN; PAM sequence: CTC
tgggaggaatagctacttat

SEQ ID NO: 103555 - DNA, 20 bp, Artificial Sequence
  Description of Artificial Sequence: Synthetic oligonucleotide
  Target: SCN9A; (+) strand; PAM type: YTN; PAM sequence: CTG
ggaggaatagctacttattc

SEQ ID NO: 103556 - DNA, 20 bp, Artificial Sequence
  Description of Artificial Sequence: Synthetic oligonucleotide
  Target: SCN9A; (+) strand; PAM type: YTN; PAM sequence: CTA
cttattcagcgtgaaacaca

SEQ ID NO: 103557 - DNA, 20 bp, Artificial Sequence
  Description of Artificial Sequence: Synthetic oligonucleotide
  Target: SCN9A; (+) strand; PAM type: YTN; PAM sequence: CTT
attcagcgtgaaacacacag

SEQ ID NO: 103558 - DNA, 20 bp, Artificial Sequence
  Description of Artificial Sequence: Synthetic oligonucleotide
  Target: SCN9A; (+) strand; PAM type: YTN; PAM sequence: TTA
ttcagcgtgaaacacacagt

SEQ ID NO: 103559 - DNA, 20 bp, Artificial Sequence
  Description of Artificial Sequence: Synthetic oligonucleotide
  Target: SCN9A; (+) strand; PAM type: YTN; PAM sequence: TTC
agcgtgaaacacacagttcc

SEQ ID NO: 103560 - DNA, 20 bp, Artificial Sequence
  Description of Artificial Sequence: Synthetic oligonucleotide
  Target: SCN9A; (+) strand; PAM type: YTN; PAM sequence: TTC
catcacaaggtcaacatgat

SEQ ID NO: 103561 - DNA, 20 bp, Artificial Sequence
  Description of Artificial Sequence: Synthetic oligonucleotide
  Target: SCN9A; (+) strand; PAM type: YTN; PAM sequence: TTC
tgttggtgaaataatgaggt

SEQ ID NO: 103562 - DNA, 20 bp, Artificial Sequence
  Description of Artificial Sequence: Synthetic oligonucleotide
  Target: SCN9A; (+) strand; PAM type: YTN; PAM sequence: CTG
ttggtgaaataatgaggtca

SEQ ID NO: 103563 - DNA, 20 bp, Artificial Sequence
  Description of Artificial Sequence: Synthetic oligonucleotide
  Target: SCN9A; (+) strand; PAM type: YTN; PAM sequence: TTG
gtgaaataatgaggtcaaat

SEQ ID NO: 103564 - DNA, 20 bp, Artificial Sequence
  Description of Artificial Sequence: Synthetic oligonucleotide
  Target: SCN9A; (+) strand; PAM type: YTN; PAM sequence: CTC
agccaccaccagagaaattc

SEQ ID NO: 103565 - DNA, 20 bp, Artificial Sequence
  Description of Artificial Sequence: Synthetic oligonucleotide
  Target: SCN9A; (+) strand; PAM type: YTN; PAM sequence: TTC
agaataaaaccagtgatttc

SEQ ID NO: 103566 - DNA, 20 bp, Artificial Sequence
  Description of Artificial Sequence: Synthetic oligonucleotide
  Target: SCN9A; (+) strand; PAM type: YTN; PAM sequence: TTT
cacggagacctcttcttttt

SEQ ID NO: 103567 - DNA, 20 bp, Artificial Sequence
  Description of Artificial Sequence: Synthetic oligonucleotide
  Target: SCN9A; (+) strand; PAM type: YTN; PAM sequence: TTC
acggagacctcttctttttc

SEQ ID NO: 103568 - DNA, 20 bp, Artificial Sequence
  Description of Artificial Sequence: Synthetic oligonucleotide
  Target: SCN9A; (+) strand; PAM type: YTN; PAM sequence: CTC
ttctttttctcagaatcttc

SEQ ID NO: 103569 - DNA, 20 bp, Artificial Sequence
  Description of Artificial Sequence: Synthetic oligonucleotide
  Target: SCN9A; (+) strand; PAM type: YTN; PAM sequence: CTT
ctttttctcagaatcttcta

SEQ ID NO: 103570 - DNA, 20 bp, Artificial Sequence
  Description of Artificial Sequence: Synthetic oligonucleotide
  Target: SCN9A; (+) strand; PAM type: YTN; PAM sequence: TTC
tttttctcagaatcttctac

SEQ ID NO: 103571 - DNA, 20 bp, Artificial Sequence
  Description of Artificial Sequence: Synthetic oligonucleotide
  Target: SCN9A; (+) strand; PAM type: YTN; PAM sequence: CTT
tttctcagaatcttctacct

SEQ ID NO: 103572 - DNA, 20 bp, Artificial Sequence
  Description of Artificial Sequence: Synthetic oligonucleotide
  Target: SCN9A; (+) strand; PAM type: YTN; PAM sequence: TTT
ttctcagaatcttctaccta

SEQ ID NO: 103573 - DNA, 20 bp, Artificial Sequence
  Description of Artificial Sequence: Synthetic oligonucleotide
  Target: SCN9A; (+) strand; PAM type: YTN; PAM sequence: TTT
tctcagaatcttctacctag

SEQ ID NO: 103574 - DNA, 20 bp, Artificial Sequence
  Description of Artificial Sequence: Synthetic oligonucleotide
  Target: SCN9A; (+) strand; PAM type: YTN; PAM sequence: TTT
ctcagaatcttctacctagg

SEQ ID NO: 103575 - DNA, 20 bp, Artificial Sequence
  Description of Artificial Sequence: Synthetic oligonucleotide
  Target: SCN9A; (+) strand; PAM type: YTN; PAM sequence: TTC
tcagaatcttctacctaggg

SEQ ID NO: 103576 - DNA, 20 bp, Artificial Sequence
  Description of Artificial Sequence: Synthetic oligonucleotide
  Target: SCN9A; (+) strand; PAM type: YTN; PAM sequence: CTC
agaatcttctacctagggca

SEQ ID NO: 103577 - DNA, 20 bp, Artificial Sequence
  Description of Artificial Sequence: Synthetic oligonucleotide
  Target: SCN9A; (+) strand; PAM type: YTN; PAM sequence: CTT
ctacctagggcactttctat

SEQ ID NO: 103578 - DNA, 20 bp, Artificial Sequence
  Description of Artificial Sequence: Synthetic oligonucleotide
  Target: SCN9A; (+) strand; PAM type: YTN; PAM sequence: TTC
tacctagggcactttctatc

SEQ ID NO: 103579 - DNA, 20 bp, Artificial Sequence
  Description of Artificial Sequence: Synthetic oligonucleotide
  Target: SCN9A; (+) strand; PAM type: YTN; PAM sequence: CTA
cctagggcactttctatcca

SEQ ID NO: 103580 - DNA, 20 bp, Artificial Sequence
  Description of Artificial Sequence: Synthetic oligonucleotide
  Target: SCN9A; (+) strand; PAM type: YTN; PAM sequence: CTA
gggcactttctatccaataa

SEQ ID NO: 103581 - DNA, 20 bp, Artificial Sequence
  Description of Artificial Sequence: Synthetic oligonucleotide
  Target: SCN9A; (+) strand; PAM type: YTN; PAM sequence: CTT
tctatccaataacatgaaaa

SEQ ID NO: 103582 - DNA, 20 bp, Artificial Sequence
  Description of Artificial Sequence: Synthetic oligonucleotide
  Target: SCN9A; (+) strand; PAM type: YTN; PAM sequence: TTT
ctatccaataacatgaaaac

SEQ ID NO: 103583 - DNA, 20 bp, Artificial Sequence
  Description of Artificial Sequence: Synthetic oligonucleotide
  Target: SCN9A; (+) strand; PAM type: YTN; PAM sequence: TTC
tatccaataacatgaaaact

SEQ ID NO: 103584 - DNA, 20 bp, Artificial Sequence
  Description of Artificial Sequence: Synthetic oligonucleotide
  Target: SCN9A; (+) strand; PAM type: YTN; PAM sequence: CTA
tccaataacatgaaaactta

SEQ ID NO: 103585 - DNA, 20 bp, Artificial Sequence
  Description of Artificial Sequence: Synthetic oligonucleotide
  Target: SCN9A; (+) strand; PAM type: YTN; PAM sequence: CTT
acgtgactaaatgataagat

SEQ ID NO: 103586 - DNA, 20 bp, Artificial Sequence
  Description of Artificial Sequence: Synthetic oligonucleotide
  Target: SCN9A; (+) strand; PAM type: YTN; PAM sequence: TTA
cgtgactaaatgataagata

SEQ ID NO: 103587 - DNA, 20 bp, Artificial Sequence
  Description of Artificial Sequence: Synthetic oligonucleotide
  Target: SCN9A; (+) strand; PAM type: YTN; PAM sequence: CTA
aatgataagatatgaatata

SEQ ID NO: 103588 - DNA, 20 bp, Artificial Sequence
  Description of Artificial Sequence: Synthetic oligonucleotide
  Target: SCN9A; (+) strand; PAM type: YTN; PAM sequence: TTG
gccatgtaagaaggctagac

SEQ ID NO: 103589 - DNA, 20 bp, Artificial Sequence
  Description of Artificial Sequence: Synthetic oligonucleotide
  Target: SCN9A; (+) strand; PAM type: YTN; PAM sequence: CTA
gactggctacagatttctca

SEQ ID NO: 103590 - DNA, 20 bp, Artificial Sequence
  Description of Artificial Sequence: Synthetic oligonucleotide
  Target: SCN9A; (+) strand; PAM type: YTN; PAM sequence: CTG
gctacagatttctcagccag

SEQ ID NO: 103591 - DNA, 20 bp, Artificial Sequence
  Description of Artificial Sequence: Synthetic oligonucleotide
  Target: SCN9A; (+) strand; PAM type: YTN; PAM sequence: CTA
cagatttctcagccaggtcc

SEQ ID NO: 103592 - DNA, 20 bp, Artificial Sequence
  Description of Artificial Sequence: Synthetic oligonucleotide
  Target: SCN9A; (+) strand; PAM type: YTN; PAM sequence: TTT
ctcagccaggtcctatagta

SEQ ID NO: 103593 - DNA, 20 bp, Artificial Sequence
  Description of Artificial Sequence: Synthetic oligonucleotide
  Target: SCN9A; (+) strand; PAM type: YTN; PAM sequence: TTC
tcagccaggtcctatagtat

SEQ ID NO: 103594 - DNA, 20 bp, Artificial Sequence
  Description of Artificial Sequence: Synthetic oligonucleotide
  Target: SCN9A; (+) strand; PAM type: YTN; PAM sequence: CTC
agccaggtcctatagtatca

SEQ ID NO: 103595 - DNA, 20 bp, Artificial Sequence
  Description of Artificial Sequence: Synthetic oligonucleotide
  Target: SCN9A; (+) strand; PAM type: YTN; PAM sequence: CTA
tagtatcatcttgaagcatc

SEQ ID NO: 103596 - DNA, 20 bp, Artificial Sequence
  Description of Artificial Sequence: Synthetic oligonucleotide
  Target: SCN9A; (+) strand; PAM type: YTN; PAM sequence: CTT
gaagcatctttctaatgaaa

SEQ ID NO: 103597 - DNA, 20 bp, Artificial Sequence
  Description of Artificial Sequence: Synthetic oligonucleotide
  Target: SCN9A; (+) strand; PAM type: YTN; PAM sequence: TTG
aagcatctttctaatgaaaa

SEQ ID NO: 103598 - DNA, 20 bp, Artificial Sequence
  Description of Artificial Sequence: Synthetic oligonucleotide
  Target: SCN9A; (+) strand; PAM type: YTN; PAM sequence: CTT
tctaatgaaaagaagagaag

SEQ ID NO: 103599 - DNA, 20 bp, Artificial Sequence
  Description of Artificial Sequence: Synthetic oligonucleotide
  Target: SCN9A; (+) strand; PAM type: YTN; PAM sequence: TTT
ctaatgaaaagaagagaagc

SEQ ID NO: 103600 - DNA, 20 bp, Artificial Sequence
  Description of Artificial Sequence: Synthetic oligonucleotide
  Target: SCN9A; (+) strand; PAM type: YTN; PAM sequence: TTC
taatgaaaagaagagaagca

SEQ ID NO: 103601 - DNA, 20 bp, Artificial Sequence
  Description of Artificial Sequence: Synthetic oligonucleotide
  Target: SCN9A; (+) strand; PAM type: YTN; PAM sequence: CTA
atgaaaagaagagaagcaaa

SEQ ID NO: 103602 - DNA, 20 bp, Artificial Sequence
  Description of Artificial Sequence: Synthetic oligonucleotide
  Target: SCN9A; (+) strand; PAM type: YTN; PAM sequence: CTA
ggagtgtaaagtggccattg

SEQ ID NO: 103603 - DNA, 20 bp, Artificial Sequence
  Description of Artificial Sequence: Synthetic oligonucleotide
  Target: SCN9A; (+) strand; PAM type: YTN; PAM sequence: TTG
atattcaagggctctctctg

SEQ ID NO: 103604 - DNA, 20 bp, Artificial Sequence
  Description of Artificial Sequence: Synthetic oligonucleotide
  Target: SCN9A; (+) strand; PAM type: YTN; PAM sequence: TTC
aagggctctctctgtgctct

SEQ ID NO: 103605 - DNA, 20 bp, Artificial Sequence
  Description of Artificial Sequence: Synthetic oligonucleotide
  Target: SCN9A; (+) strand; PAM type: YTN; PAM sequence: CTC
tctctgtgctctgtcacaga

SEQ ID NO: 103606 - DNA, 20 bp, Artificial Sequence
  Description of Artificial Sequence: Synthetic oligonucleotide
  Target: SCN9A; (+) strand; PAM type: YTN; PAM sequence: CTC
tctgtgctctgtcacagaac

SEQ ID NO: 103607 - DNA, 20 bp, Artificial Sequence
  Description of Artificial Sequence: Synthetic oligonucleotide
  Target: SCN9A; (+) strand; PAM type: YTN; PAM sequence: CTC
tgtgctctgtcacagaactg

SEQ ID NO: 103608 - DNA, 20 bp, Artificial Sequence
  Description of Artificial Sequence: Synthetic oligonucleotide
  Target: SCN9A; (+) strand; PAM type: YTN; PAM sequence: CTG
tgctctgtcacagaactgct

SEQ ID NO: 103609 - DNA, 20 bp, Artificial Sequence
  Description of Artificial Sequence: Synthetic oligonucleotide
  Target: SCN9A; (+) strand; PAM type: YTN; PAM sequence: CTC
tgtcacagaactgctacact

SEQ ID NO: 103610 - DNA, 20 bp, Artificial Sequence
  Description of Artificial Sequence: Synthetic oligonucleotide
  Target: SCN9A; (+) strand; PAM type: YTN; PAM sequence: CTG
tcacagaactgctacactgt

SEQ ID NO: 103611 - DNA, 20 bp, Artificial Sequence
  Description of Artificial Sequence: Synthetic oligonucleotide
  Target: SCN9A; (+) strand; PAM type: YTN; PAM sequence: CTG
ctacactgtttgcagagaaa

SEQ ID NO: 103612 - DNA, 20 bp, Artificial Sequence
  Description of Artificial Sequence: Synthetic oligonucleotide
  Target: SCN9A; (+) strand; PAM type: YTN; PAM sequence: CTA
cactgtttgcagagaaagca

SEQ ID NO: 103613 - DNA, 20 bp, Artificial Sequence
  Description of Artificial Sequence: Synthetic oligonucleotide
  Target: SCN9A; (+) strand; PAM type: YTN; PAM sequence: CTG
tttgcagagaaagcagctgg

SEQ ID NO: 103614 - DNA, 20 bp, Artificial Sequence
  Description of Artificial Sequence: Synthetic oligonucleotide
  Target: SCN9A; (+) strand; PAM type: YTN; PAM sequence: TTT
gcagagaaagcagctggaat

SEQ ID NO: 103615 - DNA, 20 bp, Artificial Sequence
  Description of Artificial Sequence: Synthetic oligonucleotide
  Target: SCN9A; (+) strand; PAM type: YTN; PAM sequence: TTG
cagagaaagcagctggaata

SEQ ID NO: 103616 - DNA, 20 bp, Artificial Sequence
  Description of Artificial Sequence: Synthetic oligonucleotide
  Target: SCN9A; (+) strand; PAM type: YTN; PAM sequence: CTG
gaatacagtgggtcaagtca

SEQ ID NO: 103617 - DNA, 20 bp, Artificial Sequence
  Description of Artificial Sequence: Synthetic oligonucleotide
  Target: SCN9A; (+) strand; PAM type: YTN; PAM sequence: CTT
aaagtctttagaagcaaaca

SEQ ID NO: 103618 - DNA, 20 bp, Artificial Sequence
  Description of Artificial Sequence: Synthetic oligonucleotide
  Target: SCN9A; (+) strand; PAM type: YTN; PAM sequence: TTA
aagtctttagaagcaaacat

SEQ ID NO: 103619 - DNA, 20 bp, Artificial Sequence
  Description of Artificial Sequence: Synthetic oligonucleotide
  Target: SCN9A; (+) strand; PAM type: YTN; PAM sequence: CTT
tagaagcaaacatttaaaca

SEQ ID NO: 103620 - DNA, 20 bp, Artificial Sequence
  Description of Artificial Sequence: Synthetic oligonucleotide
  Target: SCN9A; (+) strand; PAM type: YTN; PAM sequence: TTT
agaagcaaacatttaaacaa

SEQ ID NO: 103621 - DNA, 20 bp, Artificial Sequence
  Description of Artificial Sequence: Synthetic oligonucleotide
  Target: SCN9A; (+) strand; PAM type: YTN; PAM sequence: TTA
gaagcaaacatttaaacaat

SEQ ID NO: 103622 - DNA, 20 bp, Artificial Sequence
  Description of Artificial Sequence: Synthetic oligonucleotide
  Target: SCN9A; (+) strand; PAM type: YTN; PAM sequence: TTT
aaacaattttgctatttatg

SEQ ID NO: 103623 - DNA, 20 bp, Artificial Sequence
  Description of Artificial Sequence: Synthetic oligonucleotide
  Target: SCN9A; (+) strand; PAM type: YTN; PAM sequence: TTA
aacaattttgctatttatgc

SEQ ID NO: 103624 - DNA, 20 bp, Artificial Sequence
  Description of Artificial Sequence: Synthetic oligonucleotide
  Target: SCN9A; (+) strand; PAM type: YTN; PAM sequence: TTT
tgctatttatgccagcttaa

SEQ ID NO: 103625 - DNA, 20 bp, Artificial Sequence
  Description of Artificial Sequence: Synthetic oligonucleotide
  Target: SCN9A; (+) strand; PAM type: YTN; PAM sequence: TTT
gctatttatgccagcttaaa

SEQ ID NO: 103626 - DNA, 20 bp, Artificial Sequence
  Description of Artificial Sequence: Synthetic oligonucleotide
  Target: SCN9A; (+) strand; PAM type: YTN; PAM sequence: TTG
ctatttatgccagcttaaaa

SEQ ID NO: 103627 - DNA, 20 bp, Artificial Sequence
  Description of Artificial Sequence: Synthetic oligonucleotide
  Target: SCN9A; (+) strand; PAM type: YTN; PAM sequence: CTA
tttatgccagcttaaaaaaa

SEQ ID NO: 103628 - DNA, 20 bp, Artificial Sequence
  Description of Artificial Sequence: Synthetic oligonucleotide
  Target: SCN9A; (+) strand; PAM type: YTN; PAM sequence: TTT
atgccagcttaaaaaaatgc

SEQ ID NO: 103629 - DNA, 20 bp, Artificial Sequence
  Description of Artificial Sequence: Synthetic oligonucleotide
  Target: SCN9A; (+) strand; PAM type: YTN; PAM sequence: TTA
tgccagcttaaaaaaatgca

SEQ ID NO: 103630 - DNA, 20 bp, Artificial Sequence
  Description of Artificial Sequence: Synthetic oligonucleotide
  Target: SCN9A; (+) strand; PAM type: YTN; PAM sequence: CTT
aaaaaaatgcaacaagtagg

SEQ ID NO: 103631 - DNA, 20 bp, Artificial Sequence
  Description of Artificial Sequence: Synthetic oligonucleotide
  Target: SCN9A; (+) strand; PAM type: YTN; PAM sequence: TTA
aaaaaatgcaacaagtaggt

SEQ ID NO: 103632 - DNA, 20 bp, Artificial Sequence
  Description of Artificial Sequence: Synthetic oligonucleotide
  Target: SCN9A; (+) strand; PAM type: YTN; PAM sequence: TTG
gaaccttagcaaacataaag

SEQ ID NO: 103633 - DNA, 20 bp, Artificial Sequence
  Description of Artificial Sequence: Synthetic oligonucleotide
  Target: SCN9A; (+) strand; PAM type: YTN; PAM sequence: CTT
agcaaacataaaggcaaagt

SEQ ID NO: 103634 - DNA, 20 bp, Artificial Sequence
  Description of Artificial Sequence: Synthetic oligonucleotide
  Target: SCN9A; (+) strand; PAM type: YTN; PAM sequence: TTA
gcaaacataaaggcaaagtg

SEQ ID NO: 103635 - DNA, 20 bp, Artificial Sequence
  Description of Artificial Sequence: Synthetic oligonucleotide
  Target: SCN9A; (+) strand; PAM type: YTN; PAM sequence: CTC
aagcttcgtaaatattatct

SEQ ID NO: 103636 - DNA, 20 bp, Artificial Sequence
  Description of Artificial Sequence: Synthetic oligonucleotide
  Target: SCN9A; (+) strand; PAM type: YTN; PAM sequence: CTT
cgtaaatattatctataatt

SEQ ID NO: 103637 - DNA, 20 bp, Artificial Sequence
  Description of Artificial Sequence: Synthetic oligonucleotide
  Target: SCN9A; (+) strand; PAM type: YTN; PAM sequence: TTC
gtaaatattatctataattt

SEQ ID NO: 103638 - DNA, 20 bp, Artificial Sequence
  Description of Artificial Sequence: Synthetic oligonucleotide
  Target: SCN9A; (+) strand; PAM type: YTN; PAM sequence: TTA
tctataattttgaaacaaac

SEQ ID NO: 103639 - DNA, 20 bp, Artificial Sequence
  Description of Artificial Sequence: Synthetic oligonucleotide
  Target: SCN9A; (+) strand; PAM type: YTN; PAM sequence: CTA
taattttgaaacaaacaaga

SEQ ID NO: 103640 - DNA, 20 bp, Artificial Sequence
  Description of Artificial Sequence: Synthetic oligonucleotide
  Target: SCN9A; (+) strand; PAM type: YTN; PAM sequence: TTT
tgaaacaaacaagaatgaca

SEQ ID NO: 103641 - DNA, 20 bp, Artificial Sequence
  Description of Artificial Sequence: Synthetic oligonucleotide
  Target: SCN9A; (+) strand; PAM type: YTN; PAM sequence: TTT
gaaacaaacaagaatgacaa

SEQ ID NO: 103642 - DNA, 20 bp, Artificial Sequence
  Description of Artificial Sequence: Synthetic oligonucleotide
  Target: SCN9A; (+) strand; PAM type: YTN; PAM sequence: TTG
aaacaaacaagaatgacaaa

SEQ ID NO: 103643 - DNA, 20 bp, Artificial Sequence
  Description of Artificial Sequence: Synthetic oligonucleotide
  Target: SCN9A; (+) strand; PAM type: YTN; PAM sequence: CTA
cctagatatctgaatcattt

SEQ ID NO: 103644 - DNA, 20 bp, Artificial Sequence
  Description of Artificial Sequence: Synthetic oligonucleotide
  Target: SCN9A; (+) strand; PAM type: YTN; PAM sequence: CTA
gatatctgaatcatttctgt

SEQ ID NO: 103645 - DNA, 20 bp, Artificial Sequence
  Description of Artificial Sequence: Synthetic oligonucleotide
  Target: SCN9A; (+) strand; PAM type: YTN; PAM sequence: CTG
aatcatttctgttaactact

SEQ ID NO: 103646 - DNA, 20 bp, Artificial Sequence
  Description of Artificial Sequence: Synthetic oligonucleotide
  Target: SCN9A; (+) strand; PAM type: YTN; PAM sequence: TTT
ctgttaactactaatactac

SEQ ID NO: 103647 - DNA, 20 bp, Artificial Sequence
  Description of Artificial Sequence: Synthetic oligonucleotide
  Target: SCN9A; (+) strand; PAM type: YTN; PAM sequence: TTC
tgttaactactaatactacc

SEQ ID NO: 103648 - DNA, 20 bp, Artificial Sequence
  Description of Artificial Sequence: Synthetic oligonucleotide
  Target: SCN9A; (+) strand; PAM type: YTN; PAM sequence: CTG
ttaactactaatactaccca

SEQ ID NO: 103649 - DNA, 20 bp, Artificial Sequence
  Description of Artificial Sequence: Synthetic oligonucleotide
  Target: SCN9A; (+) strand; PAM type: YTN; PAM sequence: TTA
actactaatactacccacaa

SEQ ID NO: 103650 - DNA, 20 bp, Artificial Sequence
  Description of Artificial Sequence: Synthetic oligonucleotide
  Target: SCN9A; (+) strand; PAM type: YTN; PAM sequence: CTA
ctaatactacccacaatgaa

SEQ ID NO: 103651 - DNA, 20 bp, Artificial Sequence
  Description of Artificial Sequence: Synthetic oligonucleotide
  Target: SCN9A; (+) strand; PAM type: YTN; PAM sequence: CTA
atactacccacaatgaagga

SEQ ID NO: 103652 - DNA, 20 bp, Artificial Sequence
  Description of Artificial Sequence: Synthetic oligonucleotide
  Target: SCN9A; (+) strand; PAM type: YTN; PAM sequence: CTA
cccacaatgaaggagggcaa

SEQ ID NO: 103653 - DNA, 20 bp, Artificial Sequence
  Description of Artificial Sequence: Synthetic oligonucleotide
  Target: SCN9A; (+) strand; PAM type: YTN; PAM sequence: TTT
taatgaatggaataattact

SEQ ID NO: 103654 - DNA, 20 bp, Artificial Sequence
  Description of Artificial Sequence: Synthetic oligonucleotide
  Target: SCN9A; (+) strand; PAM type: YTN; PAM sequence: TTT
aatgaatggaataattacta

SEQ ID NO: 103655 - DNA, 20 bp, Artificial Sequence
  Description of Artificial Sequence: Synthetic oligonucleotide
  Target: SCN9A; (+) strand; PAM type: YTN; PAM sequence: TTA
atgaatggaataattactag

SEQ ID NO: 103656 - DNA, 20 bp, Artificial Sequence
  Description of Artificial Sequence: Synthetic oligonucleotide
  Target: SCN9A; (+) strand; PAM type: YTN; PAM sequence: TTA
ctagctttttaaacatgtgg

SEQ ID NO: 103657 - DNA, 20 bp, Artificial Sequence
  Description of Artificial Sequence: Synthetic oligonucleotide
  Target: SCN9A; (+) strand; PAM type: YTN; PAM sequence: CTA
gctttttaaacatgtggatt

SEQ ID NO: 103658 - DNA, 20 bp, Artificial Sequence
  Description of Artificial Sequence: Synthetic oligonucleotide
  Target: SCN9A; (+) strand; PAM type: YTN; PAM sequence: CTT
tttaaacatgtggatttcta

SEQ ID NO: 103659 - DNA, 20 bp, Artificial Sequence
  Description of Artificial Sequence: Synthetic oligonucleotide
  Target: SCN9A; (+) strand; PAM type: YTN; PAM sequence: TTT
ttaaacatgtggatttctaa

SEQ ID NO: 103660 - DNA, 20 bp, Artificial Sequence
  Description of Artificial Sequence: Synthetic oligonucleotide
  Target: SCN9A; (+) strand; PAM type: YTN; PAM sequence: TTT
taaacatgtggatttctaat

SEQ ID NO: 103661 - DNA, 20 bp, Artificial Sequence
  Description of Artificial Sequence: Synthetic oligonucleotide
  Target: SCN9A; (+) strand; PAM type: YTN; PAM sequence: TTT
aaacatgtggatttctaata

SEQ ID NO: 103662 - DNA, 20 bp, Artificial Sequence
  Description of Artificial Sequence: Synthetic oligonucleotide
  Target: SCN9A; (+) strand; PAM type: YTN; PAM sequence: TTA
aacatgtggatttctaatat

SEQ ID NO: 103663 - DNA, 20 bp, Artificial Sequence
  Description of Artificial Sequence: Synthetic oligonucleotide
  Target: SCN9A; (+) strand; PAM type: YTN; PAM sequence: TTT
ctaatattgaaaatataaat

SEQ ID NO: 103664 - DNA, 20 bp, Artificial Sequence
  Description of Artificial Sequence: Synthetic oligonucleotide
  Target: SCN9A; (+) strand; PAM type: YTN; PAM sequence: TTC
taatattgaaaatataaata

SEQ ID NO: 103665 - DNA, 20 bp, Artificial Sequence
  Description of Artificial Sequence: Synthetic oligonucleotide
  Target: SCN9A; (+) strand; PAM type: YTN; PAM sequence: CTA
atattgaaaatataaataga

SEQ ID NO: 103666 - DNA, 20 bp, Artificial Sequence
  Description of Artificial Sequence: Synthetic oligonucleotide
  Target: SCN9A; (+) strand; PAM type: YTN; PAM sequence: TTG
aaaatataaatagaaatttt

SEQ ID NO: 103667 - DNA, 20 bp, Artificial Sequence
  Description of Artificial Sequence: Synthetic oligonucleotide
  Target: SCN9A; (+) strand; PAM type: YTN; PAM sequence: TTT
tacatggataaaataactat

SEQ ID NO: 103668 - DNA, 20 bp, Artificial Sequence
  Description of Artificial Sequence: Synthetic oligonucleotide
  Target: SCN9A; (+) strand; PAM type: YTN; PAM sequence: TTT
acatggataaaataactata

SEQ ID NO: 103669 - DNA, 20 bp, Artificial Sequence
  Description of Artificial Sequence: Synthetic oligonucleotide
  Target: SCN9A; (+) strand; PAM type: YTN; PAM sequence: TTA
catggataaaataactatat

SEQ ID NO: 103670 - DNA, 20 bp, Artificial Sequence
  Description of Artificial Sequence: Synthetic oligonucleotide
  Target: SCN9A; (+) strand; PAM type: YTN; PAM sequence: CTA
tatcctttatgtaggcagct

SEQ ID NO: 103671 - DNA, 20 bp, Artificial Sequence
  Description of Artificial Sequence: Synthetic oligonucleotide
  Target: SCN9A; (+) strand; PAM type: YTN; PAM sequence: CTT
tatgtaggcagcttttgcta

SEQ ID NO: 103672 - DNA, 20 bp, Artificial Sequence
  Description of Artificial Sequence: Synthetic oligonucleotide
  Target: SCN9A; (+) strand; PAM type: YTN; PAM sequence: TTT
atgtaggcagcttttgctaa

SEQ ID NO: 103673 - DNA, 20 bp, Artificial Sequence
  Description of Artificial Sequence: Synthetic oligonucleotide
  Target: SCN9A; (+) strand; PAM type: YTN; PAM sequence: TTA
tgtaggcagcttttgctaaa

SEQ ID NO: 103674 - DNA, 20 bp, Artificial Sequence
  Description of Artificial Sequence: Synthetic oligonucleotide
  Target: SCN9A; (+) strand; PAM type: YTN; PAM sequence: CTT
ttgctaaagtgccatatttc

SEQ ID NO: 103675 - DNA, 20 bp, Artificial Sequence
  Description of Artificial Sequence: Synthetic oligonucleotide
  Target: SCN9A; (+) strand; PAM type: YTN; PAM sequence: TTT
tgctaaagtgccatatttca

SEQ ID NO: 103676 - DNA, 20 bp, Artificial Sequence
  Description of Artificial Sequence: Synthetic oligonucleotide
  Target: SCN9A; (+) strand; PAM type: YTN; PAM sequence: TTT
gctaaagtgccatatttcaa

SEQ ID NO: 103677 - DNA, 20 bp, Artificial Sequence
  Description of Artificial Sequence: Synthetic oligonucleotide
  Target: SCN9A; (+) strand; PAM type: YTN; PAM sequence: TTG
ctaaagtgccatatttcaag

SEQ ID NO: 103678 - DNA, 20 bp, Artificial Sequence
  Description of Artificial Sequence: Synthetic oligonucleotide
  Target: SCN9A; (+) strand; PAM type: YTN; PAM sequence: CTA
aagtgccatatttcaagtca

SEQ ID NO: 103679 - DNA, 20 bp, Artificial Sequence
  Description of Artificial Sequence: Synthetic oligonucleotide
  Target: SCN9A; (+) strand; PAM type: YTN; PAM sequence: TTT
caagtcattcttaactgaat

SEQ ID NO: 103680 - DNA, 20 bp, Artificial Sequence
  Description of Artificial Sequence: Synthetic oligonucleotide
  Target: SCN9A; (+) strand; PAM type: YTN; PAM sequence: TTC
aagtcattcttaactgaata

SEQ ID NO: 103681 - DNA, 20 bp, Artificial Sequence
  Description of Artificial Sequence: Synthetic oligonucleotide
  Target: SCN9A; (+) strand; PAM type: YTN; PAM sequence: TTC
ttaactgaatattcagtttt

SEQ ID NO: 103682 - DNA, 20 bp, Artificial Sequence
  Description of Artificial Sequence: Synthetic oligonucleotide
  Target: SCN9A; (+) strand; PAM type: YTN; PAM sequence: CTT
aactgaatattcagtttttt

SEQ ID NO: 103683 - DNA, 20 bp, Artificial Sequence
  Description of Artificial Sequence: Synthetic oligonucleotide
  Target: SCN9A; (+) strand; PAM type: YTN; PAM sequence: TTA
actgaatattcagttttttt

SEQ ID NO: 103684 - DNA, 20 bp, Artificial Sequence
  Description of Artificial Sequence: Synthetic oligonucleotide
  Target: SCN9A; (+) strand; PAM type: YTN; PAM sequence: CTG
aatattcagtttttttctta

SEQ ID NO: 103685 - DNA, 20 bp, Artificial Sequence
  Description of Artificial Sequence: Synthetic oligonucleotide
  Target: SCN9A; (+) strand; PAM type: YTN; PAM sequence: TTC
agtttttttcttaagaggat

SEQ ID NO: 103686 - DNA, 20 bp, Artificial Sequence
  Description of Artificial Sequence: Synthetic oligonucleotide
  Target: SCN9A; (+) strand; PAM type: YTN; PAM sequence: TTT
ttttcttaagaggatgacca

SEQ ID NO: 103687 - DNA, 20 bp, Artificial Sequence
  Description of Artificial Sequence: Synthetic oligonucleotide
  Target: SCN9A; (+) strand; PAM type: YTN; PAM sequence: TTT
tttcttaagaggatgaccat

SEQ ID NO: 103688 - DNA, 20 bp, Artificial Sequence
  Description of Artificial Sequence: Synthetic oligonucleotide
  Target: SCN9A; (+) strand; PAM type: YTN; PAM sequence: TTT
ttcttaagaggatgaccatt

SEQ ID NO: 103689 - DNA, 20 bp, Artificial Sequence
  Description of Artificial Sequence: Synthetic oligonucleotide
  Target: SCN9A; (+) strand; PAM type: YTN; PAM sequence: TTT
tcttaagaggatgaccattc

SEQ ID NO: 103690 - DNA, 20 bp, Artificial Sequence
  Description of Artificial Sequence: Synthetic oligonucleotide
  Target: SCN9A; (+) strand; PAM type: YTN; PAM sequence: TTT
cttaagaggatgaccattca

SEQ ID NO: 103691 - DNA, 20 bp, Artificial Sequence
  Description of Artificial Sequence: Synthetic oligonucleotide
  Target: SCN9A; (+) strand; PAM type: YTN; PAM sequence: TTC
ttaagaggatgaccattcat

SEQ ID NO: 103692 - DNA, 20 bp, Artificial Sequence
  Description of Artificial Sequence: Synthetic oligonucleotide
  Target: SCN9A; (+) strand; PAM type: YTN; PAM sequence: CTT
aagaggatgaccattcatta

SEQ ID NO: 103693 - DNA, 20 bp, Artificial Sequence
  Description of Artificial Sequence: Synthetic oligonucleotide
  Target: SCN9A; (+) strand; PAM type: YTN; PAM sequence: TTA
agaggatgaccattcattaa

SEQ ID NO: 103694 - DNA, 20 bp, Artificial Sequence
  Description of Artificial Sequence: Synthetic oligonucleotide
  Target: SCN9A; (+) strand; PAM type: YTN; PAM sequence: TTC
attaacatgtacctcatctt

SEQ ID NO: 103695 - DNA, 20 bp, Artificial Sequence
  Description of Artificial Sequence: Synthetic oligonucleotide
  Target: SCN9A; (+) strand; PAM type: YTN; PAM sequence: TTA
acatgtacctcatcttttct

SEQ ID NO: 103696 - DNA, 20 bp, Artificial Sequence
  Description of Artificial Sequence: Synthetic oligonucleotide
  Target: SCN9A; (+) strand; PAM type: YTN; PAM sequence: CTC
atcttttctaacagcttggt

SEQ ID NO: 103697 - DNA, 20 bp, Artificial Sequence
  Description of Artificial Sequence: Synthetic oligonucleotide
  Target: SCN9A; (+) strand; PAM type: YTN; PAM sequence: CTT
ttctaacagcttggtaaaaa

SEQ ID NO: 103698 - DNA, 20 bp, Artificial Sequence
  Description of Artificial Sequence: Synthetic oligonucleotide
  Target: SCN9A; (+) strand; PAM type: YTN; PAM sequence: TTT
tctaacagcttggtaaaaaa

SEQ ID NO: 103699 - DNA, 20 bp, Artificial Sequence
  Description of Artificial Sequence: Synthetic oligonucleotide
  Target: SCN9A; (+) strand; PAM type: YTN; PAM sequence: TTT
ctaacagcttggtaaaaaag

SEQ ID NO: 103700 - DNA, 20 bp, Artificial Sequence
  Description of Artificial Sequence: Synthetic oligonucleotide
  Target: SCN9A; (+) strand; PAM type: YTN; PAM sequence: TTC
taacagcttggtaaaaaagt

SEQ ID NO: 103701 - DNA, 20 bp, Artificial Sequence
  Description of Artificial Sequence: Synthetic oligonucleotide
  Target: SCN9A; (+) strand; PAM type: YTN; PAM sequence: CTA
acagcttggtaaaaaagtaa

SEQ ID NO: 103702 - DNA, 20 bp, Artificial Sequence
  Description of Artificial Sequence: Synthetic oligonucleotide
  Target: SCN9A; (+) strand; PAM type: YTN; PAM sequence: CTT
ggtaaaaaagtaataagaat

SEQ ID NO: 103703 - DNA, 20 bp, Artificial Sequence
  Description of Artificial Sequence: Synthetic oligonucleotide
  Target: SCN9A; (+) strand; PAM type: YTN; PAM sequence: TTG
gtaaaaaagtaataagaatt

SEQ ID NO: 103704 - DNA, 20 bp, Artificial Sequence
  Description of Artificial Sequence: Synthetic oligonucleotide
  Target: SCN9A; (+) strand; PAM type: YTN; PAM sequence: TTT
atgaattcaaaacatatata

SEQ ID NO: 103705 - DNA, 20 bp, Artificial Sequence
  Description of Artificial Sequence: Synthetic oligonucleotide
  Target: SCN9A; (+) strand; PAM type: YTN; PAM sequence: TTA
tgaattcaaaacatatatat

SEQ ID NO: 103706 - DNA, 20 bp, Artificial Sequence
  Description of Artificial Sequence: Synthetic oligonucleotide
  Target: SCN9A; (+) strand; PAM type: YTN; PAM sequence: TTC
aaaacatatatatgcatatg

SEQ ID NO: 103707 - DNA, 20 bp, Artificial Sequence
  Description of Artificial Sequence: Synthetic oligonucleotide
  Target: SCN9A; (+) strand; PAM type: YTN; PAM sequence: TTT
atatgtctatgcatgtatat

SEQ ID NO: 103708 - DNA, 20 bp, Artificial Sequence
  Description of Artificial Sequence: Synthetic oligonucleotide
  Target: SCN9A; (+) strand; PAM type: YTN; PAM sequence: TTA
tatgtctatgcatgtatata

SEQ ID NO: 103709 - DNA, 20 bp, Artificial Sequence
  Description of Artificial Sequence: Synthetic oligonucleotide
  Target: SCN9A; (+) strand; PAM type: YTN; PAM sequence: CTA
tgcatgtatatatatttcta

SEQ ID NO: 103710 - DNA, 20 bp, Artificial Sequence
  Description of Artificial Sequence: Synthetic oligonucleotide
  Target: SCN9A; (+) strand; PAM type: YTN; PAM sequence: TTT
ctagaaatagctttctcaaa

SEQ ID NO: 103711 - DNA, 20 bp, Artificial Sequence
  Description of Artificial Sequence: Synthetic oligonucleotide
  Target: SCN9A; (+) strand; PAM type: YTN; PAM sequence: TTC
tagaaatagctttctcaaaa

SEQ ID NO: 103712 - DNA, 20 bp, Artificial Sequence
  Description of Artificial Sequence: Synthetic oligonucleotide
  Target: SCN9A; (+) strand; PAM type: YTN; PAM sequence: CTA
gaaatagctttctcaaaaat

SEQ ID NO: 103713 - DNA, 20 bp, Artificial Sequence
  Description of Artificial Sequence: Synthetic oligonucleotide
  Target: SCN9A; (+) strand; PAM type: YTN; PAM sequence: CTT
tctcaaaaattatatgtttt

SEQ ID NO: 103714 - DNA, 20 bp, Artificial Sequence
  Description of Artificial Sequence: Synthetic oligonucleotide
  Target: SCN9A; (+) strand; PAM type: YTN; PAM sequence: TTT
ctcaaaaattatatgtttta

SEQ ID NO: 103715 - DNA, 20 bp, Artificial Sequence
  Description of Artificial Sequence: Synthetic oligonucleotide
  Target: SCN9A; (+) strand; PAM type: YTN; PAM sequence: TTC
tcaaaaattatatgttttat

SEQ ID NO: 103716 - DNA, 20 bp, Artificial Sequence
  Description of Artificial Sequence: Synthetic oligonucleotide
  Target: SCN9A; (+) strand; PAM type: YTN; PAM sequence: CTC
aaaaattatatgttttatct

SEQ ID NO: 103717 - DNA, 20 bp, Artificial Sequence
  Description of Artificial Sequence: Synthetic oligonucleotide
  Target: SCN9A; (+) strand; PAM type: YTN; PAM sequence: TTA
tatgttttatctatacctat

SEQ ID NO: 103718 - DNA, 20 bp, Artificial Sequence
  Description of Artificial Sequence: Synthetic oligonucleotide
  Target: SCN9A; (+) strand; PAM type: YTN; PAM sequence: TTT
tatctatacctatatagata

SEQ ID NO: 103719 - DNA, 20 bp, Artificial Sequence
  Description of Artificial Sequence: Synthetic oligonucleotide
  Target: SCN9A; (+) strand; PAM type: YTN; PAM sequence: TTT
atctatacctatatagataa

SEQ ID NO: 103720 - DNA, 20 bp, Artificial Sequence
  Description of Artificial Sequence: Synthetic oligonucleotide
  Target: SCN9A; (+) strand; PAM type: YTN; PAM sequence: TTA
tctatacctatatagataat

SEQ ID NO: 103721 - DNA, 20 bp, Artificial Sequence
  Description of Artificial Sequence: Synthetic oligonucleotide
  Target: SCN9A; (+) strand; PAM type: YTN; PAM sequence: CTA
tacctatatagataatattg

SEQ ID NO: 103722 - DNA, 20 bp, Artificial Sequence
  Description of Artificial Sequence: Synthetic oligonucleotide
  Target: SCN9A; (+) strand; PAM type: YTN; PAM sequence: CTA
tatagataatattgggtgta

SEQ ID NO: 103723 - DNA, 20 bp, Artificial Sequence
  Description of Artificial Sequence: Synthetic oligonucleotide
  Target: SCN9A; (+) strand; PAM type: YTN; PAM sequence: TTG
ggtgtatatgcatccttatt

SEQ ID NO: 103724 - DNA, 20 bp, Artificial Sequence
  Description of Artificial Sequence: Synthetic oligonucleotide
  Target: SCN9A; (+) strand; PAM type: YTN; PAM sequence: CTT
atttaggctctagttgaaga

SEQ ID NO: 103725 - DNA, 20 bp, Artificial Sequence
  Description of Artificial Sequence: Synthetic oligonucleotide
  Target: SCN9A; (+) strand; PAM type: YTN; PAM sequence: TTA
tttaggctctagttgaagaa

SEQ ID NO: 103726 - DNA, 20 bp, Artificial Sequence
  Description of Artificial Sequence: Synthetic oligonucleotide
  Target: SCN9A; (+) strand; PAM type: YTN; PAM sequence: TTT
aggctctagttgaagaaaat

SEQ ID NO: 103727 - DNA, 20 bp, Artificial Sequence
  Description of Artificial Sequence: Synthetic oligonucleotide
  Target: SCN9A; (+) strand; PAM type: YTN; PAM sequence: TTA
ggctctagttgaagaaaatt

SEQ ID NO: 103728 - DNA, 20 bp, Artificial Sequence
  Description of Artificial Sequence: Synthetic oligonucleotide
  Target: SCN9A; (+) strand; PAM type: YTN; PAM sequence: CTC
tagttgaagaaaattcacca

SEQ ID NO: 103729 - DNA, 20 bp, Artificial Sequence
  Description of Artificial Sequence: Synthetic oligonucleotide
  Target: SCN9A; (+) strand; PAM type: YTN; PAM sequence: CTA
gttgaagaaaattcaccata

SEQ ID NO: 103730 - DNA, 20 bp, Artificial Sequence
  Description of Artificial Sequence: Synthetic oligonucleotide
  Target: SCN9A; (+) strand; PAM type: YTN; PAM sequence: TTG
aagaaaattcaccatattct

SEQ ID NO: 103731 - DNA, 20 bp, Artificial Sequence
  Description of Artificial Sequence: Synthetic oligonucleotide
  Target: SCN9A; (+) strand; PAM type: YTN; PAM sequence: TTC
accatattctggaataaaat

SEQ ID NO: 103732 - DNA, 20 bp, Artificial Sequence
  Description of Artificial Sequence: Synthetic oligonucleotide
  Target: SCN9A; (+) strand; PAM type: YTN; PAM sequence: TTC
tggaataaaatagttttcta

SEQ ID NO: 103733 - DNA, 20 bp, Artificial Sequence
  Description of Artificial Sequence: Synthetic oligonucleotide
  Target: SCN9A; (+) strand; PAM type: YTN; PAM sequence: CTG
gaataaaatagttttctatg

SEQ ID NO: 103734 - DNA, 20 bp, Artificial Sequence
  Description of Artificial Sequence: Synthetic oligonucleotide
  Target: SCN9A; (+) strand; PAM type: YTN; PAM sequence: TTT
tctatgagaatattgcctct

SEQ ID NO: 103735 - DNA, 20 bp, Artificial Sequence
  Description of Artificial Sequence: Synthetic oligonucleotide
  Target: SCN9A; (+) strand; PAM type: YTN; PAM sequence: TTT
ctatgagaatattgcctcta

SEQ ID NO: 103736 - DNA, 20 bp, Artificial Sequence
  Description of Artificial Sequence: Synthetic oligonucleotide
  Target: SCN9A; (+) strand; PAM type: YTN; PAM sequence: TTC
tatgagaatattgcctctaa

SEQ ID NO: 103737 - DNA, 20 bp, Artificial Sequence
  Description of Artificial Sequence: Synthetic oligonucleotide
  Target: SCN9A; (+) strand; PAM type: YTN; PAM sequence: CTA
tgagaatattgcctctaaat

SEQ ID NO: 103738 - DNA, 20 bp, Artificial Sequence
  Description of Artificial Sequence: Synthetic oligonucleotide
  Target: SCN9A; (+) strand; PAM type: YTN; PAM sequence: TTG
cctctaaatccccaccaaat

SEQ ID NO: 103739 - DNA, 20 bp, Artificial Sequence
  Description of Artificial Sequence: Synthetic oligonucleotide
  Target: SCN9A; (+) strand; PAM type: YTN; PAM sequence: CTC
taaatccccaccaaatttga

SEQ ID NO: 103740 - DNA, 20 bp, Artificial Sequence
  Description of Artificial Sequence: Synthetic oligonucleotide
  Target: SCN9A; (+) strand; PAM type: YTN; PAM sequence: CTA
aatccccaccaaatttgaaa

SEQ ID NO: 103741 - DNA, 20 bp, Artificial Sequence
  Description of Artificial Sequence: Synthetic oligonucleotide
  Target: SCN9A; (+) strand; PAM type: YTN; PAM sequence: TTT
gaaatagaaaaatatatctt

SEQ ID NO: 103742 - DNA, 20 bp, Artificial Sequence
  Description of Artificial Sequence: Synthetic oligonucleotide
  Target: SCN9A; (+) strand; PAM type: YTN; PAM sequence: TTG
aaatagaaaaatatatcttt

SEQ ID NO: 103743 - DNA, 20 bp, Artificial Sequence
  Description of Artificial Sequence: Synthetic oligonucleotide
  Target: SCN9A; (+) strand; PAM type: YTN; PAM sequence: CTT
ttacttaggccacctttaaa

SEQ ID NO: 103744 - DNA, 20 bp, Artificial Sequence
  Description of Artificial Sequence: Synthetic oligonucleotide
  Target: SCN9A; (+) strand; PAM type: YTN; PAM sequence: TTT
tacttaggccacctttaaaa

SEQ ID NO: 103745 - DNA, 20 bp, Artificial Sequence
  Description of Artificial Sequence: Synthetic oligonucleotide
  Target: SCN9A; (+) strand; PAM type: YTN; PAM sequence: TTT
acttaggccacctttaaaat

SEQ ID NO: 103746 - DNA, 20 bp, Artificial Sequence
  Description of Artificial Sequence: Synthetic oligonucleotide
  Target: SCN9A; (+) strand; PAM type: YTN; PAM sequence: TTA
cttaggccacctttaaaatt

SEQ ID NO: 103747 - DNA, 20 bp, Artificial Sequence
  Description of Artificial Sequence: Synthetic oligonucleotide
  Target: SCN9A; (+) strand; PAM type: YTN; PAM sequence: CTT
aggccacctttaaaattatc

SEQ ID NO: 103748 - DNA, 20 bp, Artificial Sequence
  Description of Artificial Sequence: Synthetic oligonucleotide
  Target: SCN9A; (+) strand; PAM type: YTN; PAM sequence: TTA
ggccacctttaaaattatct

SEQ ID NO: 103749 - DNA, 20 bp, Artificial Sequence
  Description of Artificial Sequence: Synthetic oligonucleotide
  Target: SCN9A; (+) strand; PAM type: YTN; PAM sequence: CTT
taaaattatcttcaaataaa

SEQ ID NO: 103750 - DNA, 20 bp, Artificial Sequence
  Description of Artificial Sequence: Synthetic oligonucleotide
  Target: SCN9A; (+) strand; PAM type: YTN; PAM sequence: TTT
aaaattatcttcaaataaac

SEQ ID NO: 103751 - DNA, 20 bp, Artificial Sequence
  Description of Artificial Sequence: Synthetic oligonucleotide
  Target: SCN9A; (+) strand; PAM type: YTN; PAM sequence: TTA
aaattatcttcaaataaact

SEQ ID NO: 103752 - DNA, 20 bp, Artificial Sequence
  Description of Artificial Sequence: Synthetic oligonucleotide
  Target: SCN9A; (+) strand; PAM type: YTN; PAM sequence: TTA
tcttcaaataaactggaaca

SEQ ID NO: 103753 - DNA, 20 bp, Artificial Sequence
  Description of Artificial Sequence: Synthetic oligonucleotide
  Target: SCN9A; (+) strand; PAM type: YTN; PAM sequence: CTT
caaataaactggaacactaa

SEQ ID NO: 103754 - DNA, 20 bp, Artificial Sequence
  Description of Artificial Sequence: Synthetic oligonucleotide
  Target: SCN9A; (+) strand; PAM type: YTN; PAM sequence: TTC
aaataaactggaacactaaa

SEQ ID NO: 103755 - DNA, 20 bp, Artificial Sequence
  Description of Artificial Sequence: Synthetic oligonucleotide
  Target: SCN9A; (+) strand; PAM type: YTN; PAM sequence: CTG
gaacactaaaataactaatt

SEQ ID NO: 103756 - DNA, 20 bp, Artificial Sequence
  Description of Artificial Sequence: Synthetic oligonucleotide
  Target: SCN9A; (+) strand; PAM type: YTN; PAM sequence: CTA
aaataactaatttttcattt

SEQ ID NO: 103757 - DNA, 20 bp, Artificial Sequence
  Description of Artificial Sequence: Synthetic oligonucleotide
  Target: SCN9A; (+) strand; PAM type: YTN; PAM sequence: CTA
atttttcatttgaaactgtt

SEQ ID NO: 103758 - DNA, 20 bp, Artificial Sequence
  Description of Artificial Sequence: Synthetic oligonucleotide
  Target: SCN9A; (+) strand; PAM type: YTN; PAM sequence: TTT
ttcatttgaaactgttagca

SEQ ID NO: 103759 - DNA, 20 bp, Artificial Sequence
  Description of Artificial Sequence: Synthetic oligonucleotide
  Target: SCN9A; (+) strand; PAM type: YTN; PAM sequence: TTT
tcatttgaaactgttagcaa

SEQ ID NO: 103760 - DNA, 20 bp, Artificial Sequence
  Description of Artificial Sequence: Synthetic oligonucleotide
  Target: SCN9A; (+) strand; PAM type: YTN; PAM sequence: TTT
catttgaaactgttagcaat

SEQ ID NO: 103761 - DNA, 20 bp, Artificial Sequence
  Description of Artificial Sequence: Synthetic oligonucleotide
  Target: SCN9A; (+) strand; PAM type: YTN; PAM sequence: TTC
atttgaaactgttagcaata

SEQ ID NO: 103762 - DNA, 20 bp, Artificial Sequence
  Description of Artificial Sequence: Synthetic oligonucleotide
  Target: SCN9A; (+) strand; PAM type: YTN; PAM sequence: TTT
gaaactgttagcaatattat

SEQ ID NO: 103763 - DNA, 20 bp, Artificial Sequence
  Description of Artificial Sequence: Synthetic oligonucleotide
  Target: SCN9A; (+) strand; PAM type: YTN; PAM sequence: TTG
aaactgttagcaatattatc

SEQ ID NO: 103764 - DNA, 20 bp, Artificial Sequence
  Description of Artificial Sequence: Synthetic oligonucleotide
  Target: SCN9A; (+) strand; PAM type: YTN; PAM sequence: CTG
ttagcaatattatctctaag

SEQ ID NO: 103765 - DNA, 20 bp, Artificial Sequence
  Description of Artificial Sequence: Synthetic oligonucleotide
  Target: SCN9A; (+) strand; PAM type: YTN; PAM sequence: TTA
gcaatattatctctaaggtg

SEQ ID NO: 103766 - DNA, 20 bp, Artificial Sequence
  Description of Artificial Sequence: Synthetic oligonucleotide
  Target: SCN9A; (+) strand; PAM type: YTN; PAM sequence: TTA
tctctaaggtgtgtcaattt

SEQ ID NO: 103767 - DNA, 20 bp, Artificial Sequence
  Description of Artificial Sequence: Synthetic oligonucleotide
  Target: SCN9A; (+) strand; PAM type: YTN; PAM sequence: CTC
taaggtgtgtcaatttcagg

SEQ ID NO: 103768 - DNA, 20 bp, Artificial Sequence
  Description of Artificial Sequence: Synthetic oligonucleotide
  Target: SCN9A; (+) strand; PAM type: YTN; PAM sequence: CTA
aggtgtgtcaatttcaggat

SEQ ID NO: 103769 - DNA, 20 bp, Artificial Sequence
  Description of Artificial Sequence: Synthetic oligonucleotide
  Target: SCN9A; (+) strand; PAM type: YTN; PAM sequence: TTT
caggataaagttttgctttc

SEQ ID NO: 103770 - DNA, 20 bp, Artificial Sequence
  Description of Artificial Sequence: Synthetic oligonucleotide
  Target: SCN9A; (+) strand; PAM type: YTN; PAM sequence: TTC
aggataaagttttgctttca

SEQ ID NO: 103771 - DNA, 20 bp, Artificial Sequence
  Description of Artificial Sequence: Synthetic oligonucleotide
  Target: SCN9A; (+) strand; PAM type: YTN; PAM sequence: TTT
tgctttcatcattgcacaat

SEQ ID NO: 103772 - DNA, 20 bp, Artificial Sequence
  Description of Artificial Sequence: Synthetic oligonucleotide
  Target: SCN9A; (+) strand; PAM type: YTN; PAM sequence: TTT
gctttcatcattgcacaata

SEQ ID NO: 103773 - DNA, 20 bp, Artificial Sequence
  Description of Artificial Sequence: Synthetic oligonucleotide
  Target: SCN9A; (+) strand; PAM type: YTN; PAM sequence: TTG
ctttcatcattgcacaatag

SEQ ID NO: 103774 - DNA, 20 bp, Artificial Sequence
  Description of Artificial Sequence: Synthetic oligonucleotide
  Target: SCN9A; (+) strand; PAM type: YTN; PAM sequence: CTT
tcatcattgcacaatagata

SEQ ID NO: 103775 - DNA, 20 bp, Artificial Sequence
  Description of Artificial Sequence: Synthetic oligonucleotide
  Target: SCN9A; (+) strand; PAM type: YTN; PAM sequence: TTT
catcattgcacaatagataa

SEQ ID NO: 103776 - DNA, 20 bp, Artificial Sequence
  Description of Artificial Sequence: Synthetic oligonucleotide
  Target: SCN9A; (+) strand; PAM type: YTN; PAM sequence: TTC
atcattgcacaatagataac

SEQ ID NO: 103777 - DNA, 20 bp, Artificial Sequence
  Description of Artificial Sequence: Synthetic oligonucleotide
  Target: SCN9A; (+) strand; PAM type: YTN; PAM sequence: TTG
cacaatagataacaataata

SEQ ID NO: 103778 - DNA, 20 bp, Artificial Sequence
  Description of Artificial Sequence: Synthetic oligonucleotide
  Target: SCN9A; (+) strand; PAM type: YTN; PAM sequence: CTC
aacaatgacagagaaattca

SEQ ID NO: 103779 - DNA, 20 bp, Artificial Sequence
  Description of Artificial Sequence: Synthetic oligonucleotide
  Target: SCN9A; (+) strand; PAM type: YTN; PAM sequence: TTC
aaaatatgaactagattata

SEQ ID NO: 103780 - DNA, 20 bp, Artificial Sequence
  Description of Artificial Sequence: Synthetic oligonucleotide
  Target: SCN9A; (+) strand; PAM type: YTN; PAM sequence: CTA
gattataaaaaggagtcaag

SEQ ID NO: 103781 - DNA, 20 bp, Artificial Sequence
  Description of Artificial Sequence: Synthetic oligonucleotide
  Target: SCN9A; (+) strand; PAM type: YTN; PAM sequence: TTA
taaaaaggagtcaagattct

SEQ ID NO: 103782 - DNA, 20 bp, Artificial Sequence
  Description of Artificial Sequence: Synthetic oligonucleotide
  Target: SCN9A; (+) strand; PAM type: YTN; PAM sequence: TTC
ttattggcagagattcctgc

SEQ ID NO: 103783 - DNA, 20 bp, Artificial Sequence
  Description of Artificial Sequence: Synthetic oligonucleotide
  Target: SCN9A; (+) strand; PAM type: YTN; PAM sequence: CTT
attggcagagattcctgccc

SEQ ID NO: 103784 - DNA, 20 bp, Artificial Sequence
  Description of Artificial Sequence: Synthetic oligonucleotide
  Target: SCN9A; (+) strand; PAM type: YTN; PAM sequence: TTA
ttggcagagattcctgcccc

SEQ ID NO: 103785 - DNA, 20 bp, Artificial Sequence
  Description of Artificial Sequence: Synthetic oligonucleotide
  Target: SCN9A; (+) strand; PAM type: YTN; PAM sequence: TTG
gcagagattcctgcccccat

SEQ ID NO: 103786 - DNA, 20 bp, Artificial Sequence
  Description of Artificial Sequence: Synthetic oligonucleotide
  Target: SCN9A; (+) strand; PAM type: YTN; PAM sequence: TTC
ctgcccccatcctagaacta

SEQ ID NO: 103787 - DNA, 20 bp, Artificial Sequence
  Description of Artificial Sequence: Synthetic oligonucleotide
  Target: SCN9A; (+) strand; PAM type: YTN; PAM sequence: CTG
cccccatcctagaactatta

SEQ ID NO: 103788 - DNA, 20 bp, Artificial Sequence
  Description of Artificial Sequence: Synthetic oligonucleotide
  Target: SCN9A; (+) strand; PAM type: YTN; PAM sequence: CTA
gaactattaaagttcagtca

SEQ ID NO: 103789 - DNA, 20 bp, Artificial Sequence
  Description of Artificial Sequence: Synthetic oligonucleotide
  Target: SCN9A; (+) strand; PAM type: YTN; PAM sequence: CTA
ttaaagttcagtcattcaac

SEQ ID NO: 103790 - DNA, 20 bp, Artificial Sequence
  Description of Artificial Sequence: Synthetic oligonucleotide
  Target: SCN9A; (+) strand; PAM type: YTN; PAM sequence: TTA
aagttcagtcattcaacaaa

SEQ ID NO: 103791 - DNA, 20 bp, Artificial Sequence
  Description of Artificial Sequence: Synthetic oligonucleotide
  Target: SCN9A; (+) strand; PAM type: YTN; PAM sequence: TTC
agtcattcaacaaagtatgc

SEQ ID NO: 103792 - DNA, 20 bp, Artificial Sequence
  Description of Artificial Sequence: Synthetic oligonucleotide
  Target: SCN9A; (+) strand; PAM type: YTN; PAM sequence: TTC
aacaaagtatgctaaaatta

SEQ ID NO: 103793 - DNA, 20 bp, Artificial Sequence
  Description of Artificial Sequence: Synthetic oligonucleotide
  Target: SCN9A; (+) strand; PAM type: YTN; PAM sequence: CTA
aaattaaaatatatcttagt

SEQ ID NO: 103794 - DNA, 20 bp, Artificial Sequence
  Description of Artificial Sequence: Synthetic oligonucleotide
  Target: SCN9A; (+) strand; PAM type: YTN; PAM sequence: TTA
aaatatatcttagtatgtat

SEQ ID NO: 103795 - DNA, 20 bp, Artificial Sequence
  Description of Artificial Sequence: Synthetic oligonucleotide
  Target: SCN9A; (+) strand; PAM type: YTN; PAM sequence: CTT
agtatgtattttaatacatt

SEQ ID NO: 103796 - DNA, 20 bp, Artificial Sequence
  Description of Artificial Sequence: Synthetic oligonucleotide
  Target: SCN9A; (+) strand; PAM type: YTN; PAM sequence: TTA
gtatgtattttaatacattt

SEQ ID NO: 103797 - DNA, 20 bp, Artificial Sequence
  Description of Artificial Sequence: Synthetic oligonucleotide
  Target: SCN9A; (+) strand; PAM type: YTN; PAM sequence: TTT
taatacattttagaaatatt

SEQ ID NO: 103798 - DNA, 20 bp, Artificial Sequence
  Description of Artificial Sequence: Synthetic oligonucleotide
  Target: SCN9A; (+) strand; PAM type: YTN; PAM sequence: TTT
aatacattttagaaatattc

SEQ ID NO: 103799 - DNA, 20 bp, Artificial Sequence
  Description of Artificial Sequence: Synthetic oligonucleotide
  Target: SCN9A; (+) strand; PAM type: YTN; PAM sequence: TTA
atacattttagaaatattca

SEQ ID NO: 103800 - DNA, 20 bp, Artificial Sequence
  Description of Artificial Sequence: Synthetic oligonucleotide
  Target: SCN9A; (+) strand; PAM type: YTN; PAM sequence: TTT
tagaaatattcaataaggca

SEQ ID NO: 103801 - DNA, 20 bp, Artificial Sequence
  Description of Artificial Sequence: Synthetic oligonucleotide
  Target: SCN9A; (+) strand; PAM type: YTN; PAM sequence: TTT
agaaatattcaataaggcaa

SEQ ID NO: 103802 - DNA, 20 bp, Artificial Sequence
  Description of Artificial Sequence: Synthetic oligonucleotide
  Target: SCN9A; (+) strand; PAM type: YTN; PAM sequence: TTA
gaaatattcaataaggcaat

SEQ ID NO: 103803 - DNA, 20 bp, Artificial Sequence
  Description of Artificial Sequence: Synthetic oligonucleotide
  Target: SCN9A; (+) strand; PAM type: YTN; PAM sequence: TTC
aataaggcaatacatattaa

SEQ ID NO: 103804 - DNA, 20 bp, Artificial Sequence
  Description of Artificial Sequence: Synthetic oligonucleotide
  Target: SCN9A; (+) strand; PAM type: YTN; PAM sequence: TTA
atctgtatctaatttcagta

SEQ ID NO: 103805 - DNA, 20 bp, Artificial Sequence
  Description of Artificial Sequence: Synthetic oligonucleotide
  Target: SCN9A; (+) strand; PAM type: YTN; PAM sequence: CTG
tatctaatttcagtaaaagt

SEQ ID NO: 103806 - DNA, 20 bp, Artificial Sequence
  Description of Artificial Sequence: Synthetic oligonucleotide
  Target: SCN9A; (+) strand; PAM type: YTN; PAM sequence: CTA
atttcagtaaaagtgttcta

SEQ ID NO: 103807 - DNA, 20 bp, Artificial Sequence
  Description of Artificial Sequence: Synthetic oligonucleotide
  Target: SCN9A; (+) strand; PAM type: YTN; PAM sequence: TTT
cagtaaaagtgttctatgtg

SEQ ID NO: 103808 - DNA, 20 bp, Artificial Sequence
  Description of Artificial Sequence: Synthetic oligonucleotide
  Target: SCN9A; (+) strand; PAM type: YTN; PAM sequence: TTC
agtaaaagtgttctatgtgt

SEQ ID NO: 103809 - DNA, 20 bp, Artificial Sequence
  Description of Artificial Sequence: Synthetic oligonucleotide
  Target: SCN9A; (+) strand; PAM type: YTN; PAM sequence: TTC
tatgtgttattgatagatag

SEQ ID NO: 103810 - DNA, 20 bp, Artificial Sequence
  Description of Artificial Sequence: Synthetic oligonucleotide
  Target: SCN9A; (+) strand; PAM type: YTN; PAM sequence: CTA
tgtgttattgatagatagga

SEQ ID NO: 103811 - DNA, 20 bp, Artificial Sequence
  Description of Artificial Sequence: Synthetic oligonucleotide
  Target: SCN9A; (+) strand; PAM type: YTN; PAM sequence: TTA
ttgatagataggatttataa

SEQ ID NO: 103812 - DNA, 20 bp, Artificial Sequence
  Description of Artificial Sequence: Synthetic oligonucleotide
  Target: SCN9A; (+) strand; PAM type: YTN; PAM sequence: TTG
atagataggatttataatat

SEQ ID NO: 103813 - DNA, 20 bp, Artificial Sequence
  Description of Artificial Sequence: Synthetic oligonucleotide
  Target: SCN9A; (+) strand; PAM type: YTN; PAM sequence: TTT
ataatatgctctatctaaac

SEQ ID NO: 103814 - DNA, 20 bp, Artificial Sequence
  Description of Artificial Sequence: Synthetic oligonucleotide
  Target: SCN9A; (+) strand; PAM type: YTN; PAM sequence: TTA
taatatgctctatctaaacc

SEQ ID NO: 103815 - DNA, 20 bp, Artificial Sequence
  Description of Artificial Sequence: Synthetic oligonucleotide
  Target: SCN9A; (+) strand; PAM type: YTN; PAM sequence: CTC
tatctaaacctcttagtttc

SEQ ID NO: 103816 - DNA, 20 bp, Artificial Sequence
  Description of Artificial Sequence: Synthetic oligonucleotide
  Target: SCN9A; (+) strand; PAM type: YTN; PAM sequence: CTA
tctaaacctcttagtttcta

SEQ ID NO: 103817 - DNA, 20 bp, Artificial Sequence
  Description of Artificial Sequence: Synthetic oligonucleotide
  Target: SCN9A; (+) strand; PAM type: YTN; PAM sequence: CTA
aacctcttagtttctagaga

SEQ ID NO: 103818 - DNA, 20 bp, Artificial Sequence
  Description of Artificial Sequence: Synthetic oligonucleotide
  Target: SCN9A; (+) strand; PAM type: YTN; PAM sequence: CTC
ttagtttctagagactgatc

SEQ ID NO: 103819 - DNA, 20 bp, Artificial Sequence
  Description of Artificial Sequence: Synthetic oligonucleotide
  Target: SCN9A; (+) strand; PAM type: YTN; PAM sequence: CTT
agtttctagagactgatctg

SEQ ID NO: 103820 - DNA, 20 bp, Artificial Sequence
  Description of Artificial Sequence: Synthetic oligonucleotide
  Target: SCN9A; (+) strand; PAM type: YTN; PAM sequence: TTA
gtttctagagactgatctga

SEQ ID NO: 103821 - DNA, 20 bp, Artificial Sequence
  Description of Artificial Sequence: Synthetic oligonucleotide
  Target: SCN9A; (+) strand; PAM type: YTN; PAM sequence: TTT
ctagagactgatctgattat

SEQ ID NO: 103822 - DNA, 20 bp, Artificial Sequence
  Description of Artificial Sequence: Synthetic oligonucleotide
  Target: SCN9A; (+) strand; PAM type: YTN; PAM sequence: TTC
tagagactgatctgattatg

SEQ ID NO: 103823 - DNA, 20 bp, Artificial Sequence
  Description of Artificial Sequence: Synthetic oligonucleotide
  Target: SCN9A; (+) strand; PAM type: YTN; PAM sequence: CTA
gagactgatctgattatgta

SEQ ID NO: 103824 - DNA, 20 bp, Artificial Sequence
  Description of Artificial Sequence: Synthetic oligonucleotide
  Target: SCN9A; (+) strand; PAM type: YTN; PAM sequence: CTG
atctgattatgtatataatc

SEQ ID NO: 103825 - DNA, 20 bp, Artificial Sequence
  Description of Artificial Sequence: Synthetic oligonucleotide
  Target: SCN9A; (+) strand; PAM type: YTN; PAM sequence: CTG
attatgtatataatcagaaa

SEQ ID NO: 103826 - DNA, 20 bp, Artificial Sequence
  Description of Artificial Sequence: Synthetic oligonucleotide
  Target: SCN9A; (+) strand; PAM type: YTN; PAM sequence: TTA
tgtatataatcagaaactta

SEQ ID NO: 103827 - DNA, 20 bp, Artificial Sequence
  Description of Artificial Sequence: Synthetic oligonucleotide
  Target: SCN9A; (+) strand; PAM type: YTN; PAM sequence: CTT
attcttatcaatgagtaata

SEQ ID NO: 103828 - DNA, 20 bp, Artificial Sequence
  Description of Artificial Sequence: Synthetic oligonucleotide
  Target: SCN9A; (+) strand; PAM type: YTN; PAM sequence: TTA
ttcttatcaatgagtaatat

SEQ ID NO: 103829 - DNA, 20 bp, Artificial Sequence
  Description of Artificial Sequence: Synthetic oligonucleotide
  Target: SCN9A; (+) strand; PAM type: YTN; PAM sequence: TTC
ttatcaatgagtaatattac

SEQ ID NO: 103830 - DNA, 20 bp, Artificial Sequence
  Description of Artificial Sequence: Synthetic oligonucleotide
  Target: SCN9A; (+) strand; PAM type: YTN; PAM sequence: CTT
atcaatgagtaatattactt

SEQ ID NO: 103831 - DNA, 20 bp, Artificial Sequence
  Description of Artificial Sequence: Synthetic oligonucleotide
  Target: SCN9A; (+) strand; PAM type: YTN; PAM sequence: TTA
tcaatgagtaatattacttc

SEQ ID NO: 103832 - DNA, 20 bp, Artificial Sequence
  Description of Artificial Sequence: Synthetic oligonucleotide
  Target: SCN9A; (+) strand; PAM type: YTN; PAM sequence: TTA
cttctggaataaaattaaac

SEQ ID NO: 103833 - DNA, 20 bp, Artificial Sequence
  Description of Artificial Sequence: Synthetic oligonucleotide
  Target: SCN9A; (+) strand; PAM type: YTN; PAM sequence: CTT
ctggaataaaattaaacatt

SEQ ID NO: 103834 - DNA, 20 bp, Artificial Sequence
  Description of Artificial Sequence: Synthetic oligonucleotide
  Target: SCN9A; (+) strand; PAM type: YTN; PAM sequence: TTC
tggaataaaattaaacattt

SEQ ID NO: 103835 - DNA, 20 bp, Artificial Sequence
  Description of Artificial Sequence: Synthetic oligonucleotide
  Target: SCN9A; (+) strand; PAM type: YTN; PAM sequence: CTG
gaataaaattaaacattttg

SEQ ID NO: 103836 - DNA, 20 bp, Artificial Sequence
  Description of Artificial Sequence: Synthetic oligonucleotide
  Target: SCN9A; (+) strand; PAM type: YTN; PAM sequence: TTA
aacattttgaacacttatca

SEQ ID NO: 103837 - DNA, 20 bp, Artificial Sequence
  Description of Artificial Sequence: Synthetic oligonucleotide
  Target: SCN9A; (+) strand; PAM type: YTN; PAM sequence: TTT
tgaacacttatcacttattc

SEQ ID NO: 103838 - DNA, 20 bp, Artificial Sequence
  Description of Artificial Sequence: Synthetic oligonucleotide
  Target: SCN9A; (+) strand; PAM type: YTN; PAM sequence: TTT
gaacacttatcacttattca

SEQ ID NO: 103839 - DNA, 20 bp, Artificial Sequence
  Description of Artificial Sequence: Synthetic oligonucleotide
  Target: SCN9A; (+) strand; PAM type: YTN; PAM sequence: TTG
aacacttatcacttattcat

SEQ ID NO: 103840 - DNA, 20 bp, Artificial Sequence
  Description of Artificial Sequence: Synthetic oligonucleotide
  Target: SCN9A; (+) strand; PAM type: YTN; PAM sequence: CTT
atcacttattcattcatagg

SEQ ID NO: 103841 - DNA, 20 bp, Artificial Sequence
  Description of Artificial Sequence: Synthetic oligonucleotide
  Target: SCN9A; (+) strand; PAM type: YTN; PAM sequence: TTA
tcacttattcattcataggc

SEQ ID NO: 103842 - DNA, 20 bp, Artificial Sequence
  Description of Artificial Sequence: Synthetic oligonucleotide
  Target: SCN9A; (+) strand; PAM type: YTN; PAM sequence: CTT
attcattcataggcaaggcc

SEQ ID NO: 103843 - DNA, 20 bp, Artificial Sequence
  Description of Artificial Sequence: Synthetic oligonucleotide
  Target: SCN9A; (+) strand; PAM type: YTN; PAM sequence: TTA
ttcattcataggcaaggcct

SEQ ID NO: 103844 - DNA, 20 bp, Artificial Sequence
  Description of Artificial Sequence: Synthetic oligonucleotide
  Target: SCN9A; (+) strand; PAM type: YTN; PAM sequence: TTC
attcataggcaaggcctatc

SEQ ID NO: 103845 - DNA, 20 bp, Artificial Sequence
  Description of Artificial Sequence: Synthetic oligonucleotide
  Target: SCN9A; (+) strand; PAM type: YTN; PAM sequence: TTC
ataggcaaggcctatcaact

SEQ ID NO: 103846 - DNA, 20 bp, Artificial Sequence
  Description of Artificial Sequence: Synthetic oligonucleotide
  Target: SCN9A; (+) strand; PAM type: YTN; PAM sequence: CTA
tcaacttttaactgatgcat

SEQ ID NO: 103847 - DNA, 20 bp, Artificial Sequence
  Description of Artificial Sequence: Synthetic oligonucleotide
  Target: SCN9A; (+) strand; PAM type: YTN; PAM sequence: CTT
ttaactgatgcattttatat

SEQ ID NO: 103848 - DNA, 20 bp, Artificial Sequence
  Description of Artificial Sequence: Synthetic oligonucleotide
  Target: SCN9A; (+) strand; PAM type: YTN; PAM sequence: TTT
taactgatgcattttatata

SEQ ID NO: 103849 - DNA, 20 bp, Artificial Sequence
  Description of Artificial Sequence: Synthetic oligonucleotide
  Target: SCN9A; (+) strand; PAM type: YTN; PAM sequence: TTT
aactgatgcattttatatag

SEQ ID NO: 103850 - DNA, 20 bp, Artificial Sequence
  Description of Artificial Sequence: Synthetic oligonucleotide
  Target: SCN9A; (+) strand; PAM type: YTN; PAM sequence: TTA
actgatgcattttatatagg

SEQ ID NO: 103851 - DNA, 20 bp, Artificial Sequence
  Description of Artificial Sequence: Synthetic oligonucleotide
  Target: SCN9A; (+) strand; PAM type: YTN; PAM sequence: CTG
atgcattttatataggagca

SEQ ID NO: 103852 - DNA, 20 bp, Artificial Sequence
  Description of Artificial Sequence: Synthetic oligonucleotide
  Target: SCN9A; (+) strand; PAM type: YTN; PAM sequence: TTT
tatataggagcaaataaaat

SEQ ID NO: 103853 - DNA, 20 bp, Artificial Sequence
  Description of Artificial Sequence: Synthetic oligonucleotide
  Target: SCN9A; (+) strand; PAM type: YTN; PAM sequence: TTT
atataggagcaaataaaatc

SEQ ID NO: 103854 - DNA, 20 bp, Artificial Sequence
  Description of Artificial Sequence: Synthetic oligonucleotide
  Target: SCN9A; (+) strand; PAM type: YTN; PAM sequence: TTA
tataggagcaaataaaatca

SEQ ID NO: 103855 - DNA, 20 bp, Artificial Sequence
  Description of Artificial Sequence: Synthetic oligonucleotide
  Target: SCN9A; (+) strand; PAM type: YTN; PAM sequence: TTA
attactgagttgatttaaaa

SEQ ID NO: 103856 - DNA, 20 bp, Artificial Sequence
  Description of Artificial Sequence: Synthetic oligonucleotide
  Target: SCN9A; (+) strand; PAM type: YTN; PAM sequence: TTA
ctgagttgatttaaaaaaat

SEQ ID NO: 103857 - DNA, 20 bp, Artificial Sequence
  Description of Artificial Sequence: Synthetic oligonucleotide
  Target: SCN9A; (+) strand; PAM type: YTN; PAM sequence: CTG
agttgatttaaaaaaataaa

SEQ ID NO: 103858 - DNA, 20 bp, Artificial Sequence
  Description of Artificial Sequence: Synthetic oligonucleotide
  Target: SCN9A; (+) strand; PAM type: YTN; PAM sequence: TTG
atttaaaaaaataaagtccc

SEQ ID NO: 103859 - DNA, 20 bp, Artificial Sequence
  Description of Artificial Sequence: Synthetic oligonucleotide
  Target: SCN9A; (+) strand; PAM type: YTN; PAM sequence: TTT
aaaaaaataaagtcccataa

SEQ ID NO: 103860 - DNA, 20 bp, Artificial Sequence
  Description of Artificial Sequence: Synthetic oligonucleotide
  Target: SCN9A; (+) strand; PAM type: YTN; PAM sequence: TTA
aaaaaataaagtcccataac

SEQ ID NO: 103861 - DNA, 20 bp, Artificial Sequence
  Description of Artificial Sequence: Synthetic oligonucleotide
  Target: SCN9A; (+) strand; PAM type: YTN; PAM sequence: CTA
acagtgcataaaaccatttc

SEQ ID NO: 103862 - DNA, 20 bp, Artificial Sequence
  Description of Artificial Sequence: Synthetic oligonucleotide
  Target: SCN9A; (+) strand; PAM type: YTN; PAM sequence: TTT
caaaatgtattcaaagttta

SEQ ID NO: 103863 - DNA, 20 bp, Artificial Sequence
  Description of Artificial Sequence: Synthetic oligonucleotide
  Target: SCN9A; (+) strand; PAM type: YTN; PAM sequence: TTC
aaaatgtattcaaagtttat

SEQ ID NO: 103864 - DNA, 20 bp, Artificial Sequence
  Description of Artificial Sequence: Synthetic oligonucleotide
  Target: SCN9A; (+) strand; PAM type: YTN; PAM sequence: TTC
aaagtttatactagaagcag

SEQ ID NO: 103865 - DNA, 20 bp, Artificial Sequence
  Description of Artificial Sequence: Synthetic oligonucleotide
  Target: SCN9A; (+) strand; PAM type: YTN; PAM sequence: TTT
atactagaagcagggtactt

SEQ ID NO: 103866 - DNA, 20 bp, Artificial Sequence
  Description of Artificial Sequence: Synthetic oligonucleotide
  Target: SCN9A; (+) strand; PAM type: YTN; PAM sequence: TTA
tactagaagcagggtacttt

SEQ ID NO: 103867 - DNA, 20 bp, Artificial Sequence
  Description of Artificial Sequence: Synthetic oligonucleotide
  Target: SCN9A; (+) strand; PAM type: YTN; PAM sequence: CTA
gaagcagggtactttggctt

SEQ ID NO: 103868 - DNA, 20 bp, Artificial Sequence
  Description of Artificial Sequence: Synthetic oligonucleotide
  Target: SCN9A; (+) strand; PAM type: YTN; PAM sequence: CTT
tggctttgaccccaactttc

SEQ ID NO: 103869 - DNA, 20 bp, Artificial Sequence
  Description of Artificial Sequence: Synthetic oligonucleotide
  Target: SCN9A; (+) strand; PAM type: YTN; PAM sequence: TTT
ggctttgaccccaactttct

SEQ ID NO: 103870 - DNA, 20 bp, Artificial Sequence
  Description of Artificial Sequence: Synthetic oligonucleotide
  Target: SCN9A; (+) strand; PAM type: YTN; PAM sequence: TTG
gctttgaccccaactttcta

SEQ ID NO: 103871 - DNA, 20 bp, Artificial Sequence
  Description of Artificial Sequence: Synthetic oligonucleotide
  Target: SCN9A; (+) strand; PAM type: YTN; PAM sequence: CTT
tgaccccaactttctagatg

SEQ ID NO: 103872 - DNA, 20 bp, Artificial Sequence
  Description of Artificial Sequence: Synthetic oligonucleotide
  Target: SCN9A; (+) strand; PAM type: YTN; PAM sequence: TTT
gaccccaactttctagatgt

SEQ ID NO: 103873 - DNA, 20 bp, Artificial Sequence
  Description of Artificial Sequence: Synthetic oligonucleotide
  Target: SCN9A; (+) strand; PAM type: YTN; PAM sequence: TTG
accccaactttctagatgtg

SEQ ID NO: 103874 - DNA, 20 bp, Artificial Sequence
  Description of Artificial Sequence: Synthetic oligonucleotide
  Target: SCN9A; (+) strand; PAM type: YTN; PAM sequence: CTT
tctagatgtgtactaagaaa

SEQ ID NO: 103875 - DNA, 20 bp, Artificial Sequence
  Description of Artificial Sequence: Synthetic oligonucleotide
  Target: SCN9A; (+) strand; PAM type: YTN; PAM sequence: TTT
ctagatgtgtactaagaaag

SEQ ID NO: 103876 - DNA, 20 bp, Artificial Sequence
  Description of Artificial Sequence: Synthetic oligonucleotide
  Target: SCN9A; (+) strand; PAM type: YTN; PAM sequence: TTC
tagatgtgtactaagaaagc

SEQ ID NO: 103877 - DNA, 20 bp, Artificial Sequence
  Description of Artificial Sequence: Synthetic oligonucleotide
  Target: SCN9A; (+) strand; PAM type: YTN; PAM sequence: CTA
gatgtgtactaagaaagcat

SEQ ID NO: 103878 - DNA, 20 bp, Artificial Sequence
  Description of Artificial Sequence: Synthetic oligonucleotide
  Target: SCN9A; (+) strand; PAM type: YTN; PAM sequence: CTA
agaaagcatgagtctcaatt

SEQ ID NO: 103879 - DNA, 20 bp, Artificial Sequence
  Description of Artificial Sequence: Synthetic oligonucleotide
  Target: SCN9A; (+) strand; PAM type: YTN; PAM sequence: CTC
aatttgcttatccataaata

SEQ ID NO: 103880 - DNA, 20 bp, Artificial Sequence
  Description of Artificial Sequence: Synthetic oligonucleotide
  Target: SCN9A; (+) strand; PAM type: YTN; PAM sequence: TTT
gcttatccataaatacataa

SEQ ID NO: 103881 - DNA, 20 bp, Artificial Sequence
  Description of Artificial Sequence: Synthetic oligonucleotide
  Target: SCN9A; (+) strand; PAM type: YTN; PAM sequence: TTG
cttatccataaatacataac

SEQ ID NO: 103882 - DNA, 20 bp, Artificial Sequence
  Description of Artificial Sequence: Synthetic oligonucleotide
  Target: SCN9A; (+) strand; PAM type: YTN; PAM sequence: CTT
atccataaatacataaccag

SEQ ID NO: 103883 - DNA, 20 bp, Artificial Sequence
  Description of Artificial Sequence: Synthetic oligonucleotide
  Target: SCN9A; (+) strand; PAM type: YTN; PAM sequence: TTA
tccataaatacataaccaga

SEQ ID NO: 103884 - DNA, 20 bp, Artificial Sequence
  Description of Artificial Sequence: Synthetic oligonucleotide
  Target: SCN9A; (+) strand; PAM type: YTN; PAM sequence: TTA
ttaaatacaaagctagaatt

SEQ ID NO: 103885 - DNA, 20 bp, Artificial Sequence
  Description of Artificial Sequence: Synthetic oligonucleotide
  Target: SCN9A; (+) strand; PAM type: YTN; PAM sequence: TTA
aatacaaagctagaattaca

SEQ ID NO: 103886 - DNA, 20 bp, Artificial Sequence
  Description of Artificial Sequence: Synthetic oligonucleotide
  Target: SCN9A; (+) strand; PAM type: YTN; PAM sequence: CTA
gaattacaatgatcttttcc

SEQ ID NO: 103887 - DNA, 20 bp, Artificial Sequence
  Description of Artificial Sequence: Synthetic oligonucleotide
  Target: SCN9A; (+) strand; PAM type: YTN; PAM sequence: TTA
caatgatcttttcctgctct

SEQ ID NO: 103888 - DNA, 20 bp, Artificial Sequence
  Description of Artificial Sequence: Synthetic oligonucleotide
  Target: SCN9A; (+) strand; PAM type: YTN; PAM sequence: CTT
ttcctgctctgagattttat

SEQ ID NO: 103889 - DNA, 20 bp, Artificial Sequence
  Description of Artificial Sequence: Synthetic oligonucleotide
  Target: SCN9A; (+) strand; PAM type: YTN; PAM sequence: TTT
tcctgctctgagattttata

SEQ ID NO: 103890 - DNA, 20 bp, Artificial Sequence
  Description of Artificial Sequence: Synthetic oligonucleotide
  Target: SCN9A; (+) strand; PAM type: YTN; PAM sequence: TTT
cctgctctgagattttatat

SEQ ID NO: 103891 - DNA, 20 bp, Artificial Sequence
  Description of Artificial Sequence: Synthetic oligonucleotide
  Target: SCN9A; (+) strand; PAM type: YTN; PAM sequence: TTC
ctgctctgagattttatatt

SEQ ID NO: 103892 - DNA, 20 bp, Artificial Sequence
  Description of Artificial Sequence: Synthetic oligonucleotide
  Target: SCN9A; (+) strand; PAM type: YTN; PAM sequence: CTG
ctctgagattttatatttat

SEQ ID NO: 103893 - DNA, 20 bp, Artificial Sequence
  Description of Artificial Sequence: Synthetic oligonucleotide
  Target: SCN9A; (+) strand; PAM type: YTN; PAM sequence: CTC
tgagattttatatttatgcc

SEQ ID NO: 103894 - DNA, 20 bp, Artificial Sequence
  Description of Artificial Sequence: Synthetic oligonucleotide
  Target: SCN9A; (+) strand; PAM type: YTN; PAM sequence: CTG
agattttatatttatgccag

SEQ ID NO: 103895 - DNA, 20 bp, Artificial Sequence
  Description of Artificial Sequence: Synthetic oligonucleotide
  Target: SCN9A; (+) strand; PAM type: YTN; PAM sequence: TTT
tatatttatgccagaaacac

SEQ ID NO: 103896 - DNA, 20 bp, Artificial Sequence
  Description of Artificial Sequence: Synthetic oligonucleotide
  Target: SCN9A; (+) strand; PAM type: YTN; PAM sequence: TTT
atatttatgccagaaacact

SEQ ID NO: 103897 - DNA, 20 bp, Artificial Sequence
  Description of Artificial Sequence: Synthetic oligonucleotide
  Target: SCN9A; (+) strand; PAM type: YTN; PAM sequence: TTA
tatttatgccagaaacactt

SEQ ID NO: 103898 - DNA, 20 bp, Artificial Sequence
  Description of Artificial Sequence: Synthetic oligonucleotide
  Target: SCN9A; (+) strand; PAM type: YTN; PAM sequence: TTT
atgccagaaacacttcttcc

SEQ ID NO: 103899 - DNA, 20 bp, Artificial Sequence
  Description of Artificial Sequence: Synthetic oligonucleotide
  Target: SCN9A; (+) strand; PAM type: YTN; PAM sequence: TTA
tgccagaaacacttcttcca

SEQ ID NO: 103900 - DNA, 20 bp, Artificial Sequence
  Description of Artificial Sequence: Synthetic oligonucleotide
  Target: SCN9A; (+) strand; PAM type: YTN; PAM sequence: CTT
cttccacaattttttagagt

SEQ ID NO: 103901 - DNA, 20 bp, Artificial Sequence
  Description of Artificial Sequence: Synthetic oligonucleotide
  Target: SCN9A; (+) strand; PAM type: YTN; PAM sequence: TTC
ttccacaattttttagagtt

SEQ ID NO: 103902 - DNA, 20 bp, Artificial Sequence
  Description of Artificial Sequence: Synthetic oligonucleotide
  Target: SCN9A; (+) strand; PAM type: YTN; PAM sequence: CTT
ccacaattttttagagtttt

SEQ ID NO: 103903 - DNA, 20 bp, Artificial Sequence
  Description of Artificial Sequence: Synthetic oligonucleotide
  Target: SCN9A; (+) strand; PAM type: YTN; PAM sequence: TTC
cacaattttttagagttttg

SEQ ID NO: 103904 - DNA, 20 bp, Artificial Sequence
  Description of Artificial Sequence: Synthetic oligonucleotide
  Target: SCN9A; (+) strand; PAM type: YTN; PAM sequence: TTT
tttagagttttgatctactt

SEQ ID NO: 103905 - DNA, 20 bp, Artificial Sequence
  Description of Artificial Sequence: Synthetic oligonucleotide
  Target: SCN9A; (+) strand; PAM type: YTN; PAM sequence: TTT
ttagagttttgatctactta

SEQ ID NO: 103906 - DNA, 20 bp, Artificial Sequence
  Description of Artificial Sequence: Synthetic oligonucleotide
  Target: SCN9A; (+) strand; PAM type: YTN; PAM sequence: TTT
tagagttttgatctacttaa

SEQ ID NO: 103907 - DNA, 20 bp, Artificial Sequence
  Description of Artificial Sequence: Synthetic oligonucleotide
  Target: SCN9A; (+) strand; PAM type: YTN; PAM sequence: TTT
agagttttgatctacttaat

SEQ ID NO: 103908 - DNA, 20 bp, Artificial Sequence
  Description of Artificial Sequence: Synthetic oligonucleotide
  Target: SCN9A; (+) strand; PAM type: YTN; PAM sequence: TTA
gagttttgatctacttaatt

SEQ ID NO: 103909 - DNA, 20 bp, Artificial Sequence
  Description of Artificial Sequence: Synthetic oligonucleotide
  Target: SCN9A; (+) strand; PAM type: YTN; PAM sequence: TTT
tgatctacttaatttaaatg

SEQ ID NO: 103910 - DNA, 20 bp, Artificial Sequence
  Description of Artificial Sequence: Synthetic oligonucleotide
  Target: SCN9A; (+) strand; PAM type: YTN; PAM sequence: TTT
gatctacttaatttaaatgt

SEQ ID NO: 103911 - DNA, 20 bp, Artificial Sequence
  Description of Artificial Sequence: Synthetic oligonucleotide
  Target: SCN9A; (+) strand; PAM type: YTN; PAM sequence: TTG
atctacttaatttaaatgtg

SEQ ID NO: 103912 - DNA, 20 bp, Artificial Sequence
  Description of Artificial Sequence: Synthetic oligonucleotide
  Target: SCN9A; (+) strand; PAM type: YTN; PAM sequence: CTA
cttaatttaaatgtgacaat

SEQ ID NO: 103913 - DNA, 20 bp, Artificial Sequence
  Description of Artificial Sequence: Synthetic oligonucleotide
  Target: SCN9A; (+) strand; PAM type: YTN; PAM sequence: CTT
aatttaaatgtgacaattta

SEQ ID NO: 103914 - DNA, 20 bp, Artificial Sequence
  Description of Artificial Sequence: Synthetic oligonucleotide
  Target: SCN9A; (+) strand; PAM type: YTN; PAM sequence: TTA
atttaaatgtgacaatttaa

SEQ ID NO: 103915 - DNA, 20 bp, Artificial Sequence
  Description of Artificial Sequence: Synthetic oligonucleotide
  Target: SCN9A; (+) strand; PAM type: YTN; PAM sequence: TTT
aaatgtgacaatttaatgtg

SEQ ID NO: 103916 - DNA, 20 bp, Artificial Sequence
  Description of Artificial Sequence: Synthetic oligonucleotide
  Target: SCN9A; (+) strand; PAM type: YTN; PAM sequence: TTA
aatgtgacaatttaatgtga

SEQ ID NO: 103917 - DNA, 20 bp, Artificial Sequence
  Description of Artificial Sequence: Synthetic oligonucleotide
  Target: SCN9A; (+) strand; PAM type: YTN; PAM sequence: TTT
aatgtgatatacatctctcc

SEQ ID NO: 103918 - DNA, 20 bp, Artificial Sequence
  Description of Artificial Sequence: Synthetic oligonucleotide
  Target: SCN9A; (+) strand; PAM type: YTN; PAM sequence: TTA
atgtgatatacatctctcca

SEQ ID NO: 103919 - DNA, 20 bp, Artificial Sequence
  Description of Artificial Sequence: Synthetic oligonucleotide
  Target: SCN9A; (+) strand; PAM type: YTN; PAM sequence: CTC
tccatatttttatgtagatt

SEQ ID NO: 103920 - DNA, 20 bp, Artificial Sequence
  Description of Artificial Sequence: Synthetic oligonucleotide
  Target: SCN9A; (+) strand; PAM type: YTN; PAM sequence: CTC
catatttttatgtagattaa

SEQ ID NO: 103921 - DNA, 20 bp, Artificial Sequence
  Description of Artificial Sequence: Synthetic oligonucleotide
  Target: SCN9A; (+) strand; PAM type: YTN; PAM sequence: TTT
ttatgtagattaaatcagga

SEQ ID NO: 103922 - DNA, 20 bp, Artificial Sequence
  Description of Artificial Sequence: Synthetic oligonucleotide
  Target: SCN9A; (+) strand; PAM type: YTN; PAM sequence: TTT
tatgtagattaaatcaggaa

SEQ ID NO: 103923 - DNA, 20 bp, Artificial Sequence
  Description of Artificial Sequence: Synthetic oligonucleotide
  Target: SCN9A; (+) strand; PAM type: YTN; PAM sequence: TTT
atgtagattaaatcaggaag

SEQ ID NO: 103924 - DNA, 20 bp, Artificial Sequence
  Description of Artificial Sequence: Synthetic oligonucleotide
  Target: SCN9A; (+) strand; PAM type: YTN; PAM sequence: TTA
tgtagattaaatcaggaagg

SEQ ID NO: 103925 - DNA, 20 bp, Artificial Sequence
  Description of Artificial Sequence: Synthetic oligonucleotide
  Target: SCN9A; (+) strand; PAM type: YTN; PAM sequence: TTA
aatcaggaagggaagttgat

SEQ ID NO: 103926 - DNA, 20 bp, Artificial Sequence
  Description of Artificial Sequence: Synthetic oligonucleotide
  Target: SCN9A; (+) strand; PAM type: YTN; PAM sequence: TTG
atagaggttttcaaattaaa

SEQ ID NO: 103927 - DNA, 20 bp, Artificial Sequence
  Description of Artificial Sequence: Synthetic oligonucleotide
  Target: SCN9A; (+) strand; PAM type: YTN; PAM sequence: TTT
tcaaattaaatgtagcttca

SEQ ID NO: 103928 - DNA, 20 bp, Artificial Sequence
  Description of Artificial Sequence: Synthetic oligonucleotide
  Target: SCN9A; (+) strand; PAM type: YTN; PAM sequence: TTT
caaattaaatgtagcttcaa

SEQ ID NO: 103929 - DNA, 20 bp, Artificial Sequence
  Description of Artificial Sequence: Synthetic oligonucleotide
  Target: SCN9A; (+) strand; PAM type: YTN; PAM sequence: TTC
aaattaaatgtagcttcaat

SEQ ID NO: 103930 - DNA, 20 bp, Artificial Sequence
  Description of Artificial Sequence: Synthetic oligonucleotide
  Target: SCN9A; (+) strand; PAM type: YTN; PAM sequence: TTA
aatgtagcttcaatggctac

SEQ ID NO: 103931 - DNA, 20 bp, Artificial Sequence
  Description of Artificial Sequence: Synthetic oligonucleotide
  Target: SCN9A; (+) strand; PAM type: YTN; PAM sequence: CTT
caatggctactgttacattc

SEQ ID NO: 103932 - DNA, 20 bp, Artificial Sequence
  Description of Artificial Sequence: Synthetic oligonucleotide
  Target: SCN9A; (+) strand; PAM type: YTN; PAM sequence: TTC
aatggctactgttacattct

SEQ ID NO: 103933 - DNA, 20 bp, Artificial Sequence
  Description of Artificial Sequence: Synthetic oligonucleotide
  Target: SCN9A; (+) strand; PAM type: YTN; PAM sequence: CTA
ctgttacattctgcatttta

SEQ ID NO: 103934 - DNA, 20 bp, Artificial Sequence
  Description of Artificial Sequence: Synthetic oligonucleotide
  Target: SCN9A; (+) strand; PAM type: YTN; PAM sequence: CTG
ttacattctgcattttactt

SEQ ID NO: 103935 - DNA, 20 bp, Artificial Sequence
  Description of Artificial Sequence: Synthetic oligonucleotide
  Target: SCN9A; (+) strand; PAM type: YTN; PAM sequence: TTA
cattctgcattttactttta

SEQ ID NO: 103936 - DNA, 20 bp, Artificial Sequence
  Description of Artificial Sequence: Synthetic oligonucleotide
  Target: SCN9A; (+) strand; PAM type: YTN; PAM sequence: TTC
tgcattttacttttataatc

SEQ ID NO: 103937 - DNA, 20 bp, Artificial Sequence
  Description of Artificial Sequence: Synthetic oligonucleotide
  Target: SCN9A; (+) strand; PAM type: YTN; PAM sequence: CTG
cattttacttttataatcaa

SEQ ID NO: 103938 - DNA, 20 bp, Artificial Sequence
  Description of Artificial Sequence: Synthetic oligonucleotide
  Target: SCN9A; (+) strand; PAM type: YTN; PAM sequence: TTT
tacttttataatcaattcaa

SEQ ID NO: 103939 - DNA, 20 bp, Artificial Sequence
  Description of Artificial Sequence: Synthetic oligonucleotide
  Target: SCN9A; (+) strand; PAM type: YTN; PAM sequence: TTT
acttttataatcaattcaat

SEQ ID NO: 103940 - DNA, 20 bp, Artificial Sequence
  Description of Artificial Sequence: Synthetic oligonucleotide
  Target: SCN9A; (+) strand; PAM type: YTN; PAM sequence: TTA
cttttataatcaattcaata

SEQ ID NO: 103941 - DNA, 20 bp, Artificial Sequence
  Description of Artificial Sequence: Synthetic oligonucleotide
  Target: SCN9A; (+) strand; PAM type: YTN; PAM sequence: CTT
ttataatcaattcaataaaa

SEQ ID NO: 103942 - DNA, 20 bp, Artificial Sequence
  Description of Artificial Sequence: Synthetic oligonucleotide
  Target: SCN9A; (+) strand; PAM type: YTN; PAM sequence: TTT
tataatcaattcaataaaaa

SEQ ID NO: 103943 - DNA, 20 bp, Artificial Sequence
  Description of Artificial Sequence: Synthetic oligonucleotide
  Target: SCN9A; (+) strand; PAM type: YTN; PAM sequence: TTT
ataatcaattcaataaaaat

SEQ ID NO: 103944 - DNA, 20 bp, Artificial Sequence
  Description of Artificial Sequence: Synthetic oligonucleotide
  Target: SCN9A; (+) strand; PAM type: YTN; PAM sequence: TTA
taatcaattcaataaaaatc

SEQ ID NO: 103945 - DNA, 20 bp, Artificial Sequence
  Description of Artificial Sequence: Synthetic oligonucleotide
  Target: SCN9A; (+) strand; PAM type: YTN; PAM sequence: TTC
aataaaaatctacagatcat

SEQ ID NO: 103946 - DNA, 20 bp, Artificial Sequence
  Description of Artificial Sequence: Synthetic oligonucleotide
  Target: SCN9A; (+) strand; PAM type: YTN; PAM sequence: CTA
cagatcatgcacttgaaatc

SEQ ID NO: 103947 - DNA, 20 bp, Artificial Sequence
  Description of Artificial Sequence: Synthetic oligonucleotide
  Target: SCN9A; (+) strand; PAM type: YTN; PAM sequence: CTT
gaaatcacttaagcacatga

SEQ ID NO: 103948 - DNA, 20 bp, Artificial Sequence
  Description of Artificial Sequence: Synthetic oligonucleotide
  Target: SCN9A; (+) strand; PAM type: YTN; PAM sequence: TTG
aaatcacttaagcacatgaa

SEQ ID NO: 103949 - DNA, 20 bp, Artificial Sequence
  Description of Artificial Sequence: Synthetic oligonucleotide
  Target: SCN9A; (+) strand; PAM type: YTN; PAM sequence: CTT
aagcacatgaaggttacatc

SEQ ID NO: 103950 - DNA, 20 bp, Artificial Sequence
  Description of Artificial Sequence: Synthetic oligonucleotide
  Target: SCN9A; (+) strand; PAM type: YTN; PAM sequence: TTA
agcacatgaaggttacatca

SEQ ID NO: 103951 - DNA, 20 bp, Artificial Sequence
  Description of Artificial Sequence: Synthetic oligonucleotide
  Target: SCN9A; (+) strand; PAM type: YTN; PAM sequence: TTA
catcaagaagtcatcaagag

SEQ ID NO: 103952 - DNA, 20 bp, Artificial Sequence
  Description of Artificial Sequence: Synthetic oligonucleotide
  Target: SCN9A; (+) strand; PAM type: YTN; PAM sequence: TTG
ccctggtgacatgctgtgat

SEQ ID NO: 103953 - DNA, 20 bp, Artificial Sequence
  Description of Artificial Sequence: Synthetic oligonucleotide
  Target: SCN9A; (+) strand; PAM type: YTN; PAM sequence: CTG
gtgacatgctgtgatgtcac

SEQ ID NO: 103954 - DNA, 20 bp, Artificial Sequence
  Description of Artificial Sequence: Synthetic oligonucleotide
  Target: SCN9A; (+) strand; PAM type: YTN; PAM sequence: CTG
tgatgtcactttatctattg

SEQ ID NO: 103955 - DNA, 20 bp, Artificial Sequence
  Description of Artificial Sequence: Synthetic oligonucleotide
  Target: SCN9A; (+) strand; PAM type: YTN; PAM sequence: CTT
tatctattgaacaactgtat

SEQ ID NO: 103956 - DNA, 20 bp, Artificial Sequence
  Description of Artificial Sequence: Synthetic oligonucleotide
  Target: SCN9A; (+) strand; PAM type: YTN; PAM sequence: TTT
atctattgaacaactgtata

SEQ ID NO: 103957 - DNA, 20 bp, Artificial Sequence
  Description of Artificial Sequence: Synthetic oligonucleotide
  Target: SCN9A; (+) strand; PAM type: YTN; PAM sequence: TTA
tctattgaacaactgtatat

SEQ ID NO: 103958 - DNA, 20 bp, Artificial Sequence
  Description of Artificial Sequence: Synthetic oligonucleotide
  Target: SCN9A; (+) strand; PAM type: YTN; PAM sequence: CTA
ttgaacaactgtatatgttt

SEQ ID NO: 103959 - DNA, 20 bp, Artificial Sequence
  Description of Artificial Sequence: Synthetic oligonucleotide
  Target: SCN9A; (+) strand; PAM type: YTN; PAM sequence: TTG
aacaactgtatatgtttcta

SEQ ID NO: 103960 - DNA, 20 bp, Artificial Sequence
  Description of Artificial Sequence: Synthetic oligonucleotide
  Target: SCN9A; (+) strand; PAM type: YTN; PAM sequence: CTG
tatatgtttctactttcttg

SEQ ID NO: 103961 - DNA, 20 bp, Artificial Sequence
  Description of Artificial Sequence: Synthetic oligonucleotide
  Target: SCN9A; (+) strand; PAM type: YTN; PAM sequence: TTT
ctactttcttgcagtgggtc

SEQ ID NO: 103962 - DNA, 20 bp, Artificial Sequence
  Description of Artificial Sequence: Synthetic oligonucleotide
  Target: SCN9A; (+) strand; PAM type: YTN; PAM sequence: TTC
tactttcttgcagtgggtca

SEQ ID NO: 103963 - DNA, 20 bp, Artificial Sequence
  Description of Artificial Sequence: Synthetic oligonucleotide
  Target: SCN9A; (+) strand; PAM type: YTN; PAM sequence: CTA
ctttcttgcagtgggtcagg

SEQ ID NO: 103964 - DNA, 20 bp, Artificial Sequence
  Description of Artificial Sequence: Synthetic oligonucleotide
  Target: SCN9A; (+) strand; PAM type: YTN; PAM sequence: CTT
tcttgcagtgggtcaggcag

SEQ ID NO: 103965 - DNA, 20 bp, Artificial Sequence
  Description of Artificial Sequence: Synthetic oligonucleotide
  Target: SCN9A; (+) strand; PAM type: YTN; PAM sequence: TTT
cttgcagtgggtcaggcaga

SEQ ID NO: 103966 - DNA, 20 bp, Artificial Sequence
  Description of Artificial Sequence: Synthetic oligonucleotide
  Target: SCN9A; (+) strand; PAM type: YTN; PAM sequence: TTC
ttgcagtgggtcaggcagaa

SEQ ID NO: 103967 - DNA, 20 bp, Artificial Sequence
  Description of Artificial Sequence: Synthetic oligonucleotide
  Target: SCN9A; (+) strand; PAM type: YTN; PAM sequence: CTT
gcagtgggtcaggcagaaag

SEQ ID NO: 103968 - DNA, 20 bp, Artificial Sequence
  Description of Artificial Sequence: Synthetic oligonucleotide
  Target: SCN9A; (+) strand; PAM type: YTN; PAM sequence: TTG
cagtgggtcaggcagaaagg

SEQ ID NO: 103969 - DNA, 20 bp, Artificial Sequence
  Description of Artificial Sequence: Synthetic oligonucleotide
  Target: SCN9A; (+) strand; PAM type: YTN; PAM sequence: TTT
tgtagctgaacagcatgcaa

SEQ ID NO: 103970 - DNA, 20 bp, Artificial Sequence
  Description of Artificial Sequence: Synthetic oligonucleotide
  Target: SCN9A; (+) strand; PAM type: YTN; PAM sequence: TTT
gtagctgaacagcatgcaag

SEQ ID NO: 103971 - DNA, 20 bp, Artificial Sequence
  Description of Artificial Sequence: Synthetic oligonucleotide
  Target: SCN9A; (+) strand; PAM type: YTN; PAM sequence: TTG
tagctgaacagcatgcaaga

SEQ ID NO: 103972 - DNA, 20 bp, Artificial Sequence
  Description of Artificial Sequence: Synthetic oligonucleotide
  Target: SCN9A; (+) strand; PAM type: YTN; PAM sequence: CTG
aacagcatgcaagacattga

SEQ ID NO: 103973 - DNA, 20 bp, Artificial Sequence
  Description of Artificial Sequence: Synthetic oligonucleotide
  Target: SCN9A; (+) strand; PAM type: YTN; PAM sequence: TTG
aaaaaatatcgtatgtatga

SEQ ID NO: 103974 - DNA, 20 bp, Artificial Sequence
  Description of Artificial Sequence: Synthetic oligonucleotide
  Target: SCN9A; (+) strand; PAM type: YTN; PAM sequence: TTT
ttttaggtaacctgtgtaaa

SEQ ID NO: 103975 - DNA, 20 bp, Artificial Sequence
  Description of Artificial Sequence: Synthetic oligonucleotide
  Target: SCN9A; (+) strand; PAM type: YTN; PAM sequence: TTT
tttaggtaacctgtgtaaaa

SEQ ID NO: 103976 - DNA, 20 bp, Artificial Sequence
  Description of Artificial Sequence: Synthetic oligonucleotide
  Target: SCN9A; (+) strand; PAM type: YTN; PAM sequence: TTT
ttaggtaacctgtgtaaaag

SEQ ID NO: 103977 - DNA, 20 bp, Artificial Sequence
  Description of Artificial Sequence: Synthetic oligonucleotide
  Target: SCN9A; (+) strand; PAM type: YTN; PAM sequence: TTT
taggtaacctgtgtaaaagt

SEQ ID NO: 103978 - DNA, 20 bp, Artificial Sequence
  Description of Artificial Sequence: Synthetic oligonucleotide
  Target: SCN9A; (+) strand; PAM type: YTN; PAM sequence: TTT
aggtaacctgtgtaaaagtg

SEQ ID NO: 103979 - DNA, 20 bp, Artificial Sequence
  Description of Artificial Sequence: Synthetic oligonucleotide
  Target: SCN9A; (+) strand; PAM type: YTN; PAM sequence: TTA
ggtaacctgtgtaaaagtgg

SEQ ID NO: 103980 - DNA, 20 bp, Artificial Sequence
  Description of Artificial Sequence: Synthetic oligonucleotide
  Target: SCN9A; (+) strand; PAM type: YTN; PAM sequence: CTG
tgtaaaagtggtgacatatg

SEQ ID NO: 103981 - DNA, 20 bp, Artificial Sequence
  Description of Artificial Sequence: Synthetic oligonucleotide
  Target: SCN9A; (+) strand; PAM type: YTN; PAM sequence: CTC
tgcctggttaaaagcacaga

SEQ ID NO: 103982 - DNA, 20 bp, Artificial Sequence
  Description of Artificial Sequence: Synthetic oligonucleotide
  Target: SCN9A; (+) strand; PAM type: YTN; PAM sequence: CTG
cctggttaaaagcacagagc

SEQ ID NO: 103983 - DNA, 20 bp, Artificial Sequence
  Description of Artificial Sequence: Synthetic oligonucleotide
  Target: SCN9A; (+) strand; PAM type: YTN; PAM sequence: CTG
gttaaaagcacagagctgca

SEQ ID NO: 103984 - DNA, 20 bp, Artificial Sequence
  Description of Artificial Sequence: Synthetic oligonucleotide
  Target: SCN9A; (+) strand; PAM type: YTN; PAM sequence: TTA
aaagcacagagctgcatcct

SEQ ID NO: 103985 - DNA, 20 bp, Artificial Sequence
  Description of Artificial Sequence: Synthetic oligonucleotide
  Target: SCN9A; (+) strand; PAM type: YTN; PAM sequence: CTG
catccttgactgatccagtt

SEQ ID NO: 103986 - DNA, 20 bp, Artificial Sequence
  Description of Artificial Sequence: Synthetic oligonucleotide
  Target: SCN9A; (+) strand; PAM type: YTN; PAM sequence: CTT
gactgatccagtttgatatt

SEQ ID NO: 103987 - DNA, 20 bp, Artificial Sequence
  Description of Artificial Sequence: Synthetic oligonucleotide
  Target: SCN9A; (+) strand; PAM type: YTN; PAM sequence: TTG
actgatccagtttgatatta

SEQ ID NO: 103988 - DNA, 20 bp, Artificial Sequence
  Description of Artificial Sequence: Synthetic oligonucleotide
  Target: SCN9A; (+) strand; PAM type: YTN; PAM sequence: CTG
atccagtttgatattacccc

SEQ ID NO: 103989 - DNA, 20 bp, Artificial Sequence
  Description of Artificial Sequence: Synthetic oligonucleotide
  Target: SCN9A; (+) strand; PAM type: YTN; PAM sequence: TTT
gatattacccctgtgagaag

SEQ ID NO: 103990 - DNA, 20 bp, Artificial Sequence
  Description of Artificial Sequence: Synthetic oligonucleotide
  Target: SCN9A; (+) strand; PAM type: YTN; PAM sequence: TTG
atattacccctgtgagaaga

SEQ ID NO: 103991 - DNA, 20 bp, Artificial Sequence
  Description of Artificial Sequence: Synthetic oligonucleotide
  Target: SCN9A; (+) strand; PAM type: YTN; PAM sequence: TTA
cccctgtgagaagaaggtta

SEQ ID NO: 103992 - DNA, 20 bp, Artificial Sequence
  Description of Artificial Sequence: Synthetic oligonucleotide
  Target: SCN9A; (+) strand; PAM type: YTN; PAM sequence: CTG
tgagaagaaggttaggtact

SEQ ID NO: 103993 - DNA, 20 bp, Artificial Sequence
  Description of Artificial Sequence: Synthetic oligonucleotide
  Target: SCN9A; (+) strand; PAM type: YTN; PAM sequence: TTA
ggtactgaattttagaaatg

SEQ ID NO: 103994 - DNA, 20 bp, Artificial Sequence
  Description of Artificial Sequence: Synthetic oligonucleotide
  Target: SCN9A; (+) strand; PAM type: YTN; PAM sequence: CTG
aattttagaaatgcagcatg

SEQ ID NO: 103995 - DNA, 20 bp, Artificial Sequence
  Description of Artificial Sequence: Synthetic oligonucleotide
  Target: SCN9A; (+) strand; PAM type: YTN; PAM sequence: TTT
tagaaatgcagcatgatgaa

SEQ ID NO: 103996 - DNA, 20 bp, Artificial Sequence
  Description of Artificial Sequence: Synthetic oligonucleotide
  Target: SCN9A; (+) strand; PAM type: YTN; PAM sequence: TTT
agaaatgcagcatgatgaaa

SEQ ID NO: 103997 - DNA, 20 bp, Artificial Sequence
  Description of Artificial Sequence: Synthetic oligonucleotide
  Target: SCN9A; (+) strand; PAM type: YTN; PAM sequence: TTA
gaaatgcagcatgatgaaag

SEQ ID NO: 103998 - DNA, 20 bp, Artificial Sequence
  Description of Artificial Sequence: Synthetic oligonucleotide
  Target: SCN9A; (+) strand; PAM type: YTN; PAM sequence: TTT
agtcaactgtgttttaaaat

SEQ ID NO: 103999 - DNA, 20 bp, Artificial Sequence
  Description of Artificial Sequence: Synthetic oligonucleotide
  Target: SCN9A; (+) strand; PAM type: YTN; PAM sequence: TTA
gtcaactgtgttttaaaatg

SEQ ID NO: 104000 - DNA, 20 bp, Artificial Sequence
  Description of Artificial Sequence: Synthetic oligonucleotide
  Target: SCN9A; (+) strand; PAM type: YTN; PAM sequence: CTG
tgttttaaaatgtttaaagt

SEQ ID NO: 104001 - DNA, 20 bp, Artificial Sequence
  Description of Artificial Sequence: Synthetic oligonucleotide
  Target: SCN9A; (+) strand; PAM type: YTN; PAM sequence: TTT
taaaatgtttaaagtcatat

SEQ ID NO: 104002 - DNA, 20 bp, Artificial Sequence
  Description of Artificial Sequence: Synthetic oligonucleotide
  Target: SCN9A; (+) strand; PAM type: YTN; PAM sequence: TTT
aaaatgtttaaagtcatata

SEQ ID NO: 104003 - DNA, 20 bp, Artificial Sequence
  Description of Artificial Sequence: Synthetic oligonucleotide
  Target: SCN9A; (+) strand; PAM type: YTN; PAM sequence: TTA
aaatgtttaaagtcatatac

SEQ ID NO: 104004 - DNA, 20 bp, Artificial Sequence
  Description of Artificial Sequence: Synthetic oligonucleotide
  Target: SCN9A; (+) strand; PAM type: YTN; PAM sequence: TTT
aaagtcatatacctgtaagt

SEQ ID NO: 104005 - DNA, 20 bp, Artificial Sequence
  Description of Artificial Sequence: Synthetic oligonucleotide
  Target: SCN9A; (+) strand; PAM type: YTN; PAM sequence: TTA
aagtcatatacctgtaagta

SEQ ID NO: 104006 - DNA, 20 bp, Artificial Sequence
  Description of Artificial Sequence: Synthetic oligonucleotide
  Target: SCN9A; (+) strand; PAM type: YTN; PAM sequence: CTG
taagtagaaattagttacat

SEQ ID NO: 104007 - DNA, 20 bp, Artificial Sequence
  Description of Artificial Sequence: Synthetic oligonucleotide
  Target: SCN9A; (+) strand; PAM type: YTN; PAM sequence: TTA
gttacatatttgaaagtaca

SEQ ID NO: 104008 - DNA, 20 bp, Artificial Sequence
  Description of Artificial Sequence: Synthetic oligonucleotide
  Target: SCN9A; (+) strand; PAM type: YTN; PAM sequence: TTA
catatttgaaagtacatgct

SEQ ID NO: 104009 - DNA, 20 bp, Artificial Sequence
  Description of Artificial Sequence: Synthetic oligonucleotide
  Target: SCN9A; (+) strand; PAM type: YTN; PAM sequence: TTT
gaaagtacatgctatatact

SEQ ID NO: 104010 - DNA, 20 bp, Artificial Sequence
  Description of Artificial Sequence: Synthetic oligonucleotide
  Target: SCN9A; (+) strand; PAM type: YTN; PAM sequence: TTG
aaagtacatgctatatactc

SEQ ID NO: 104011 - DNA, 20 bp, Artificial Sequence
  Description of Artificial Sequence: Synthetic oligonucleotide
  Target: SCN9A; (+) strand; PAM type: YTN; PAM sequence: CTA
tatactcaacgttaagcaat

SEQ ID NO: 104012 - DNA, 20 bp, Artificial Sequence
  Description of Artificial Sequence: Synthetic oligonucleotide
  Target: SCN9A; (+) strand; PAM type: YTN; PAM sequence: CTC
aacgttaagcaatatatttg

SEQ ID NO: 104013 - DNA, 20 bp, Artificial Sequence
  Description of Artificial Sequence: Synthetic oligonucleotide
  Target: SCN9A; (+) strand; PAM type: YTN; PAM sequence: TTA
agcaatatatttgaatcaca

SEQ ID NO: 104014 - DNA, 20 bp, Artificial Sequence
  Description of Artificial Sequence: Synthetic oligonucleotide
  Target: SCN9A; (+) strand; PAM type: YTN; PAM sequence: TTT
gaatcacagtactaagatta

SEQ ID NO: 104015 - DNA, 20 bp, Artificial Sequence
  Description of Artificial Sequence: Synthetic oligonucleotide
  Target: SCN9A; (+) strand; PAM type: YTN; PAM sequence: TTG
aatcacagtactaagattaa

SEQ ID NO: 104016 - DNA, 20 bp, Artificial Sequence
  Description of Artificial Sequence: Synthetic oligonucleotide
  Target: SCN9A; (+) strand; PAM type: YTN; PAM sequence: CTA
agattaaatgtcattcaaca

SEQ ID NO: 104017 - DNA, 20 bp, Artificial Sequence
  Description of Artificial Sequence: Synthetic oligonucleotide
  Target: SCN9A; (+) strand; PAM type: YTN; PAM sequence: TTA
aatgtcattcaacagagact

SEQ ID NO: 104018 - DNA, 20 bp, Artificial Sequence
  Description of Artificial Sequence: Synthetic oligonucleotide
  Target: SCN9A; (+) strand; PAM type: YTN; PAM sequence: TTC
aacagagacttaaaaacaat

SEQ ID NO: 104019 - DNA, 20 bp, Artificial Sequence
  Description of Artificial Sequence: Synthetic oligonucleotide
  Target: SCN9A; (+) strand; PAM type: YTN; PAM sequence: CTT
aaaaacaatcaattaaacag

SEQ ID NO: 104020 - DNA, 20 bp, Artificial Sequence
  Description of Artificial Sequence: Synthetic oligonucleotide
  Target: SCN9A; (+) strand; PAM type: YTN; PAM sequence: TTA
aaaacaatcaattaaacagt

SEQ ID NO: 104021 - DNA, 20 bp, Artificial Sequence
  Description of Artificial Sequence: Synthetic oligonucleotide
  Target: SCN9A; (+) strand; PAM type: YTN; PAM sequence: TTA
aacagttacataattctact

SEQ ID NO: 104022 - DNA, 20 bp, Artificial Sequence
  Description of Artificial Sequence: Synthetic oligonucleotide
  Target: SCN9A; (+) strand; PAM type: YTN; PAM sequence: TTA
cataattctactctactatt

SEQ ID NO: 104023 - DNA, 20 bp, Artificial Sequence
  Description of Artificial Sequence: Synthetic oligonucleotide
  Target: SCN9A; (+) strand; PAM type: YTN; PAM sequence: TTC
tactctactatttaaaaatt

SEQ ID NO: 104024 - DNA, 20 bp, Artificial Sequence
  Description of Artificial Sequence: Synthetic oligonucleotide
  Target: SCN9A; (+) strand; PAM type: YTN; PAM sequence: CTA
ctctactatttaaaaattga

SEQ ID NO: 104025 - DNA, 20 bp, Artificial Sequence
  Description of Artificial Sequence: Synthetic oligonucleotide
  Target: SCN9A; (+) strand; PAM type: YTN; PAM sequence: CTC
tactatttaaaaattgaatt

SEQ ID NO: 104026 - DNA, 20 bp, Artificial Sequence
  Description of Artificial Sequence: Synthetic oligonucleotide
  Target: SCN9A; (+) strand; PAM type: YTN; PAM sequence: CTA
ctatttaaaaattgaattta

SEQ ID NO: 104027 - DNA, 20 bp, Artificial Sequence
  Description of Artificial Sequence: Synthetic oligonucleotide
  Target: SCN9A; (+) strand; PAM type: YTN; PAM sequence: CTA
tttaaaaattgaatttaaat

SEQ ID NO: 104028 - DNA, 20 bp, Artificial Sequence
  Description of Artificial Sequence: Synthetic oligonucleotide
  Target: SCN9A; (+) strand; PAM type: YTN; PAM sequence: TTT
aaaaattgaatttaaatact

SEQ ID NO: 104029 - DNA, 20 bp, Artificial Sequence
  Description of Artificial Sequence: Synthetic oligonucleotide
  Target: SCN9A; (+) strand; PAM type: YTN; PAM sequence: TTA
aaaattgaatttaaatacta

SEQ ID NO: 104030 - DNA, 20 bp, Artificial Sequence
  Description of Artificial Sequence: Synthetic oligonucleotide
  Target: SCN9A; (+) strand; PAM type: YTN; PAM sequence: TTG
aatttaaatactataatgtg

SEQ ID NO: 104031 - DNA, 20 bp, Artificial Sequence
  Description of Artificial Sequence: Synthetic oligonucleotide
  Target: SCN9A; (+) strand; PAM type: YTN; PAM sequence: TTT
aaatactataatgtgctaat

SEQ ID NO: 104032 - DNA, 20 bp, Artificial Sequence
  Description of Artificial Sequence: Synthetic oligonucleotide
  Target: SCN9A; (+) strand; PAM type: YTN; PAM sequence: TTA
aatactataatgtgctaatg

SEQ ID NO: 104033 - DNA, 20 bp, Artificial Sequence
  Description of Artificial Sequence: Synthetic oligonucleotide
  Target: SCN9A; (+) strand; PAM type: YTN; PAM sequence: CTA
taatgtgctaatgcaatgtt

SEQ ID NO: 104034 - DNA, 20 bp, Artificial Sequence
  Description of Artificial Sequence: Synthetic oligonucleotide
  Target: SCN9A; (+) strand; PAM type: YTN; PAM sequence: CTA
atgcaatgttttgcattcta

SEQ ID NO: 104035 - DNA, 20 bp, Artificial Sequence
  Description of Artificial Sequence: Synthetic oligonucleotide
  Target: SCN9A; (+) strand; PAM type: YTN; PAM sequence: TTT
tgcattctatttttccttaa

SEQ ID NO: 104036 - DNA, 20 bp, Artificial Sequence
  Description of Artificial Sequence: Synthetic oligonucleotide
  Target: SCN9A; (+) strand; PAM type: YTN; PAM sequence: TTT
gcattctatttttccttaaa

SEQ ID NO: 104037 - DNA, 20 bp, Artificial Sequence
  Description of Artificial Sequence: Synthetic oligonucleotide
  Target: SCN9A; (+) strand; PAM type: YTN; PAM sequence: TTG
cattctatttttccttaaat

SEQ ID NO: 104038 - DNA, 20 bp, Artificial Sequence
  Description of Artificial Sequence: Synthetic oligonucleotide
  Target: SCN9A; (+) strand; PAM type: YTN; PAM sequence: TTC
tatttttccttaaatgcaag

SEQ ID NO: 104039 - DNA, 20 bp, Artificial Sequence
  Description of Artificial Sequence: Synthetic oligonucleotide
  Target: SCN9A; (+) strand; PAM type: YTN; PAM sequence: CTA
tttttccttaaatgcaagca

SEQ ID NO: 104040 - DNA, 20 bp, Artificial Sequence
  Description of Artificial Sequence: Synthetic oligonucleotide
  Target: SCN9A; (+) strand; PAM type: YTN; PAM sequence: TTT
ttccttaaatgcaagcaaca

SEQ ID NO: 104041 - DNA, 20 bp, Artificial Sequence
  Description of Artificial Sequence: Synthetic oligonucleotide
  Target: SCN9A; (+) strand; PAM type: YTN; PAM sequence: TTT
tccttaaatgcaagcaacat

SEQ ID NO: 104042 - DNA, 20 bp, Artificial Sequence
  Description of Artificial Sequence: Synthetic oligonucleotide
  Target: SCN9A; (+) strand; PAM type: YTN; PAM sequence: TTT
ccttaaatgcaagcaacatt

SEQ ID NO: 104043 - DNA, 20 bp, Artificial Sequence
  Description of Artificial Sequence: Synthetic oligonucleotide
  Target: SCN9A; (+) strand; PAM type: YTN; PAM sequence: TTC
cttaaatgcaagcaacattt

SEQ ID NO: 104044 - DNA, 20 bp, Artificial Sequence
  Description of Artificial Sequence: Synthetic oligonucleotide
  Target: SCN9A; (+) strand; PAM type: YTN; PAM sequence: CTT
aaatgcaagcaacatttaaa

SEQ ID NO: 104045 - DNA, 20 bp, Artificial Sequence
  Description of Artificial Sequence: Synthetic oligonucleotide
  Target: SCN9A; (+) strand; PAM type: YTN; PAM sequence: TTA
aatgcaagcaacatttaaat

SEQ ID NO: 104046 - DNA, 20 bp, Artificial Sequence
  Description of Artificial Sequence: Synthetic oligonucleotide
  Target: SCN9A; (+) strand; PAM type: YTN; PAM sequence: TTT
aaatataagtgattctcagt

SEQ ID NO: 104047 - DNA, 20 bp, Artificial Sequence
  Description of Artificial Sequence: Synthetic oligonucleotide
  Target: SCN9A; (+) strand; PAM type: YTN; PAM sequence: TTA
aatataagtgattctcagta

SEQ ID NO: 104048 - DNA, 20 bp, Artificial Sequence
  Description of Artificial Sequence: Synthetic oligonucleotide
  Target: SCN9A; (+) strand; PAM type: YTN; PAM sequence: TTC
tcagtatagggggtgaggtg

SEQ ID NO: 104049 - DNA, 20 bp, Artificial Sequence
  Description of Artificial Sequence: Synthetic oligonucleotide
  Target: SCN9A; (+) strand; PAM type: YTN; PAM sequence: CTC
agtatagggggtgaggtggc

SEQ ID NO: 104050 - DNA, 20 bp, Artificial Sequence
  Description of Artificial Sequence: Synthetic oligonucleotide
  Target: SCN9A; (+) strand; PAM type: YTN; PAM sequence: CTT
taaaaagcatattctaaaat

SEQ ID NO: 104051 - DNA, 20 bp, Artificial Sequence
  Description of Artificial Sequence: Synthetic oligonucleotide
  Target: SCN9A; (+) strand; PAM type: YTN; PAM sequence: TTT
aaaaagcatattctaaaatt

SEQ ID NO: 104052 - DNA, 20 bp, Artificial Sequence
  Description of Artificial Sequence: Synthetic oligonucleotide
  Target: SCN9A; (+) strand; PAM type: YTN; PAM sequence: TTA
aaaagcatattctaaaatta

SEQ ID NO: 104053 - DNA, 20 bp, Artificial Sequence
  Description of Artificial Sequence: Synthetic oligonucleotide
  Target: SCN9A; (+) strand; PAM type: YTN; PAM sequence: TTC
taaaattagcatttcttgat

SEQ ID NO: 104054 - DNA, 20 bp, Artificial Sequence
  Description of Artificial Sequence: Synthetic oligonucleotide
  Target: SCN9A; (+) strand; PAM type: YTN; PAM sequence: CTA
aaattagcatttcttgattg

SEQ ID NO: 104055 - DNA, 20 bp, Artificial Sequence
  Description of Artificial Sequence: Synthetic oligonucleotide
  Target: SCN9A; (+) strand; PAM type: YTN; PAM sequence: TTA
gcatttcttgattgacttat

SEQ ID NO: 104056 - DNA, 20 bp, Artificial Sequence
  Description of Artificial Sequence: Synthetic oligonucleotide
  Target: SCN9A; (+) strand; PAM type: YTN; PAM sequence: TTT
cttgattgacttatttttat

SEQ ID NO: 104057 - DNA, 20 bp, Artificial Sequence
  Description of Artificial Sequence: Synthetic oligonucleotide
  Target: SCN9A; (+) strand; PAM type: YTN; PAM sequence: TTC
ttgattgacttatttttatt

SEQ ID NO: 104058 - DNA, 20 bp, Artificial Sequence
  Description of Artificial Sequence: Synthetic oligonucleotide
  Target: SCN9A; (+) strand; PAM type: YTN; PAM sequence: CTT
gattgacttatttttattta

SEQ ID NO: 104059 - DNA, 20 bp, Artificial Sequence
  Description of Artificial Sequence: Synthetic oligonucleotide
  Target: SCN9A; (+) strand; PAM type: YTN; PAM sequence: TTG
attgacttatttttatttaa

SEQ ID NO: 104060 - DNA, 20 bp, Artificial Sequence
  Description of Artificial Sequence: Synthetic oligonucleotide
  Target: SCN9A; (+) strand; PAM type: YTN; PAM sequence: TTG
acttatttttatttaattaa

SEQ ID NO: 104061 - DNA, 20 bp, Artificial Sequence
  Description of Artificial Sequence: Synthetic oligonucleotide
  Target: SCN9A; (+) strand; PAM type: YTN; PAM sequence: CTT
atttttatttaattaatttt

SEQ ID NO: 104062 - DNA, 20 bp, Artificial Sequence
  Description of Artificial Sequence: Synthetic oligonucleotide
  Target: SCN9A; (+) strand; PAM type: YTN; PAM sequence: TTA
tttttatttaattaattttg

SEQ ID NO: 104063 - DNA, 20 bp, Artificial Sequence
  Description of Artificial Sequence: Synthetic oligonucleotide
  Target: SCN9A; (+) strand; PAM type: YTN; PAM sequence: TTT
ttatttaattaattttgaca

SEQ ID NO: 104064 - DNA, 20 bp, Artificial Sequence
  Description of Artificial Sequence: Synthetic oligonucleotide
  Target: SCN9A; (+) strand; PAM type: YTN; PAM sequence: TTT
tatttaattaattttgacat

SEQ ID NO: 104065 - DNA, 20 bp, Artificial Sequence
  Description of Artificial Sequence: Synthetic oligonucleotide
  Target: SCN9A; (+) strand; PAM type: YTN; PAM sequence: TTT
atttaattaattttgacatt

SEQ ID NO: 104066 - DNA, 20 bp, Artificial Sequence
  Description of Artificial Sequence: Synthetic oligonucleotide
  Target: SCN9A; (+) strand; PAM type: YTN; PAM sequence: TTA
tttaattaattttgacattt

SEQ ID NO: 104067 - DNA, 20 bp, Artificial Sequence
  Description of Artificial Sequence: Synthetic oligonucleotide
  Target: SCN9A; (+) strand; PAM type: YTN; PAM sequence: TTT
aattaattttgacattttaa

SEQ ID NO: 104068 - DNA, 20 bp, Artificial Sequence
  Description of Artificial Sequence: Synthetic oligonucleotide
  Target: SCN9A; (+) strand; PAM type: YTN; PAM sequence: TTA
attaattttgacattttaaa

SEQ ID NO: 104069 - DNA, 20 bp, Artificial Sequence
  Description of Artificial Sequence: Synthetic oligonucleotide
  Target: SCN9A; (+) strand; PAM type: YTN; PAM sequence: TTA
attttgacattttaaacagc

SEQ ID NO: 104070 - DNA, 20 bp, Artificial Sequence
  Description of Artificial Sequence: Synthetic oligonucleotide
  Target: SCN9A; (+) strand; PAM type: YTN; PAM sequence: TTT
tgacattttaaacagcattg

SEQ ID NO: 104071 - DNA, 20 bp, Artificial Sequence
  Description of Artificial Sequence: Synthetic oligonucleotide
  Target: SCN9A; (+) strand; PAM type: YTN; PAM sequence: TTT
gacattttaaacagcattgc

SEQ ID NO: 104072 - DNA, 20 bp, Artificial Sequence
  Description of Artificial Sequence: Synthetic oligonucleotide
  Target: SCN9A; (+) strand; PAM type: YTN; PAM sequence: TTG
acattttaaacagcattgca

SEQ ID NO: 104073 - DNA, 20 bp, Artificial Sequence
  Description of Artificial Sequence: Synthetic oligonucleotide
  Target: SCN9A; (+) strand; PAM type: YTN; PAM sequence: TTT
taaacagcattgcaaaaaag

SEQ ID NO: 104074 - DNA, 20 bp, Artificial Sequence
  Description of Artificial Sequence: Synthetic oligonucleotide
  Target: SCN9A; (+) strand; PAM type: YTN; PAM sequence: TTT
aaacagcattgcaaaaaagt

SEQ ID NO: 104075 - DNA, 20 bp, Artificial Sequence
  Description of Artificial Sequence: Synthetic oligonucleotide
  Target: SCN9A; (+) strand; PAM type: YTN; PAM sequence: TTA
aacagcattgcaaaaaagtg

SEQ ID NO: 104076 - DNA, 20 bp, Artificial Sequence
  Description of Artificial Sequence: Synthetic oligonucleotide
  Target: SCN9A; (+) strand; PAM type: YTN; PAM sequence: TTG
caaaaaagtgaagtttccaa

SEQ ID NO: 104077 - DNA, 20 bp, Artificial Sequence
  Description of Artificial Sequence: Synthetic oligonucleotide
  Target: SCN9A; (+) strand; PAM type: YTN; PAM sequence: TTT
ccaaatttatcaaaatataa

SEQ ID NO: 104078 - DNA, 20 bp, Artificial Sequence
  Description of Artificial Sequence: Synthetic oligonucleotide
  Target: SCN9A; (+) strand; PAM type: YTN; PAM sequence: TTC
caaatttatcaaaatataaa

SEQ ID NO: 104079 - DNA, 20 bp, Artificial Sequence
  Description of Artificial Sequence: Synthetic oligonucleotide
  Target: SCN9A; (+) strand; PAM type: YTN; PAM sequence: TTT
atcaaaatataaagaataag

SEQ ID NO: 104080 - DNA, 20 bp, Artificial Sequence
  Description of Artificial Sequence: Synthetic oligonucleotide
  Target: SCN9A; (+) strand; PAM type: YTN; PAM sequence: TTA
tcaaaatataaagaataaga

SEQ ID NO: 104081 - DNA, 20 bp, Artificial Sequence
  Description of Artificial Sequence: Synthetic oligonucleotide
  Target: SCN9A; (+) strand; PAM type: YTN; PAM sequence: TTG
atttgaatatgtcagacaaa

SEQ ID NO: 104082 - DNA, 20 bp, Artificial Sequence
  Description of Artificial Sequence: Synthetic oligonucleotide
  Target: SCN9A; (+) strand; PAM type: YTN; PAM sequence: TTT
gaatatgtcagacaaatatt

SEQ ID NO: 104083 - DNA, 20 bp, Artificial Sequence
  Description of Artificial Sequence: Synthetic oligonucleotide
  Target: SCN9A; (+) strand; PAM type: YTN; PAM sequence: TTG
aatatgtcagacaaatattt

SEQ ID NO: 104084 - DNA, 20 bp, Artificial Sequence
  Description of Artificial Sequence: Synthetic oligonucleotide
  Target: SCN9A; (+) strand; PAM type: YTN; PAM sequence: TTT
cattgtttttaggcacgtaa

SEQ ID NO: 104085 - DNA, 20 bp, Artificial Sequence
  Description of Artificial Sequence: Synthetic oligonucleotide
  Target: SCN9A; (+) strand; PAM type: YTN; PAM sequence: TTC
attgtttttaggcacgtaaa

SEQ ID NO: 104086 - DNA, 20 bp, Artificial Sequence
  Description of Artificial Sequence: Synthetic oligonucleotide
  Target: SCN9A; (+) strand; PAM type: YTN; PAM sequence: TTG
tttttaggcacgtaaacaaa

SEQ ID NO: 104087 - DNA, 20 bp, Artificial Sequence
  Description of Artificial Sequence: Synthetic oligonucleotide
  Target: SCN9A; (+) strand; PAM type: YTN; PAM sequence: TTT
ttaggcacgtaaacaaatcc

SEQ ID NO: 104088 - DNA, 20 bp, Artificial Sequence
  Description of Artificial Sequence: Synthetic oligonucleotide
  Target: SCN9A; (+) strand; PAM type: YTN; PAM sequence: TTT
taggcacgtaaacaaatcca

SEQ ID NO: 104089 - DNA, 20 bp, Artificial Sequence
  Description of Artificial Sequence: Synthetic oligonucleotide
  Target: SCN9A; (+) strand; PAM type: YTN; PAM sequence: TTT
aggcacgtaaacaaatccaa

SEQ ID NO: 104090 - DNA, 20 bp, Artificial Sequence
  Description of Artificial Sequence: Synthetic oligonucleotide
  Target: SCN9A; (+) strand; PAM type: YTN; PAM sequence: TTA
ggcacgtaaacaaatccaat

SEQ ID NO: 104091 - DNA, 20 bp, Artificial Sequence
  Description of Artificial Sequence: Synthetic oligonucleotide
  Target: SCN9A; (+) strand; PAM type: YTN; PAM sequence: TTT
ttcaaattctttggaaacaa

SEQ ID NO: 104092 - DNA, 20 bp, Artificial Sequence
  Description of Artificial Sequence: Synthetic oligonucleotide
  Target: SCN9A; (+) strand; PAM type: YTN; PAM sequence: TTT
tcaaattctttggaaacaac

SEQ ID NO: 104093 - DNA, 20 bp, Artificial Sequence
  Description of Artificial Sequence: Synthetic oligonucleotide
  Target: SCN9A; (+) strand; PAM type: YTN; PAM sequence: TTT
caaattctttggaaacaacc

SEQ ID NO: 104094 - DNA, 20 bp, Artificial Sequence
  Description of Artificial Sequence: Synthetic oligonucleotide
  Target: SCN9A; (+) strand; PAM type: YTN; PAM sequence: TTC
aaattctttggaaacaacct

SEQ ID NO: 104095 - DNA, 20 bp, Artificial Sequence
  Description of Artificial Sequence: Synthetic oligonucleotide
  Target: SCN9A; (+) strand; PAM type: YTN; PAM sequence: TTC
tttggaaacaacctgaaaaa

SEQ ID NO: 104096 - DNA, 20 bp, Artificial Sequence
  Description of Artificial Sequence: Synthetic oligonucleotide
  Target: SCN9A; (+) strand; PAM type: YTN; PAM sequence: CTT
tggaaacaacctgaaaaaaa

SEQ ID NO: 104097 - DNA, 20 bp, Artificial Sequence
  Description of Artificial Sequence: Synthetic oligonucleotide
  Target: SCN9A; (+) strand; PAM type: YTN; PAM sequence: TTT
ggaaacaacctgaaaaaaac

SEQ ID NO: 104098 - DNA, 20 bp, Artificial Sequence
  Description of Artificial Sequence: Synthetic oligonucleotide
  Target: SCN9A; (+) strand; PAM type: YTN; PAM sequence: TTG
gaaacaacctgaaaaaaaca

SEQ ID NO: 104099 - DNA, 20 bp, Artificial Sequence
  Description of Artificial Sequence: Synthetic oligonucleotide
  Target: SCN9A; (+) strand; PAM type: YTN; PAM sequence: CTG
aaaaaaacaaatggtctaag

SEQ ID NO: 104100 - DNA, 20 bp, Artificial Sequence
  Description of Artificial Sequence: Synthetic oligonucleotide
  Target: SCN9A; (+) strand; PAM type: YTN; PAM sequence: CTA
agtgcaattctacagaagag

SEQ ID NO: 104101 - DNA, 20 bp, Artificial Sequence
  Description of Artificial Sequence: Synthetic oligonucleotide
  Target: SCN9A; (+) strand; PAM type: YTN; PAM sequence: TTC
tacagaagagtgcttttaaa

SEQ ID NO: 104102 - DNA, 20 bp, Artificial Sequence
  Description of Artificial Sequence: Synthetic oligonucleotide
  Target: SCN9A; (+) strand; PAM type: YTN; PAM sequence: CTA
cagaagagtgcttttaaaaa

SEQ ID NO: 104103 - DNA, 20 bp, Artificial Sequence
  Description of Artificial Sequence: Synthetic oligonucleotide
  Target: SCN9A; (+) strand; PAM type: YTN; PAM sequence: CTT
ttaaaaaaaatctatgcata

SEQ ID NO: 104104 - DNA, 20 bp, Artificial Sequence
  Description of Artificial Sequence: Synthetic oligonucleotide
  Target: SCN9A; (+) strand; PAM type: YTN; PAM sequence: TTT
taaaaaaaatctatgcataa

SEQ ID NO: 104105 - DNA, 20 bp, Artificial Sequence
  Description of Artificial Sequence: Synthetic oligonucleotide
  Target: SCN9A; (+) strand; PAM type: YTN; PAM sequence: TTT
aaaaaaaatctatgcataaa

SEQ ID NO: 104106 - DNA, 20 bp, Artificial Sequence
  Description of Artificial Sequence: Synthetic oligonucleotide
  Target: SCN9A; (+) strand; PAM type: YTN; PAM sequence: TTA
aaaaaaatctatgcataaaa

SEQ ID NO: 104107 - DNA, 20 bp, Artificial Sequence
  Description of Artificial Sequence: Synthetic oligonucleotide
  Target: SCN9A; (+) strand; PAM type: YTN; PAM sequence: CTA
tgcataaaatatagaatcaa

SEQ ID NO: 104108 - DNA, 20 bp, Artificial Sequence
  Description of Artificial Sequence: Synthetic oligonucleotide
  Target: SCN9A; (+) strand; PAM type: YTN; PAM sequence: TTT
tacgaaacagcataactgta

SEQ ID NO: 104109 - DNA, 20 bp, Artificial Sequence
  Description of Artificial Sequence: Synthetic oligonucleotide
  Target: SCN9A; (+) strand; PAM type: YTN; PAM sequence: TTT
acgaaacagcataactgtaa

SEQ ID NO: 104110 - DNA, 20 bp, Artificial Sequence
  Description of Artificial Sequence: Synthetic oligonucleotide
  Target: SCN9A; (+) strand; PAM type: YTN; PAM sequence: TTA
cgaaacagcataactgtaac

SEQ ID NO: 104111 - DNA, 20 bp, Artificial Sequence
  Description of Artificial Sequence: Synthetic oligonucleotide
  Target: SCN9A; (+) strand; PAM type: YTN; PAM sequence: CTG
taactaatccctaaatcttt

SEQ ID NO: 104112 - DNA, 20 bp, Artificial Sequence
  Description of Artificial Sequence: Synthetic oligonucleotide
  Target: SCN9A; (+) strand; PAM type: YTN; PAM sequence: CTA
atccctaaatctttcaaagt

SEQ ID NO: 104113 - DNA, 20 bp, Artificial Sequence
  Description of Artificial Sequence: Synthetic oligonucleotide
  Target: SCN9A; (+) strand; PAM type: YTN; PAM sequence: CTA
aatctttcaaagtcaaatgc

SEQ ID NO: 104114 - DNA, 20 bp, Artificial Sequence
  Description of Artificial Sequence: Synthetic oligonucleotide
  Target: SCN9A; (+) strand; PAM type: YTN; PAM sequence: CTT
tcaaagtcaaatgcattttt

SEQ ID NO: 104115 - DNA, 20 bp, Artificial Sequence
  Description of Artificial Sequence: Synthetic oligonucleotide
  Target: SCN9A; (+) strand; PAM type: YTN; PAM sequence: TTT
caaagtcaaatgcattttta

SEQ ID NO: 104116 - DNA, 20 bp, Artificial Sequence
  Description of Artificial Sequence: Synthetic oligonucleotide
  Target: SCN9A; (+) strand; PAM type: YTN; PAM sequence: TTC
aaagtcaaatgcatttttaa

SEQ ID NO: 104117 - DNA, 20 bp, Artificial Sequence
  Description of Artificial Sequence: Synthetic oligonucleotide
  Target: SCN9A; (+) strand; PAM type: YTN; PAM sequence: TTT
ttaaaagattattatatttt

SEQ ID NO: 104118 - DNA, 20 bp, Artificial Sequence
  Description of Artificial Sequence: Synthetic oligonucleotide
  Target: SCN9A; (+) strand; PAM type: YTN; PAM sequence: TTT
taaaagattattatattttc

SEQ ID NO: 104119 - DNA, 20 bp, Artificial Sequence
  Description of Artificial Sequence: Synthetic oligonucleotide
  Target: SCN9A; (+) strand; PAM type: YTN; PAM sequence: TTT
aaaagattattatattttct

SEQ ID NO: 104120 - DNA, 20 bp, Artificial Sequence
  Description of Artificial Sequence: Synthetic oligonucleotide
  Target: SCN9A; (+) strand; PAM type: YTN; PAM sequence: TTA
aaagattattatattttcta

SEQ ID NO: 104121 - DNA, 20 bp, Artificial Sequence
  Description of Artificial Sequence: Synthetic oligonucleotide
  Target: SCN9A; (+) strand; PAM type: YTN; PAM sequence: TTA
ttatattttctaaagtgtag

SEQ ID NO: 104122 - DNA, 20 bp, Artificial Sequence
  Description of Artificial Sequence: Synthetic oligonucleotide
  Target: SCN9A; (+) strand; PAM type: YTN; PAM sequence: TTA
tattttctaaagtgtagtaa

SEQ ID NO: 104123 - DNA, 20 bp, Artificial Sequence
  Description of Artificial Sequence: Synthetic oligonucleotide
  Target: SCN9A; (+) strand; PAM type: YTN; PAM sequence: TTT
tctaaagtgtagtaataagc

SEQ ID NO: 104124 - DNA, 20 bp, Artificial Sequence
  Description of Artificial Sequence: Synthetic oligonucleotide
  Target: SCN9A; (+) strand; PAM type: YTN; PAM sequence: TTT
ctaaagtgtagtaataagca

SEQ ID NO: 104125 - DNA, 20 bp, Artificial Sequence
  Description of Artificial Sequence: Synthetic oligonucleotide
  Target: SCN9A; (+) strand; PAM type: YTN; PAM sequence: TTC
taaagtgtagtaataagcag

SEQ ID NO: 104126 - DNA, 20 bp, Artificial Sequence
  Description of Artificial Sequence: Synthetic oligonucleotide
  Target: SCN9A; (+) strand; PAM type: YTN; PAM sequence: CTA
aagtgtagtaataagcagaa

SEQ ID NO: 104127 - DNA, 20 bp, Artificial Sequence
  Description of Artificial Sequence: Synthetic oligonucleotide
  Target: SCN9A; (+) strand; PAM type: YTN; PAM sequence: CTA
aaactttgattaaaaatcta

SEQ ID NO: 104128 - DNA, 20 bp, Artificial Sequence
  Description of Artificial Sequence: Synthetic oligonucleotide
  Target: SCN9A; (+) strand; PAM type: YTN; PAM sequence: CTT
tgattaaaaatctaaagaga

SEQ ID NO: 104129 - DNA, 20 bp, Artificial Sequence
  Description of Artificial Sequence: Synthetic oligonucleotide
  Target: SCN9A; (+) strand; PAM type: YTN; PAM sequence: TTT
gattaaaaatctaaagagag

SEQ ID NO: 104130 - DNA, 20 bp, Artificial Sequence
  Description of Artificial Sequence: Synthetic oligonucleotide
  Target: SCN9A; (+) strand; PAM type: YTN; PAM sequence: TTG
attaaaaatctaaagagaga

SEQ ID NO: 104131 - DNA, 20 bp, Artificial Sequence
  Description of Artificial Sequence: Synthetic oligonucleotide
  Target: SCN9A; (+) strand; PAM type: YTN; PAM sequence: TTA
aaaatctaaagagagaaagt

SEQ ID NO: 104132 - DNA, 20 bp, Artificial Sequence
  Description of Artificial Sequence: Synthetic oligonucleotide
  Target: SCN9A; (+) strand; PAM type: YTN; PAM sequence: CTA
aagagagaaagtcttgataa

SEQ ID NO: 104133 - DNA, 20 bp, Artificial Sequence
  Description of Artificial Sequence: Synthetic oligonucleotide
  Target: SCN9A; (+) strand; PAM type: YTN; PAM sequence: CTT
gataacagtgtaattaaaac

SEQ ID NO: 104134 - DNA, 20 bp, Artificial Sequence
  Description of Artificial Sequence: Synthetic oligonucleotide
  Target: SCN9A; (+) strand; PAM type: YTN; PAM sequence: TTG
ataacagtgtaattaaaacc

SEQ ID NO: 104135 - DNA, 20 bp, Artificial Sequence
  Description of Artificial Sequence: Synthetic oligonucleotide
  Target: SCN9A; (+) strand; PAM type: YTN; PAM sequence: TTA
aaaccaccacatagtaaaag

SEQ ID NO: 104136 - DNA, 20 bp, Artificial Sequence
  Description of Artificial Sequence: Synthetic oligonucleotide
  Target: SCN9A; (+) strand; PAM type: YTN; PAM sequence: TTA
aatatttaatttgggaactg

SEQ ID NO: 104137 - DNA, 20 bp, Artificial Sequence
  Description of Artificial Sequence: Synthetic oligonucleotide
  Target: SCN9A; (+) strand; PAM type: YTN; PAM sequence: TTT
aatttgggaactgcaaatat

SEQ ID NO: 104138 - DNA, 20 bp, Artificial Sequence
  Description of Artificial Sequence: Synthetic oligonucleotide
  Target: SCN9A; (+) strand; PAM type: YTN; PAM sequence: TTA
atttgggaactgcaaatatt

SEQ ID NO: 104139 - DNA, 20 bp, Artificial Sequence
  Description of Artificial Sequence: Synthetic oligonucleotide
  Target: SCN9A; (+) strand; PAM type: YTN; PAM sequence: TTT
gggaactgcaaatattgaaa

SEQ ID NO: 104140 - DNA, 20 bp, Artificial Sequence
  Description of Artificial Sequence: Synthetic oligonucleotide
  Target: SCN9A; (+) strand; PAM type: YTN; PAM sequence: TTG
ggaactgcaaatattgaaac

SEQ ID NO: 104141 - DNA, 20 bp, Artificial Sequence
  Description of Artificial Sequence: Synthetic oligonucleotide
  Target: SCN9A; (+) strand; PAM type: YTN; PAM sequence: CTG
caaatattgaaacaactttt

SEQ ID NO: 104142 - DNA, 20 bp, Artificial Sequence
  Description of Artificial Sequence: Synthetic oligonucleotide
  Target: SCN9A; (+) strand; PAM type: YTN; PAM sequence: TTG
aaacaactttttatcaggtc

SEQ ID NO: 104143 - DNA, 20 bp, Artificial Sequence
  Description of Artificial Sequence: Synthetic oligonucleotide
  Target: SCN9A; (+) strand; PAM type: YTN; PAM sequence: CTT
tttatcaggtcaacaaaatg

SEQ ID NO: 104144 - DNA, 20 bp, Artificial Sequence
  Description of Artificial Sequence: Synthetic oligonucleotide
  Target: SCN9A; (+) strand; PAM type: YTN; PAM sequence: TTT
ttatcaggtcaacaaaatga

SEQ ID NO: 104145 - DNA, 20 bp, Artificial Sequence
  Description of Artificial Sequence: Synthetic oligonucleotide
  Target: SCN9A; (+) strand; PAM type: YTN; PAM sequence: TTT
tatcaggtcaacaaaatgac

SEQ ID NO: 104146 - DNA, 20 bp, Artificial Sequence
  Description of Artificial Sequence: Synthetic oligonucleotide
  Target: SCN9A; (+) strand; PAM type: YTN; PAM sequence: TTT
atcaggtcaacaaaatgact

SEQ ID NO: 104147 - DNA, 20 bp, Artificial Sequence
  Description of Artificial Sequence: Synthetic oligonucleotide
  Target: SCN9A; (+) strand; PAM type: YTN; PAM sequence: TTA
tcaggtcaacaaaatgacta

SEQ ID NO: 104148 - DNA, 20 bp, Artificial Sequence
  Description of Artificial Sequence: Synthetic oligonucleotide
  Target: SCN9A; (+) strand; PAM type: YTN; PAM sequence: CTA
catttcataataataagcat

SEQ ID NO: 104149 - DNA, 20 bp, Artificial Sequence
  Description of Artificial Sequence: Synthetic oligonucleotide
  Target: SCN9A; (+) strand; PAM type: YTN; PAM sequence: TTT
cataataataagcatattta

SEQ ID NO: 104150 - DNA, 20 bp, Artificial Sequence
  Description of Artificial Sequence: Synthetic oligonucleotide
  Target: SCN9A; (+) strand; PAM type: YTN; PAM sequence: TTC
ataataataagcatatttaa

SEQ ID NO: 104151 - DNA, 20 bp, Artificial Sequence
  Description of Artificial Sequence: Synthetic oligonucleotide
  Target: SCN9A; (+) strand; PAM type: YTN; PAM sequence: TTT
aagtatctccaaagataatg

SEQ ID NO: 104152 - DNA, 20 bp, Artificial Sequence
  Description of Artificial Sequence: Synthetic oligonucleotide
  Target: SCN9A; (+) strand; PAM type: YTN; PAM sequence: TTA
agtatctccaaagataatga

SEQ ID NO: 104153 - DNA, 20 bp, Artificial Sequence
  Description of Artificial Sequence: Synthetic oligonucleotide
  Target: SCN9A; (+) strand; PAM type: YTN; PAM sequence: CTC
caaagataatgactttgtaa

SEQ ID NO: 104154 - DNA, 20 bp, Artificial Sequence
  Description of Artificial Sequence: Synthetic oligonucleotide
  Target: SCN9A; (+) strand; PAM type: YTN; PAM sequence: CTT
tgtaaactgaacactgaata

SEQ ID NO: 104155 - DNA, 20 bp, Artificial Sequence
  Description of Artificial Sequence: Synthetic oligonucleotide
  Target: SCN9A; (+) strand; PAM type: YTN; PAM sequence: TTT
gtaaactgaacactgaatag

SEQ ID NO: 104156 - DNA, 20 bp, Artificial Sequence
  Description of Artificial Sequence: Synthetic oligonucleotide
  Target: SCN9A; (+) strand; PAM type: YTN; PAM sequence: TTG
taaactgaacactgaataga

SEQ ID NO: 104157 - DNA, 20 bp, Artificial Sequence
  Description of Artificial Sequence: Synthetic oligonucleotide
  Target: SCN9A; (+) strand; PAM type: YTN; PAM sequence: CTG
aacactgaatagatgaatgg

SEQ ID NO: 104158 - DNA, 20 bp, Artificial Sequence
  Description of Artificial Sequence: Synthetic oligonucleotide
  Target: SCN9A; (+) strand; PAM type: YTN; PAM sequence: CTG
aatagatgaatgggtggata

SEQ ID NO: 104159 - DNA, 20 bp, Artificial Sequence
  Description of Artificial Sequence: Synthetic oligonucleotide
  Target: SCN9A; (+) strand; PAM type: YTN; PAM sequence: CTT
gttcctctgcctgagatttc

SEQ ID NO: 104160 - DNA, 20 bp, Artificial Sequence
  Description of Artificial Sequence: Synthetic oligonucleotide
  Target: SCN9A; (+) strand; PAM type: YTN; PAM sequence: TTG
ttcctctgcctgagatttcc

SEQ ID NO: 104161 - DNA, 20 bp, Artificial Sequence
  Description of Artificial Sequence: Synthetic oligonucleotide
  Target: SCN9A; (+) strand; PAM type: YTN; PAM sequence: TTC
ctctgcctgagatttccttc

SEQ ID NO: 104162 - DNA, 20 bp, Artificial Sequence
  Description of Artificial Sequence: Synthetic oligonucleotide
  Target: SCN9A; (+) strand; PAM type: YTN; PAM sequence: CTC
tgcctgagatttccttctgt

SEQ ID NO: 104163 - DNA, 20 bp, Artificial Sequence
  Description of Artificial Sequence: Synthetic oligonucleotide
  Target: SCN9A; (+) strand; PAM type: YTN; PAM sequence: CTG
cctgagatttccttctgtac

SEQ ID NO: 104164 - DNA, 20 bp, Artificial Sequence
  Description of Artificial Sequence: Synthetic oligonucleotide
  Target: SCN9A; (+) strand; PAM type: YTN; PAM sequence: CTG
agatttccttctgtaccaca

SEQ ID NO: 104165 - DNA, 20 bp, Artificial Sequence
  Description of Artificial Sequence: Synthetic oligonucleotide
  Target: SCN9A; (+) strand; PAM type: YTN; PAM sequence: TTT
ccttctgtaccacatctgcc

SEQ ID NO: 104166 - DNA, 20 bp, Artificial Sequence
  Description of Artificial Sequence: Synthetic oligonucleotide
  Target: SCN9A; (+) strand; PAM type: YTN; PAM sequence: TTC
cttctgtaccacatctgccc

SEQ ID NO: 104167 - DNA, 20 bp, Artificial Sequence
  Description of Artificial Sequence: Synthetic oligonucleotide
  Target: SCN9A; (+) strand; PAM type: YTN; PAM sequence: CTT
ctgtaccacatctgcccagt

SEQ ID NO: 104168 - DNA, 20 bp, Artificial Sequence
  Description of Artificial Sequence: Synthetic oligonucleotide
  Target: SCN9A; (+) strand; PAM type: YTN; PAM sequence: TTC
tgtaccacatctgcccagtg

SEQ ID NO: 104169 - DNA, 20 bp, Artificial Sequence
  Description of Artificial Sequence: Synthetic oligonucleotide
  Target: SCN9A; (+) strand; PAM type: YTN; PAM sequence: CTG
taccacatctgcccagtgaa

SEQ ID NO: 104170 - DNA, 20 bp, Artificial Sequence
  Description of Artificial Sequence: Synthetic oligonucleotide
  Target: SCN9A; (+) strand; PAM type: YTN; PAM sequence: CTG
cccagtgaaattttctccat

SEQ ID NO: 104171 - DNA, 20 bp, Artificial Sequence
  Description of Artificial Sequence: Synthetic oligonucleotide
  Target: SCN9A; (+) strand; PAM type: YTN; PAM sequence: TTT
tctccatactgtaaggtctg

SEQ ID NO: 104172 - DNA, 20 bp, Artificial Sequence
  Description of Artificial Sequence: Synthetic oligonucleotide
  Target: SCN9A; (+) strand; PAM type: YTN; PAM sequence: TTT
ctccatactgtaaggtctgg

SEQ ID NO: 104173 - DNA, 20 bp, Artificial Sequence
  Description of Artificial Sequence: Synthetic oligonucleotide
  Target: SCN9A; (+) strand; PAM type: YTN; PAM sequence: TTC
tccatactgtaaggtctggt

SEQ ID NO: 104174 - DNA, 20 bp, Artificial Sequence
  Description of Artificial Sequence: Synthetic oligonucleotide
  Target: SCN9A; (+) strand; PAM type: YTN; PAM sequence: CTC
catactgtaaggtctggtct

SEQ ID NO: 104175 - DNA, 20 bp, Artificial Sequence
  Description of Artificial Sequence: Synthetic oligonucleotide
  Target: SCN9A; (+) strand; PAM type: YTN; PAM sequence: CTG
taaggtctggtctaagtgcc

SEQ ID NO: 104176 - DNA, 20 bp, Artificial Sequence
  Description of Artificial Sequence: Synthetic oligonucleotide
  Target: SCN9A; (+) strand; PAM type: YTN; PAM sequence: CTG
gtctaagtgccacctccttt

SEQ ID NO: 104177 - DNA, 20 bp, Artificial Sequence
  Description of Artificial Sequence: Synthetic oligonucleotide
  Target: SCN9A; (+) strand; PAM type: YTN; PAM sequence: CTA
agtgccacctcctttcatgt

SEQ ID NO: 104178 - DNA, 20 bp, Artificial Sequence
  Description of Artificial Sequence: Synthetic oligonucleotide
  Target: SCN9A; (+) strand; PAM type: YTN; PAM sequence: CTC
ctttcatgtgaagtcagcca

SEQ ID NO: 104179 - DNA, 20 bp, Artificial Sequence
  Description of Artificial Sequence: Synthetic oligonucleotide
  Target: SCN9A; (+) strand; PAM type: YTN; PAM sequence: CTT
tcatgtgaagtcagccagat

SEQ ID NO: 104180 - DNA, 20 bp, Artificial Sequence
  Description of Artificial Sequence: Synthetic oligonucleotide
  Target: SCN9A; (+) strand; PAM type: YTN; PAM sequence: TTT
catgtgaagtcagccagata

SEQ ID NO: 104181 - DNA, 20 bp, Artificial Sequence
  Description of Artificial Sequence: Synthetic oligonucleotide
  Target: SCN9A; (+) strand; PAM type: YTN; PAM sequence: TTC
atgtgaagtcagccagatac

SEQ ID NO: 104182 - DNA, 20 bp, Artificial Sequence
  Description of Artificial Sequence: Synthetic oligonucleotide
  Target: SCN9A; (+) strand; PAM type: YTN; PAM sequence: CTT
actcaatgcatcctcaatgg

SEQ ID NO: 104183 - DNA, 20 bp, Artificial Sequence
  Description of Artificial Sequence: Synthetic oligonucleotide
  Target: SCN9A; (+) strand; PAM type: YTN; PAM sequence: TTA
ctcaatgcatcctcaatgga

SEQ ID NO: 104184 - DNA, 20 bp, Artificial Sequence
  Description of Artificial Sequence: Synthetic oligonucleotide
  Target: SCN9A; (+) strand; PAM type: YTN; PAM sequence: CTC
aatgcatcctcaatggacta

SEQ ID NO: 104185 - DNA, 20 bp, Artificial Sequence
  Description of Artificial Sequence: Synthetic oligonucleotide
  Target: SCN9A; (+) strand; PAM type: YTN; PAM sequence: CTC
aatggactagtttagtgtcc

SEQ ID NO: 104186 - DNA, 20 bp, Artificial Sequence
  Description of Artificial Sequence: Synthetic oligonucleotide
  Target: SCN9A; (+) strand; PAM type: YTN; PAM sequence: CTA
gtttagtgtcctgttacgga

SEQ ID NO: 104187 - DNA, 20 bp, Artificial Sequence
  Description of Artificial Sequence: Synthetic oligonucleotide
  Target: SCN9A; (+) strand; PAM type: YTN; PAM sequence: TTT
agtgtcctgttacggattgt

SEQ ID NO: 104188 - DNA, 20 bp, Artificial Sequence
  Description of Artificial Sequence: Synthetic oligonucleotide
  Target: SCN9A; (+) strand; PAM type: YTN; PAM sequence: TTA
gtgtcctgttacggattgtg

SEQ ID NO: 104189 - DNA, 20 bp, Artificial Sequence
  Description of Artificial Sequence: Synthetic oligonucleotide
  Target: SCN9A; (+) strand; PAM type: YTN; PAM sequence: CTG
ttacggattgtgctttgctt

SEQ ID NO: 104190 - DNA, 20 bp, Artificial Sequence
  Description of Artificial Sequence: Synthetic oligonucleotide
  Target: SCN9A; (+) strand; PAM type: YTN; PAM sequence: TTA
cggattgtgctttgctttgt

SEQ ID NO: 104191 - DNA, 20 bp, Artificial Sequence
  Description of Artificial Sequence: Synthetic oligonucleotide
  Target: SCN9A; (+) strand; PAM type: YTN; PAM sequence: TTG
tgctttgctttgttctgtgt

SEQ ID NO: 104192 - DNA, 20 bp, Artificial Sequence
  Description of Artificial Sequence: Synthetic oligonucleotide
  Target: SCN9A; (+) strand; PAM type: YTN; PAM sequence: CTT
tgctttgttctgtgttataa

SEQ ID NO: 104193 - DNA, 20 bp, Artificial Sequence
  Description of Artificial Sequence: Synthetic oligonucleotide
  Target: SCN9A; (+) strand; PAM type: YTN; PAM sequence: TTT
gctttgttctgtgttataat

SEQ ID NO: 104194 - DNA, 20 bp, Artificial Sequence
  Description of Artificial Sequence: Synthetic oligonucleotide
  Target: SCN9A; (+) strand; PAM type: YTN; PAM sequence: TTG
ctttgttctgtgttataatt

SEQ ID NO: 104195 - DNA, 20 bp, Artificial Sequence
  Description of Artificial Sequence: Synthetic oligonucleotide
  Target: SCN9A; (+) strand; PAM type: YTN; PAM sequence: CTT
tgttctgtgttataattttt

SEQ ID NO: 104196 - DNA, 20 bp, Artificial Sequence
  Description of Artificial Sequence: Synthetic oligonucleotide
  Target: SCN9A; (+) strand; PAM type: YTN; PAM sequence: TTT
gttctgtgttataatttttt

SEQ ID NO: 104197 - DNA, 20 bp, Artificial Sequence
  Description of Artificial Sequence: Synthetic oligonucleotide
  Target: SCN9A; (+) strand; PAM type: YTN; PAM sequence: TTG
ttctgtgttataattttttg

SEQ ID NO: 104198 - DNA, 20 bp, Artificial Sequence
  Description of Artificial Sequence: Synthetic oligonucleotide
  Target: SCN9A; (+) strand; PAM type: YTN; PAM sequence: TTC
tgtgttataattttttgtat

SEQ ID NO: 104199 - DNA, 20 bp, Artificial Sequence
  Description of Artificial Sequence: Synthetic oligonucleotide
  Target: SCN9A; (+) strand; PAM type: YTN; PAM sequence: CTG
tgttataattttttgtatat

SEQ ID NO: 104200 - DNA, 20 bp, Artificial Sequence
  Description of Artificial Sequence: Synthetic oligonucleotide
  Target: SCN9A; (+) strand; PAM type: YTN; PAM sequence: TTA
taattttttgtatatttacc

SEQ ID NO: 104201 - DNA, 20 bp, Artificial Sequence
  Description of Artificial Sequence: Synthetic oligonucleotide
  Target: SCN9A; (+) strand; PAM type: YTN; PAM sequence: TTT
tttgtatatttacctaaggt

SEQ ID NO: 104202 - DNA, 20 bp, Artificial Sequence
  Description of Artificial Sequence: Synthetic oligonucleotide
  Target: SCN9A; (+) strand; PAM type: YTN; PAM sequence: TTT
ttgtatatttacctaaggtg

SEQ ID NO: 104203 - DNA, 20 bp, Artificial Sequence
  Description of Artificial Sequence: Synthetic oligonucleotide
  Target: SCN9A; (+) strand; PAM type: YTN; PAM sequence: TTT
tgtatatttacctaaggtgc

SEQ ID NO: 104204 - DNA, 20 bp, Artificial Sequence
  Description of Artificial Sequence: Synthetic oligonucleotide
  Target: SCN9A; (+) strand; PAM type: YTN; PAM sequence: TTT
gtatatttacctaaggtgca

SEQ ID NO: 104205 - DNA, 20 bp, Artificial Sequence
  Description of Artificial Sequence: Synthetic oligonucleotide
  Target: SCN9A; (+) strand; PAM type: YTN; PAM sequence: TTG
tatatttacctaaggtgcaa

SEQ ID NO: 104206 - DNA, 20 bp, Artificial Sequence
  Description of Artificial Sequence: Synthetic oligonucleotide
  Target: SCN9A; (+) strand; PAM type: YTN; PAM sequence: TTT
acctaaggtgcaagctatta

SEQ ID NO: 104207 - DNA, 20 bp, Artificial Sequence
  Description of Artificial Sequence: Synthetic oligonucleotide
  Target: SCN9A; (+) strand; PAM type: YTN; PAM sequence: TTA
cctaaggtgcaagctattag

SEQ ID NO: 104208 - DNA, 20 bp, Artificial Sequence
  Description of Artificial Sequence: Synthetic oligonucleotide
  Target: SCN9A; (+) strand; PAM type: YTN; PAM sequence: CTA
aggtgcaagctattagagtg

SEQ ID NO: 104209 - DNA, 20 bp, Artificial Sequence
  Description of Artificial Sequence: Synthetic oligonucleotide
  Target: SCN9A; (+) strand; PAM type: YTN; PAM sequence: CTA
ttagagtgtatactttttgt

SEQ ID NO: 104210 - DNA, 20 bp, Artificial Sequence
  Description of Artificial Sequence: Synthetic oligonucleotide
  Target: SCN9A; (+) strand; PAM type: YTN; PAM sequence: TTA
gagtgtatactttttgttgt

SEQ ID NO: 104211 - DNA, 20 bp, Artificial Sequence
  Description of Artificial Sequence: Synthetic oligonucleotide
  Target: SCN9A; (+) strand; PAM type: YTN; PAM sequence: CTT
tttgttgtcaatgatcaatc

SEQ ID NO: 104212 - DNA, 20 bp, Artificial Sequence
  Description of Artificial Sequence: Synthetic oligonucleotide
  Target: SCN9A; (+) strand; PAM type: YTN; PAM sequence: TTT
ttgttgtcaatgatcaatca

SEQ ID NO: 104213 - DNA, 20 bp, Artificial Sequence
  Description of Artificial Sequence: Synthetic oligonucleotide
  Target: SCN9A; (+) strand; PAM type: YTN; PAM sequence: TTT
tgttgtcaatgatcaatcac

SEQ ID NO: 104214 - DNA, 20 bp, Artificial Sequence
  Description of Artificial Sequence: Synthetic oligonucleotide
  Target: SCN9A; (+) strand; PAM type: YTN; PAM sequence: TTT
gttgtcaatgatcaatcacc

SEQ ID NO: 104215 - DNA, 20 bp, Artificial Sequence
  Description of Artificial Sequence: Synthetic oligonucleotide
  Target: SCN9A; (+) strand; PAM type: YTN; PAM sequence: TTG
ttgtcaatgatcaatcaccc

SEQ ID NO: 104216 - DNA, 20 bp, Artificial Sequence
  Description of Artificial Sequence: Synthetic oligonucleotide
  Target: SCN9A; (+) strand; PAM type: YTN; PAM sequence: TTG
tcaatgatcaatcacccttt

SEQ ID NO: 104217 - DNA, 20 bp, Artificial Sequence
  Description of Artificial Sequence: Synthetic oligonucleotide
  Target: SCN9A; (+) strand; PAM type: YTN; PAM sequence: CTT
tacctttgaagtacatgaag

SEQ ID NO: 104218 - DNA, 20 bp, Artificial Sequence
  Description of Artificial Sequence: Synthetic oligonucleotide
  Target: SCN9A; (+) strand; PAM type: YTN; PAM sequence: TTT
acctttgaagtacatgaagt

SEQ ID NO: 104219 - DNA, 20 bp, Artificial Sequence
  Description of Artificial Sequence: Synthetic oligonucleotide
  Target: SCN9A; (+) strand; PAM type: YTN; PAM sequence: TTA
cctttgaagtacatgaagtt

SEQ ID NO: 104220 - DNA, 20 bp, Artificial Sequence
  Description of Artificial Sequence: Synthetic oligonucleotide
  Target: SCN9A; (+) strand; PAM type: YTN; PAM sequence: CTT
tgaagtacatgaagttttta

SEQ ID NO: 104221 - DNA, 20 bp, Artificial Sequence
  Description of Artificial Sequence: Synthetic oligonucleotide
  Target: SCN9A; (+) strand; PAM type: YTN; PAM sequence: TTT
gaagtacatgaagtttttag

SEQ ID NO: 104222 - DNA, 20 bp, Artificial Sequence
  Description of Artificial Sequence: Synthetic oligonucleotide
  Target: SCN9A; (+) strand; PAM type: YTN; PAM sequence: TTG
aagtacatgaagtttttagt

SEQ ID NO: 104223 - DNA, 20 bp, Artificial Sequence
  Description of Artificial Sequence: Synthetic oligonucleotide
  Target: SCN9A; (+) strand; PAM type: YTN; PAM sequence: TTT
ttagtgtggtttttggggga

SEQ ID NO: 104224 - DNA, 20 bp, Artificial Sequence
  Description of Artificial Sequence: Synthetic oligonucleotide
  Target: SCN9A; (+) strand; PAM type: YTN; PAM sequence: TTT
tagtgtggtttttgggggac

SEQ ID NO: 104225 - DNA, 20 bp, Artificial Sequence
  Description of Artificial Sequence: Synthetic oligonucleotide
  Target: SCN9A; (+) strand; PAM type: YTN; PAM sequence: TTT
agtgtggtttttgggggact

SEQ ID NO: 104226 - DNA, 20 bp, Artificial Sequence
  Description of Artificial Sequence: Synthetic oligonucleotide
  Target: SCN9A; (+) strand; PAM type: YTN; PAM sequence: TTA
gtgtggtttttgggggactc

SEQ ID NO: 104227 - DNA, 20 bp, Artificial Sequence
  Description of Artificial Sequence: Synthetic oligonucleotide
  Target: SCN9A; (+) strand; PAM type: YTN; PAM sequence: TTT
ttgggggactcaatatttat

SEQ ID NO: 104228 - DNA, 20 bp, Artificial Sequence
  Description of Artificial Sequence: Synthetic oligonucleotide
  Target: SCN9A; (+) strand; PAM type: YTN; PAM sequence: TTT
tgggggactcaatatttata

SEQ ID NO: 104229 - DNA, 20 bp, Artificial Sequence
  Description of Artificial Sequence: Synthetic oligonucleotide
  Target: SCN9A; (+) strand; PAM type: YTN; PAM sequence: TTT
gggggactcaatatttatag

SEQ ID NO: 104230 - DNA, 20 bp, Artificial Sequence
  Description of Artificial Sequence: Synthetic oligonucleotide
  Target: SCN9A; (+) strand; PAM type: YTN; PAM sequence: TTG
ggggactcaatatttatagg

SEQ ID NO: 104231 - DNA, 20 bp, Artificial Sequence
  Description of Artificial Sequence: Synthetic oligonucleotide
  Target: SCN9A; (+) strand; PAM type: YTN; PAM sequence: CTC
aatatttatagggggccaaa

SEQ ID NO: 104232 - DNA, 20 bp, Artificial Sequence
  Description of Artificial Sequence: Synthetic oligonucleotide
  Target: SCN9A; (+) strand; PAM type: YTN; PAM sequence: TTT
atagggggccaaaaatattt

SEQ ID NO: 104233 - DNA, 20 bp, Artificial Sequence
  Description of Artificial Sequence: Synthetic oligonucleotide
  Target: SCN9A; (+) strand; PAM type: YTN; PAM sequence: TTA
tagggggccaaaaatatttc

SEQ ID NO: 104234 - DNA, 20 bp, Artificial Sequence
  Description of Artificial Sequence: Synthetic oligonucleotide
  Target: SCN9A; (+) strand; PAM type: YTN; PAM sequence: TTT
catgagtgtaatttaggaga

SEQ ID NO: 104235 - DNA, 20 bp, Artificial Sequence
  Description of Artificial Sequence: Synthetic oligonucleotide
  Target: SCN9A; (+) strand; PAM type: YTN; PAM sequence: TTC
atgagtgtaatttaggagag

SEQ ID NO: 104236 - DNA, 20 bp, Artificial Sequence
  Description of Artificial Sequence: Synthetic oligonucleotide
  Target: SCN9A; (+) strand; PAM type: YTN; PAM sequence: TTT
aggagagaaaaactctatgc

SEQ ID NO: 104237 - DNA, 20 bp, Artificial Sequence
  Description of Artificial Sequence: Synthetic oligonucleotide
  Target: SCN9A; (+) strand; PAM type: YTN; PAM sequence: TTA
ggagagaaaaactctatgcc

SEQ ID NO: 104238 - DNA, 20 bp, Artificial Sequence
  Description of Artificial Sequence: Synthetic oligonucleotide
  Target: SCN9A; (+) strand; PAM type: YTN; PAM sequence: CTC
tatgcctattataattctgg

SEQ ID NO: 104239 - DNA, 20 bp, Artificial Sequence
  Description of Artificial Sequence: Synthetic oligonucleotide
  Target: SCN9A; (+) strand; PAM type: YTN; PAM sequence: CTA
tgcctattataattctgggc

SEQ ID NO: 104240 - DNA, 20 bp, Artificial Sequence
  Description of Artificial Sequence: Synthetic oligonucleotide
  Target: SCN9A; (+) strand; PAM type: YTN; PAM sequence: CTA
ttataattctgggcagagag

SEQ ID NO: 104241 - DNA, 20 bp, Artificial Sequence
  Description of Artificial Sequence: Synthetic oligonucleotide
  Target: SCN9A; (+) strand; PAM type: YTN; PAM sequence: TTA
taattctgggcagagagtca

SEQ ID NO: 104242 - DNA, 20 bp, Artificial Sequence
  Description of Artificial Sequence: Synthetic oligonucleotide
  Target: SCN9A; (+) strand; PAM type: YTN; PAM sequence: TTC
tgggcagagagtcatagaaa

SEQ ID NO: 104243 - DNA, 20 bp, Artificial Sequence
  Description of Artificial Sequence: Synthetic oligonucleotide
  Target: SCN9A; (+) strand; PAM type: YTN; PAM sequence: CTG
ggcagagagtcatagaaaat

SEQ ID NO: 104244 - DNA, 20 bp, Artificial Sequence
  Description of Artificial Sequence: Synthetic oligonucleotide
  Target: SCN9A; (+) strand; PAM type: YTN; PAM sequence: TTT
taatgtgttctctactatgc

SEQ ID NO: 104245 - DNA, 20 bp, Artificial Sequence
  Description of Artificial Sequence: Synthetic oligonucleotide
  Target: SCN9A; (+) strand; PAM type: YTN; PAM sequence: TTT
aatgtgttctctactatgca

SEQ ID NO: 104246 - DNA, 20 bp, Artificial Sequence
  Description of Artificial Sequence: Synthetic oligonucleotide
  Target: SCN9A; (+) strand; PAM type: YTN; PAM sequence: TTA
atgtgttctctactatgcac

SEQ ID NO: 104247 - DNA, 20 bp, Artificial Sequence
  Description of Artificial Sequence: Synthetic oligonucleotide
  Target: SCN9A; (+) strand; PAM type: YTN; PAM sequence: TTC
tctactatgcacaaataaaa

SEQ ID NO: 104248 - DNA, 20 bp, Artificial Sequence
  Description of Artificial Sequence: Synthetic oligonucleotide
  Target: SCN9A; (+) strand; PAM type: YTN; PAM sequence: CTC
tactatgcacaaataaaaga

SEQ ID NO: 104249 - DNA, 20 bp, Artificial Sequence
  Description of Artificial Sequence: Synthetic oligonucleotide
  Target: SCN9A; (+) strand; PAM type: YTN; PAM sequence: CTA
ctatgcacaaataaaagaaa

SEQ ID NO: 104250 - DNA, 20 bp, Artificial Sequence
  Description of Artificial Sequence: Synthetic oligonucleotide
  Target: SCN9A; (+) strand; PAM type: YTN; PAM sequence: CTA
tgcacaaataaaagaaatga

SEQ ID NO: 104251 - DNA, 20 bp, Artificial Sequence
  Description of Artificial Sequence: Synthetic oligonucleotide
  Target: SCN9A; (+) strand; PAM type: YTN; PAM sequence: CTG
tgttcagtaacataatattt

SEQ ID NO: 104252 - DNA, 20 bp, Artificial Sequence
  Description of Artificial Sequence: Synthetic oligonucleotide
  Target: SCN9A; (+) strand; PAM type: YTN; PAM sequence: TTC
agtaacataatatttatgta

SEQ ID NO: 104253 - DNA, 20 bp, Artificial Sequence
  Description of Artificial Sequence: Synthetic oligonucleotide
  Target: SCN9A; (+) strand; PAM type: YTN; PAM sequence: TTT
atgtaattaagaaataagat

SEQ ID NO: 104254 - DNA, 20 bp, Artificial Sequence
  Description of Artificial Sequence: Synthetic oligonucleotide
  Target: SCN9A; (+) strand; PAM type: YTN; PAM sequence: TTA
tgtaattaagaaataagatt

SEQ ID NO: 104255 - DNA, 20 bp, Artificial Sequence
  Description of Artificial Sequence: Synthetic oligonucleotide
  Target: SCN9A; (+) strand; PAM type: YTN; PAM sequence: TTA
agaaataagattatacaggt

SEQ ID NO: 104256 - DNA, 20 bp, Artificial Sequence
  Description of Artificial Sequence: Synthetic oligonucleotide
  Target: SCN9A; (+) strand; PAM type: YTN; PAM sequence: TTA
tacaggtagaatgaagttta

SEQ ID NO: 104257 - DNA, 20 bp, Artificial Sequence
  Description of Artificial Sequence: Synthetic oligonucleotide
  Target: SCN9A; (+) strand; PAM type: YTN; PAM sequence: TTT
atattttacttatgcctttg

SEQ ID NO: 104258 - DNA, 20 bp, Artificial Sequence
  Description of Artificial Sequence: Synthetic oligonucleotide
  Target: SCN9A; (+) strand; PAM type: YTN; PAM sequence: TTA
tattttacttatgcctttgt

SEQ ID NO: 104259 - DNA, 20 bp, Artificial Sequence
  Description of Artificial Sequence: Synthetic oligonucleotide
  Target: SCN9A; (+) strand; PAM type: YTN; PAM sequence: TTT
tacttatgcctttgtattat

SEQ ID NO: 104260 - DNA, 20 bp, Artificial Sequence
  Description of Artificial Sequence: Synthetic oligonucleotide
  Target: SCN9A; (+) strand; PAM type: YTN; PAM sequence: TTT
acttatgcctttgtattatg

SEQ ID NO: 104261 - DNA, 20 bp, Artificial Sequence
  Description of Artificial Sequence: Synthetic oligonucleotide
  Target: SCN9A; (+) strand; PAM type: YTN; PAM sequence: TTA
cttatgcctttgtattatgt

SEQ ID NO: 104262 - DNA, 20 bp, Artificial Sequence
  Description of Artificial Sequence: Synthetic oligonucleotide
  Target: SCN9A; (+) strand; PAM type: YTN; PAM sequence: CTT
atgcctttgtattatgttga

SEQ ID NO: 104263 - DNA, 20 bp, Artificial Sequence
  Description of Artificial Sequence: Synthetic oligonucleotide
  Target: SCN9A; (+) strand; PAM type: YTN; PAM sequence: TTA
tgcctttgtattatgttgag

SEQ ID NO: 104264 - DNA, 20 bp, Artificial Sequence
  Description of Artificial Sequence: Synthetic oligonucleotide
  Target: SCN9A; (+) strand; PAM type: YTN; PAM sequence: CTT
tgtattatgttgagccacat

SEQ ID NO: 104265 - DNA, 20 bp, Artificial Sequence
  Description of Artificial Sequence: Synthetic oligonucleotide
  Target: SCN9A; (+) strand; PAM type: YTN; PAM sequence: TTT
gtattatgttgagccacatg

SEQ ID NO: 104266 - DNA, 20 bp, Artificial Sequence
  Description of Artificial Sequence: Synthetic oligonucleotide
  Target: SCN9A; (+) strand; PAM type: YTN; PAM sequence: TTG
tattatgttgagccacatga

SEQ ID NO: 104267 - DNA, 20 bp, Artificial Sequence
  Description of Artificial Sequence: Synthetic oligonucleotide
  Target: SCN9A; (+) strand; PAM type: YTN; PAM sequence: TTA
tgttgagccacatgaaattt

SEQ ID NO: 104268 - DNA, 20 bp, Artificial Sequence
  Description of Artificial Sequence: Synthetic oligonucleotide
  Target: SCN9A; (+) strand; PAM type: YTN; PAM sequence: TTG
agccacatgaaatttctagt

SEQ ID NO: 104269 - DNA, 20 bp, Artificial Sequence
  Description of Artificial Sequence: Synthetic oligonucleotide
  Target: SCN9A; (+) strand; PAM type: YTN; PAM sequence: TTT
ctagtttttgcagattaaaa

SEQ ID NO: 104270 - DNA, 20 bp, Artificial Sequence
  Description of Artificial Sequence: Synthetic oligonucleotide
  Target: SCN9A; (+) strand; PAM type: YTN; PAM sequence: TTC
tagtttttgcagattaaaaa

SEQ ID NO: 104271 - DNA, 20 bp, Artificial Sequence
  Description of Artificial Sequence: Synthetic oligonucleotide
  Target: SCN9A; (+) strand; PAM type: YTN; PAM sequence: CTA
gtttttgcagattaaaaatg

SEQ ID NO: 104272 - DNA, 20 bp, Artificial Sequence
  Description of Artificial Sequence: Synthetic oligonucleotide
  Target: SCN9A; (+) strand; PAM type: YTN; PAM sequence: TTT
ttgcagattaaaaatggttg

SEQ ID NO: 104273 - DNA, 20 bp, Artificial Sequence
  Description of Artificial Sequence: Synthetic oligonucleotide
  Target: SCN9A; (+) strand; PAM type: YTN; PAM sequence: TTT
tgcagattaaaaatggttgg

SEQ ID NO: 104274 - DNA, 20 bp, Artificial Sequence
  Description of Artificial Sequence: Synthetic oligonucleotide
  Target: SCN9A; (+) strand; PAM type: YTN; PAM sequence: TTT
gcagattaaaaatggttgga

SEQ ID NO: 104275 - DNA, 20 bp, Artificial Sequence
  Description of Artificial Sequence: Synthetic oligonucleotide
  Target: SCN9A; (+) strand; PAM type: YTN; PAM sequence: TTG
cagattaaaaatggttggat

SEQ ID NO: 104276 - DNA, 20 bp, Artificial Sequence
  Description of Artificial Sequence: Synthetic oligonucleotide
  Target: SCN9A; (+) strand; PAM type: YTN; PAM sequence: TTA
aaaatggttggatatttagt

SEQ ID NO: 104277 - DNA, 20 bp, Artificial Sequence
  Description of Artificial Sequence: Synthetic oligonucleotide
  Target: SCN9A; (+) strand; PAM type: YTN; PAM sequence: TTG
gatatttagttttttattat

SEQ ID NO: 104278 - DNA, 20 bp, Artificial Sequence
  Description of Artificial Sequence: Synthetic oligonucleotide
  Target: SCN9A; (+) strand; PAM type: YTN; PAM sequence: TTT
agttttttattatttaactt

SEQ ID NO: 104279 - DNA, 20 bp, Artificial Sequence
  Description of Artificial Sequence: Synthetic oligonucleotide
  Target: SCN9A; (+) strand; PAM type: YTN; PAM sequence: TTA
gttttttattatttaactta

SEQ ID NO: 104280 - DNA, 20 bp, Artificial Sequence
  Description of Artificial Sequence: Synthetic oligonucleotide
  Target: SCN9A; (+) strand; PAM type: YTN; PAM sequence: TTT
tttattatttaacttaaaat

SEQ ID NO: 104281 - DNA, 20 bp, Artificial Sequence
  Description of Artificial Sequence: Synthetic oligonucleotide
  Target: SCN9A; (+) strand; PAM type: YTN; PAM sequence: TTT
ttattatttaacttaaaata

SEQ ID NO: 104282 - DNA, 20 bp, Artificial Sequence
  Description of Artificial Sequence: Synthetic oligonucleotide
  Target: SCN9A; (+) strand; PAM type: YTN; PAM sequence: TTT
tattatttaacttaaaatat

SEQ ID NO: 104283 - DNA, 20 bp, Artificial Sequence
  Description of Artificial Sequence: Synthetic oligonucleotide
  Target: SCN9A; (+) strand; PAM type: YTN; PAM sequence: TTT
attatttaacttaaaatatt

SEQ ID NO: 104284 - DNA, 20 bp, Artificial Sequence
  Description of Artificial Sequence: Synthetic oligonucleotide
  Target: SCN9A; (+) strand; PAM type: YTN; PAM sequence: TTA
ttatttaacttaaaatattc

SEQ ID NO: 104285 - DNA, 20 bp, Artificial Sequence
  Description of Artificial Sequence: Synthetic oligonucleotide
  Target: SCN9A; (+) strand; PAM type: YTN; PAM sequence: TTA
tttaacttaaaatattctta

SEQ ID NO: 104286 - DNA, 20 bp, Artificial Sequence
  Description of Artificial Sequence: Synthetic oligonucleotide
  Target: SCN9A; (+) strand; PAM type: YTN; PAM sequence: TTT
aacttaaaatattcttattt

SEQ ID NO: 104287 - DNA, 20 bp, Artificial Sequence
  Description of Artificial Sequence: Synthetic oligonucleotide
  Target: SCN9A; (+) strand; PAM type: YTN; PAM sequence: TTA
acttaaaatattcttatttt

SEQ ID NO: 104288 - DNA, 20 bp, Artificial Sequence
  Description of Artificial Sequence: Synthetic oligonucleotide
  Target: SCN9A; (+) strand; PAM type: YTN; PAM sequence: CTT
aaaatattcttattttcata

SEQ ID NO: 104289 - DNA, 20 bp, Artificial Sequence
  Description of Artificial Sequence: Synthetic oligonucleotide
  Target: SCN9A; (+) strand; PAM type: YTN; PAM sequence: TTA
aaatattcttattttcatat

SEQ ID NO: 104290 - DNA, 20 bp, Artificial Sequence
  Description of Artificial Sequence: Synthetic oligonucleotide
  Target: SCN9A; (+) strand; PAM type: YTN; PAM sequence: TTC
ttattttcatatatattttc

SEQ ID NO: 104291 - DNA, 20 bp, Artificial Sequence
  Description of Artificial Sequence: Synthetic oligonucleotide
  Target: SCN9A; (+) strand; PAM type: YTN; PAM sequence: CTT
attttcatatatattttcta

SEQ ID NO: 104292 - DNA, 20 bp, Artificial Sequence
  Description of Artificial Sequence: Synthetic oligonucleotide
  Target: SCN9A; (+) strand; PAM type: YTN; PAM sequence: TTA
ttttcatatatattttctaa

SEQ ID NO: 104293 - DNA, 20 bp, Artificial Sequence
  Description of Artificial Sequence: Synthetic oligonucleotide
  Target: SCN9A; (+) strand; PAM type: YTN; PAM sequence: TTT
tcatatatattttctaattc

SEQ ID NO: 104294 - DNA, 20 bp, Artificial Sequence
  Description of Artificial Sequence: Synthetic oligonucleotide
  Target: SCN9A; (+) strand; PAM type: YTN; PAM sequence: TTT
catatatattttctaattca

SEQ ID NO: 104295 - DNA, 20 bp, Artificial Sequence
  Description of Artificial Sequence: Synthetic oligonucleotide
  Target: SCN9A; (+) strand; PAM type: YTN; PAM sequence: TTC
atatatattttctaattcaa

SEQ ID NO: 104296 - DNA, 20 bp, Artificial Sequence
  Description of Artificial Sequence: Synthetic oligonucleotide
  Target: SCN9A; (+) strand; PAM type: YTN; PAM sequence: TTT
tctaattcaataagtaaaaa

SEQ ID NO: 104297 - DNA, 20 bp, Artificial Sequence
  Description of Artificial Sequence: Synthetic oligonucleotide
  Target: SCN9A; (+) strand; PAM type: YTN; PAM sequence: TTT
ctaattcaataagtaaaaat

SEQ ID NO: 104298 - DNA, 20 bp, Artificial Sequence
  Description of Artificial Sequence: Synthetic oligonucleotide
  Target: SCN9A; (+) strand; PAM type: YTN; PAM sequence: TTC
taattcaataagtaaaaatt

SEQ ID NO: 104299 - DNA, 20 bp, Artificial Sequence
  Description of Artificial Sequence: Synthetic oligonucleotide
  Target: SCN9A; (+) strand; PAM type: YTN; PAM sequence: CTA
attcaataagtaaaaattaa

SEQ ID NO: 104300 - DNA, 20 bp, Artificial Sequence
  Description of Artificial Sequence: Synthetic oligonucleotide
  Target: SCN9A; (+) strand; PAM type: YTN; PAM sequence: TTC
aataagtaaaaattaacttt

SEQ ID NO: 104301 - DNA, 20 bp, Artificial Sequence
  Description of Artificial Sequence: Synthetic oligonucleotide
  Target: SCN9A; (+) strand; PAM type: YTN; PAM sequence: TTA
acttttgttttttggtaatt

SEQ ID NO: 104302 - DNA, 20 bp, Artificial Sequence
  Description of Artificial Sequence: Synthetic oligonucleotide
  Target: SCN9A; (+) strand; PAM type: YTN; PAM sequence: CTT
ttgttttttggtaattttat

SEQ ID NO: 104303 - DNA, 20 bp, Artificial Sequence
  Description of Artificial Sequence: Synthetic oligonucleotide
  Target: SCN9A; (+) strand; PAM type: YTN; PAM sequence: TTT
tgttttttggtaattttata

SEQ ID NO: 104304 - DNA, 20 bp, Artificial Sequence
  Description of Artificial Sequence: Synthetic oligonucleotide
  Target: SCN9A; (+) strand; PAM type: YTN; PAM sequence: TTT
gttttttggtaattttatac

SEQ ID NO: 104305 - DNA, 20 bp, Artificial Sequence
  Description of Artificial Sequence: Synthetic oligonucleotide
  Target: SCN9A; (+) strand; PAM type: YTN; PAM sequence: TTG
ttttttggtaattttataca

SEQ ID NO: 104306 - DNA, 20 bp, Artificial Sequence
  Description of Artificial Sequence: Synthetic oligonucleotide
  Target: SCN9A; (+) strand; PAM type: YTN; PAM sequence: TTT
tttggtaattttatacaata

SEQ ID NO: 104307 - DNA, 20 bp, Artificial Sequence
  Description of Artificial Sequence: Synthetic oligonucleotide
  Target: SCN9A; (+) strand; PAM type: YTN; PAM sequence: TTT
ttggtaattttatacaatat

SEQ ID NO: 104308 - DNA, 20 bp, Artificial Sequence
  Description of Artificial Sequence: Synthetic oligonucleotide
  Target: SCN9A; (+) strand; PAM type: YTN; PAM sequence: TTT
tggtaattttatacaatatg

SEQ ID NO: 104309 - DNA, 20 bp, Artificial Sequence
  Description of Artificial Sequence: Synthetic oligonucleotide
  Target: SCN9A; (+) strand; PAM type: YTN; PAM sequence: TTT
ggtaattttatacaatatgt

SEQ ID NO: 104310 - DNA, 20 bp, Artificial Sequence
  Description of Artificial Sequence: Synthetic oligonucleotide
  Target: SCN9A; (+) strand; PAM type: YTN; PAM sequence: TTG
gtaattttatacaatatgtt

SEQ ID NO: 104311 - DNA, 20 bp, Artificial Sequence
  Description of Artificial Sequence: Synthetic oligonucleotide
  Target: SCN9A; (+) strand; PAM type: YTN; PAM sequence: TTT
tatacaatatgtttcaaagt

SEQ ID NO: 104312 - DNA, 20 bp, Artificial Sequence
  Description of Artificial Sequence: Synthetic oligonucleotide
  Target: SCN9A; (+) strand; PAM type: YTN; PAM sequence: TTT
atacaatatgtttcaaagta

SEQ ID NO: 104313 - DNA, 20 bp, Artificial Sequence
  Description of Artificial Sequence: Synthetic oligonucleotide
  Target: SCN9A; (+) strand; PAM type: YTN; PAM sequence: TTA
tacaatatgtttcaaagtat

SEQ ID NO: 104314 - DNA, 20 bp, Artificial Sequence
  Description of Artificial Sequence: Synthetic oligonucleotide
  Target: SCN9A; (+) strand; PAM type: YTN; PAM sequence: TTT
caaagtataacattacaatt

SEQ ID NO: 104315 - DNA, 20 bp, Artificial Sequence
  Description of Artificial Sequence: Synthetic oligonucleotide
  Target: SCN9A; (+) strand; PAM type: YTN; PAM sequence: TTC
aaagtataacattacaattg

SEQ ID NO: 104316 - DNA, 20 bp, Artificial Sequence
  Description of Artificial Sequence: Synthetic oligonucleotide
  Target: SCN9A; (+) strand; PAM type: YTN; PAM sequence: TTA
caattgatgcatattattcc

SEQ ID NO: 104317 - DNA, 20 bp, Artificial Sequence
  Description of Artificial Sequence: Synthetic oligonucleotide
  Target: SCN9A; (+) strand; PAM type: YTN; PAM sequence: TTG
atgcatattattccaaatta

SEQ ID NO: 104318 - DNA, 20 bp, Artificial Sequence
  Description of Artificial Sequence: Synthetic oligonucleotide
  Target: SCN9A; (+) strand; PAM type: YTN; PAM sequence: TTA
ttccaaattatgcctagtaa

SEQ ID NO: 104319 - DNA, 20 bp, Artificial Sequence
  Description of Artificial Sequence: Synthetic oligonucleotide
  Target: SCN9A; (+) strand; PAM type: YTN; PAM sequence: TTC
caaattatgcctagtaactg

SEQ ID NO: 104320 - DNA, 20 bp, Artificial Sequence
  Description of Artificial Sequence: Synthetic oligonucleotide
  Target: SCN9A; (+) strand; PAM type: YTN; PAM sequence: TTA
tgcctagtaactgcatctct

SEQ ID NO: 104321 - DNA, 20 bp, Artificial Sequence
  Description of Artificial Sequence: Synthetic oligonucleotide
  Target: SCN9A; (+) strand; PAM type: YTN; PAM sequence: CTA
gtaactgcatctcttaaaat

SEQ ID NO: 104322 - DNA, 20 bp, Artificial Sequence
  Description of Artificial Sequence: Synthetic oligonucleotide
  Target: SCN9A; (+) strand; PAM type: YTN; PAM sequence: CTG
catctcttaaaatagaaaat

SEQ ID NO: 104323 - DNA, 20 bp, Artificial Sequence
  Description of Artificial Sequence: Synthetic oligonucleotide
  Target: SCN9A; (+) strand; PAM type: YTN; PAM sequence: CTC
ttaaaatagaaaattaccat

SEQ ID NO: 104324 - DNA, 20 bp, Artificial Sequence
  Description of Artificial Sequence: Synthetic oligonucleotide
  Target: SCN9A; (+) strand; PAM type: YTN; PAM sequence: CTT
aaaatagaaaattaccatcc

SEQ ID NO: 104325 - DNA, 20 bp, Artificial Sequence
  Description of Artificial Sequence: Synthetic oligonucleotide
  Target: SCN9A; (+) strand; PAM type: YTN; PAM sequence: TTA
aaatagaaaattaccatcct

SEQ ID NO: 104326 - DNA, 20 bp, Artificial Sequence
  Description of Artificial Sequence: Synthetic oligonucleotide
  Target: SCN9A; (+) strand; PAM type: YTN; PAM sequence: TTA
ccatccttcaattcttttga

SEQ ID NO: 104327 - DNA, 20 bp, Artificial Sequence
  Description of Artificial Sequence: Synthetic oligonucleotide
  Target: SCN9A; (+) strand; PAM type: YTN; PAM sequence: CTT
caattcttttgacattttca

SEQ ID NO: 104328 - DNA, 20 bp, Artificial Sequence
  Description of Artificial Sequence: Synthetic oligonucleotide
  Target: SCN9A; (+) strand; PAM type: YTN; PAM sequence: TTC
aattcttttgacattttcat

SEQ ID NO: 104329 - DNA, 20 bp, Artificial Sequence
  Description of Artificial Sequence: Synthetic oligonucleotide
  Target: SCN9A; (+) strand; PAM type: YTN; PAM sequence: TTC
ttttgacattttcataaagg

SEQ ID NO: 104330 - DNA, 20 bp, Artificial Sequence
  Description of Artificial Sequence: Synthetic oligonucleotide
  Target: SCN9A; (+) strand; PAM type: YTN; PAM sequence: CTT
ttgacattttcataaaggaa

SEQ ID NO: 104331 - DNA, 20 bp, Artificial Sequence
  Description of Artificial Sequence: Synthetic oligonucleotide
  Target: SCN9A; (+) strand; PAM type: YTN; PAM sequence: TTT
tgacattttcataaaggaat

SEQ ID NO: 104332 - DNA, 20 bp, Artificial Sequence
  Description of Artificial Sequence: Synthetic oligonucleotide
  Target: SCN9A; (+) strand; PAM type: YTN; PAM sequence: TTT
gacattttcataaaggaata

SEQ ID NO: 104333 - DNA, 20 bp, Artificial Sequence
  Description of Artificial Sequence: Synthetic oligonucleotide
  Target: SCN9A; (+) strand; PAM type: YTN; PAM sequence: TTG
acattttcataaaggaataa

SEQ ID NO: 104334 - DNA, 20 bp, Artificial Sequence
  Description of Artificial Sequence: Synthetic oligonucleotide
  Target: SCN9A; (+) strand; PAM type: YTN; PAM sequence: TTT
tcataaaggaataataataa

SEQ ID NO: 104335 - DNA, 20 bp, Artificial Sequence
  Description of Artificial Sequence: Synthetic oligonucleotide
  Target: SCN9A; (+) strand; PAM type: YTN; PAM sequence: TTT
cataaaggaataataataat

SEQ ID NO: 104336 - DNA, 20 bp, Artificial Sequence
  Description of Artificial Sequence: Synthetic oligonucleotide
  Target: SCN9A; (+) strand; PAM type: YTN; PAM sequence: TTC
ataaaggaataataataatt

SEQ ID NO: 104337 - DNA, 20 bp, Artificial Sequence
  Description of Artificial Sequence: Synthetic oligonucleotide
  Target: SCN9A; (+) strand; PAM type: YTN; PAM sequence: TTA
gtagcagtagtaatattgga

SEQ ID NO: 104338 - DNA, 20 bp, Artificial Sequence
  Description of Artificial Sequence: Synthetic oligonucleotide
  Target: SCN9A; (+) strand; PAM type: YTN; PAM sequence: TTG
gagaagcatgcctgaccttg

SEQ ID NO: 104339 - DNA, 20 bp, Artificial Sequence
  Description of Artificial Sequence: Synthetic oligonucleotide
  Target: SCN9A; (+) strand; PAM type: YTN; PAM sequence: CTG
accttgttaataccttccaa

SEQ ID NO: 104340 - DNA, 20 bp, Artificial Sequence
  Description of Artificial Sequence: Synthetic oligonucleotide
  Target: SCN9A; (+) strand; PAM type: YTN; PAM sequence: CTT
gttaataccttccaaggtat

SEQ ID NO: 104341 - DNA, 20 bp, Artificial Sequence
  Description of Artificial Sequence: Synthetic oligonucleotide
  Target: SCN9A; (+) strand; PAM type: YTN; PAM sequence: TTG
ttaataccttccaaggtatc

SEQ ID NO: 104342 - DNA, 20 bp, Artificial Sequence
  Description of Artificial Sequence: Synthetic oligonucleotide
  Target: SCN9A; (+) strand; PAM type: YTN; PAM sequence: TTA
ataccttccaaggtatctta

SEQ ID NO: 104343 - DNA, 20 bp, Artificial Sequence
  Description of Artificial Sequence: Synthetic oligonucleotide
  Target: SCN9A; (+) strand; PAM type: YTN; PAM sequence: CTT
ccaaggtatcttaccaagag

SEQ ID NO: 104344 - DNA, 20 bp, Artificial Sequence
  Description of Artificial Sequence: Synthetic oligonucleotide
  Target: SCN9A; (+) strand; PAM type: YTN; PAM sequence: TTC
caaggtatcttaccaagaga

SEQ ID NO: 104345 - DNA, 20 bp, Artificial Sequence
  Description of Artificial Sequence: Synthetic oligonucleotide
  Target: SCN9A; (+) strand; PAM type: YTN; PAM sequence: CTT
accaagagaatccagatttt

SEQ ID NO: 104346 - DNA, 20 bp, Artificial Sequence
  Description of Artificial Sequence: Synthetic oligonucleotide
  Target: SCN9A; (+) strand; PAM type: YTN; PAM sequence: TTA
ccaagagaatccagatttta

SEQ ID NO: 104347 - DNA, 20 bp, Artificial Sequence
  Description of Artificial Sequence: Synthetic oligonucleotide
  Target: SCN9A; (+) strand; PAM type: YTN; PAM sequence: TTT
tattcagggtagcaatatgc

SEQ ID NO: 104348 - DNA, 20 bp, Artificial Sequence
  Description of Artificial Sequence: Synthetic oligonucleotide
  Target: SCN9A; (+) strand; PAM type: YTN; PAM sequence: TTT
attcagggtagcaatatgcc

SEQ ID NO: 104349 - DNA, 20 bp, Artificial Sequence
  Description of Artificial Sequence: Synthetic oligonucleotide
  Target: SCN9A; (+) strand; PAM type: YTN; PAM sequence: TTA
ttcagggtagcaatatgccc

SEQ ID NO: 104350 - DNA, 20 bp, Artificial Sequence
  Description of Artificial Sequence: Synthetic oligonucleotide
  Target: SCN9A; (+) strand; PAM type: YTN; PAM sequence: TTC
agggtagcaatatgcccaga

SEQ ID NO: 104351 - DNA, 20 bp, Artificial Sequence
  Description of Artificial Sequence: Synthetic oligonucleotide
  Target: SCN9A; (+) strand; PAM type: YTN; PAM sequence: CTG
cctcagccaggctaccttgt

SEQ ID NO: 104352 - DNA, 20 bp, Artificial Sequence
  Description of Artificial Sequence: Synthetic oligonucleotide
  Target: SCN9A; (+) strand; PAM type: YTN; PAM sequence: CTC
agccaggctaccttgttgtt

SEQ ID NO: 104353 - DNA, 20 bp, Artificial Sequence
  Description of Artificial Sequence: Synthetic oligonucleotide
  Target: SCN9A; (+) strand; PAM type: YTN; PAM sequence: CTA
ccttgttgttaggggtggcc

SEQ ID NO: 104354 - DNA, 20 bp, Artificial Sequence
  Description of Artificial Sequence: Synthetic oligonucleotide
  Target: SCN9A; (+) strand; PAM type: YTN; PAM sequence: CTT
gttgttaggggtggccatgt

SEQ ID NO: 104355 - DNA, 20 bp, Artificial Sequence
  Description of Artificial Sequence: Synthetic oligonucleotide
  Target: SCN9A; (+) strand; PAM type: YTN; PAM sequence: TTG
ttgttaggggtggccatgtc

SEQ ID NO: 104356 - DNA, 20 bp, Artificial Sequence
  Description of Artificial Sequence: Synthetic oligonucleotide
  Target: SCN9A; (+) strand; PAM type: YTN; PAM sequence: TTG
ttaggggtggccatgtcaca

SEQ ID NO: 104357 - DNA, 20 bp, Artificial Sequence
  Description of Artificial Sequence: Synthetic oligonucleotide
  Target: SCN9A; (+) strand; PAM type: YTN; PAM sequence: TTA
ggggtggccatgtcacactg

SEQ ID NO: 104358 - DNA, 20 bp, Artificial Sequence
  Description of Artificial Sequence: Synthetic oligonucleotide
  Target: SCN9A; (+) strand; PAM type: YTN; PAM sequence: CTG
ttcttgccaataagacataa

SEQ ID NO: 104359 - DNA, 20 bp, Artificial Sequence
  Description of Artificial Sequence: Synthetic oligonucleotide
  Target: SCN9A; (+) strand; PAM type: YTN; PAM sequence: TTC
ttgccaataagacataagcc

SEQ ID NO: 104360 - DNA, 20 bp, Artificial Sequence
  Description of Artificial Sequence: Synthetic oligonucleotide
  Target: SCN9A; (+) strand; PAM type: YTN; PAM sequence: CTT
gccaataagacataagccaa

SEQ ID NO: 104361 - DNA, 20 bp, Artificial Sequence
  Description of Artificial Sequence: Synthetic oligonucleotide
  Target: SCN9A; (+) strand; PAM type: YTN; PAM sequence: TTG
ccaataagacataagccaaa

SEQ ID NO: 104362 - DNA, 20 bp, Artificial Sequence
  Description of Artificial Sequence: Synthetic oligonucleotide
  Target: SCN9A; (+) strand; PAM type: YTN; PAM sequence: TTG
gataaggatctctgggaaag

SEQ ID NO: 104363 - DNA, 20 bp, Artificial Sequence
  Description of Artificial Sequence: Synthetic oligonucleotide
  Target: SCN9A; (+) strand; PAM type: YTN; PAM sequence: CTC
tgggaaagttttgcccttcc

SEQ ID NO: 104364 - DNA, 20 bp, Artificial Sequence
  Description of Artificial Sequence: Synthetic oligonucleotide
  Target: SCN9A; (+) strand; PAM type: YTN; PAM sequence: CTG
ggaaagttttgcccttcctc

SEQ ID NO: 104365 - DNA, 20 bp, Artificial Sequence
  Description of Artificial Sequence: Synthetic oligonucleotide
  Target: SCN9A; (+) strand; PAM type: YTN; PAM sequence: TTT
tgcccttcctcaggcaagtg

SEQ ID NO: 104366 - DNA, 20 bp, Artificial Sequence
  Description of Artificial Sequence: Synthetic oligonucleotide
  Target: SCN9A; (+) strand; PAM type: YTN; PAM sequence: TTT
gcccttcctcaggcaagtgg

SEQ ID NO: 104367 - DNA, 20 bp, Artificial Sequence
  Description of Artificial Sequence: Synthetic oligonucleotide
  Target: SCN9A; (+) strand; PAM type: YTN; PAM sequence: TTG
cccttcctcaggcaagtggg

SEQ ID NO: 104368 - DNA, 20 bp, Artificial Sequence
  Description of Artificial Sequence: Synthetic oligonucleotide
  Target: SCN9A; (+) strand; PAM type: YTN; PAM sequence: CTT
cctcaggcaagtgggatagt

SEQ ID NO: 104369 - DNA, 20 bp, Artificial Sequence
  Description of Artificial Sequence: Synthetic oligonucleotide
  Target: SCN9A; (+) strand; PAM type: YTN; PAM sequence: TTC
ctcaggcaagtgggatagtc

SEQ ID NO: 104370 - DNA, 20 bp, Artificial Sequence
  Description of Artificial Sequence: Synthetic oligonucleotide
  Target: SCN9A; (+) strand; PAM type: YTN; PAM sequence: CTC
aggcaagtgggatagtcatt

SEQ ID NO: 104371 - DNA, 20 bp, Artificial Sequence
  Description of Artificial Sequence: Synthetic oligonucleotide
  Target: SCN9A; (+) strand; PAM type: YTN; PAM sequence: TTA
cttctgcttcgttctatttc

SEQ ID NO: 104372 - DNA, 20 bp, Artificial Sequence
  Description of Artificial Sequence: Synthetic oligonucleotide
  Target: SCN9A; (+) strand; PAM type: YTN; PAM sequence: CTT
ctgcttcgttctatttcttt

SEQ ID NO: 104373 - DNA, 20 bp, Artificial Sequence
  Description of Artificial Sequence: Synthetic oligonucleotide
  Target: SCN9A; (+) strand; PAM type: YTN; PAM sequence: TTC
tgcttcgttctatttctttc

SEQ ID NO: 104374 - DNA, 20 bp, Artificial Sequence
  Description of Artificial Sequence: Synthetic oligonucleotide
  Target: SCN9A; (+) strand; PAM type: YTN; PAM sequence: CTG
cttcgttctatttctttctc

SEQ ID NO: 104375 - DNA, 20 bp, Artificial Sequence
  Description of Artificial Sequence: Synthetic oligonucleotide
  Target: SCN9A; (+) strand; PAM type: YTN; PAM sequence: CTT
cgttctatttctttctctac

SEQ ID NO: 104376 - DNA, 20 bp, Artificial Sequence
  Description of Artificial Sequence: Synthetic oligonucleotide
  Target: SCN9A; (+) strand; PAM type: YTN; PAM sequence: TTC
gttctatttctttctctacc

SEQ ID NO: 104377 - DNA, 20 bp, Artificial Sequence
  Description of Artificial Sequence: Synthetic oligonucleotide
  Target: SCN9A; (+) strand; PAM type: YTN; PAM sequence: TTC
tatttctttctctacctggg

SEQ ID NO: 104378 - DNA, 20 bp, Artificial Sequence
  Description of Artificial Sequence: Synthetic oligonucleotide
  Target: SCN9A; (+) strand; PAM type: YTN; PAM sequence: CTA
tttctttctctacctgggta

SEQ ID NO: 104379 - DNA, 20 bp, Artificial Sequence
  Description of Artificial Sequence: Synthetic oligonucleotide
  Target: SCN9A; (+) strand; PAM type: YTN; PAM sequence: TTT
ctttctctacctgggtattg

SEQ ID NO: 104380 - DNA, 20 bp, Artificial Sequence
  Description of Artificial Sequence: Synthetic oligonucleotide
  Target: SCN9A; (+) strand; PAM type: YTN; PAM sequence: TTC
tttctctacctgggtattgg

SEQ ID NO: 104381 - DNA, 20 bp, Artificial Sequence
  Description of Artificial Sequence: Synthetic oligonucleotide
  Target: SCN9A; (+) strand; PAM type: YTN; PAM sequence: CTT
tctctacctgggtattggat

SEQ ID NO: 104382 - DNA, 20 bp, Artificial Sequence
  Description of Artificial Sequence: Synthetic oligonucleotide
  Target: SCN9A; (+) strand; PAM type: YTN; PAM sequence: TTT
ctctacctgggtattggata

SEQ ID NO: 104383 - DNA, 20 bp, Artificial Sequence
  Description of Artificial Sequence: Synthetic oligonucleotide
  Target: SCN9A; (+) strand; PAM type: YTN; PAM sequence: TTC
tctacctgggtattggatat

SEQ ID NO: 104384 - DNA, 20 bp, Artificial Sequence
  Description of Artificial Sequence: Synthetic oligonucleotide
  Target: SCN9A; (+) strand; PAM type: YTN; PAM sequence: CTC
tacctgggtattggatataa

SEQ ID NO: 104385 - DNA, 20 bp, Artificial Sequence
  Description of Artificial Sequence: Synthetic oligonucleotide
  Target: SCN9A; (+) strand; PAM type: YTN; PAM sequence: CTA
cctgggtattggatataaag

SEQ ID NO: 104386 - DNA, 20 bp, Artificial Sequence
  Description of Artificial Sequence: Synthetic oligonucleotide
  Target: SCN9A; (+) strand; PAM type: YTN; PAM sequence: CTG
ggtattggatataaagctgt

SEQ ID NO: 104387 - DNA, 20 bp, Artificial Sequence
  Description of Artificial Sequence: Synthetic oligonucleotide
  Target: SCN9A; (+) strand; PAM type: YTN; PAM sequence: TTG
gatataaagctgtaggtgga

SEQ ID NO: 104388 - DNA, 20 bp, Artificial Sequence
  Description of Artificial Sequence: Synthetic oligonucleotide
  Target: SCN9A; (+) strand; PAM type: YTN; PAM sequence: CTG
taggtggaacagtcacctct

SEQ ID NO: 104389 - DNA, 20 bp, Artificial Sequence
  Description of Artificial Sequence: Synthetic oligonucleotide
  Target: SCN9A; (+) strand; PAM type: YTN; PAM sequence: CTC
taatcataggcattaatata

SEQ ID NO: 104390 - DNA, 20 bp, Artificial Sequence
  Description of Artificial Sequence: Synthetic oligonucleotide
  Target: SCN9A; (+) strand; PAM type: YTN; PAM sequence: CTA
atcataggcattaatataga

SEQ ID NO: 104391 - DNA, 20 bp, Artificial Sequence
  Description of Artificial Sequence: Synthetic oligonucleotide
  Target: SCN9A; (+) strand; PAM type: YTN; PAM sequence: TTA
atatagaagaaaaaacacat

SEQ ID NO: 104392 - DNA, 20 bp, Artificial Sequence
  Description of Artificial Sequence: Synthetic oligonucleotide
  Target: SCN9A; (+) strand; PAM type: YTN; PAM sequence: TTG
gcagaagggagaagagatgg

SEQ ID NO: 104393 - DNA, 20 bp, Artificial Sequence
  Description of Artificial Sequence: Synthetic oligonucleotide
  Target: SCN9A; (+) strand; PAM type: YTN; PAM sequence: CTA
ggacatggaggccacgtgga

SEQ ID NO: 104394 - DNA, 20 bp, Artificial Sequence
  Description of Artificial Sequence: Synthetic oligonucleotide
  Target: SCN9A; (+) strand; PAM type: YTN; PAM sequence: CTG
ctgatctgtggatgttttaa

SEQ ID NO: 104395 - DNA, 20 bp, Artificial Sequence
  Description of Artificial Sequence: Synthetic oligonucleotide
  Target: SCN9A; (+) strand; PAM type: YTN; PAM sequence: CTG
atctgtggatgttttaaaat

SEQ ID NO: 104396 - DNA, 20 bp, Artificial Sequence
  Description of Artificial Sequence: Synthetic oligonucleotide
  Target: SCN9A; (+) strand; PAM type: YTN; PAM sequence: CTG
tggatgttttaaaatatgaa

SEQ ID NO: 104397 - DNA, 20 bp, Artificial Sequence
  Description of Artificial Sequence: Synthetic oligonucleotide
  Target: SCN9A; (+) strand; PAM type: YTN; PAM sequence: TTT
taaaatatgaaaacagaatg

SEQ ID NO: 104398 - DNA, 20 bp, Artificial Sequence
  Description of Artificial Sequence: Synthetic oligonucleotide
  Target: SCN9A; (+) strand; PAM type: YTN; PAM sequence: TTT
aaaatatgaaaacagaatgt

SEQ ID NO: 104399 - DNA, 20 bp, Artificial Sequence
  Description of Artificial Sequence: Synthetic oligonucleotide
  Target: SCN9A; (+) strand; PAM type: YTN; PAM sequence: TTA
aaatatgaaaacagaatgtt

SEQ ID NO: 104400 - DNA, 20 bp, Artificial Sequence
  Description of Artificial Sequence: Synthetic oligonucleotide
  Target: SCN9A; (+) strand; PAM type: YTN; PAM sequence: TTC
tatccagttatgccaatgta

SEQ ID NO: 104401 - DNA, 20 bp, Artificial Sequence
  Description of Artificial Sequence: Synthetic oligonucleotide
  Target: SCN9A; (+) strand; PAM type: YTN; PAM sequence: CTA
tccagttatgccaatgtagt

SEQ ID NO: 104402 - DNA, 20 bp, Artificial Sequence
  Description of Artificial Sequence: Synthetic oligonucleotide
  Target: SCN9A; (+) strand; PAM type: YTN; PAM sequence: TTA
tgccaatgtagttaagtctc

SEQ ID NO: 104403 - DNA, 20 bp, Artificial Sequence
  Description of Artificial Sequence: Synthetic oligonucleotide
  Target: SCN9A; (+) strand; PAM type: YTN; PAM sequence: TTA
agtctctgttgcatgcagtt

SEQ ID NO: 104404 - DNA, 20 bp, Artificial Sequence
  Description of Artificial Sequence: Synthetic oligonucleotide
  Target: SCN9A; (+) strand; PAM type: YTN; PAM sequence: CTC
tgttgcatgcagttaaacag

SEQ ID NO: 104405 - DNA, 20 bp, Artificial Sequence
  Description of Artificial Sequence: Synthetic oligonucleotide
  Target: SCN9A; (+) strand; PAM type: YTN; PAM sequence: CTG
ttgcatgcagttaaacagag

SEQ ID NO: 104406 - DNA, 20 bp, Artificial Sequence
  Description of Artificial Sequence: Synthetic oligonucleotide
  Target: SCN9A; (+) strand; PAM type: YTN; PAM sequence: TTG
catgcagttaaacagagtcc

SEQ ID NO: 104407 - DNA, 20 bp, Artificial Sequence
  Description of Artificial Sequence: Synthetic oligonucleotide
  Target: SCN9A; (+) strand; PAM type: YTN; PAM sequence: TTA
aacagagtcctgactcagaa

SEQ ID NO: 104408 - DNA, 20 bp, Artificial Sequence
  Description of Artificial Sequence: Synthetic oligonucleotide
  Target: SCN9A; (+) strand; PAM type: YTN; PAM sequence: CTG
actcagaaatagccaaaaat

SEQ ID NO: 104409 - DNA, 20 bp, Artificial Sequence
  Description of Artificial Sequence: Synthetic oligonucleotide
  Target: SCN9A; (+) strand; PAM type: YTN; PAM sequence: CTC
agaaatagccaaaaataaca

SEQ ID NO: 104410 - DNA, 20 bp, Artificial Sequence
  Description of Artificial Sequence: Synthetic oligonucleotide
  Target: SCN9A; (+) strand; PAM type: YTN; PAM sequence: TTA
cccatgtacccttaagtaaa

SEQ ID NO: 104411 - DNA, 20 bp, Artificial Sequence
  Description of Artificial Sequence: Synthetic oligonucleotide
  Target: SCN9A; (+) strand; PAM type: YTN; PAM sequence: CTT
aagtaaaataggtttattca

SEQ ID NO: 104412 - DNA, 20 bp, Artificial Sequence
  Description of Artificial Sequence: Synthetic oligonucleotide
  Target: SCN9A; (+) strand; PAM type: YTN; PAM sequence: TTA
agtaaaataggtttattcaa

SEQ ID NO: 104413 - DNA, 20 bp, Artificial Sequence
  Description of Artificial Sequence: Synthetic oligonucleotide
  Target: SCN9A; (+) strand; PAM type: YTN; PAM sequence: TTT
attcaaatagttaagatctt

SEQ ID NO: 104414 - DNA, 20 bp, Artificial Sequence
  Description of Artificial Sequence: Synthetic oligonucleotide
  Target: SCN9A; (+) strand; PAM type: YTN; PAM sequence: TTA
ttcaaatagttaagatctta

SEQ ID NO: 104415 - DNA, 20 bp, Artificial Sequence
  Description of Artificial Sequence: Synthetic oligonucleotide
  Target: SCN9A; (+) strand; PAM type: YTN; PAM sequence: TTC
aaatagttaagatcttaaca

SEQ ID NO: 104416 - DNA, 20 bp, Artificial Sequence
  Description of Artificial Sequence: Synthetic oligonucleotide
  Target: SCN9A; (+) strand; PAM type: YTN; PAM sequence: TTA
agatcttaacatgtgtacct

SEQ ID NO: 104417 - DNA, 20 bp, Artificial Sequence
  Description of Artificial Sequence: Synthetic oligonucleotide
  Target: SCN9A; (+) strand; PAM type: YTN; PAM sequence: CTT
aacatgtgtaccttggtgtg

SEQ ID NO: 104418 - DNA, 20 bp, Artificial Sequence
  Description of Artificial Sequence: Synthetic oligonucleotide
  Target: SCN9A; (+) strand; PAM type: YTN; PAM sequence: TTA
acatgtgtaccttggtgtgg

SEQ ID NO: 104419 - DNA, 20 bp, Artificial Sequence
  Description of Artificial Sequence: Synthetic oligonucleotide
  Target: SCN9A; (+) strand; PAM type: YTN; PAM sequence: CTT
ggtgtggcagtaagtgtact

SEQ ID NO: 104420 - DNA, 20 bp, Artificial Sequence
  Description of Artificial Sequence: Synthetic oligonucleotide
  Target: SCN9A; (+) strand; PAM type: YTN; PAM sequence: TTG
gtgtggcagtaagtgtactc

SEQ ID NO: 104421 - DNA, 20 bp, Artificial Sequence
  Description of Artificial Sequence: Synthetic oligonucleotide
  Target: SCN9A; (+) strand; PAM type: YTN; PAM sequence: CTC
cctagcccctaatatagcct

SEQ ID NO: 104422 - DNA, 20 bp, Artificial Sequence
  Description of Artificial Sequence: Synthetic oligonucleotide
  Target: SCN9A; (+) strand; PAM type: YTN; PAM sequence: CTA
gcccctaatatagccttaat

SEQ ID NO: 104423 - DNA, 20 bp, Artificial Sequence
  Description of Artificial Sequence: Synthetic oligonucleotide
  Target: SCN9A; (+) strand; PAM type: YTN; PAM sequence: CTA
atatagccttaatgtgaaag

SEQ ID NO: 104424 - DNA, 20 bp, Artificial Sequence
  Description of Artificial Sequence: Synthetic oligonucleotide
  Target: SCN9A; (+) strand; PAM type: YTN; PAM sequence: CTT
aatgtgaaagataatataat

SEQ ID NO: 104425 - DNA, 20 bp, Artificial Sequence
  Description of Artificial Sequence: Synthetic oligonucleotide
  Target: SCN9A; (+) strand; PAM type: YTN; PAM sequence: TTA
atgtgaaagataatataata

SEQ ID NO: 104426 - DNA, 20 bp, Artificial Sequence
  Description of Artificial Sequence: Synthetic oligonucleotide
  Target: SCN9A; (+) strand; PAM type: YTN; PAM sequence: TTC
tacttaatacattgtcctga

SEQ ID NO: 104427 - DNA, 20 bp, Artificial Sequence
  Description of Artificial Sequence: Synthetic oligonucleotide
  Target: SCN9A; (+) strand; PAM type: YTN; PAM sequence: CTA
cttaatacattgtcctgaga

SEQ ID NO: 104428 - DNA, 20 bp, Artificial Sequence
  Description of Artificial Sequence: Synthetic oligonucleotide
  Target: SCN9A; (+) strand; PAM type: YTN; PAM sequence: CTT
aatacattgtcctgagagaa

SEQ ID NO: 104429 - DNA, 20 bp, Artificial Sequence
  Description of Artificial Sequence: Synthetic oligonucleotide
  Target: SCN9A; (+) strand; PAM type: YTN; PAM sequence: TTA
atacattgtcctgagagaac

SEQ ID NO: 104430 - DNA, 20 bp, Artificial Sequence
  Description of Artificial Sequence: Synthetic oligonucleotide
  Target: SCN9A; (+) strand; PAM type: YTN; PAM sequence: TTG
tcctgagagaacacaaaggt

SEQ ID NO: 104431 - DNA, 20 bp, Artificial Sequence
  Description of Artificial Sequence: Synthetic oligonucleotide
  Target: SCN9A; (+) strand; PAM type: YTN; PAM sequence: CTG
agagaacacaaaggttcaaa

SEQ ID NO: 104432 - DNA, 20 bp, Artificial Sequence
  Description of Artificial Sequence: Synthetic oligonucleotide
  Target: SCN9A; (+) strand; PAM type: YTN; PAM sequence: TTC
aaagagagcaaagtgatgtg

SEQ ID NO: 104433 - DNA, 20 bp, Artificial Sequence
  Description of Artificial Sequence: Synthetic oligonucleotide
  Target: SCN9A; (+) strand; PAM type: YTN; PAM sequence: TTA
tgccaaattgatttaatact

SEQ ID NO: 104434 - DNA, 20 bp, Artificial Sequence
  Description of Artificial Sequence: Synthetic oligonucleotide
  Target: SCN9A; (+) strand; PAM type: YTN; PAM sequence: TTG
atttaatacttttctgtaat

SEQ ID NO: 104435 - DNA, 20 bp, Artificial Sequence
  Description of Artificial Sequence: Synthetic oligonucleotide
  Target: SCN9A; (+) strand; PAM type: YTN; PAM sequence: TTT
aatacttttctgtaataaca

SEQ ID NO: 104436 - DNA, 20 bp, Artificial Sequence
  Description of Artificial Sequence: Synthetic oligonucleotide
  Target: SCN9A; (+) strand; PAM type: YTN; PAM sequence: TTA
atacttttctgtaataacat

SEQ ID NO: 104437 - DNA, 20 bp, Artificial Sequence
  Description of Artificial Sequence: Synthetic oligonucleotide
  Target: SCN9A; (+) strand; PAM type: YTN; PAM sequence: CTT
ttctgtaataacataataag

SEQ ID NO: 104438 - DNA, 20 bp, Artificial Sequence
  Description of Artificial Sequence: Synthetic oligonucleotide
  Target: SCN9A; (+) strand; PAM type: YTN; PAM sequence: TTT
tctgtaataacataataagt

SEQ ID NO: 104439 - DNA, 20 bp, Artificial Sequence
  Description of Artificial Sequence: Synthetic oligonucleotide
  Target: SCN9A; (+) strand; PAM type: YTN; PAM sequence: TTT
ctgtaataacataataagtc

SEQ ID NO: 104440 - DNA, 20 bp, Artificial Sequence
  Description of Artificial Sequence: Synthetic oligonucleotide
  Target: SCN9A; (+) strand; PAM type: YTN; PAM sequence: TTC
tgtaataacataataagtca

SEQ ID NO: 104441 - DNA, 20 bp, Artificial Sequence
  Description of Artificial Sequence: Synthetic oligonucleotide
  Target: SCN9A; (+) strand; PAM type: YTN; PAM sequence: CTG
taataacataataagtcatg

SEQ ID NO: 104442 - DNA, 20 bp, Artificial Sequence
  Description of Artificial Sequence: Synthetic oligonucleotide
  Target: SCN9A; (+) strand; PAM type: YTN; PAM sequence: CTT
taaaggcaatgatctggact

SEQ ID NO: 104443 - DNA, 20 bp, Artificial Sequence
  Description of Artificial Sequence: Synthetic oligonucleotide
  Target: SCN9A; (+) strand; PAM type: YTN; PAM sequence: TTT
aaaggcaatgatctggactt

SEQ ID NO: 104444 - DNA, 20 bp, Artificial Sequence
  Description of Artificial Sequence: Synthetic oligonucleotide
  Target: SCN9A; (+) strand; PAM type: YTN; PAM sequence: TTA
aaggcaatgatctggacttt

SEQ ID NO: 104445 - DNA, 20 bp, Artificial Sequence
  Description of Artificial Sequence: Synthetic oligonucleotide
  Target: SCN9A; (+) strand; PAM type: YTN; PAM sequence: CTG
gactttagtgatatttctga

SEQ ID NO: 104446 - DNA, 20 bp, Artificial Sequence
  Description of Artificial Sequence: Synthetic oligonucleotide
  Target: SCN9A; (+) strand; PAM type: YTN; PAM sequence: CTT
tagtgatatttctgagtcac

SEQ ID NO: 104447 - DNA, 20 bp, Artificial Sequence
  Description of Artificial Sequence: Synthetic oligonucleotide
  Target: SCN9A; (+) strand; PAM type: YTN; PAM sequence: TTT
agtgatatttctgagtcact

SEQ ID NO: 104448 - DNA, 20 bp, Artificial Sequence
  Description of Artificial Sequence: Synthetic oligonucleotide
  Target: SCN9A; (+) strand; PAM type: YTN; PAM sequence: TTA
gtgatatttctgagtcactt

SEQ ID NO: 104449 - DNA, 20 bp, Artificial Sequence
  Description of Artificial Sequence: Synthetic oligonucleotide
  Target: SCN9A; (+) strand; PAM type: YTN; PAM sequence: TTT
ctgagtcacttgccaatttc

SEQ ID NO: 104450 - DNA, 20 bp, Artificial Sequence
  Description of Artificial Sequence: Synthetic oligonucleotide
  Target: SCN9A; (+) strand; PAM type: YTN; PAM sequence: TTC
tgagtcacttgccaatttca

SEQ ID NO: 104451 - DNA, 20 bp, Artificial Sequence
  Description of Artificial Sequence: Synthetic oligonucleotide
  Target: SCN9A; (+) strand; PAM type: YTN; PAM sequence: CTG
agtcacttgccaatttcatc

SEQ ID NO: 104452 - DNA, 20 bp, Artificial Sequence
  Description of Artificial Sequence: Synthetic oligonucleotide
  Target: SCN9A; (+) strand; PAM type: YTN; PAM sequence: CTT
gccaatttcatcaacaagcc

SEQ ID NO: 104453 - DNA, 20 bp, Artificial Sequence
  Description of Artificial Sequence: Synthetic oligonucleotide
  Target: SCN9A; (+) strand; PAM type: YTN; PAM sequence: TTG
ccaatttcatcaacaagcca

SEQ ID NO: 104454 - DNA, 20 bp, Artificial Sequence
  Description of Artificial Sequence: Synthetic oligonucleotide
  Target: SCN9A; (+) strand; PAM type: YTN; PAM sequence: TTT
catcaacaagccagggagag

SEQ ID NO: 104455 - DNA, 20 bp, Artificial Sequence
  Description of Artificial Sequence: Synthetic oligonucleotide
  Target: SCN9A; (+) strand; PAM type: YTN; PAM sequence: TTC
atcaacaagccagggagagc

SEQ ID NO: 104456 - DNA, 20 bp, Artificial Sequence
  Description of Artificial Sequence: Synthetic oligonucleotide
  Target: SCN9A; (+) strand; PAM type: YTN; PAM sequence: CTG
gataagtcttagtagcacta

SEQ ID NO: 104457 - DNA, 20 bp, Artificial Sequence
  Description of Artificial Sequence: Synthetic oligonucleotide
  Target: SCN9A; (+) strand; PAM type: YTN; PAM sequence: CTT
agtagcactaagaacctcat

SEQ ID NO: 104458 - DNA, 20 bp, Artificial Sequence
  Description of Artificial Sequence: Synthetic oligonucleotide
  Target: SCN9A; (+) strand; PAM type: YTN; PAM sequence: TTA
gtagcactaagaacctcata

SEQ ID NO: 104459 - DNA, 20 bp, Artificial Sequence
  Description of Artificial Sequence: Synthetic oligonucleotide
  Target: SCN9A; (+) strand; PAM type: YTN; PAM sequence: CTA
agaacctcatagttacctca

SEQ ID NO: 104460 - DNA, 20 bp, Artificial Sequence
  Description of Artificial Sequence: Synthetic oligonucleotide
  Target: SCN9A; (+) strand; PAM type: YTN; PAM sequence: CTC
atagttacctcagcaaggtt

SEQ ID NO: 104461 - DNA, 20 bp, Artificial Sequence
  Description of Artificial Sequence: Synthetic oligonucleotide
  Target: SCN9A; (+) strand; PAM type: YTN; PAM sequence: TTA
cctcagcaaggttttcacct

SEQ ID NO: 104462 - DNA, 20 bp, Artificial Sequence
  Description of Artificial Sequence: Synthetic oligonucleotide
  Target: SCN9A; (+) strand; PAM type: YTN; PAM sequence: CTC
agcaaggttttcacctagag

SEQ ID NO: 104463 - DNA, 20 bp, Artificial Sequence
  Description of Artificial Sequence: Synthetic oligonucleotide
  Target: SCN9A; (+) strand; PAM type: YTN; PAM sequence: TTT
tcacctagagaagaatgaat

SEQ ID NO: 104464 - DNA, 20 bp, Artificial Sequence
  Description of Artificial Sequence: Synthetic oligonucleotide
  Target: SCN9A; (+) strand; PAM type: YTN; PAM sequence: TTT
cacctagagaagaatgaatg

SEQ ID NO: 104465 - DNA, 20 bp, Artificial Sequence
  Description of Artificial Sequence: Synthetic oligonucleotide
  Target: SCN9A; (+) strand; PAM type: YTN; PAM sequence: TTC
acctagagaagaatgaatgt

SEQ ID NO: 104466 - DNA, 20 bp, Artificial Sequence
  Description of Artificial Sequence: Synthetic oligonucleotide
  Target: SCN9A; (+) strand; PAM type: YTN; PAM sequence: CTA
gagaagaatgaatgtatcag

SEQ ID NO: 104467 - DNA, 20 bp, Artificial Sequence
  Description of Artificial Sequence: Synthetic oligonucleotide
  Target: SCN9A; (+) strand; PAM type: YTN; PAM sequence: CTA
caagaacttgaatttggtct

SEQ ID NO: 104468 - DNA, 20 bp, Artificial Sequence
  Description of Artificial Sequence: Synthetic oligonucleotide
  Target: SCN9A; (+) strand; PAM type: YTN; PAM sequence: CTT
gaatttggtctagatgagtt

SEQ ID NO: 104469 - DNA, 20 bp, Artificial Sequence
  Description of Artificial Sequence: Synthetic oligonucleotide
  Target: SCN9A; (+) strand; PAM type: YTN; PAM sequence: TTG
aatttggtctagatgagttt

SEQ ID NO: 104470 - DNA, 20 bp, Artificial Sequence
  Description of Artificial Sequence: Synthetic oligonucleotide
  Target: SCN9A; (+) strand; PAM type: YTN; PAM sequence: TTT
ggtctagatgagtttgtcat

SEQ ID NO: 104471 - DNA, 20 bp, Artificial Sequence
  Description of Artificial Sequence: Synthetic oligonucleotide
  Target: SCN9A; (+) strand; PAM type: YTN; PAM sequence: TTG
gtctagatgagtttgtcata

SEQ ID NO: 104472 - DNA, 20 bp, Artificial Sequence
  Description of Artificial Sequence: Synthetic oligonucleotide
  Target: SCN9A; (+) strand; PAM type: YTN; PAM sequence: CTA
gatgagtttgtcatatttat

SEQ ID NO: 104473 - DNA, 20 bp, Artificial Sequence
  Description of Artificial Sequence: Synthetic oligonucleotide
  Target: SCN9A; (+) strand; PAM type: YTN; PAM sequence: TTT
gtcatatttatcaataattt

SEQ ID NO: 104474 - DNA, 20 bp, Artificial Sequence
  Description of Artificial Sequence: Synthetic oligonucleotide
  Target: SCN9A; (+) strand; PAM type: YTN; PAM sequence: TTG
tcatatttatcaataatttg

SEQ ID NO: 104475 - DNA, 20 bp, Artificial Sequence
  Description of Artificial Sequence: Synthetic oligonucleotide
  Target: SCN9A; (+) strand; PAM type: YTN; PAM sequence: TTT
atcaataatttgcatgaaaa

SEQ ID NO: 104476 - DNA, 20 bp, Artificial Sequence
  Description of Artificial Sequence: Synthetic oligonucleotide
  Target: SCN9A; (+) strand; PAM type: YTN; PAM sequence: TTA
tcaataatttgcatgaaaaa

SEQ ID NO: 104477 - DNA, 20 bp, Artificial Sequence
  Description of Artificial Sequence: Synthetic oligonucleotide
  Target: SCN9A; (+) strand; PAM type: YTN; PAM sequence: TTT
gcatgaaaaaatagacacat

SEQ ID NO: 104478 - DNA, 20 bp, Artificial Sequence
  Description of Artificial Sequence: Synthetic oligonucleotide
  Target: SCN9A; (+) strand; PAM type: YTN; PAM sequence: TTG
catgaaaaaatagacacatt

SEQ ID NO: 104479 - DNA, 20 bp, Artificial Sequence
  Description of Artificial Sequence: Synthetic oligonucleotide
  Target: SCN9A; (+) strand; PAM type: YTN; PAM sequence: TTA
atatatgcaaaaataaatat

SEQ ID NO: 104480 - DNA, 20 bp, Artificial Sequence
  Description of Artificial Sequence: Synthetic oligonucleotide
  Target: SCN9A; (+) strand; PAM type: YTN; PAM sequence: TTT
aatactgaataaatggaaag

SEQ ID NO: 104481 - DNA, 20 bp, Artificial Sequence
  Description of Artificial Sequence: Synthetic oligonucleotide
  Target: SCN9A; (+) strand; PAM type: YTN; PAM sequence: TTA
atactgaataaatggaaagg

SEQ ID NO: 104482 - DNA, 20 bp, Artificial Sequence
  Description of Artificial Sequence: Synthetic oligonucleotide
  Target: SCN9A; (+) strand; PAM type: YTN; PAM sequence: CTG
aataaatggaaaggaaaggg

SEQ ID NO: 104483 - DNA, 20 bp, Artificial Sequence
  Description of Artificial Sequence: Synthetic oligonucleotide
  Target: SCN9A; (+) strand; PAM type: YTN; PAM sequence: TTA
tgtagtcttgagaaagaaat

SEQ ID NO: 104484 - DNA, 20 bp, Artificial Sequence
  Description of Artificial Sequence: Synthetic oligonucleotide
  Target: SCN9A; (+) strand; PAM type: YTN; PAM sequence: CTT
gagaaagaaatatattctag

SEQ ID NO: 104485 - DNA, 20 bp, Artificial Sequence
  Description of Artificial Sequence: Synthetic oligonucleotide
  Target: SCN9A; (+) strand; PAM type: YTN; PAM sequence: TTG
agaaagaaatatattctaga

SEQ ID NO: 104486 - DNA, 20 bp, Artificial Sequence
  Description of Artificial Sequence: Synthetic oligonucleotide
  Target: SCN9A; (+) strand; PAM type: YTN; PAM sequence: TTC
tagaagtaaaatcagtttta

SEQ ID NO: 104487 - DNA, 20 bp, Artificial Sequence
  Description of Artificial Sequence: Synthetic oligonucleotide
  Target: SCN9A; (+) strand; PAM type: YTN; PAM sequence: CTA
gaagtaaaatcagttttact

SEQ ID NO: 104488 - DNA, 20 bp, Artificial Sequence
  Description of Artificial Sequence: Synthetic oligonucleotide
  Target: SCN9A; (+) strand; PAM type: YTN; PAM sequence: TTT
tacttttcaataaagaaggg

SEQ ID NO: 104489 - DNA, 20 bp, Artificial Sequence
  Description of Artificial Sequence: Synthetic oligonucleotide
  Target: SCN9A; (+) strand; PAM type: YTN; PAM sequence: TTT
acttttcaataaagaaggga

SEQ ID NO: 104490 - DNA, 20 bp, Artificial Sequence
  Description of Artificial Sequence: Synthetic oligonucleotide
  Target: SCN9A; (+) strand; PAM type: YTN; PAM sequence: TTA
cttttcaataaagaagggaa

SEQ ID NO: 104491 - DNA, 20 bp, Artificial Sequence
  Description of Artificial Sequence: Synthetic oligonucleotide
  Target: SCN9A; (+) strand; PAM type: YTN; PAM sequence: CTT
ttcaataaagaagggaataa

SEQ ID NO: 104492 - DNA, 20 bp, Artificial Sequence
  Description of Artificial Sequence: Synthetic oligonucleotide
  Target: SCN9A; (+) strand; PAM type: YTN; PAM sequence: TTT
tcaataaagaagggaataag

SEQ ID NO: 104493 - DNA, 20 bp, Artificial Sequence
  Description of Artificial Sequence: Synthetic oligonucleotide
  Target: SCN9A; (+) strand; PAM type: YTN; PAM sequence: TTT
caataaagaagggaataaga

SEQ ID NO: 104494 - DNA, 20 bp, Artificial Sequence
  Description of Artificial Sequence: Synthetic oligonucleotide
  Target: SCN9A; (+) strand; PAM type: YTN; PAM sequence: TTC
aataaagaagggaataagat

SEQ ID NO: 104495 - DNA, 20 bp, Artificial Sequence
  Description of Artificial Sequence: Synthetic oligonucleotide
  Target: SCN9A; (+) strand; PAM type: YTN; PAM sequence: TTT
tgaagaaacaaatttaaaca

SEQ ID NO: 104496 - DNA, 20 bp, Artificial Sequence
  Description of Artificial Sequence: Synthetic oligonucleotide
  Target: SCN9A; (+) strand; PAM type: YTN; PAM sequence: TTT
gaagaaacaaatttaaacac

SEQ ID NO: 104497 - DNA, 20 bp, Artificial Sequence
  Description of Artificial Sequence: Synthetic oligonucleotide
  Target: SCN9A; (+) strand; PAM type: YTN; PAM sequence: TTG
aagaaacaaatttaaacacc

SEQ ID NO: 104498 - DNA, 20 bp, Artificial Sequence
  Description of Artificial Sequence: Synthetic oligonucleotide
  Target: SCN9A; (+) strand; PAM type: YTN; PAM sequence: TTT
aaacacctaaaatataaaaa

SEQ ID NO: 104499 - DNA, 20 bp, Artificial Sequence
  Description of Artificial Sequence: Synthetic oligonucleotide
  Target: SCN9A; (+) strand; PAM type: YTN; PAM sequence: TTA
aacacctaaaatataaaaat

SEQ ID NO: 104500 - DNA, 20 bp, Artificial Sequence
  Description of Artificial Sequence: Synthetic oligonucleotide
  Target: SCN9A; (+) strand; PAM type: YTN; PAM sequence: CTA
aaatataaaaatcacacatt

SEQ ID NO: 104501 - DNA, 20 bp, Artificial Sequence
  Description of Artificial Sequence: Synthetic oligonucleotide
  Target: SCN9A; (+) strand; PAM type: YTN; PAM sequence: TTA
ttaccaaggtagactataac

SEQ ID NO: 104502 - DNA, 20 bp, Artificial Sequence
  Description of Artificial Sequence: Synthetic oligonucleotide
  Target: SCN9A; (+) strand; PAM type: YTN; PAM sequence: TTA
ccaaggtagactataaccta

SEQ ID NO: 104503 - DNA, 20 bp, Artificial Sequence
  Description of Artificial Sequence: Synthetic oligonucleotide
  Target: SCN9A; (+) strand; PAM type: YTN; PAM sequence: CTA
taacctaatcagtcagcatt

SEQ ID NO: 104504 - DNA, 20 bp, Artificial Sequence
  Description of Artificial Sequence: Synthetic oligonucleotide
  Target: SCN9A; (+) strand; PAM type: YTN; PAM sequence: CTA
atcagtcagcattaaggtgg

SEQ ID NO: 104505 - DNA, 20 bp, Artificial Sequence
  Description of Artificial Sequence: Synthetic oligonucleotide
  Target: SCN9A; (+) strand; PAM type: YTN; PAM sequence: TTA
aggtggattagaagcacaat

SEQ ID NO: 104506 - DNA, 20 bp, Artificial Sequence
  Description of Artificial Sequence: Synthetic oligonucleotide
  Target: SCN9A; (+) strand; PAM type: YTN; PAM sequence: TTA
gaagcacaatatcagaatcc

SEQ ID NO: 104507 - DNA, 20 bp, Artificial Sequence
  Description of Artificial Sequence: Synthetic oligonucleotide
  Target: SCN9A; (+) strand; PAM type: YTN; PAM sequence: TTA
caacagaaaatttcaccctg

SEQ ID NO: 104508 - DNA, 20 bp, Artificial Sequence
  Description of Artificial Sequence: Synthetic oligonucleotide
  Target: SCN9A; (+) strand; PAM type: YTN; PAM sequence: TTT
caccctgaattacaccatta

SEQ ID NO: 104509 - DNA, 20 bp, Artificial Sequence
  Description of Artificial Sequence: Synthetic oligonucleotide
  Target: SCN9A; (+) strand; PAM type: YTN; PAM sequence: TTC
accctgaattacaccattac

SEQ ID NO: 104510 - DNA, 20 bp, Artificial Sequence
  Description of Artificial Sequence: Synthetic oligonucleotide
  Target: SCN9A; (+) strand; PAM type: YTN; PAM sequence: CTG
aattacaccattacagaggt

SEQ ID NO: 104511 - DNA, 20 bp, Artificial Sequence
  Description of Artificial Sequence: Synthetic oligonucleotide
  Target: SCN9A; (+) strand; PAM type: YTN; PAM sequence: TTA
caccattacagaggtatagc

SEQ ID NO: 104512 - DNA, 20 bp, Artificial Sequence
  Description of Artificial Sequence: Synthetic oligonucleotide
  Target: SCN9A; (+) strand; PAM type: YTN; PAM sequence: TTA
cagaggtatagcagaaaaca

SEQ ID NO: 104513 - DNA, 20 bp, Artificial Sequence
  Description of Artificial Sequence: Synthetic oligonucleotide
  Target: SCN9A; (+) strand; PAM type: YTN; PAM sequence: TTA
tactactactcattttcttg

SEQ ID NO: 104514 - DNA, 20 bp, Artificial Sequence
  Description of Artificial Sequence: Synthetic oligonucleotide
  Target: SCN9A; (+) strand; PAM type: YTN; PAM sequence: CTA
ctactcattttcttgccttt

SEQ ID NO: 104515 - DNA, 20 bp, Artificial Sequence
  Description of Artificial Sequence: Synthetic oligonucleotide
  Target: SCN9A; (+) strand; PAM type: YTN; PAM sequence: CTA
ctcattttcttgcctttcta

SEQ ID NO: 104516 - DNA, 20 bp, Artificial Sequence
  Description of Artificial Sequence: Synthetic oligonucleotide
  Target: SCN9A; (+) strand; PAM type: YTN; PAM sequence: CTC
attttcttgcctttctatgg

SEQ ID NO: 104517 - DNA, 20 bp, Artificial Sequence
  Description of Artificial Sequence: Synthetic oligonucleotide
  Target: SCN9A; (+) strand; PAM type: YTN; PAM sequence: TTT
tcttgcctttctatggcatg

SEQ ID NO: 104518 - DNA, 20 bp, Artificial Sequence
  Description of Artificial Sequence: Synthetic oligonucleotide
  Target: SCN9A; (+) strand; PAM type: YTN; PAM sequence: TTT
cttgcctttctatggcatgt

SEQ ID NO: 104519 - DNA, 20 bp, Artificial Sequence
  Description of Artificial Sequence: Synthetic oligonucleotide
  Target: SCN9A; (+) strand; PAM type: YTN; PAM sequence: TTC
ttgcctttctatggcatgta

SEQ ID NO: 104520 - DNA, 20 bp, Artificial Sequence
  Description of Artificial Sequence: Synthetic oligonucleotide
  Target: SCN9A; (+) strand; PAM type: YTN; PAM sequence: CTT
gcctttctatggcatgtagt

SEQ ID NO: 104521 - DNA, 20 bp, Artificial Sequence
  Description of Artificial Sequence: Synthetic oligonucleotide
  Target: SCN9A; (+) strand; PAM type: YTN; PAM sequence: TTG
cctttctatggcatgtagta

SEQ ID NO: 104522 - DNA, 20 bp, Artificial Sequence
  Description of Artificial Sequence: Synthetic oligonucleotide
  Target: SCN9A; (+) strand; PAM type: YTN; PAM sequence: CTT
tctatggcatgtagtataat

SEQ ID NO: 104523 - DNA, 20 bp, Artificial Sequence
  Description of Artificial Sequence: Synthetic oligonucleotide
  Target: SCN9A; (+) strand; PAM type: YTN; PAM sequence: TTT
ctatggcatgtagtataatg

SEQ ID NO: 104524 - DNA, 20 bp, Artificial Sequence
  Description of Artificial Sequence: Synthetic oligonucleotide
  Target: SCN9A; (+) strand; PAM type: YTN; PAM sequence: TTC
tatggcatgtagtataatga

SEQ ID NO: 104525 - DNA, 20 bp, Artificial Sequence
  Description of Artificial Sequence: Synthetic oligonucleotide
  Target: SCN9A; (+) strand; PAM type: YTN; PAM sequence: CTA
tggcatgtagtataatgatt

SEQ ID NO: 104526 - DNA, 20 bp, Artificial Sequence
  Description of Artificial Sequence: Synthetic oligonucleotide
  Target: SCN9A; (+) strand; PAM type: YTN; PAM sequence: TTA
cagcttggggtttaaattta

SEQ ID NO: 104527 - DNA, 20 bp, Artificial Sequence
  Description of Artificial Sequence: Synthetic oligonucleotide
  Target: SCN9A; (+) strand; PAM type: YTN; PAM sequence: CTT
ggggtttaaatttaaaaaga

SEQ ID NO: 104528 - DNA, 20 bp, Artificial Sequence
  Description of Artificial Sequence: Synthetic oligonucleotide
  Target: SCN9A; (+) strand; PAM type: YTN; PAM sequence: TTG
gggtttaaatttaaaaagac

SEQ ID NO: 104529 - DNA, 20 bp, Artificial Sequence
  Description of Artificial Sequence: Synthetic oligonucleotide
  Target: SCN9A; (+) strand; PAM type: YTN; PAM sequence: TTT
aaatttaaaaagacccccag

SEQ ID NO: 104530 - DNA, 20 bp, Artificial Sequence
  Description of Artificial Sequence: Synthetic oligonucleotide
  Target: SCN9A; (+) strand; PAM type: YTN; PAM sequence: TTA
aatttaaaaagacccccaga

SEQ ID NO: 104531 - DNA, 20 bp, Artificial Sequence
  Description of Artificial Sequence: Synthetic oligonucleotide
  Target: SCN9A; (+) strand; PAM type: YTN; PAM sequence: TTT
aaaaagacccccagatacgt

SEQ ID NO: 104532 - DNA, 20 bp, Artificial Sequence
  Description of Artificial Sequence: Synthetic oligonucleotide
  Target: SCN9A; (+) strand; PAM type: YTN; PAM sequence: TTA
aaaagacccccagatacgtc

SEQ ID NO: 104533 - DNA, 20 bp, Artificial Sequence
  Description of Artificial Sequence: Synthetic oligonucleotide
  Target: SCN9A; (+) strand; PAM type: YTN; PAM sequence: CTA
accaaatcttttcttaatct

SEQ ID NO: 104534 - DNA, 20 bp, Artificial Sequence
  Description of Artificial Sequence: Synthetic oligonucleotide
  Target: SCN9A; (+) strand; PAM type: YTN; PAM sequence: CTT
ttcttaatcttttagaatcg

SEQ ID NO: 104535 - DNA, 20 bp, Artificial Sequence
  Description of Artificial Sequence: Synthetic oligonucleotide
  Target: SCN9A; (+) strand; PAM type: YTN; PAM sequence: TTT
tcttaatcttttagaatcgc

SEQ ID NO: 104536 - DNA, 20 bp, Artificial Sequence
  Description of Artificial Sequence: Synthetic oligonucleotide
  Target: SCN9A; (+) strand; PAM type: YTN; PAM sequence: TTT
cttaatcttttagaatcgca

SEQ ID NO: 104537 - DNA, 20 bp, Artificial Sequence
  Description of Artificial Sequence: Synthetic oligonucleotide
  Target: SCN9A; (+) strand; PAM type: YTN; PAM sequence: TTC
ttaatcttttagaatcgcag

SEQ ID NO: 104538 - DNA, 20 bp, Artificial Sequence
  Description of Artificial Sequence: Synthetic oligonucleotide
  Target: SCN9A; (+) strand; PAM type: YTN; PAM sequence: CTT
aatcttttagaatcgcagtc

SEQ ID NO: 104539 - DNA, 20 bp, Artificial Sequence
  Description of Artificial Sequence: Synthetic oligonucleotide
  Target: SCN9A; (+) strand; PAM type: YTN; PAM sequence: TTA
atcttttagaatcgcagtca

SEQ ID NO: 104540 - DNA, 20 bp, Artificial Sequence
  Description of Artificial Sequence: Synthetic oligonucleotide
  Target: SCN9A; (+) strand; PAM type: YTN; PAM sequence: CTT
ttagaatcgcagtcatctgc

SEQ ID NO: 104541 - DNA, 20 bp, Artificial Sequence
  Description of Artificial Sequence: Synthetic oligonucleotide
  Target: SCN9A; (+) strand; PAM type: YTN; PAM sequence: TTT
tagaatcgcagtcatctgca

SEQ ID NO: 104542 - DNA, 20 bp, Artificial Sequence
  Description of Artificial Sequence: Synthetic oligonucleotide
  Target: SCN9A; (+) strand; PAM type: YTN; PAM sequence: TTT
agaatcgcagtcatctgcaa

SEQ ID NO: 104543 - DNA, 20 bp, Artificial Sequence
  Description of Artificial Sequence: Synthetic oligonucleotide
  Target: SCN9A; (+) strand; PAM type: YTN; PAM sequence: TTA
gaatcgcagtcatctgcaaa

SEQ ID NO: 104544 - DNA, 20 bp, Artificial Sequence
  Description of Artificial Sequence: Synthetic oligonucleotide
  Target: SCN9A; (+) strand; PAM type: YTN; PAM sequence: CTG
caaatatagatgcattatat

SEQ ID NO: 104545 - DNA, 20 bp, Artificial Sequence
  Description of Artificial Sequence: Synthetic oligonucleotide
  Target: SCN9A; (+) strand; PAM type: YTN; PAM sequence: TTA
tatttacttcctaaggaggt

SEQ ID NO: 104546 - DNA, 20 bp, Artificial Sequence
  Description of Artificial Sequence: Synthetic oligonucleotide
  Target: SCN9A; (+) strand; PAM type: YTN; PAM sequence: TTT
acttcctaaggaggtcacaa

SEQ ID NO: 104547 - DNA, 20 bp, Artificial Sequence
  Description of Artificial Sequence: Synthetic oligonucleotide
  Target: SCN9A; (+) strand; PAM type: YTN; PAM sequence: TTA
cttcctaaggaggtcacaaa

SEQ ID NO: 104548 - DNA, 20 bp, Artificial Sequence
  Description of Artificial Sequence: Synthetic oligonucleotide
  Target: SCN9A; (+) strand; PAM type: YTN; PAM sequence: CTT
cctaaggaggtcacaaagac

SEQ ID NO: 104549 - DNA, 20 bp, Artificial Sequence
  Description of Artificial Sequence: Synthetic oligonucleotide
  Target: SCN9A; (+) strand; PAM type: YTN; PAM sequence: TTC
ctaaggaggtcacaaagacg

SEQ ID NO: 104550 - DNA, 20 bp, Artificial Sequence
  Description of Artificial Sequence: Synthetic oligonucleotide
  Target: SCN9A; (+) strand; PAM type: YTN; PAM sequence: CTA
aggaggtcacaaagacgaaa

SEQ ID NO: 104551 - DNA, 20 bp, Artificial Sequence
  Description of Artificial Sequence: Synthetic oligonucleotide
  Target: SCN9A; (+) strand; PAM type: YTN; PAM sequence: TTA
tataatgtgtgtaaaggggc

SEQ ID NO: 104552 - DNA, 20 bp, Artificial Sequence
  Description of Artificial Sequence: Synthetic oligonucleotide
  Target: SCN9A; (+) strand; PAM type: YTN; PAM sequence: CTA
ctgtatacattttatccgtg

SEQ ID NO: 104553 - DNA, 20 bp, Artificial Sequence
  Description of Artificial Sequence: Synthetic oligonucleotide
  Target: SCN9A; (+) strand; PAM type: YTN; PAM sequence: CTG
tatacattttatccgtgtgt

SEQ ID NO: 104554 - DNA, 20 bp, Artificial Sequence
  Description of Artificial Sequence: Synthetic oligonucleotide
  Target: SCN9A; (+) strand; PAM type: YTN; PAM sequence: TTT
tatccgtgtgtgtgtgcgtg

SEQ ID NO: 104555 - DNA, 20 bp, Artificial Sequence
  Description of Artificial Sequence: Synthetic oligonucleotide
  Target: SCN9A; (+) strand; PAM type: YTN; PAM sequence: TTT
atccgtgtgtgtgtgcgtgc

SEQ ID NO: 104556 - DNA, 20 bp, Artificial Sequence
  Description of Artificial Sequence: Synthetic oligonucleotide
  Target: SCN9A; (+) strand; PAM type: YTN; PAM sequence: TTA
tccgtgtgtgtgtgcgtgct

SEQ ID NO: 104557 - DNA, 20 bp, Artificial Sequence
  Description of Artificial Sequence: Synthetic oligonucleotide
  Target: SCN9A; (+) strand; PAM type: YTN; PAM sequence: CTT
tcttcttttgcatccacctc

SEQ ID NO: 104558 - DNA, 20 bp, Artificial Sequence
  Description of Artificial Sequence: Synthetic oligonucleotide
  Target: SCN9A; (+) strand; PAM type: YTN; PAM sequence: TTT
cttcttttgcatccacctct

SEQ ID NO: 104559 - DNA, 20 bp, Artificial Sequence
  Description of Artificial Sequence: Synthetic oligonucleotide
  Target: SCN9A; (+) strand; PAM type: YTN; PAM sequence: TTC
ttcttttgcatccacctctc

SEQ ID NO: 104560 - DNA, 20 bp, Artificial Sequence
  Description of Artificial Sequence: Synthetic oligonucleotide
  Target: SCN9A; (+) strand; PAM type: YTN; PAM sequence: CTT
cttttgcatccacctctcaa

SEQ ID NO: 104561 - DNA, 20 bp, Artificial Sequence
  Description of Artificial Sequence: Synthetic oligonucleotide
  Target: SCN9A; (+) strand; PAM type: YTN; PAM sequence: TTC
ttttgcatccacctctcaaa

SEQ ID NO: 104562 - DNA, 20 bp, Artificial Sequence
  Description of Artificial Sequence: Synthetic oligonucleotide
  Target: SCN9A; (+) strand; PAM type: YTN; PAM sequence: CTT
ttgcatccacctctcaaatg

SEQ ID NO: 104563 - DNA, 20 bp, Artificial Sequence
  Description of Artificial Sequence: Synthetic oligonucleotide
  Target: SCN9A; (+) strand; PAM type: YTN; PAM sequence: TTT
tgcatccacctctcaaatgt

SEQ ID NO: 104564 - DNA, 20 bp, Artificial Sequence
  Description of Artificial Sequence: Synthetic oligonucleotide
  Target: SCN9A; (+) strand; PAM type: YTN; PAM sequence: TTT
gcatccacctctcaaatgtg

SEQ ID NO: 104565 - DNA, 20 bp, Artificial Sequence
  Description of Artificial Sequence: Synthetic oligonucleotide
  Target: SCN9A; (+) strand; PAM type: YTN; PAM sequence: TTG
catccacctctcaaatgtgt

SEQ ID NO: 104566 - DNA, 20 bp, Artificial Sequence
  Description of Artificial Sequence: Synthetic oligonucleotide
  Target: SCN9A; (+) strand; PAM type: YTN; PAM sequence: CTC
tcaaatgtgtttgatccgct

SEQ ID NO: 104567 - DNA, 20 bp, Artificial Sequence
  Description of Artificial Sequence: Synthetic oligonucleotide
  Target: SCN9A; (+) strand; PAM type: YTN; PAM sequence: CTC
aaatgtgtttgatccgctgt

SEQ ID NO: 104568 - DNA, 20 bp, Artificial Sequence
  Description of Artificial Sequence: Synthetic oligonucleotide
  Target: SCN9A; (+) strand; PAM type: YTN; PAM sequence: TTT
gatccgctgttctcagctgc

SEQ ID NO: 104569 - DNA, 20 bp, Artificial Sequence
  Description of Artificial Sequence: Synthetic oligonucleotide
  Target: SCN9A; (+) strand; PAM type: YTN; PAM sequence: TTG
atccgctgttctcagctgct

SEQ ID NO: 104570 - DNA, 20 bp, Artificial Sequence
  Description of Artificial Sequence: Synthetic oligonucleotide
  Target: SCN9A; (+) strand; PAM type: YTN; PAM sequence: CTG
ttctcagctgctgtctgtgg

SEQ ID NO: 104571 - DNA, 20 bp, Artificial Sequence
  Description of Artificial Sequence: Synthetic oligonucleotide
  Target: SCN9A; (+) strand; PAM type: YTN; PAM sequence: TTC
tcagctgctgtctgtggttc

SEQ ID NO: 104572 - DNA, 20 bp, Artificial Sequence
  Description of Artificial Sequence: Synthetic oligonucleotide
  Target: SCN9A; (+) strand; PAM type: YTN; PAM sequence: CTC
agctgctgtctgtggttctg

SEQ ID NO: 104573 - DNA, 20 bp, Artificial Sequence
  Description of Artificial Sequence: Synthetic oligonucleotide
  Target: SCN9A; (+) strand; PAM type: YTN; PAM sequence: CTG
ctgtctgtggttctgtcatg

SEQ ID NO: 104574 - DNA, 20 bp, Artificial Sequence
  Description of Artificial Sequence: Synthetic oligonucleotide
  Target: SCN9A; (+) strand; PAM type: YTN; PAM sequence: CTG
tctgtggttctgtcatgaag

SEQ ID NO: 104575 - DNA, 20 bp, Artificial Sequence
  Description of Artificial Sequence: Synthetic oligonucleotide
  Target: SCN9A; (+) strand; PAM type: YTN; PAM sequence: CTG
tggttctgtcatgaagtaga

SEQ ID NO: 104576 - DNA, 20 bp, Artificial Sequence
  Description of Artificial Sequence: Synthetic oligonucleotide
  Target: SCN9A; (+) strand; PAM type: YTN; PAM sequence: TTC
tgtcatgaagtagatgctct

SEQ ID NO: 104577 - DNA, 20 bp, Artificial Sequence
  Description of Artificial Sequence: Synthetic oligonucleotide
  Target: SCN9A; (+) strand; PAM type: YTN; PAM sequence: CTG
tcatgaagtagatgctctaa

SEQ ID NO: 104578 - DNA, 20 bp, Artificial Sequence
  Description of Artificial Sequence: Synthetic oligonucleotide
  Target: SCN9A; (+) strand; PAM type: YTN; PAM sequence: CTC
taaggcactgtccacatcct

SEQ ID NO: 104579 - DNA, 20 bp, Artificial Sequence
  Description of Artificial Sequence: Synthetic oligonucleotide
  Target: SCN9A; (+) strand; PAM type: YTN; PAM sequence: CTA
aggcactgtccacatcctgc

SEQ ID NO: 104580 - DNA, 20 bp, Artificial Sequence
  Description of Artificial Sequence: Synthetic oligonucleotide
  Target: SCN9A; (+) strand; PAM type: YTN; PAM sequence: CTG
tccacatcctgctttccagc

SEQ ID NO: 104581 - DNA, 20 bp, Artificial Sequence
  Description of Artificial Sequence: Synthetic oligonucleotide
  Target: SCN9A; (+) strand; PAM type: YTN; PAM sequence: CTG
ctttccagcaagctgctcat

SEQ ID NO: 104582 - DNA, 20 bp, Artificial Sequence
  Description of Artificial Sequence: Synthetic oligonucleotide
  Target: SCN9A; (+) strand; PAM type: YTN; PAM sequence: CTT
tccagcaagctgctcattcc

SEQ ID NO: 104583 - DNA, 20 bp, Artificial Sequence
  Description of Artificial Sequence: Synthetic oligonucleotide
  Target: SCN9A; (+) strand; PAM type: YTN; PAM sequence: TTT
ccagcaagctgctcattccc

SEQ ID NO: 104584 - DNA, 20 bp, Artificial Sequence
  Description of Artificial Sequence: Synthetic oligonucleotide
  Target: SCN9A; (+) strand; PAM type: YTN; PAM sequence: TTC
cagcaagctgctcattcccc

SEQ ID NO: 104585 - DNA, 20 bp, Artificial Sequence
  Description of Artificial Sequence: Synthetic oligonucleotide
  Target: SCN9A; (+) strand; PAM type: YTN; PAM sequence: CTG
ctcattcccccagctgccaa

SEQ ID NO: 104586 - DNA, 20 bp, Artificial Sequence
  Description of Artificial Sequence: Synthetic oligonucleotide
  Target: SCN9A; (+) strand; PAM type: YTN; PAM sequence: CTC
attcccccagctgccaaaag

SEQ ID NO: 104587 - DNA, 20 bp, Artificial Sequence
  Description of Artificial Sequence: Synthetic oligonucleotide
  Target: SCN9A; (+) strand; PAM type: YTN; PAM sequence: TTC
ccccagctgccaaaagtgtt

SEQ ID NO: 104588 - DNA, 20 bp, Artificial Sequence
  Description of Artificial Sequence: Synthetic oligonucleotide
  Target: SCN9A; (+) strand; PAM type: YTN; PAM sequence: CTG
ccaaaagtgttggatgctga

SEQ ID NO: 104589 - DNA, 20 bp, Artificial Sequence
  Description of Artificial Sequence: Synthetic oligonucleotide
  Target: SCN9A; (+) strand; PAM type: YTN; PAM sequence: TTG
gatgctgaaggctcacatct

SEQ ID NO: 104590 - DNA, 20 bp, Artificial Sequence
  Description of Artificial Sequence: Synthetic oligonucleotide
  Target: SCN9A; (+) strand; PAM type: YTN; PAM sequence: CTG
aaggctcacatctgaatccc

SEQ ID NO: 104591 - DNA, 20 bp, Artificial Sequence
  Description of Artificial Sequence: Synthetic oligonucleotide
  Target: SCN9A; (+) strand; PAM type: YTN; PAM sequence: CTC
acatctgaatccctctttgg

SEQ ID NO: 104592 - DNA, 20 bp, Artificial Sequence
  Description of Artificial Sequence: Synthetic oligonucleotide
  Target: SCN9A; (+) strand; PAM type: YTN; PAM sequence: CTG
aatccctctttgggccttat

SEQ ID NO: 104593 - DNA, 20 bp, Artificial Sequence
  Description of Artificial Sequence: Synthetic oligonucleotide
  Target: SCN9A; (+) strand; PAM type: YTN; PAM sequence: CTC
tttgggccttatcgtggcag

SEQ ID NO: 104594 - DNA, 20 bp, Artificial Sequence
  Description of Artificial Sequence: Synthetic oligonucleotide
  Target: SCN9A; (+) strand; PAM type: YTN; PAM sequence: CTT
tgggccttatcgtggcagaa

SEQ ID NO: 104595 - DNA, 20 bp, Artificial Sequence
  Description of Artificial Sequence: Synthetic oligonucleotide
  Target: SCN9A; (+) strand; PAM type: YTN; PAM sequence: TTT
gggccttatcgtggcagaag

SEQ ID NO: 104596 - DNA, 20 bp, Artificial Sequence
  Description of Artificial Sequence: Synthetic oligonucleotide
  Target: SCN9A; (+) strand; PAM type: YTN; PAM sequence: TTG
ggccttatcgtggcagaagg

SEQ ID NO: 104597 - DNA, 20 bp, Artificial Sequence
  Description of Artificial Sequence: Synthetic oligonucleotide
  Target: SCN9A; (+) strand; PAM type: YTN; PAM sequence: CTT
atcgtggcagaagggaggtg

SEQ ID NO: 104598 - DNA, 20 bp, Artificial Sequence
  Description of Artificial Sequence: Synthetic oligonucleotide
  Target: SCN9A; (+) strand; PAM type: YTN; PAM sequence: TTA
tcgtggcagaagggaggtgc

SEQ ID NO: 104599 - DNA, 20 bp, Artificial Sequence
  Description of Artificial Sequence: Synthetic oligonucleotide
  Target: SCN9A; (+) strand; PAM type: YTN; PAM sequence: CTT
cccccaaggttatacccttc

SEQ ID NO: 104600 - DNA, 20 bp, Artificial Sequence
  Description of Artificial Sequence: Synthetic oligonucleotide
  Target: SCN9A; (+) strand; PAM type: YTN; PAM sequence: TTC
ccccaaggttatacccttct

SEQ ID NO: 104601 - DNA, 20 bp, Artificial Sequence
  Description of Artificial Sequence: Synthetic oligonucleotide
  Target: SCN9A; (+) strand; PAM type: YTN; PAM sequence: TTA
tacccttctcccctggaaag

SEQ ID NO: 104602 - DNA, 20 bp, Artificial Sequence
  Description of Artificial Sequence: Synthetic oligonucleotide
  Target: SCN9A; (+) strand; PAM type: YTN; PAM sequence: CTT
ctcccctggaaaggtaaagg

SEQ ID NO: 104603 - DNA, 20 bp, Artificial Sequence
  Description of Artificial Sequence: Synthetic oligonucleotide
  Target: SCN9A; (+) strand; PAM type: YTN; PAM sequence: TTC
tcccctggaaaggtaaaggg

SEQ ID NO: 104604 - DNA, 20 bp, Artificial Sequence
  Description of Artificial Sequence: Synthetic oligonucleotide
  Target: SCN9A; (+) strand; PAM type: YTN; PAM sequence: CTC
ccctggaaaggtaaagggag

SEQ ID NO: 104605 - DNA, 20 bp, Artificial Sequence
  Description of Artificial Sequence: Synthetic oligonucleotide
  Target: SCN9A; (+) strand; PAM type: YTN; PAM sequence: CTG
gaaaggtaaagggagagcct

SEQ ID NO: 104606 - DNA, 20 bp, Artificial Sequence
  Description of Artificial Sequence: Synthetic oligonucleotide
  Target: SCN9A; (+) strand; PAM type: YTN; PAM sequence: CTG
catccaatgaatggtgtgga

SEQ ID NO: 104607 - DNA, 20 bp, Artificial Sequence
  Description of Artificial Sequence: Synthetic oligonucleotide
  Target: SCN9A; (+) strand; PAM type: YTN; PAM sequence: CTG
accctcttgctttgttttgg

SEQ ID NO: 104608 - DNA, 20 bp, Artificial Sequence
  Description of Artificial Sequence: Synthetic oligonucleotide
  Target: SCN9A; (+) strand; PAM type: YTN; PAM sequence: CTC
ttgctttgttttggaactac

SEQ ID NO: 104609 - DNA, 20 bp, Artificial Sequence
  Description of Artificial Sequence: Synthetic oligonucleotide
  Target: SCN9A; (+) strand; PAM type: YTN; PAM sequence: CTT
gctttgttttggaactactc

SEQ ID NO: 104610 - DNA, 20 bp, Artificial Sequence
  Description of Artificial Sequence: Synthetic oligonucleotide
  Target: SCN9A; (+) strand; PAM type: YTN; PAM sequence: TTG
ctttgttttggaactactcc

SEQ ID NO: 104611 - DNA, 20 bp, Artificial Sequence
  Description of Artificial Sequence: Synthetic oligonucleotide
  Target: SCN9A; (+) strand; PAM type: YTN; PAM sequence: CTT
tgttttggaactactccaga

SEQ ID NO: 104612 - DNA, 20 bp, Artificial Sequence
  Description of Artificial Sequence: Synthetic oligonucleotide
  Target: SCN9A; (+) strand; PAM type: YTN; PAM sequence: TTT
gttttggaactactccagag

SEQ ID NO: 104613 - DNA, 20 bp, Artificial Sequence
  Description of Artificial Sequence: Synthetic oligonucleotide
  Target: SCN9A; (+) strand; PAM type: YTN; PAM sequence: TTG
ttttggaactactccagagg

SEQ ID NO: 104614 - DNA, 20 bp, Artificial Sequence
  Description of Artificial Sequence: Synthetic oligonucleotide
  Target: SCN9A; (+) strand; PAM type: YTN; PAM sequence: TTT
tggaactactccagagggtt

SEQ ID NO: 104615 - DNA, 20 bp, Artificial Sequence
  Description of Artificial Sequence: Synthetic oligonucleotide
  Target: SCN9A; (+) strand; PAM type: YTN; PAM sequence: TTT
ggaactactccagagggttg

SEQ ID NO: 104616 - DNA, 20 bp, Artificial Sequence
  Description of Artificial Sequence: Synthetic oligonucleotide
  Target: SCN9A; (+) strand; PAM type: YTN; PAM sequence: TTG
gaactactccagagggttgt

SEQ ID NO: 104617 - DNA, 20 bp, Artificial Sequence
  Description of Artificial Sequence: Synthetic oligonucleotide
  Target: SCN9A; (+) strand; PAM type: YTN; PAM sequence: CTA
ctccagagggttgtcacagc

SEQ ID NO: 104618 - DNA, 20 bp, Artificial Sequence
  Description of Artificial Sequence: Synthetic oligonucleotide
  Target: SCN9A; (+) strand; PAM type: YTN; PAM sequence: CTC
cagagggttgtcacagcatc

SEQ ID NO: 104619 - DNA, 20 bp, Artificial Sequence
  Description of Artificial Sequence: Synthetic oligonucleotide
  Target: SCN9A; (+) strand; PAM type: YTN; PAM sequence: TTG
tcacagcatcagagatgcca

SEQ ID NO: 104620 - DNA, 20 bp, Artificial Sequence
  Description of Artificial Sequence: Synthetic oligonucleotide
  Target: SCN9A; (+) strand; PAM type: YTN; PAM sequence: CTC
tgttgcaattttaacagttc

SEQ ID NO: 104621 - DNA, 20 bp, Artificial Sequence
  Description of Artificial Sequence: Synthetic oligonucleotide
  Target: SCN9A; (+) strand; PAM type: YTN; PAM sequence: CTG
ttgcaattttaacagttcaa

SEQ ID NO: 104622 - DNA, 20 bp, Artificial Sequence
  Description of Artificial Sequence: Synthetic oligonucleotide
  Target: SCN9A; (+) strand; PAM type: YTN; PAM sequence: TTG
caattttaacagttcaactt

SEQ ID NO: 104623 - DNA, 20 bp, Artificial Sequence
  Description of Artificial Sequence: Synthetic oligonucleotide
  Target: SCN9A; (+) strand; PAM type: YTN; PAM sequence: TTT
taacagttcaacttctctct

SEQ ID NO: 104624 - DNA, 20 bp, Artificial Sequence
  Description of Artificial Sequence: Synthetic oligonucleotide
  Target: SCN9A; (+) strand; PAM type: YTN; PAM sequence: TTT
aacagttcaacttctctctc

SEQ ID NO: 104625 - DNA, 20 bp, Artificial Sequence
  Description of Artificial Sequence: Synthetic oligonucleotide
  Target: SCN9A; (+) strand; PAM type: YTN; PAM sequence: TTA
acagttcaacttctctctct

SEQ ID NO: 104626 - DNA, 20 bp, Artificial Sequence
  Description of Artificial Sequence: Synthetic oligonucleotide
  Target: SCN9A; (+) strand; PAM type: YTN; PAM sequence: TTC
aacttctctctctgcccaat

SEQ ID NO: 104627 - DNA, 20 bp, Artificial Sequence
  Description of Artificial Sequence: Synthetic oligonucleotide
  Target: SCN9A; (+) strand; PAM type: YTN; PAM sequence: CTT
ctctctctgcccaataattt

SEQ ID NO: 104628 - DNA, 20 bp, Artificial Sequence
  Description of Artificial Sequence: Synthetic oligonucleotide
  Target: SCN9A; (+) strand; PAM type: YTN; PAM sequence: TTC
tctctctgcccaataatttt

SEQ ID NO: 104629 - DNA, 20 bp, Artificial Sequence
  Description of Artificial Sequence: Synthetic oligonucleotide
  Target: SCN9A; (+) strand; PAM type: YTN; PAM sequence: CTC
tctctgcccaataattttgc

SEQ ID NO: 104630 - DNA, 20 bp, Artificial Sequence
  Description of Artificial Sequence: Synthetic oligonucleotide
  Target: SCN9A; (+) strand; PAM type: YTN; PAM sequence: CTC
tctgcccaataattttgcat

SEQ ID NO: 104631 - DNA, 20 bp, Artificial Sequence
  Description of Artificial Sequence: Synthetic oligonucleotide
  Target: SCN9A; (+) strand; PAM type: YTN; PAM sequence: CTC
tgcccaataattttgcatgc

SEQ ID NO: 104632 - DNA, 20 bp, Artificial Sequence
  Description of Artificial Sequence: Synthetic oligonucleotide
  Target: SCN9A; (+) strand; PAM type: YTN; PAM sequence: CTG
cccaataattttgcatgcct

SEQ ID NO: 104633 - DNA, 20 bp, Artificial Sequence
  Description of Artificial Sequence: Synthetic oligonucleotide
  Target: SCN9A; (+) strand; PAM type: YTN; PAM sequence: TTT
tgcatgcctcactttttaca

SEQ ID NO: 104634 - DNA, 20 bp, Artificial Sequence
  Description of Artificial Sequence: Synthetic oligonucleotide
  Target: SCN9A; (+) strand; PAM type: YTN; PAM sequence: TTT
gcatgcctcactttttacag

SEQ ID NO: 104635 - DNA, 20 bp, Artificial Sequence
  Description of Artificial Sequence: Synthetic oligonucleotide
  Target: SCN9A; (+) strand; PAM type: YTN; PAM sequence: TTG
catgcctcactttttacaga

SEQ ID NO: 104636 - DNA, 20 bp, Artificial Sequence
  Description of Artificial Sequence: Synthetic oligonucleotide
  Target: SCN9A; (+) strand; PAM type: YTN; PAM sequence: CTC
actttttacagatgttacgt

SEQ ID NO: 104637 - DNA, 20 bp, Artificial Sequence
  Description of Artificial Sequence: Synthetic oligonucleotide
  Target: SCN9A; (+) strand; PAM type: YTN; PAM sequence: CTT
tttacagatgttacgtttcg

SEQ ID NO: 104638 - DNA, 20 bp, Artificial Sequence
  Description of Artificial Sequence: Synthetic oligonucleotide
  Target: SCN9A; (+) strand; PAM type: YTN; PAM sequence: TTT
ttacagatgttacgtttcgt

SEQ ID NO: 104639 - DNA, 20 bp, Artificial Sequence
  Description of Artificial Sequence: Synthetic oligonucleotide
  Target: SCN9A; (+) strand; PAM type: YTN; PAM sequence: TTT
tacagatgttacgtttcgtt

SEQ ID NO: 104640 - DNA, 20 bp, Artificial Sequence
  Description of Artificial Sequence: Synthetic oligonucleotide
  Target: SCN9A; (+) strand; PAM type: YTN; PAM sequence: TTT
acagatgttacgtttcgttc

SEQ ID NO: 104641 - DNA, 20 bp, Artificial Sequence
  Description of Artificial Sequence: Synthetic oligonucleotide
  Target: SCN9A; (+) strand; PAM type: YTN; PAM sequence: TTA
cagatgttacgtttcgttcc

SEQ ID NO: 104642 - DNA, 20 bp, Artificial Sequence
  Description of Artificial Sequence: Synthetic oligonucleotide
  Target: SCN9A; (+) strand; PAM type: YTN; PAM sequence: TTA
cgtttcgttcctgaaaacac

SEQ ID NO: 104643 - DNA, 20 bp, Artificial Sequence
  Description of Artificial Sequence: Synthetic oligonucleotide
  Target: SCN9A; (+) strand; PAM type: YTN; PAM sequence: TTT
cgttcctgaaaacacttctc

SEQ ID NO: 104644 - DNA, 20 bp, Artificial Sequence
  Description of Artificial Sequence: Synthetic oligonucleotide
  Target: SCN9A; (+) strand; PAM type: YTN; PAM sequence: TTC
gttcctgaaaacacttctca

SEQ ID NO: 104645 - DNA, 20 bp, Artificial Sequence
  Description of Artificial Sequence: Synthetic oligonucleotide
  Target: SCN9A; (+) strand; PAM type: YTN; PAM sequence: TTC
ctgaaaacacttctcagtaa

SEQ ID NO: 104646 - DNA, 20 bp, Artificial Sequence
  Description of Artificial Sequence: Synthetic oligonucleotide
  Target: SCN9A; (+) strand; PAM type: YTN; PAM sequence: CTG
aaaacacttctcagtaaatc

SEQ ID NO: 104647 - DNA, 20 bp, Artificial Sequence
  Description of Artificial Sequence: Synthetic oligonucleotide
  Target: SCN9A; (+) strand; PAM type: YTN; PAM sequence: CTT
ctcagtaaatctcagatttc

SEQ ID NO: 104648 - DNA, 20 bp, Artificial Sequence
  Description of Artificial Sequence: Synthetic oligonucleotide
  Target: SCN9A; (+) strand; PAM type: YTN; PAM sequence: TTC
tcagtaaatctcagatttct

SEQ ID NO: 104649 - DNA, 20 bp, Artificial Sequence
  Description of Artificial Sequence: Synthetic oligonucleotide
  Target: SCN9A; (+) strand; PAM type: YTN; PAM sequence: CTC
agtaaatctcagatttctct

SEQ ID NO: 104650 - DNA, 20 bp, Artificial Sequence
  Description of Artificial Sequence: Synthetic oligonucleotide
  Target: SCN9A; (+) strand; PAM type: YTN; PAM sequence: CTC
agatttctctctcaggattg

SEQ ID NO: 104651 - DNA, 20 bp, Artificial Sequence
  Description of Artificial Sequence: Synthetic oligonucleotide
  Target: SCN9A; (+) strand; PAM type: YTN; PAM sequence: TTT
ctctctcaggattggtttcc

SEQ ID NO: 104652 - DNA, 20 bp, Artificial Sequence
  Description of Artificial Sequence: Synthetic oligonucleotide
  Target: SCN9A; (+) strand; PAM type: YTN; PAM sequence: TTC
tctctcaggattggtttccc

SEQ ID NO: 104653 - DNA, 20 bp, Artificial Sequence
  Description of Artificial Sequence: Synthetic oligonucleotide
  Target: SCN9A; (+) strand; PAM type: YTN; PAM sequence: CTC
tctcaggattggtttcccag

SEQ ID NO: 104654 - DNA, 20 bp, Artificial Sequence
  Description of Artificial Sequence: Synthetic oligonucleotide
  Target: SCN9A; (+) strand; PAM type: YTN; PAM sequence: CTC
tcaggattggtttcccaggg

SEQ ID NO: 104655 - DNA, 20 bp, Artificial Sequence
  Description of Artificial Sequence: Synthetic oligonucleotide
  Target: SCN9A; (+) strand; PAM type: YTN; PAM sequence: CTC
aggattggtttcccagggaa

SEQ ID NO: 104656 - DNA, 20 bp, Artificial Sequence
  Description of Artificial Sequence: Synthetic oligonucleotide
  Target: SCN9A; (+) strand; PAM type: YTN; PAM sequence: TTG
gtttcccagggaactgaccc

SEQ ID NO: 104657 - DNA, 20 bp, Artificial Sequence
  Description of Artificial Sequence: Synthetic oligonucleotide
  Target: SCN9A; (+) strand; PAM type: YTN; PAM sequence: TTT
cccagggaactgacccctac

SEQ ID NO: 104658 - DNA, 20 bp, Artificial Sequence
  Description of Artificial Sequence: Synthetic oligonucleotide
  Target: SCN9A; (+) strand; PAM type: YTN; PAM sequence: TTC
ccagggaactgacccctaca

SEQ ID NO: 104659 - DNA, 20 bp, Artificial Sequence
  Description of Artificial Sequence: Synthetic oligonucleotide
  Target: SCN9A; (+) strand; PAM type: YTN; PAM sequence: CTG
acccctacacaatcccgtga

SEQ ID NO: 104660 - DNA, 20 bp, Artificial Sequence
  Description of Artificial Sequence: Synthetic oligonucleotide
  Target: SCN9A; (+) strand; PAM type: YTN; PAM sequence: CTA
cacaatcccgtgattaatga

SEQ ID NO: 104661 - DNA, 20 bp, Artificial Sequence
  Description of Artificial Sequence: Synthetic oligonucleotide
  Target: SCN9A; (+) strand; PAM type: YTN; PAM sequence: TTA
atgaaagttagcatacaaaa

SEQ ID NO: 104662 - DNA, 20 bp, Artificial Sequence
  Description of Artificial Sequence: Synthetic oligonucleotide
  Target: SCN9A; (+) strand; PAM type: YTN; PAM sequence: TTA
gcatacaaaatcccaaccta

SEQ ID NO: 104663 - DNA, 20 bp, Artificial Sequence
  Description of Artificial Sequence: Synthetic oligonucleotide
  Target: SCN9A; (+) strand; PAM type: YTN; PAM sequence: CTA
tctacaactctgacttttct

SEQ ID NO: 104664 - DNA, 20 bp, Artificial Sequence
  Description of Artificial Sequence: Synthetic oligonucleotide
  Target: SCN9A; (+) strand; PAM type: YTN; PAM sequence: CTA
caactctgacttttcttctt

SEQ ID NO: 104665 - DNA, 20 bp, Artificial Sequence
  Description of Artificial Sequence: Synthetic oligonucleotide
  Target: SCN9A; (+) strand; PAM type: YTN; PAM sequence: CTC
tgacttttcttctttcctta

SEQ ID NO: 104666 - DNA, 20 bp, Artificial Sequence
  Description of Artificial Sequence: Synthetic oligonucleotide
  Target: SCN9A; (+) strand; PAM type: YTN; PAM sequence: CTG
acttttcttctttccttaag

SEQ ID NO: 104667 - DNA, 20 bp, Artificial Sequence
  Description of Artificial Sequence: Synthetic oligonucleotide
  Target: SCN9A; (+) strand; PAM type: YTN; PAM sequence: CTT
ttcttctttccttaagattt

SEQ ID NO: 104668 - DNA, 20 bp, Artificial Sequence
  Description of Artificial Sequence: Synthetic oligonucleotide
  Target: SCN9A; (+) strand; PAM type: YTN; PAM sequence: TTT
tcttctttccttaagattta

SEQ ID NO: 104669 - DNA, 20 bp, Artificial Sequence
  Description of Artificial Sequence: Synthetic oligonucleotide
  Target: SCN9A; (+) strand; PAM type: YTN; PAM sequence: TTT
cttctttccttaagatttat

SEQ ID NO: 104670 - DNA, 20 bp, Artificial Sequence
  Description of Artificial Sequence: Synthetic oligonucleotide
  Target: SCN9A; (+) strand; PAM type: YTN; PAM sequence: TTC
ttctttccttaagatttatc

SEQ ID NO: 104671 - DNA, 20 bp, Artificial Sequence
  Description of Artificial Sequence: Synthetic oligonucleotide
  Target: SCN9A; (+) strand; PAM type: YTN; PAM sequence: CTT
ctttccttaagatttatctt

SEQ ID NO: 104672 - DNA, 20 bp, Artificial Sequence
  Description of Artificial Sequence: Synthetic oligonucleotide
  Target: SCN9A; (+) strand; PAM type: YTN; PAM sequence: TTC
tttccttaagatttatcttt

SEQ ID NO: 104673 - DNA, 20 bp, Artificial Sequence
  Description of Artificial Sequence: Synthetic oligonucleotide
  Target: SCN9A; (+) strand; PAM type: YTN; PAM sequence: CTT
tccttaagatttatctttcc

SEQ ID NO: 104674 - DNA, 20 bp, Artificial Sequence
  Description of Artificial Sequence: Synthetic oligonucleotide
  Target: SCN9A; (+) strand; PAM type: YTN; PAM sequence: TTT
ccttaagatttatctttcca

SEQ ID NO: 104675 - DNA, 20 bp, Artificial Sequence
  Description of Artificial Sequence: Synthetic oligonucleotide
  Target: SCN9A; (+) strand; PAM type: YTN; PAM sequence: TTC
cttaagatttatctttccat

SEQ ID NO: 104676 - DNA, 20 bp, Artificial Sequence
  Description of Artificial Sequence: Synthetic oligonucleotide
  Target: SCN9A; (+) strand; PAM type: YTN; PAM sequence: CTT
aagatttatctttccatata

SEQ ID NO: 104677 - DNA, 20 bp, Artificial Sequence
  Description of Artificial Sequence: Synthetic oligonucleotide
  Target: SCN9A; (+) strand; PAM type: YTN; PAM sequence: TTA
agatttatctttccatatac

SEQ ID NO: 104678 - DNA, 20 bp, Artificial Sequence
  Description of Artificial Sequence: Synthetic oligonucleotide
  Target: SCN9A; (+) strand; PAM type: YTN; PAM sequence: TTT
atctttccatatacctcctg

SEQ ID NO: 104679 - DNA, 20 bp, Artificial Sequence
  Description of Artificial Sequence: Synthetic oligonucleotide
  Target: SCN9A; (+) strand; PAM type: YTN; PAM sequence: TTA
tctttccatatacctcctgt

SEQ ID NO: 104680 - DNA, 20 bp, Artificial Sequence
  Description of Artificial Sequence: Synthetic oligonucleotide
  Target: SCN9A; (+) strand; PAM type: YTN; PAM sequence: CTT
tccatatacctcctgttcag

SEQ ID NO: 104681 - DNA, 20 bp, Artificial Sequence
  Description of Artificial Sequence: Synthetic oligonucleotide
  Target: SCN9A; (+) strand; PAM type: YTN; PAM sequence: TTT
ccatatacctcctgttcagg

SEQ ID NO: 104682 - DNA, 20 bp, Artificial Sequence
  Description of Artificial Sequence: Synthetic oligonucleotide
  Target: SCN9A; (+) strand; PAM type: YTN; PAM sequence: TTC
catatacctcctgttcaggt

SEQ ID NO: 104683 - DNA, 20 bp, Artificial Sequence
  Description of Artificial Sequence: Synthetic oligonucleotide
  Target: SCN9A; (+) strand; PAM type: YTN; PAM sequence: CTC
ctgttcaggttcactgcctg

SEQ ID NO: 104684 - DNA, 20 bp, Artificial Sequence
  Description of Artificial Sequence: Synthetic oligonucleotide
  Target: SCN9A; (+) strand; PAM type: YTN; PAM sequence: CTG
ttcaggttcactgcctgtac

SEQ ID NO: 104685 - DNA, 20 bp, Artificial Sequence
  Description of Artificial Sequence: Synthetic oligonucleotide
  Target: SCN9A; (+) strand; PAM type: YTN; PAM sequence: TTC
aggttcactgcctgtactgc

SEQ ID NO: 104686 - DNA, 20 bp, Artificial Sequence
  Description of Artificial Sequence: Synthetic oligonucleotide
  Target: SCN9A; (+) strand; PAM type: YTN; PAM sequence: TTC
actgcctgtactgcaagtag

SEQ ID NO: 104687 - DNA, 20 bp, Artificial Sequence
  Description of Artificial Sequence: Synthetic oligonucleotide
  Target: SCN9A; (+) strand; PAM type: YTN; PAM sequence: CTG
cctgtactgcaagtagttca

SEQ ID NO: 104688 - DNA, 20 bp, Artificial Sequence
  Description of Artificial Sequence: Synthetic oligonucleotide
  Target: SCN9A; (+) strand; PAM type: YTN; PAM sequence: CTG
tactgcaagtagttcaaatt

SEQ ID NO: 104689 - DNA, 20 bp, Artificial Sequence
  Description of Artificial Sequence: Synthetic oligonucleotide
  Target: SCN9A; (+) strand; PAM type: YTN; PAM sequence: CTG
caagtagttcaaatttatga

SEQ ID NO: 104690 - DNA, 20 bp, Artificial Sequence
  Description of Artificial Sequence: Synthetic oligonucleotide
  Target: SCN9A; (+) strand; PAM type: YTN; PAM sequence: TTC
aaatttatgatgccaccaaa

SEQ ID NO: 104691 - DNA, 20 bp, Artificial Sequence
  Description of Artificial Sequence: Synthetic oligonucleotide
  Target: SCN9A; (+) strand; PAM type: YTN; PAM sequence: TTT
atgatgccaccaaattaaac

SEQ ID NO: 104692 - DNA, 20 bp, Artificial Sequence
  Description of Artificial Sequence: Synthetic oligonucleotide
  Target: SCN9A; (+) strand; PAM type: YTN; PAM sequence: TTA
tgatgccaccaaattaaact

SEQ ID NO: 104693 - DNA, 20 bp, Artificial Sequence
  Description of Artificial Sequence: Synthetic oligonucleotide
  Target: SCN9A; (+) strand; PAM type: YTN; PAM sequence: TTA
aactctgtatttcccctacc

SEQ ID NO: 104694 - DNA, 20 bp, Artificial Sequence
  Description of Artificial Sequence: Synthetic oligonucleotide
  Target: SCN9A; (+) strand; PAM type: YTN; PAM sequence: CTC
tgtatttcccctacctcctc

SEQ ID NO: 104695 - DNA, 20 bp, Artificial Sequence
  Description of Artificial Sequence: Synthetic oligonucleotide
  Target: SCN9A; (+) strand; PAM type: YTN; PAM sequence: CTG
tatttcccctacctcctcaa

SEQ ID NO: 104696 - DNA, 20 bp, Artificial Sequence
  Description of Artificial Sequence: Synthetic oligonucleotide
  Target: SCN9A; (+) strand; PAM type: YTN; PAM sequence: TTT
cccctacctcctcaattttc

SEQ ID NO: 104697 - DNA, 20 bp, Artificial Sequence
  Description of Artificial Sequence: Synthetic oligonucleotide
  Target: SCN9A; (+) strand; PAM type: YTN; PAM sequence: TTC
ccctacctcctcaattttct

SEQ ID NO: 104698 - DNA, 20 bp, Artificial Sequence
  Description of Artificial Sequence: Synthetic oligonucleotide
  Target: SCN9A; (+) strand; PAM type: YTN; PAM sequence: CTA
cctcctcaattttctcctcc

SEQ ID NO: 104699 - DNA, 20 bp, Artificial Sequence
  Description of Artificial Sequence: Synthetic oligonucleotide
  Target: SCN9A; (+) strand; PAM type: YTN; PAM sequence: CTC
ctcaattttctcctccatca

SEQ ID NO: 104700 - DNA, 20 bp, Artificial Sequence
  Description of Artificial Sequence: Synthetic oligonucleotide
  Target: SCN9A; (+) strand; PAM type: YTN; PAM sequence: CTC
aattttctcctccatcagtg

SEQ ID NO: 104701 - DNA, 20 bp, Artificial Sequence
  Description of Artificial Sequence: Synthetic oligonucleotide
  Target: SCN9A; (+) strand; PAM type: YTN; PAM sequence: TTT
tctcctccatcagtgtattc

SEQ ID NO: 104702 - DNA, 20 bp, Artificial Sequence
  Description of Artificial Sequence: Synthetic oligonucleotide
  Target: SCN9A; (+) strand; PAM type: YTN; PAM sequence: TTT
ctcctccatcagtgtattct

SEQ ID NO: 104703 - DNA, 20 bp, Artificial Sequence
  Description of Artificial Sequence: Synthetic oligonucleotide
  Target: SCN9A; (+) strand; PAM type: YTN; PAM sequence: TTC
tcctccatcagtgtattctt

SEQ ID NO: 104704 - DNA, 20 bp, Artificial Sequence
  Description of Artificial Sequence: Synthetic oligonucleotide
  Target: SCN9A; (+) strand; PAM type: YTN; PAM sequence: CTC
ctccatcagtgtattcttaa

SEQ ID NO: 104705 - DNA, 20 bp, Artificial Sequence
  Description of Artificial Sequence: Synthetic oligonucleotide
  Target: SCN9A; (+) strand; PAM type: YTN; PAM sequence: CTC
catcagtgtattcttaattg

SEQ ID NO: 104706 - DNA, 20 bp, Artificial Sequence
  Description of Artificial Sequence: Synthetic oligonucleotide
  Target: SCN9A; (+) strand; PAM type: YTN; PAM sequence: TTC
ttaattgtatcaataaccat

SEQ ID NO: 104707 - DNA, 20 bp, Artificial Sequence
  Description of Artificial Sequence: Synthetic oligonucleotide
  Target: SCN9A; (+) strand; PAM type: YTN; PAM sequence: CTT
aattgtatcaataaccatct

SEQ ID NO: 104708 - DNA, 20 bp, Artificial Sequence
  Description of Artificial Sequence: Synthetic oligonucleotide
  Target: SCN9A; (+) strand; PAM type: YTN; PAM sequence: TTA
attgtatcaataaccatcta

SEQ ID NO: 104709 - DNA, 20 bp, Artificial Sequence
  Description of Artificial Sequence: Synthetic oligonucleotide
  Target: SCN9A; (+) strand; PAM type: YTN; PAM sequence: TTG
tatcaataaccatctagtct

SEQ ID NO: 104710 - DNA, 20 bp, Artificial Sequence
  Description of Artificial Sequence: Synthetic oligonucleotide
  Target: SCN9A; (+) strand; PAM type: YTN; PAM sequence: CTA
gtcttctaagtcaaaattct

SEQ ID NO: 104711 - DNA, 20 bp, Artificial Sequence
  Description of Artificial Sequence: Synthetic oligonucleotide
  Target: SCN9A; (+) strand; PAM type: YTN; PAM sequence: CTT
ctaagtcaaaattctttgtt

SEQ ID NO: 104712 - DNA, 20 bp, Artificial Sequence
  Description of Artificial Sequence: Synthetic oligonucleotide
  Target: SCN9A; (+) strand; PAM type: YTN; PAM sequence: TTC
taagtcaaaattctttgttg

SEQ ID NO: 104713 - DNA, 20 bp, Artificial Sequence
  Description of Artificial Sequence: Synthetic oligonucleotide
  Target: SCN9A; (+) strand; PAM type: YTN; PAM sequence: CTA
agtcaaaattctttgttgtg

SEQ ID NO: 104714 - DNA, 20 bp, Artificial Sequence
  Description of Artificial Sequence: Synthetic oligonucleotide
  Target: SCN9A; (+) strand; PAM type: YTN; PAM sequence: TTC
tttgttgtgggttgaattgt

SEQ ID NO: 104715 - DNA, 20 bp, Artificial Sequence
  Description of Artificial Sequence: Synthetic oligonucleotide
  Target: SCN9A; (+) strand; PAM type: YTN; PAM sequence: CTT
tgttgtgggttgaattgtaa

SEQ ID NO: 104716 - DNA, 20 bp, Artificial Sequence
  Description of Artificial Sequence: Synthetic oligonucleotide
  Target: SCN9A; (+) strand; PAM type: YTN; PAM sequence: TTT
gttgtgggttgaattgtaat

SEQ ID NO: 104717 - DNA, 20 bp, Artificial Sequence
  Description of Artificial Sequence: Synthetic oligonucleotide
  Target: SCN9A; (+) strand; PAM type: YTN; PAM sequence: TTG
ttgtgggttgaattgtaatc

SEQ ID NO: 104718 - DNA, 20 bp, Artificial Sequence
  Description of Artificial Sequence: Synthetic oligonucleotide
  Target: SCN9A; (+) strand; PAM type: YTN; PAM sequence: TTG
tgggttgaattgtaatcctc

SEQ ID NO: 104719 - DNA, 20 bp, Artificial Sequence
  Description of Artificial Sequence: Synthetic oligonucleotide
  Target: SCN9A; (+) strand; PAM type: YTN; PAM sequence: TTG
aattgtaatcctccaaaagt

SEQ ID NO: 104720 - DNA, 20 bp, Artificial Sequence
  Description of Artificial Sequence: Synthetic oligonucleotide
  Target: SCN9A; (+) strand; PAM type: YTN; PAM sequence: TTG
taatcctccaaaagttatgt

SEQ ID NO: 104721 - DNA, 20 bp, Artificial Sequence
  Description of Artificial Sequence: Synthetic oligonucleotide
  Target: SCN9A; (+) strand; PAM type: YTN; PAM sequence: CTC
caaaagttatgttgaagtcc

SEQ ID NO: 104722 - DNA, 20 bp, Artificial Sequence
  Description of Artificial Sequence: Synthetic oligonucleotide
  Target: SCN9A; (+) strand; PAM type: YTN; PAM sequence: TTA
tgttgaagtcctaaccctgg

SEQ ID NO: 104723 - DNA, 20 bp, Artificial Sequence
  Description of Artificial Sequence: Synthetic oligonucleotide
  Target: SCN9A; (+) strand; PAM type: YTN; PAM sequence: TTG
aagtcctaaccctggcatgt

SEQ ID NO: 104724 - DNA, 20 bp, Artificial Sequence
  Description of Artificial Sequence: Synthetic oligonucleotide
  Target: SCN9A; (+) strand; PAM type: YTN; PAM sequence: CTA
accctggcatgtttgagtgt

SEQ ID NO: 104725 - DNA, 20 bp, Artificial Sequence
  Description of Artificial Sequence: Synthetic oligonucleotide
  Target: SCN9A; (+) strand; PAM type: YTN; PAM sequence: CTG
gcatgtttgagtgtgatctt

SEQ ID NO: 104726 - DNA, 20 bp, Artificial Sequence
  Description of Artificial Sequence: Synthetic oligonucleotide
  Target: SCN9A; (+) strand; PAM type: YTN; PAM sequence: TTT
gagtgtgatcttatttggaa

SEQ ID NO: 104727 - DNA, 20 bp, Artificial Sequence
  Description of Artificial Sequence: Synthetic oligonucleotide
  Target: SCN9A; (+) strand; PAM type: YTN; PAM sequence: TTG
agtgtgatcttatttggaaa

SEQ ID NO: 104728 - DNA, 20 bp, Artificial Sequence
  Description of Artificial Sequence: Synthetic oligonucleotide
  Target: SCN9A; (+) strand; PAM type: YTN; PAM sequence: CTT
atttggaaatatggtctttg

SEQ ID NO: 104729 - DNA, 20 bp, Artificial Sequence
  Description of Artificial Sequence: Synthetic oligonucleotide
  Target: SCN9A; (+) strand; PAM type: YTN; PAM sequence: TTA
tttggaaatatggtctttgc

SEQ ID NO: 104730 - DNA, 20 bp, Artificial Sequence
  Description of Artificial Sequence: Synthetic oligonucleotide
  Target: SCN9A; (+) strand; PAM type: YTN; PAM sequence: TTT
ggaaatatggtctttgcaga

SEQ ID NO: 104731 - DNA, 20 bp, Artificial Sequence
  Description of Artificial Sequence: Synthetic oligonucleotide
  Target: SCN9A; (+) strand; PAM type: YTN; PAM sequence: TTG
gaaatatggtctttgcagac

SEQ ID NO: 104732 - DNA, 20 bp, Artificial Sequence
  Description of Artificial Sequence: Synthetic oligonucleotide
  Target: SCN9A; (+) strand; PAM type: YTN; PAM sequence: CTT
tgcagacacaatgaagatga

SEQ ID NO: 104733 - DNA, 20 bp, Artificial Sequence
  Description of Artificial Sequence: Synthetic oligonucleotide
  Target: SCN9A; (+) strand; PAM type: YTN; PAM sequence: TTT
gcagacacaatgaagatgag

SEQ ID NO: 104734 - DNA, 20 bp, Artificial Sequence
  Description of Artificial Sequence: Synthetic oligonucleotide
  Target: SCN9A; (+) strand; PAM type: YTN; PAM sequence: TTG
cagacacaatgaagatgagg

SEQ ID NO: 104735 - DNA, 20 bp, Artificial Sequence
  Description of Artificial Sequence: Synthetic oligonucleotide
  Target: SCN9A; (+) strand; PAM type: YTN; PAM sequence: TTG
tgtgggtccaaatccaatat

SEQ ID NO: 104736 - DNA, 20 bp, Artificial Sequence
  Description of Artificial Sequence: Synthetic oligonucleotide
  Target: SCN9A; (+) strand; PAM type: YTN; PAM sequence: CTG
gggtccttataagaagaaaa

SEQ ID NO: 104737 - DNA, 20 bp, Artificial Sequence
  Description of Artificial Sequence: Synthetic oligonucleotide
  Target: SCN9A; (+) strand; PAM type: YTN; PAM sequence: CTT
ataagaagaaaagaccgaga

SEQ ID NO: 104738 - DNA, 20 bp, Artificial Sequence
  Description of Artificial Sequence: Synthetic oligonucleotide
  Target: SCN9A; (+) strand; PAM type: YTN; PAM sequence: TTA
taagaagaaaagaccgagac

SEQ ID NO: 104739 - DNA, 20 bp, Artificial Sequence
  Description of Artificial Sequence: Synthetic oligonucleotide
  Target: SCN9A; (+) strand; PAM type: YTN; PAM sequence: CTA
cgtgagtaccgggccagaga

SEQ ID NO: 104740 - DNA, 20 bp, Artificial Sequence
  Description of Artificial Sequence: Synthetic oligonucleotide
  Target: SCN9A; (+) strand; PAM type: YTN; PAM sequence: TTG
ggatgatgcagctgcaagct

SEQ ID NO: 104741 - DNA, 20 bp, Artificial Sequence
  Description of Artificial Sequence: Synthetic oligonucleotide
  Target: SCN9A; (+) strand; PAM type: YTN; PAM sequence: CTG
caagctgcaaggattgccaa

SEQ ID NO: 104742 - DNA, 20 bp, Artificial Sequence
  Description of Artificial Sequence: Synthetic oligonucleotide
  Target: SCN9A; (+) strand; PAM type: YTN; PAM sequence: CTG
caaggattgccaacaacctc

SEQ ID NO: 104743 - DNA, 20 bp, Artificial Sequence
  Description of Artificial Sequence: Synthetic oligonucleotide
  Target: SCN9A; (+) strand; PAM type: YTN; PAM sequence: TTG
ccaacaacctccaaagttag

SEQ ID NO: 104744 - DNA, 20 bp, Artificial Sequence
  Description of Artificial Sequence: Synthetic oligonucleotide
  Target: SCN9A; (+) strand; PAM type: YTN; PAM sequence: CTC
caaagttagaaagcagcaag

SEQ ID NO: 104745 - DNA, 20 bp, Artificial Sequence
  Description of Artificial Sequence: Synthetic oligonucleotide
  Target: SCN9A; (+) strand; PAM type: YTN; PAM sequence: TTA
gaaagcagcaaggcaggata

SEQ ID NO: 104746 - DNA, 20 bp, Artificial Sequence
  Description of Artificial Sequence: Synthetic oligonucleotide
  Target: SCN9A; (+) strand; PAM type: YTN; PAM sequence: CTT
actagagcctttagagaaat

SEQ ID NO: 104747 - DNA, 20 bp, Artificial Sequence
  Description of Artificial Sequence: Synthetic oligonucleotide
  Target: SCN9A; (+) strand; PAM type: YTN; PAM sequence: TTA
ctagagcctttagagaaatc

SEQ ID NO: 104748 - DNA, 20 bp, Artificial Sequence
  Description of Artificial Sequence: Synthetic oligonucleotide
  Target: SCN9A; (+) strand; PAM type: YTN; PAM sequence: CTA
gagcctttagagaaatcatg

SEQ ID NO: 104749 - DNA, 20 bp, Artificial Sequence
  Description of Artificial Sequence: Synthetic oligonucleotide
  Target: SCN9A; (+) strand; PAM type: YTN; PAM sequence: CTT
tagagaaatcatggccttgc

SEQ ID NO: 104750 - DNA, 20 bp, Artificial Sequence
  Description of Artificial Sequence: Synthetic oligonucleotide
  Target: SCN9A; (+) strand; PAM type: YTN; PAM sequence: TTT
agagaaatcatggccttgct

SEQ ID NO: 104751 - DNA, 20 bp, Artificial Sequence
  Description of Artificial Sequence: Synthetic oligonucleotide
  Target: SCN9A; (+) strand; PAM type: YTN; PAM sequence: TTA
gagaaatcatggccttgctc

SEQ ID NO: 104752 - DNA, 20 bp, Artificial Sequence
  Description of Artificial Sequence: Synthetic oligonucleotide
  Target: SCN9A; (+) strand; PAM type: YTN; PAM sequence: CTT
gctcagaccttgatttcaga

SEQ ID NO: 104753 - DNA, 20 bp, Artificial Sequence
  Description of Artificial Sequence: Synthetic oligonucleotide
  Target: SCN9A; (+) strand; PAM type: YTN; PAM sequence: TTG
ctcagaccttgatttcagac

SEQ ID NO: 104754 - DNA, 20 bp, Artificial Sequence
  Description of Artificial Sequence: Synthetic oligonucleotide
  Target: SCN9A; (+) strand; PAM type: YTN; PAM sequence: CTC
agaccttgatttcagacttc

SEQ ID NO: 104755 - DNA, 20 bp, Artificial Sequence
  Description of Artificial Sequence: Synthetic oligonucleotide
  Target: SCN9A; (+) strand; PAM type: YTN; PAM sequence: CTT
gatttcagacttctagcctc

SEQ ID NO: 104756 - DNA, 20 bp, Artificial Sequence
  Description of Artificial Sequence: Synthetic oligonucleotide
  Target: SCN9A; (+) strand; PAM type: YTN; PAM sequence: TTG
atttcagacttctagcctcc

SEQ ID NO: 104757 - DNA, 20 bp, Artificial Sequence
  Description of Artificial Sequence: Synthetic oligonucleotide
  Target: SCN9A; (+) strand; PAM type: YTN; PAM sequence: TTT
cagacttctagcctccagaa

SEQ ID NO: 104758 - DNA, 20 bp, Artificial Sequence
  Description of Artificial Sequence: Synthetic oligonucleotide
  Target: SCN9A; (+) strand; PAM type: YTN; PAM sequence: TTC
agacttctagcctccagaac

SEQ ID NO: 104759 - DNA, 20 bp, Artificial Sequence
  Description of Artificial Sequence: Synthetic oligonucleotide
  Target: SCN9A; (+) strand; PAM type: YTN; PAM sequence: CTT
ctagcctccagaactggcaa

SEQ ID NO: 104760 - DNA, 20 bp, Artificial Sequence
  Description of Artificial Sequence: Synthetic oligonucleotide
  Target: SCN9A; (+) strand; PAM type: YTN; PAM sequence: TTC
tagcctccagaactggcaaa

SEQ ID NO: 104761 - DNA, 20 bp, Artificial Sequence
  Description of Artificial Sequence: Synthetic oligonucleotide
  Target: SCN9A; (+) strand; PAM type: YTN; PAM sequence: CTA
gcctccagaactggcaaaag

SEQ ID NO: 104762 - DNA, 20 bp, Artificial Sequence
  Description of Artificial Sequence: Synthetic oligonucleotide
  Target: SCN9A; (+) strand; PAM type: YTN; PAM sequence: CTC
cagaactggcaaaagaataa

SEQ ID NO: 104763 - DNA, 20 bp, Artificial Sequence
  Description of Artificial Sequence: Synthetic oligonucleotide
  Target: SCN9A; (+) strand; PAM type: YTN; PAM sequence: CTG
gcaaaagaataaatttctgt

SEQ ID NO: 104764 - DNA, 20 bp, Artificial Sequence
  Description of Artificial Sequence: Synthetic oligonucleotide
  Target: SCN9A; (+) strand; PAM type: YTN; PAM sequence: TTT
ctgttgttgtaagccactga

SEQ ID NO: 104765 - DNA, 20 bp, Artificial Sequence
  Description of Artificial Sequence: Synthetic oligonucleotide
  Target: SCN9A; (+) strand; PAM type: YTN; PAM sequence: TTC
tgttgttgtaagccactgag

SEQ ID NO: 104766 - DNA, 20 bp, Artificial Sequence
  Description of Artificial Sequence: Synthetic oligonucleotide
  Target: SCN9A; (+) strand; PAM type: YTN; PAM sequence: CTG
ttgttgtaagccactgagtt

SEQ ID NO: 104767 - DNA, 20 bp, Artificial Sequence
  Description of Artificial Sequence: Synthetic oligonucleotide
  Target: SCN9A; (+) strand; PAM type: YTN; PAM sequence: TTG
ttgtaagccactgagttttg

SEQ ID NO: 104768 - DNA, 20 bp, Artificial Sequence
  Description of Artificial Sequence: Synthetic oligonucleotide
  Target: SCN9A; (+) strand; PAM type: YTN; PAM sequence: TTG
taagccactgagttttgcta

SEQ ID NO: 104769 - DNA, 20 bp, Artificial Sequence
  Description of Artificial Sequence: Synthetic oligonucleotide
  Target: SCN9A; (+) strand; PAM type: YTN; PAM sequence: CTG
agttttgctaatttgttaca

SEQ ID NO: 104770 - DNA, 20 bp, Artificial Sequence
  Description of Artificial Sequence: Synthetic oligonucleotide
  Target: SCN9A; (+) strand; PAM type: YTN; PAM sequence: TTT
tgctaatttgttacaacagc

SEQ ID NO: 104771 - DNA, 20 bp, Artificial Sequence
  Description of Artificial Sequence: Synthetic oligonucleotide
  Target: SCN9A; (+) strand; PAM type: YTN; PAM sequence: TTT
gctaatttgttacaacagcc

SEQ ID NO: 104772 - DNA, 20 bp, Artificial Sequence
  Description of Artificial Sequence: Synthetic oligonucleotide
  Target: SCN9A; (+) strand; PAM type: YTN; PAM sequence: TTG
ctaatttgttacaacagccg

SEQ ID NO: 104773 - DNA, 20 bp, Artificial Sequence
  Description of Artificial Sequence: Synthetic oligonucleotide
  Target: SCN9A; (+) strand; PAM type: YTN; PAM sequence: CTA
atttgttacaacagccgtaa

SEQ ID NO: 104774 - DNA, 20 bp, Artificial Sequence
  Description of Artificial Sequence: Synthetic oligonucleotide
  Target: SCN9A; (+) strand; PAM type: YTN; PAM sequence: TTT
gttacaacagccgtaagaaa

SEQ ID NO: 104775 - DNA, 20 bp, Artificial Sequence
  Description of Artificial Sequence: Synthetic oligonucleotide
  Target: SCN9A; (+) strand; PAM type: YTN; PAM sequence: TTG
ttacaacagccgtaagaaac

SEQ ID NO: 104776 - DNA, 20 bp, Artificial Sequence
  Description of Artificial Sequence: Synthetic oligonucleotide
  Target: SCN9A; (+) strand; PAM type: YTN; PAM sequence: TTA
caacagccgtaagaaactaa

SEQ ID NO: 104777 - DNA, 20 bp, Artificial Sequence
  Description of Artificial Sequence: Synthetic oligonucleotide
  Target: SCN9A; (+) strand; PAM type: YTN; PAM sequence: CTA
atacatccttggatcagctc

SEQ ID NO: 104778 - DNA, 20 bp, Artificial Sequence
  Description of Artificial Sequence: Synthetic oligonucleotide
  Target: SCN9A; (+) strand; PAM type: YTN; PAM sequence: CTT
ggatcagctcacaatcttat

SEQ ID NO: 104779 - DNA, 20 bp, Artificial Sequence
  Description of Artificial Sequence: Synthetic oligonucleotide
  Target: SCN9A; (+) strand; PAM type: YTN; PAM sequence: TTG
gatcagctcacaatcttata

SEQ ID NO: 104780 - DNA, 20 bp, Artificial Sequence
  Description of Artificial Sequence: Synthetic oligonucleotide
  Target: SCN9A; (+) strand; PAM type: YTN; PAM sequence: CTC
acaatcttatatatctagac

SEQ ID NO: 104781 - DNA, 20 bp, Artificial Sequence
  Description of Artificial Sequence: Synthetic oligonucleotide
  Target: SCN9A; (+) strand; PAM type: YTN; PAM sequence: CTT
atatatctagaccctgagcc

SEQ ID NO: 104782 - DNA, 20 bp, Artificial Sequence
  Description of Artificial Sequence: Synthetic oligonucleotide
  Target: SCN9A; (+) strand; PAM type: YTN; PAM sequence: TTA
tatatctagaccctgagccc

SEQ ID NO: 104783 - DNA, 20 bp, Artificial Sequence
  Description of Artificial Sequence: Synthetic oligonucleotide
  Target: SCN9A; (+) strand; PAM type: YTN; PAM sequence: CTA
gaccctgagcccttatattt

SEQ ID NO: 104784 - DNA, 20 bp, Artificial Sequence
  Description of Artificial Sequence: Synthetic oligonucleotide
  Target: SCN9A; (+) strand; PAM type: YTN; PAM sequence: CTG
agcccttatattttaacttt

SEQ ID NO: 104785 - DNA, 20 bp, Artificial Sequence
  Description of Artificial Sequence: Synthetic oligonucleotide
  Target: SCN9A; (+) strand; PAM type: YTN; PAM sequence: CTT
atattttaactttcaagtta

SEQ ID NO: 104786 - DNA, 20 bp, Artificial Sequence
  Description of Artificial Sequence: Synthetic oligonucleotide
  Target: SCN9A; (+) strand; PAM type: YTN; PAM sequence: TTA
tattttaactttcaagttaa

SEQ ID NO: 104787 - DNA, 20 bp, Artificial Sequence
  Description of Artificial Sequence: Synthetic oligonucleotide
  Target: SCN9A; (+) strand; PAM type: YTN; PAM sequence: TTT
taactttcaagttaatcccg

SEQ ID NO: 104788 - DNA, 20 bp, Artificial Sequence
  Description of Artificial Sequence: Synthetic oligonucleotide
  Target: SCN9A; (+) strand; PAM type: YTN; PAM sequence: TTT
aactttcaagttaatcccga

SEQ ID NO: 104789 - DNA, 20 bp, Artificial Sequence
  Description of Artificial Sequence: Synthetic oligonucleotide
  Target: SCN9A; (+) strand; PAM type: YTN; PAM sequence: TTA
actttcaagttaatcccgat

SEQ ID NO: 104790 - DNA, 20 bp, Artificial Sequence
  Description of Artificial Sequence: Synthetic oligonucleotide
  Target: SCN9A; (+) strand; PAM type: YTN; PAM sequence: CTT
tcaagttaatcccgatatta

SEQ ID NO: 104791 - DNA, 20 bp, Artificial Sequence
  Description of Artificial Sequence: Synthetic oligonucleotide
  Target: SCN9A; (+) strand; PAM type: YTN; PAM sequence: TTT
caagttaatcccgatattaa

SEQ ID NO: 104792 - DNA, 20 bp, Artificial Sequence
  Description of Artificial Sequence: Synthetic oligonucleotide
  Target: SCN9A; (+) strand; PAM type: YTN; PAM sequence: TTC
aagttaatcccgatattaaa

SEQ ID NO: 104793 - DNA, 20 bp, Artificial Sequence
  Description of Artificial Sequence: Synthetic oligonucleotide
  Target: SCN9A; (+) strand; PAM type: YTN; PAM sequence: TTA
atcccgatattaaattgttg

SEQ ID NO: 104794 - DNA, 20 bp, Artificial Sequence
  Description of Artificial Sequence: Synthetic oligonucleotide
  Target: SCN9A; (+) strand; PAM type: YTN; PAM sequence: TTA
aattgttgcagctgtgtgag

SEQ ID NO: 104795 - DNA, 20 bp, Artificial Sequence
  Description of Artificial Sequence: Synthetic oligonucleotide
  Target: SCN9A; (+) strand; PAM type: YTN; PAM sequence: TTG
ttgcagctgtgtgagaacat

SEQ ID NO: 104796 - DNA, 20 bp, Artificial Sequence
  Description of Artificial Sequence: Synthetic oligonucleotide
  Target: SCN9A; (+) strand; PAM type: YTN; PAM sequence: TTG
cagctgtgtgagaacatgat

SEQ ID NO: 104797 - DNA, 20 bp, Artificial Sequence
  Description of Artificial Sequence: Synthetic oligonucleotide
  Target: SCN9A; (+) strand; PAM type: YTN; PAM sequence: CTG
tgtgagaacatgatcttttt

SEQ ID NO: 104798 - DNA, 20 bp, Artificial Sequence
  Description of Artificial Sequence: Synthetic oligonucleotide
  Target: SCN9A; (+) strand; PAM type: YTN; PAM sequence: CTT
ttttccctcagcaattctta

SEQ ID NO: 104799 - DNA, 20 bp, Artificial Sequence
  Description of Artificial Sequence: Synthetic oligonucleotide
  Target: SCN9A; (+) strand; PAM type: YTN; PAM sequence: TTT
tttccctcagcaattcttag

SEQ ID NO: 104800 - DNA, 20 bp, Artificial Sequence
  Description of Artificial Sequence: Synthetic oligonucleotide
  Target: SCN9A; (+) strand; PAM type: YTN; PAM sequence: TTT
ttccctcagcaattcttagc

SEQ ID NO: 104801 - DNA, 20 bp, Artificial Sequence
  Description of Artificial Sequence: Synthetic oligonucleotide
  Target: SCN9A; (+) strand; PAM type: YTN; PAM sequence: TTT
tccctcagcaattcttagca

SEQ ID NO: 104802 - DNA, 20 bp, Artificial Sequence
  Description of Artificial Sequence: Synthetic oligonucleotide
  Target: SCN9A; (+) strand; PAM type: YTN; PAM sequence: TTT
ccctcagcaattcttagcac

SEQ ID NO: 104803 - DNA, 20 bp, Artificial Sequence
  Description of Artificial Sequence: Synthetic oligonucleotide
  Target: SCN9A; (+) strand; PAM type: YTN; PAM sequence: TTC
cctcagcaattcttagcaca

SEQ ID NO: 104804 - DNA, 20 bp, Artificial Sequence
  Description of Artificial Sequence: Synthetic oligonucleotide
  Target: SCN9A; (+) strand; PAM type: YTN; PAM sequence: CTC
agcaattcttagcacagtgc

SEQ ID NO: 104805 - DNA, 20 bp, Artificial Sequence
  Description of Artificial Sequence: Synthetic oligonucleotide
  Target: SCN9A; (+) strand; PAM type: YTN; PAM sequence: TTC
ttagcacagtgcttagagca

SEQ ID NO: 104806 - DNA, 20 bp, Artificial Sequence
  Description of Artificial Sequence: Synthetic oligonucleotide
  Target: SCN9A; (+) strand; PAM type: YTN; PAM sequence: CTT
agcacagtgcttagagcata

SEQ ID NO: 104807 - DNA, 20 bp, Artificial Sequence
  Description of Artificial Sequence: Synthetic oligonucleotide
  Target: SCN9A; (+) strand; PAM type: YTN; PAM sequence: TTA
gcacagtgcttagagcatag

SEQ ID NO: 104808 - DNA, 20 bp, Artificial Sequence
  Description of Artificial Sequence: Synthetic oligonucleotide
  Target: SCN9A; (+) strand; PAM type: YTN; PAM sequence: CTT
agagcatagtaaggtgtaat

SEQ ID NO: 104809 - DNA, 20 bp, Artificial Sequence
  Description of Artificial Sequence: Synthetic oligonucleotide
  Target: SCN9A; (+) strand; PAM type: YTN; PAM sequence: TTA
gagcatagtaaggtgtaata

SEQ ID NO: 104810 - DNA, 20 bp, Artificial Sequence
  Description of Artificial Sequence: Synthetic oligonucleotide
  Target: SCN9A; (+) strand; PAM type: YTN; PAM sequence: TTT
attgacaaatgggtgcattt

SEQ ID NO: 104811 - DNA, 20 bp, Artificial Sequence
  Description of Artificial Sequence: Synthetic oligonucleotide
  Target: SCN9A; (+) strand; PAM type: YTN; PAM sequence: TTA
ttgacaaatgggtgcatttc

SEQ ID NO: 104812 - DNA, 20 bp, Artificial Sequence
  Description of Artificial Sequence: Synthetic oligonucleotide
  Target: SCN9A; (+) strand; PAM type: YTN; PAM sequence: TTG
acaaatgggtgcatttcata

SEQ ID NO: 104813 - DNA, 20 bp, Artificial Sequence
  Description of Artificial Sequence: Synthetic oligonucleotide
  Target: SCN9A; (+) strand; PAM type: YTN; PAM sequence: TTT
catacttcctttaaggcttc

SEQ ID NO: 104814 - DNA, 20 bp, Artificial Sequence
  Description of Artificial Sequence: Synthetic oligonucleotide
  Target: SCN9A; (+) strand; PAM type: YTN; PAM sequence: TTC
atacttcctttaaggcttct

SEQ ID NO: 104815 - DNA, 20 bp, Artificial Sequence
  Description of Artificial Sequence: Synthetic oligonucleotide
  Target: SCN9A; (+) strand; PAM type: YTN; PAM sequence: CTT
cctttaaggcttctaatgag

SEQ ID NO: 104816 - DNA, 20 bp, Artificial Sequence
  Description of Artificial Sequence: Synthetic oligonucleotide
  Target: SCN9A; (+) strand; PAM type: YTN; PAM sequence: TTC
ctttaaggcttctaatgagg

SEQ ID NO: 104817 - DNA, 20 bp, Artificial Sequence
  Description of Artificial Sequence: Synthetic oligonucleotide
  Target: SCN9A; (+) strand; PAM type: YTN; PAM sequence: CTT
taaggcttctaatgaggaag

SEQ ID NO: 104818 - DNA, 20 bp, Artificial Sequence
  Description of Artificial Sequence: Synthetic oligonucleotide
  Target: SCN9A; (+) strand; PAM type: YTN; PAM sequence: TTT
aaggcttctaatgaggaagc

SEQ ID NO: 104819 - DNA, 20 bp, Artificial Sequence
  Description of Artificial Sequence: Synthetic oligonucleotide
  Target: SCN9A; (+) strand; PAM type: YTN; PAM sequence: TTA
aggcttctaatgaggaagca

SEQ ID NO: 104820 - DNA, 20 bp, Artificial Sequence
  Description of Artificial Sequence: Synthetic oligonucleotide
  Target: SCN9A; (+) strand; PAM type: YTN; PAM sequence: CTT
ctaatgaggaagcacttcac

SEQ ID NO: 104821 - DNA, 20 bp, Artificial Sequence
  Description of Artificial Sequence: Synthetic oligonucleotide
  Target: SCN9A; (+) strand; PAM type: YTN; PAM sequence: TTC
taatgaggaagcacttcact

SEQ ID NO: 104822 - DNA, 20 bp, Artificial Sequence
  Description of Artificial Sequence: Synthetic oligonucleotide
  Target: SCN9A; (+) strand; PAM type: YTN; PAM sequence: CTA
atgaggaagcacttcactgc

SEQ ID NO: 104823 - DNA, 20 bp, Artificial Sequence
  Description of Artificial Sequence: Synthetic oligonucleotide
  Target: SCN9A; (+) strand; PAM type: YTN; PAM sequence: CTT
cactgccagtggtaaaaaag

SEQ ID NO: 104824 - DNA, 20 bp, Artificial Sequence
  Description of Artificial Sequence: Synthetic oligonucleotide
  Target: SCN9A; (+) strand; PAM type: YTN; PAM sequence: TTC
actgccagtggtaaaaaagc

SEQ ID NO: 104825 - DNA, 20 bp, Artificial Sequence
  Description of Artificial Sequence: Synthetic oligonucleotide
  Target: SCN9A; (+) strand; PAM type: YTN; PAM sequence: CTG
ccagtggtaaaaaagcctgt

SEQ ID NO: 104826 - DNA, 20 bp, Artificial Sequence
  Description of Artificial Sequence: Synthetic oligonucleotide
  Target: SCN9A; (+) strand; PAM type: YTN; PAM sequence: CTG
tgtagtgtgttgttaatgtt

SEQ ID NO: 104827 - DNA, 20 bp, Artificial Sequence
  Description of Artificial Sequence: Synthetic oligonucleotide
  Target: SCN9A; (+) strand; PAM type: YTN; PAM sequence: TTG
ttaatgtttggagtgtgctt

SEQ ID NO: 104828 - DNA, 20 bp, Artificial Sequence
  Description of Artificial Sequence: Synthetic oligonucleotide
  Target: SCN9A; (+) strand; PAM type: YTN; PAM sequence: TTA
atgtttggagtgtgcttgga

SEQ ID NO: 104829 - DNA, 20 bp, Artificial Sequence
  Description of Artificial Sequence: Synthetic oligonucleotide
  Target: SCN9A; (+) strand; PAM type: YTN; PAM sequence: TTT
ggagtgtgcttggagggctt

SEQ ID NO: 104830 - DNA, 20 bp, Artificial Sequence
  Description of Artificial Sequence: Synthetic oligonucleotide
  Target: SCN9A; (+) strand; PAM type: YTN; PAM sequence: TTG
gagtgtgcttggagggcttc

SEQ ID NO: 104831 - DNA, 20 bp, Artificial Sequence
  Description of Artificial Sequence: Synthetic oligonucleotide
  Target: SCN9A; (+) strand; PAM type: YTN; PAM sequence: CTT
ggagggcttcattgcacttc

SEQ ID NO: 104832 - DNA, 20 bp, Artificial Sequence
  Description of Artificial Sequence: Synthetic oligonucleotide
  Target: SCN9A; (+) strand; PAM type: YTN; PAM sequence: TTG
gagggcttcattgcacttca

SEQ ID NO: 104833 - DNA, 20 bp, Artificial Sequence
  Description of Artificial Sequence: Synthetic oligonucleotide
  Target: SCN9A; (+) strand; PAM type: YTN; PAM sequence: CTT
cattgcacttcaggagaagg

SEQ ID NO: 104834 - DNA, 20 bp, Artificial Sequence
  Description of Artificial Sequence: Synthetic oligonucleotide
  Target: SCN9A; (+) strand; PAM type: YTN; PAM sequence: TTC
attgcacttcaggagaaggc

SEQ ID NO: 104835 - DNA, 20 bp, Artificial Sequence
  Description of Artificial Sequence: Synthetic oligonucleotide
  Target: SCN9A; (+) strand; PAM type: YTN; PAM sequence: TTG
cacttcaggagaaggctgac

SEQ ID NO: 104836 - DNA, 20 bp, Artificial Sequence
  Description of Artificial Sequence: Synthetic oligonucleotide
  Target: SCN9A; (+) strand; PAM type: YTN; PAM sequence: CTT
caggagaaggctgactctga

SEQ ID NO: 104837 - DNA, 20 bp, Artificial Sequence
  Description of Artificial Sequence: Synthetic oligonucleotide
  Target: SCN9A; (+) strand; PAM type: YTN; PAM sequence: TTC
aggagaaggctgactctgag

SEQ ID NO: 104838 - DNA, 20 bp, Artificial Sequence
  Description of Artificial Sequence: Synthetic oligonucleotide
  Target: SCN9A; (+) strand; PAM type: YTN; PAM sequence: CTG
actctgagaagagccatcag

SEQ ID NO: 104839 - DNA, 20 bp, Artificial Sequence
  Description of Artificial Sequence: Synthetic oligonucleotide
  Target: SCN9A; (+) strand; PAM type: YTN; PAM sequence: CTC
tgagaagagccatcagttca

SEQ ID NO: 104840 - DNA, 20 bp, Artificial Sequence
  Description of Artificial Sequence: Synthetic oligonucleotide
  Target: SCN9A; (+) strand; PAM type: YTN; PAM sequence: CTG
agaagagccatcagttcagt

SEQ ID NO: 104841 - DNA, 20 bp, Artificial Sequence
  Description of Artificial Sequence: Synthetic oligonucleotide
  Target: SCN9A; (+) strand; PAM type: YTN; PAM sequence: TTC
agtgcctgcattcttagaaa

SEQ ID NO: 104842 - DNA, 20 bp, Artificial Sequence
  Description of Artificial Sequence: Synthetic oligonucleotide
  Target: SCN9A; (+) strand; PAM type: YTN; PAM sequence: CTG
cattcttagaaacagtgaaa

SEQ ID NO: 104843 - DNA, 20 bp, Artificial Sequence
  Description of Artificial Sequence: Synthetic oligonucleotide
  Target: SCN9A; (+) strand; PAM type: YTN; PAM sequence: TTC
ttagaaacagtgaaaagagt

SEQ ID NO: 104844 - DNA, 20 bp, Artificial Sequence
  Description of Artificial Sequence: Synthetic oligonucleotide
  Target: SCN9A; (+) strand; PAM type: YTN; PAM sequence: CTT
agaaacagtgaaaagagtat

SEQ ID NO: 104845 - DNA, 20 bp, Artificial Sequence
  Description of Artificial Sequence: Synthetic oligonucleotide
  Target: SCN9A; (+) strand; PAM type: YTN; PAM sequence: TTA
gaaacagtgaaaagagtatt

SEQ ID NO: 104846 - DNA, 20 bp, Artificial Sequence
  Description of Artificial Sequence: Synthetic oligonucleotide
  Target: SCN9A; (+) strand; PAM type: YTN; PAM sequence: TTA
ttctcatgggtacctttgag

SEQ ID NO: 104847 - DNA, 20 bp, Artificial Sequence
  Description of Artificial Sequence: Synthetic oligonucleotide
  Target: SCN9A; (+) strand; PAM type: YTN; PAM sequence: TTC
tcatgggtacctttgagata

SEQ ID NO: 104848 - DNA, 20 bp, Artificial Sequence
  Description of Artificial Sequence: Synthetic oligonucleotide
  Target: SCN9A; (+) strand; PAM type: YTN; PAM sequence: CTC
atgggtacctttgagataac

SEQ ID NO: 104849 - DNA, 20 bp, Artificial Sequence
  Description of Artificial Sequence: Synthetic oligonucleotide
  Target: SCN9A; (+) strand; PAM type: YTN; PAM sequence: CTT
tgagataacagcatgtcttt

SEQ ID NO: 104850 - DNA, 20 bp, Artificial Sequence
  Description of Artificial Sequence: Synthetic oligonucleotide
  Target: SCN9A; (+) strand; PAM type: YTN; PAM sequence: TTT
gagataacagcatgtctttc

SEQ ID NO: 104851 - DNA, 20 bp, Artificial Sequence
  Description of Artificial Sequence: Synthetic oligonucleotide
  Target: SCN9A; (+) strand; PAM type: YTN; PAM sequence: TTG
agataacagcatgtctttct

SEQ ID NO: 104852 - DNA, 20 bp, Artificial Sequence
  Description of Artificial Sequence: Synthetic oligonucleotide
  Target: SCN9A; (+) strand; PAM type: YTN; PAM sequence: CTT
tcttgattctgacactgact

SEQ ID NO: 104853 - DNA, 20 bp, Artificial Sequence
  Description of Artificial Sequence: Synthetic oligonucleotide
  Target: SCN9A; (+) strand; PAM type: YTN; PAM sequence: TTT
cttgattctgacactgacta

SEQ ID NO: 104854 - DNA, 20 bp, Artificial Sequence
  Description of Artificial Sequence: Synthetic oligonucleotide
  Target: SCN9A; (+) strand; PAM type: YTN; PAM sequence: TTC
ttgattctgacactgactat

SEQ ID NO: 104855 - DNA, 20 bp, Artificial Sequence
  Description of Artificial Sequence: Synthetic oligonucleotide
  Target: SCN9A; (+) strand; PAM type: YTN; PAM sequence: CTT
gattctgacactgactatct

SEQ ID NO: 104856 - DNA, 20 bp, Artificial Sequence
  Description of Artificial Sequence: Synthetic oligonucleotide
  Target: SCN9A; (+) strand; PAM type: YTN; PAM sequence: TTG
attctgacactgactatctc

SEQ ID NO: 104857 - DNA, 20 bp, Artificial Sequence
  Description of Artificial Sequence: Synthetic oligonucleotide
  Target: SCN9A; (+) strand; PAM type: YTN; PAM sequence: TTC
tgacactgactatctcttca

SEQ ID NO: 104858 - DNA, 20 bp, Artificial Sequence
  Description of Artificial Sequence: Synthetic oligonucleotide
  Target: SCN9A; (+) strand; PAM type: YTN; PAM sequence: CTG
acactgactatctcttcaga

SEQ ID NO: 104859 - DNA, 20 bp, Artificial Sequence
  Description of Artificial Sequence: Synthetic oligonucleotide
  Target: SCN9A; (+) strand; PAM type: YTN; PAM sequence: CTG
actatctcttcagagaagtg

SEQ ID NO: 104860 - DNA, 20 bp, Artificial Sequence
  Description of Artificial Sequence: Synthetic oligonucleotide
  Target: SCN9A; (+) strand; PAM type: YTN; PAM sequence: CTA
tctcttcagagaagtgctat

SEQ ID NO: 104861 - DNA, 20 bp, Artificial Sequence
  Description of Artificial Sequence: Synthetic oligonucleotide
  Target: SCN9A; (+) strand; PAM type: YTN; PAM sequence: CTC
ttcagagaagtgctattgtt

SEQ ID NO: 104862 - DNA, 20 bp, Artificial Sequence
  Description of Artificial Sequence: Synthetic oligonucleotide
  Target: SCN9A; (+) strand; PAM type: YTN; PAM sequence: CTT
cagagaagtgctattgttct

SEQ ID NO: 104863 - DNA, 20 bp, Artificial Sequence
  Description of Artificial Sequence: Synthetic oligonucleotide
  Target: SCN9A; (+) strand; PAM type: YTN; PAM sequence: TTC
agagaagtgctattgttcta

SEQ ID NO: 104864 - DNA, 20 bp, Artificial Sequence
  Description of Artificial Sequence: Synthetic oligonucleotide
  Target: SCN9A; (+) strand; PAM type: YTN; PAM sequence: CTA
ttgttctatttccatttgtt

SEQ ID NO: 104865 - DNA, 20 bp, Artificial Sequence
  Description of Artificial Sequence: Synthetic oligonucleotide
  Target: SCN9A; (+) strand; PAM type: YTN; PAM sequence: TTG
ttctatttccatttgtttcc

SEQ ID NO: 104866 - DNA, 20 bp, Artificial Sequence
  Description of Artificial Sequence: Synthetic oligonucleotide
  Target: SCN9A; (+) strand; PAM type: YTN; PAM sequence: TTC
tatttccatttgtttcctca

SEQ ID NO: 104867 - DNA, 20 bp, Artificial Sequence
  Description of Artificial Sequence: Synthetic oligonucleotide
  Target: SCN9A; (+) strand; PAM type: YTN; PAM sequence: CTA
tttccatttgtttcctcaga

SEQ ID NO: 104868 - DNA, 20 bp, Artificial Sequence
  Description of Artificial Sequence: Synthetic oligonucleotide
  Target: SCN9A; (+) strand; PAM type: YTN; PAM sequence: TTT
ccatttgtttcctcagaact

SEQ ID NO: 104869 - DNA, 20 bp, Artificial Sequence
  Description of Artificial Sequence: Synthetic oligonucleotide
  Target: SCN9A; (+) strand; PAM type: YTN; PAM sequence: TTC
catttgtttcctcagaactg

SEQ ID NO: 104870 - DNA, 20 bp, Artificial Sequence
  Description of Artificial Sequence: Synthetic oligonucleotide
  Target: SCN9A; (+) strand; PAM type: YTN; PAM sequence: TTT
gtttcctcagaactgtttaa

SEQ ID NO: 104871 - DNA, 20 bp, Artificial Sequence
  Description of Artificial Sequence: Synthetic oligonucleotide
  Target: SCN9A; (+) strand; PAM type: YTN; PAM sequence: TTG
tttcctcagaactgtttaag

SEQ ID NO: 104872 - DNA, 20 bp, Artificial Sequence
  Description of Artificial Sequence: Synthetic oligonucleotide
  Target: SCN9A; (+) strand; PAM type: YTN; PAM sequence: TTT
cctcagaactgtttaagata

SEQ ID NO: 104873 - DNA, 20 bp, Artificial Sequence
  Description of Artificial Sequence: Synthetic oligonucleotide
  Target: SCN9A; (+) strand; PAM type: YTN; PAM sequence: TTC
ctcagaactgtttaagatat

SEQ ID NO: 104874 - DNA, 20 bp, Artificial Sequence
  Description of Artificial Sequence: Synthetic oligonucleotide
  Target: SCN9A; (+) strand; PAM type: YTN; PAM sequence: CTC
agaactgtttaagatatttg

SEQ ID NO: 104875 - DNA, 20 bp, Artificial Sequence
  Description of Artificial Sequence: Synthetic oligonucleotide
  Target: SCN9A; (+) strand; PAM type: YTN; PAM sequence: CTG
tttaagatatttgactaaac

SEQ ID NO: 104876 - DNA, 20 bp, Artificial Sequence
  Description of Artificial Sequence: Synthetic oligonucleotide
  Target: SCN9A; (+) strand; PAM type: YTN; PAM sequence: TTT
aagatatttgactaaaccgt

SEQ ID NO: 104877 - DNA, 20 bp, Artificial Sequence
  Description of Artificial Sequence: Synthetic oligonucleotide
  Target: SCN9A; (+) strand; PAM type: YTN; PAM sequence: TTA
agatatttgactaaaccgtt

SEQ ID NO: 104878 - DNA, 20 bp, Artificial Sequence
  Description of Artificial Sequence: Synthetic oligonucleotide
  Target: SCN9A; (+) strand; PAM type: YTN; PAM sequence: TTT
gactaaaccgtttgttttaa

SEQ ID NO: 104879 - DNA, 20 bp, Artificial Sequence
  Description of Artificial Sequence: Synthetic oligonucleotide
  Target: SCN9A; (+) strand; PAM type: YTN; PAM sequence: TTG
actaaaccgtttgttttaac

SEQ ID NO: 104880 - DNA, 20 bp, Artificial Sequence
  Description of Artificial Sequence: Synthetic oligonucleotide
  Target: SCN9A; (+) strand; PAM type: YTN; PAM sequence: CTA
aaccgtttgttttaactcat

SEQ ID NO: 104881 - DNA, 20 bp, Artificial Sequence
  Description of Artificial Sequence: Synthetic oligonucleotide
  Target: SCN9A; (+) strand; PAM type: YTN; PAM sequence: TTT
gttttaactcatctctttgg

SEQ ID NO: 104882 - DNA, 20 bp, Artificial Sequence
  Description of Artificial Sequence: Synthetic oligonucleotide
  Target: SCN9A; (+) strand; PAM type: YTN; PAM sequence: TTG
ttttaactcatctctttggt

SEQ ID NO: 104883 - DNA, 20 bp, Artificial Sequence
  Description of Artificial Sequence: Synthetic oligonucleotide
  Target: SCN9A; (+) strand; PAM type: YTN; PAM sequence: TTT
taactcatctctttggttat

SEQ ID NO: 104884 - DNA, 20 bp, Artificial Sequence
  Description of Artificial Sequence: Synthetic oligonucleotide
  Target: SCN9A; (+) strand; PAM type: YTN; PAM sequence: TTT
aactcatctctttggttatt

SEQ ID NO: 104885 - DNA, 20 bp, Artificial Sequence
  Description of Artificial Sequence: Synthetic oligonucleotide
  Target: SCN9A; (+) strand; PAM type: YTN; PAM sequence: TTA
actcatctctttggttattt

SEQ ID NO: 104886 - DNA, 20 bp, Artificial Sequence
  Description of Artificial Sequence: Synthetic oligonucleotide
  Target: SCN9A; (+) strand; PAM type: YTN; PAM sequence: CTC
atctctttggttattttctg

SEQ ID NO: 104887 - DNA, 20 bp, Artificial Sequence
  Description of Artificial Sequence: Synthetic oligonucleotide
  Target: SCN9A; (+) strand; PAM type: YTN; PAM sequence: CTC
tttggttattttctgataag

SEQ ID NO: 104888 - DNA, 20 bp, Artificial Sequence
  Description of Artificial Sequence: Synthetic oligonucleotide
  Target: SCN9A; (+) strand; PAM type: YTN; PAM sequence: CTT
tggttattttctgataagag

SEQ ID NO: 104889 - DNA, 20 bp, Artificial Sequence
  Description of Artificial Sequence: Synthetic oligonucleotide
  Target: SCN9A; (+) strand; PAM type: YTN; PAM sequence: TTT
ggttattttctgataagagg

SEQ ID NO: 104890 - DNA, 20 bp, Artificial Sequence
  Description of Artificial Sequence: Synthetic oligonucleotide
  Target: SCN9A; (+) strand; PAM type: YTN; PAM sequence: TTG
gttattttctgataagaggt

SEQ ID NO: 104891 - DNA, 20 bp, Artificial Sequence
  Description of Artificial Sequence: Synthetic oligonucleotide
  Target: SCN9A; (+) strand; PAM type: YTN; PAM sequence: TTA
ttttctgataagaggtttta

SEQ ID NO: 104892 - DNA, 20 bp, Artificial Sequence
  Description of Artificial Sequence: Synthetic oligonucleotide
  Target: SCN9A; (+) strand; PAM type: YTN; PAM sequence: TTT
tctgataagaggttttactg

SEQ ID NO: 104893 - DNA, 20 bp, Artificial Sequence
  Description of Artificial Sequence: Synthetic oligonucleotide
  Target: SCN9A; (+) strand; PAM type: YTN; PAM sequence: TTT
ctgataagaggttttactgt

SEQ ID NO: 104894 - DNA, 20 bp, Artificial Sequence
  Description of Artificial Sequence: Synthetic oligonucleotide
  Target: SCN9A; (+) strand; PAM type: YTN; PAM sequence: TTC
tgataagaggttttactgta

SEQ ID NO: 104895 - DNA, 20 bp, Artificial Sequence
  Description of Artificial Sequence: Synthetic oligonucleotide
  Target: SCN9A; (+) strand; PAM type: YTN; PAM sequence: CTG
ataagaggttttactgtaaa

SEQ ID NO: 104896 - DNA, 20 bp, Artificial Sequence
  Description of Artificial Sequence: Synthetic oligonucleotide
  Target: SCN9A; (+) strand; PAM type: YTN; PAM sequence: TTT
tactgtaaaatattttgatt

SEQ ID NO: 104897 - DNA, 20 bp, Artificial Sequence
  Description of Artificial Sequence: Synthetic oligonucleotide
  Target: SCN9A; (+) strand; PAM type: YTN; PAM sequence: TTT
actgtaaaatattttgattt

SEQ ID NO: 104898 - DNA, 20 bp, Artificial Sequence
  Description of Artificial Sequence: Synthetic oligonucleotide
  Target: SCN9A; (+) strand; PAM type: YTN; PAM sequence: TTA
ctgtaaaatattttgatttg

SEQ ID NO: 104899 - DNA, 20 bp, Artificial Sequence
  Description of Artificial Sequence: Synthetic oligonucleotide
  Target: SCN9A; (+) strand; PAM type: YTN; PAM sequence: CTG
taaaatattttgatttgatt

SEQ ID NO: 104900 - DNA, 20 bp, Artificial Sequence
  Description of Artificial Sequence: Synthetic oligonucleotide
  Target: SCN9A; (+) strand; PAM type: YTN; PAM sequence: TTT
tgatttgattctggagtgta

SEQ ID NO: 104901 - DNA, 20 bp, Artificial Sequence
  Description of Artificial Sequence: Synthetic oligonucleotide
  Target: SCN9A; (+) strand; PAM type: YTN; PAM sequence: TTT
gatttgattctggagtgtat

SEQ ID NO: 104902 - DNA, 20 bp, Artificial Sequence
  Description of Artificial Sequence: Synthetic oligonucleotide
  Target: SCN9A; (+) strand; PAM type: YTN; PAM sequence: TTG
atttgattctggagtgtatt

SEQ ID NO: 104903 - DNA, 20 bp, Artificial Sequence
  Description of Artificial Sequence: Synthetic oligonucleotide
  Target: SCN9A; (+) strand; PAM type: YTN; PAM sequence: TTT
gattctggagtgtattttta

SEQ ID NO: 104904 - DNA, 20 bp, Artificial Sequence
  Description of Artificial Sequence: Synthetic oligonucleotide
  Target: SCN9A; (+) strand; PAM type: YTN; PAM sequence: TTG
attctggagtgtatttttaa

SEQ ID NO: 104905 - DNA, 20 bp, Artificial Sequence
  Description of Artificial Sequence: Synthetic oligonucleotide
  Target: SCN9A; (+) strand; PAM type: YTN; PAM sequence: TTC
tggagtgtatttttaactgt

SEQ ID NO: 104906 - DNA, 20 bp, Artificial Sequence
  Description of Artificial Sequence: Synthetic oligonucleotide
  Target: SCN9A; (+) strand; PAM type: YTN; PAM sequence: CTG
gagtgtatttttaactgtct

SEQ ID NO: 104907 - DNA, 20 bp, Artificial Sequence
  Description of Artificial Sequence: Synthetic oligonucleotide
  Target: SCN9A; (+) strand; PAM type: YTN; PAM sequence: TTT
ttaactgtctatcaggttga

SEQ ID NO: 104908 - DNA, 20 bp, Artificial Sequence
  Description of Artificial Sequence: Synthetic oligonucleotide
  Target: SCN9A; (+) strand; PAM type: YTN; PAM sequence: TTT
taactgtctatcaggttgag

SEQ ID NO: 104909 - DNA, 20 bp, Artificial Sequence
  Description of Artificial Sequence: Synthetic oligonucleotide
  Target: SCN9A; (+) strand; PAM type: YTN; PAM sequence: TTT
aactgtctatcaggttgagg

SEQ ID NO: 104910 - DNA, 20 bp, Artificial Sequence
  Description of Artificial Sequence: Synthetic oligonucleotide
  Target: SCN9A; (+) strand; PAM type: YTN; PAM sequence: TTA
actgtctatcaggttgagga

SEQ ID NO: 104911 - DNA, 20 bp, Artificial Sequence
  Description of Artificial Sequence: Synthetic oligonucleotide
  Target: SCN9A; (+) strand; PAM type: YTN; PAM sequence: CTG
tctatcaggttgaggaaatc

SEQ ID NO: 104912 - DNA, 20 bp, Artificial Sequence
  Description of Artificial Sequence: Synthetic oligonucleotide
  Target: SCN9A; (+) strand; PAM type: YTN; PAM sequence: CTA
tcaggttgaggaaatctgtc

SEQ ID NO: 104913 - DNA, 20 bp, Artificial Sequence
  Description of Artificial Sequence: Synthetic oligonucleotide
  Target: SCN9A; (+) strand; PAM type: YTN; PAM sequence: TTG
aggaaatctgtcaacctgaa

SEQ ID NO: 104914 - DNA, 20 bp, Artificial Sequence
  Description of Artificial Sequence: Synthetic oligonucleotide
  Target: SCN9A; (+) strand; PAM type: YTN; PAM sequence: CTG
tcaacctgaaaacttatact

SEQ ID NO: 104915 - DNA, 20 bp, Artificial Sequence
  Description of Artificial Sequence: Synthetic oligonucleotide
  Target: SCN9A; (+) strand; PAM type: YTN; PAM sequence: CTG
aaaacttatactaggagagc

SEQ ID NO: 104916 - DNA, 20 bp, Artificial Sequence
  Description of Artificial Sequence: Synthetic oligonucleotide
  Target: SCN9A; (+) strand; PAM type: YTN; PAM sequence: CTT
atactaggagagcactgaaa

SEQ ID NO: 104917 - DNA, 20 bp, Artificial Sequence
  Description of Artificial Sequence: Synthetic oligonucleotide
  Target: SCN9A; (+) strand; PAM type: YTN; PAM sequence: TTA
tactaggagagcactgaaaa

SEQ ID NO: 104918 - DNA, 20 bp, Artificial Sequence
  Description of Artificial Sequence: Synthetic oligonucleotide
  Target: SCN9A; (+) strand; PAM type: YTN; PAM sequence: CTA
ggagagcactgaaaattctc

SEQ ID NO: 104919 - DNA, 20 bp, Artificial Sequence
  Description of Artificial Sequence: Synthetic oligonucleotide
  Target: SCN9A; (+) strand; PAM type: YTN; PAM sequence: CTG
aaaattctccataaactctg

SEQ ID NO: 104920 - DNA, 20 bp, Artificial Sequence
  Description of Artificial Sequence: Synthetic oligonucleotide
  Target: SCN9A; (+) strand; PAM type: YTN; PAM sequence: TTC
tccataaactctgttgagaa

SEQ ID NO: 104921 - DNA, 20 bp, Artificial Sequence
  Description of Artificial Sequence: Synthetic oligonucleotide
  Target: SCN9A; (+) strand; PAM type: YTN; PAM sequence: CTC
cataaactctgttgagaaac

SEQ ID NO: 104922 - DNA, 20 bp, Artificial Sequence
  Description of Artificial Sequence: Synthetic oligonucleotide
  Target: SCN9A; (+) strand; PAM type: YTN; PAM sequence: CTC
tgttgagaaaccaggatgct

SEQ ID NO: 104923 - DNA, 20 bp, Artificial Sequence
  Description of Artificial Sequence: Synthetic oligonucleotide
  Target: SCN9A; (+) strand; PAM type: YTN; PAM sequence: CTG
ttgagaaaccaggatgctag

SEQ ID NO: 104924 - DNA, 20 bp, Artificial Sequence
  Description of Artificial Sequence: Synthetic oligonucleotide
  Target: SCN9A; (+) strand; PAM type: YTN; PAM sequence: TTG
agaaaccaggatgctaggtc

SEQ ID NO: 104925 - DNA, 20 bp, Artificial Sequence
  Description of Artificial Sequence: Synthetic oligonucleotide
  Target: SCN9A; (+) strand; PAM type: YTN; PAM sequence: CTA
ggtcataaaagagagggttt

SEQ ID NO: 104926 - DNA, 20 bp, Artificial Sequence
  Description of Artificial Sequence: Synthetic oligonucleotide
  Target: SCN9A; (+) strand; PAM type: YTN; PAM sequence: TTT
ttgggtagggagaagagagg

SEQ ID NO: 104927 - DNA, 20 bp, Artificial Sequence
  Description of Artificial Sequence: Synthetic oligonucleotide
  Target: SCN9A; (+) strand; PAM type: YTN; PAM sequence: TTT
tgggtagggagaagagaggg

SEQ ID NO: 104928 - DNA, 20 bp, Artificial Sequence
  Description of Artificial Sequence: Synthetic oligonucleotide
  Target: SCN9A; (+) strand; PAM type: YTN; PAM sequence: TTT
gggtagggagaagagaggga

SEQ ID NO: 104929 - DNA, 20 bp, Artificial Sequence
  Description of Artificial Sequence: Synthetic oligonucleotide
  Target: SCN9A; (+) strand; PAM type: YTN; PAM sequence: TTG
ggtagggagaagagagggag

SEQ ID NO: 104930 - DNA, 20 bp, Artificial Sequence
  Description of Artificial Sequence: Synthetic oligonucleotide
  Target: SCN9A; (+) strand; PAM type: YTN; PAM sequence: TTT
tttccccttgctcaaaatgc

SEQ ID NO: 104931 - DNA, 20 bp, Artificial Sequence
  Description of Artificial Sequence: Synthetic oligonucleotide
  Target: SCN9A; (+) strand; PAM type: YTN; PAM sequence: TTT
ttccccttgctcaaaatgca

SEQ ID NO: 104932 - DNA, 20 bp, Artificial Sequence
  Description of Artificial Sequence: Synthetic oligonucleotide
  Target: SCN9A; (+) strand; PAM type: YTN; PAM sequence: TTT
tccccttgctcaaaatgcag

SEQ ID NO: 104933 - DNA, 20 bp, Artificial Sequence
  Description of Artificial Sequence: Synthetic oligonucleotide
  Target: SCN9A; (+) strand; PAM type: YTN; PAM sequence: TTT
ccccttgctcaaaatgcagg

SEQ ID NO: 104934 - DNA, 20 bp, Artificial Sequence
  Description of Artificial Sequence: Synthetic oligonucleotide
  Target: SCN9A; (+) strand; PAM type: YTN; PAM sequence: TTC
cccttgctcaaaatgcaggt

SEQ ID NO: 104935 - DNA, 20 bp, Artificial Sequence
  Description of Artificial Sequence: Synthetic oligonucleotide
  Target: SCN9A; (+) strand; PAM type: YTN; PAM sequence: CTT
gctcaaaatgcaggttctta

SEQ ID NO: 104936 - DNA, 20 bp, Artificial Sequence
  Description of Artificial Sequence: Synthetic oligonucleotide
  Target: SCN9A; (+) strand; PAM type: YTN; PAM sequence: TTG
ctcaaaatgcaggttcttaa

SEQ ID NO: 104937 - DNA, 20 bp, Artificial Sequence
  Description of Artificial Sequence: Synthetic oligonucleotide
  Target: SCN9A; (+) strand; PAM type: YTN; PAM sequence: CTC
aaaatgcaggttcttaaaca

SEQ ID NO: 104938 - DNA, 20 bp, Artificial Sequence
  Description of Artificial Sequence: Synthetic oligonucleotide
  Target: SCN9A; (+) strand; PAM type: YTN; PAM sequence: TTC
ttaaacaagcaaaaggggaa

SEQ ID NO: 104939 - DNA, 20 bp, Artificial Sequence
  Description of Artificial Sequence: Synthetic oligonucleotide
  Target: SCN9A; (+) strand; PAM type: YTN; PAM sequence: CTT
aaacaagcaaaaggggaaat

SEQ ID NO: 104940 - DNA, 20 bp, Artificial Sequence
  Description of Artificial Sequence: Synthetic oligonucleotide
  Target: SCN9A; (+) strand; PAM type: YTN; PAM sequence: TTA
aacaagcaaaaggggaaata

SEQ ID NO: 104941 - DNA, 20 bp, Artificial Sequence
  Description of Artificial Sequence: Synthetic oligonucleotide
  Target: SCN9A; (+) strand; PAM type: YTN; PAM sequence: CTG
aataaagaaaataatatctc

SEQ ID NO: 104942 - DNA, 20 bp, Artificial Sequence
  Description of Artificial Sequence: Synthetic oligonucleotide
  Target: SCN9A; (+) strand; PAM type: YTN; PAM sequence: CTC
agaaacctgaatccaagtaa

SEQ ID NO: 104943 - DNA, 20 bp, Artificial Sequence
  Description of Artificial Sequence: Synthetic oligonucleotide
  Target: SCN9A; (+) strand; PAM type: YTN; PAM sequence: CTG
aatccaagtaagctagggat

SEQ ID NO: 104944 - DNA, 20 bp, Artificial Sequence
  Description of Artificial Sequence: Synthetic oligonucleotide
  Target: SCN9A; (+) strand; PAM type: YTN; PAM sequence: CTA
gggattaagttggcatcatt

SEQ ID NO: 104945 - DNA, 20 bp, Artificial Sequence
  Description of Artificial Sequence: Synthetic oligonucleotide
  Target: SCN9A; (+) strand; PAM type: YTN; PAM sequence: TTA
agttggcatcatttatttta

SEQ ID NO: 104946 - DNA, 20 bp, Artificial Sequence
  Description of Artificial Sequence: Synthetic oligonucleotide
  Target: SCN9A; (+) strand; PAM type: YTN; PAM sequence: TTG
gcatcatttattttaaaaat

SEQ ID NO: 104947 - DNA, 20 bp, Artificial Sequence
  Description of Artificial Sequence: Synthetic oligonucleotide
  Target: SCN9A; (+) strand; PAM type: YTN; PAM sequence: TTT
attttaaaaattattgacac

SEQ ID NO: 104948 - DNA, 20 bp, Artificial Sequence
  Description of Artificial Sequence: Synthetic oligonucleotide
  Target: SCN9A; (+) strand; PAM type: YTN; PAM sequence: TTA
ttttaaaaattattgacaca

SEQ ID NO: 104949 - DNA, 20 bp, Artificial Sequence
  Description of Artificial Sequence: Synthetic oligonucleotide
  Target: SCN9A; (+) strand; PAM type: YTN; PAM sequence: TTT
taaaaattattgacacataa

SEQ ID NO: 104950 - DNA, 20 bp, Artificial Sequence
  Description of Artificial Sequence: Synthetic oligonucleotide
  Target: SCN9A; (+) strand; PAM type: YTN; PAM sequence: TTT
aaaaattattgacacataat

SEQ ID NO: 104951 - DNA, 20 bp, Artificial Sequence
  Description of Artificial Sequence: Synthetic oligonucleotide
  Target: SCN9A; (+) strand; PAM type: YTN; PAM sequence: TTA
aaaattattgacacataata

SEQ ID NO: 104952 - DNA, 20 bp, Artificial Sequence
  Description of Artificial Sequence: Synthetic oligonucleotide
  Target: SCN9A; (+) strand; PAM type: YTN; PAM sequence: TTA
ttgacacataataattgtac

SEQ ID NO: 104953 - DNA, 20 bp, Artificial Sequence
  Description of Artificial Sequence: Synthetic oligonucleotide
  Target: SCN9A; (+) strand; PAM type: YTN; PAM sequence: TTG
acacataataattgtacata

SEQ ID NO: 104954 - DNA, 20 bp, Artificial Sequence
  Description of Artificial Sequence: Synthetic oligonucleotide
  Target: SCN9A; (+) strand; PAM type: YTN; PAM sequence: TTG
tacatatttatggggtacat

SEQ ID NO: 104955 - DNA, 20 bp, Artificial Sequence
  Description of Artificial Sequence: Synthetic oligonucleotide
  Target: SCN9A; (+) strand; PAM type: YTN; PAM sequence: TTT
atggggtacatgtgatagtt

SEQ ID NO: 104956 - DNA, 20 bp, Artificial Sequence
  Description of Artificial Sequence: Synthetic oligonucleotide
  Target: SCN9A; (+) strand; PAM type: YTN; PAM sequence: TTA
tggggtacatgtgatagttt

SEQ ID NO: 104957 - DNA, 20 bp, Artificial Sequence
  Description of Artificial Sequence: Synthetic oligonucleotide
  Target: SCN9A; (+) strand; PAM type: YTN; PAM sequence: TTT
gatacatgtatacattatat

SEQ ID NO: 104958 - DNA, 20 bp, Artificial Sequence
  Description of Artificial Sequence: Synthetic oligonucleotide
  Target: SCN9A; (+) strand; PAM type: YTN; PAM sequence: TTG
atacatgtatacattatata

SEQ ID NO: 104959 - DNA, 20 bp, Artificial Sequence
  Description of Artificial Sequence: Synthetic oligonucleotide
  Target: SCN9A; (+) strand; PAM type: YTN; PAM sequence: TTA
tataattatcaaatagggta

SEQ ID NO: 104960 - DNA, 20 bp, Artificial Sequence
  Description of Artificial Sequence: Synthetic oligonucleotide
  Target: SCN9A; (+) strand; PAM type: YTN; PAM sequence: TTA
tcaaatagggtaactagcag

SEQ ID NO: 104961 - DNA, 20 bp, Artificial Sequence
  Description of Artificial Sequence: Synthetic oligonucleotide
  Target: SCN9A; (+) strand; PAM type: YTN; PAM sequence: CTA
gcagatccatagctttgaac

SEQ ID NO: 104962 - DNA, 20 bp, Artificial Sequence
  Description of Artificial Sequence: Synthetic oligonucleotide
  Target: SCN9A; (+) strand; PAM type: YTN; PAM sequence: CTT
tgaacatttaccatttcttt

SEQ ID NO: 104963 - DNA, 20 bp, Artificial Sequence
  Description of Artificial Sequence: Synthetic oligonucleotide
  Target: SCN9A; (+) strand; PAM type: YTN; PAM sequence: TTT
gaacatttaccatttctttg

SEQ ID NO: 104964 - DNA, 20 bp, Artificial Sequence
  Description of Artificial Sequence: Synthetic oligonucleotide
  Target: SCN9A; (+) strand; PAM type: YTN; PAM sequence: TTG
aacatttaccatttctttgt

SEQ ID NO: 104965 - DNA, 20 bp, Artificial Sequence
  Description of Artificial Sequence: Synthetic oligonucleotide
  Target: SCN9A; (+) strand; PAM type: YTN; PAM sequence: TTT
accatttctttgtgaggaga

SEQ ID NO: 104966 - DNA, 20 bp, Artificial Sequence
  Description of Artificial Sequence: Synthetic oligonucleotide
  Target: SCN9A; (+) strand; PAM type: YTN; PAM sequence: TTA
ccatttctttgtgaggagac

SEQ ID NO: 104967 - DNA, 20 bp, Artificial Sequence
  Description of Artificial Sequence: Synthetic oligonucleotide
  Target: SCN9A; (+) strand; PAM type: YTN; PAM sequence: TTT
ctttgtgaggagaccattta

SEQ ID NO: 104968 - DNA, 20 bp, Artificial Sequence
  Description of Artificial Sequence: Synthetic oligonucleotide
  Target: SCN9A; (+) strand; PAM type: YTN; PAM sequence: TTC
tttgtgaggagaccatttaa

SEQ ID NO: 104969 - DNA, 20 bp, Artificial Sequence
  Description of Artificial Sequence: Synthetic oligonucleotide
  Target: SCN9A; (+) strand; PAM type: YTN; PAM sequence: CTT
tgtgaggagaccatttaaaa

SEQ ID NO: 104970 - DNA, 20 bp, Artificial Sequence
  Description of Artificial Sequence: Synthetic oligonucleotide
  Target: SCN9A; (+) strand; PAM type: YTN; PAM sequence: TTT
gtgaggagaccatttaaaaa

SEQ ID NO: 104971 - DNA, 20 bp, Artificial Sequence
  Description of Artificial Sequence: Synthetic oligonucleotide
  Target: SCN9A; (+) strand; PAM type: YTN; PAM sequence: TTG
tgaggagaccatttaaaaac

SEQ ID NO: 104972 - DNA, 20 bp, Artificial Sequence
  Description of Artificial Sequence: Synthetic oligonucleotide
  Target: SCN9A; (+) strand; PAM type: YTN; PAM sequence: TTT
aaaaacttctagctattttg

SEQ ID NO: 104973 - DNA, 20 bp, Artificial Sequence
  Description of Artificial Sequence: Synthetic oligonucleotide
  Target: SCN9A; (+) strand; PAM type: YTN; PAM sequence: TTA
aaaacttctagctattttga

SEQ ID NO: 104974 - DNA, 20 bp, Artificial Sequence
  Description of Artificial Sequence: Synthetic oligonucleotide
  Target: SCN9A; (+) strand; PAM type: YTN; PAM sequence: CTT
ctagctattttgaaatatac

SEQ ID NO: 104975 - DNA, 20 bp, Artificial Sequence
  Description of Artificial Sequence: Synthetic oligonucleotide
  Target: SCN9A; (+) strand; PAM type: YTN; PAM sequence: TTC
tagctattttgaaatataca

SEQ ID NO: 104976 - DNA, 20 bp, Artificial Sequence
  Description of Artificial Sequence: Synthetic oligonucleotide
  Target: SCN9A; (+) strand; PAM type: YTN; PAM sequence: CTA
gctattttgaaatatacaac

SEQ ID NO: 104977 - DNA, 20 bp, Artificial Sequence
  Description of Artificial Sequence: Synthetic oligonucleotide
  Target: SCN9A; (+) strand; PAM type: YTN; PAM sequence: CTA
ttttgaaatatacaacacat

SEQ ID NO: 104978 - DNA, 20 bp, Artificial Sequence
  Description of Artificial Sequence: Synthetic oligonucleotide
  Target: SCN9A; (+) strand; PAM type: YTN; PAM sequence: TTT
tgaaatatacaacacattat

SEQ ID NO: 104979 - DNA, 20 bp, Artificial Sequence
  Description of Artificial Sequence: Synthetic oligonucleotide
  Target: SCN9A; (+) strand; PAM type: YTN; PAM sequence: TTT
gaaatatacaacacattatg

SEQ ID NO: 104980 - DNA, 20 bp, Artificial Sequence
  Description of Artificial Sequence: Synthetic oligonucleotide
  Target: SCN9A; (+) strand; PAM type: YTN; PAM sequence: TTG
aaatatacaacacattatgg

SEQ ID NO: 104981 - DNA, 20 bp, Artificial Sequence
  Description of Artificial Sequence: Synthetic oligonucleotide
  Target: SCN9A; (+) strand; PAM type: YTN; PAM sequence: TTA
tggttaactctagtcatcca

SEQ ID NO: 104982 - DNA, 20 bp, Artificial Sequence
  Description of Artificial Sequence: Synthetic oligonucleotide
  Target: SCN9A; (+) strand; PAM type: YTN; PAM sequence: TTA
actctagtcatccaacgatt

SEQ ID NO: 104983 - DNA, 20 bp, Artificial Sequence
  Description of Artificial Sequence: Synthetic oligonucleotide
  Target: SCN9A; (+) strand; PAM type: YTN; PAM sequence: CTC
tagtcatccaacgattcaat

SEQ ID NO: 104984 - DNA, 20 bp, Artificial Sequence
  Description of Artificial Sequence: Synthetic oligonucleotide
  Target: SCN9A; (+) strand; PAM type: YTN; PAM sequence: CTA
gtcatccaacgattcaatag

SEQ ID NO: 104985 - DNA, 20 bp, Artificial Sequence
  Description of Artificial Sequence: Synthetic oligonucleotide
  Target: SCN9A; (+) strand; PAM type: YTN; PAM sequence: TTC
aatagaacaccagaacttat

SEQ ID NO: 104986 - DNA, 20 bp, Artificial Sequence
  Description of Artificial Sequence: Synthetic oligonucleotide
  Target: SCN9A; (+) strand; PAM type: YTN; PAM sequence: CTT
attctttctatctcactgta

SEQ ID NO: 104987 - DNA, 20 bp, Artificial Sequence
  Description of Artificial Sequence: Synthetic oligonucleotide
  Target: SCN9A; (+) strand; PAM type: YTN; PAM sequence: TTA
ttctttctatctcactgtag

SEQ ID NO: 104988 - DNA, 20 bp, Artificial Sequence
  Description of Artificial Sequence: Synthetic oligonucleotide
  Target: SCN9A; (+) strand; PAM type: YTN; PAM sequence: TTC
tttctatctcactgtagctt

SEQ ID NO: 104989 - DNA, 20 bp, Artificial Sequence
  Description of Artificial Sequence: Synthetic oligonucleotide
  Target: SCN9A; (+) strand; PAM type: YTN; PAM sequence: CTT
tctatctcactgtagctttg

SEQ ID NO: 104990 - DNA, 20 bp, Artificial Sequence
  Description of Artificial Sequence: Synthetic oligonucleotide
  Target: SCN9A; (+) strand; PAM type: YTN; PAM sequence: TTT
ctatctcactgtagctttgt

SEQ ID NO: 104991 - DNA, 20 bp, Artificial Sequence
  Description of Artificial Sequence: Synthetic oligonucleotide
  Target: SCN9A; (+) strand; PAM type: YTN; PAM sequence: TTC
tatctcactgtagctttgta

SEQ ID NO: 104992 - DNA, 20 bp, Artificial Sequence
  Description of Artificial Sequence: Synthetic oligonucleotide
  Target: SCN9A; (+) strand; PAM type: YTN; PAM sequence: CTA
tctcactgtagctttgtacc

SEQ ID NO: 104993 - DNA, 20 bp, Artificial Sequence
  Description of Artificial Sequence: Synthetic oligonucleotide
  Target: SCN9A; (+) strand; PAM type: YTN; PAM sequence: CTC
actgtagctttgtacctgtt

SEQ ID NO: 104994 - DNA, 20 bp, Artificial Sequence
  Description of Artificial Sequence: Synthetic oligonucleotide
  Target: SCN9A; (+) strand; PAM type: YTN; PAM sequence: CTG
tagctttgtacctgttgacc

SEQ ID NO: 104995 - DNA, 20 bp, Artificial Sequence
  Description of Artificial Sequence: Synthetic oligonucleotide
  Target: SCN9A; (+) strand; PAM type: YTN; PAM sequence: CTT
tgtacctgttgaccaatctt

SEQ ID NO: 104996 - DNA, 20 bp, Artificial Sequence
  Description of Artificial Sequence: Synthetic oligonucleotide
  Target: SCN9A; (+) strand; PAM type: YTN; PAM sequence: TTT
gtacctgttgaccaatcttt

SEQ ID NO: 104997 - DNA, 20 bp, Artificial Sequence
  Description of Artificial Sequence: Synthetic oligonucleotide
  Target: SCN9A; (+) strand; PAM type: YTN; PAM sequence: TTG
tacctgttgaccaatctttc

SEQ ID NO: 104998 - DNA, 20 bp, Artificial Sequence
  Description of Artificial Sequence: Synthetic oligonucleotide
  Target: SCN9A; (+) strand; PAM type: YTN; PAM sequence: CTG
ttgaccaatctttccccaca

SEQ ID NO: 104999 - DNA, 20 bp, Artificial Sequence
  Description of Artificial Sequence: Synthetic oligonucleotide
  Target: SCN9A; (+) strand; PAM type: YTN; PAM sequence: TTG
accaatctttccccacacct

SEQ ID NO: 105000 - DNA, 20 bp, Artificial Sequence
  Description of Artificial Sequence: Synthetic oligonucleotide
  Target: SCN9A; (+) strand; PAM type: YTN; PAM sequence: CTT
tccccacacctcgctcctcc

SEQ ID NO: 105001 - DNA, 20 bp, Artificial Sequence
  Description of Artificial Sequence: Synthetic oligonucleotide
  Target: SCN9A; (+) strand; PAM type: YTN; PAM sequence: TTT
ccccacacctcgctcctcca

SEQ ID NO: 105002 - DNA, 20 bp, Artificial Sequence
  Description of Artificial Sequence: Synthetic oligonucleotide
  Target: SCN9A; (+) strand; PAM type: YTN; PAM sequence: TTC
cccacacctcgctcctccaa

SEQ ID NO: 105003 - DNA, 20 bp, Artificial Sequence
  Description of Artificial Sequence: Synthetic oligonucleotide
  Target: SCN9A; (+) strand; PAM type: YTN; PAM sequence: CTC
gctcctccaagcctcccatc

SEQ ID NO: 105004 - DNA, 20 bp, Artificial Sequence
  Description of Artificial Sequence: Synthetic oligonucleotide
  Target: SCN9A; (+) strand; PAM type: YTN; PAM sequence: CTC
ctccaagcctcccatcctcc

SEQ ID NO: 105005 - DNA, 20 bp, Artificial Sequence
  Description of Artificial Sequence: Synthetic oligonucleotide
  Target: SCN9A; (+) strand; PAM type: YTN; PAM sequence: CTC
caagcctcccatcctccgat

SEQ ID NO: 105006 - DNA, 20 bp, Artificial Sequence
  Description of Artificial Sequence: Synthetic oligonucleotide
  Target: SCN9A; (+) strand; PAM type: YTN; PAM sequence: CTC
ccatcctccgataaccacta

SEQ ID NO: 105007 - DNA, 20 bp, Artificial Sequence
  Description of Artificial Sequence: Synthetic oligonucleotide
  Target: SCN9A; (+) strand; PAM type: YTN; PAM sequence: CTC
cgataaccactattctacta

SEQ ID NO: 105008 - DNA, 20 bp, Artificial Sequence
  Description of Artificial Sequence: Synthetic oligonucleotide
  Target: SCN9A; (+) strand; PAM type: YTN; PAM sequence: CTA
ttctactatctacttctatg

SEQ ID NO: 105009 - DNA, 20 bp, Artificial Sequence
  Description of Artificial Sequence: Synthetic oligonucleotide
  Target: SCN9A; (+) strand; PAM type: YTN; PAM sequence: TTC
tactatctacttctatgaca

SEQ ID NO: 105010 - DNA, 20 bp, Artificial Sequence
  Description of Artificial Sequence: Synthetic oligonucleotide
  Target: SCN9A; (+) strand; PAM type: YTN; PAM sequence: CTA
ctatctacttctatgacaac

SEQ ID NO: 105011 - DNA, 20 bp, Artificial Sequence
  Description of Artificial Sequence: Synthetic oligonucleotide
  Target: SCN9A; (+) strand; PAM type: YTN; PAM sequence: CTA
tctacttctatgacaaccct

SEQ ID NO: 105012 - DNA, 20 bp, Artificial Sequence
  Description of Artificial Sequence: Synthetic oligonucleotide
  Target: SCN9A; (+) strand; PAM type: YTN; PAM sequence: CTA
cttctatgacaaccctttag

SEQ ID NO: 105013 - DNA, 20 bp, Artificial Sequence
  Description of Artificial Sequence: Synthetic oligonucleotide
  Target: SCN9A; (+) strand; PAM type: YTN; PAM sequence: CTT
ctatgacaaccctttagatt

SEQ ID NO: 105014 - DNA, 20 bp, Artificial Sequence
  Description of Artificial Sequence: Synthetic oligonucleotide
  Target: SCN9A; (+) strand; PAM type: YTN; PAM sequence: TTC
tatgacaaccctttagattc

SEQ ID NO: 105015 - DNA, 20 bp, Artificial Sequence
  Description of Artificial Sequence: Synthetic oligonucleotide
  Target: SCN9A; (+) strand; PAM type: YTN; PAM sequence: CTA
tgacaaccctttagattcca

SEQ ID NO: 105016 - DNA, 20 bp, Artificial Sequence
  Description of Artificial Sequence: Synthetic oligonucleotide
  Target: SCN9A; (+) strand; PAM type: YTN; PAM sequence: CTT
tagattccacatatgtgtga

SEQ ID NO: 105017 - DNA, 20 bp, Artificial Sequence
  Description of Artificial Sequence: Synthetic oligonucleotide
  Target: SCN9A; (+) strand; PAM type: YTN; PAM sequence: TTT
agattccacatatgtgtgag

SEQ ID NO: 105018 - DNA, 20 bp, Artificial Sequence
  Description of Artificial Sequence: Synthetic oligonucleotide
  Target: SCN9A; (+) strand; PAM type: YTN; PAM sequence: TTA
gattccacatatgtgtgaga

SEQ ID NO: 105019 - DNA, 20 bp, Artificial Sequence
  Description of Artificial Sequence: Synthetic oligonucleotide
  Target: SCN9A; (+) strand; PAM type: YTN; PAM sequence: TTC
cacatatgtgtgagatattt

SEQ ID NO: 105020 - DNA, 20 bp, Artificial Sequence
  Description of Artificial Sequence: Synthetic oligonucleotide
  Target: SCN9A; (+) strand; PAM type: YTN; PAM sequence: TTT
gactttctgtgcctggctga

SEQ ID NO: 105021 - DNA, 20 bp, Artificial Sequence
  Description of Artificial Sequence: Synthetic oligonucleotide
  Target: SCN9A; (+) strand; PAM type: YTN; PAM sequence: TTG
actttctgtgcctggctgat

SEQ ID NO: 105022 - DNA, 20 bp, Artificial Sequence
  Description of Artificial Sequence: Synthetic oligonucleotide
  Target: SCN9A; (+) strand; PAM type: YTN; PAM sequence: CTT
tctgtgcctggctgatttca

SEQ ID NO: 105023 - DNA, 20 bp, Artificial Sequence
  Description of Artificial Sequence: Synthetic oligonucleotide
  Target: SCN9A; (+) strand; PAM type: YTN; PAM sequence: TTT
ctgtgcctggctgatttcac

SEQ ID NO: 105024 - DNA, 20 bp, Artificial Sequence
  Description of Artificial Sequence: Synthetic oligonucleotide
  Target: SCN9A; (+) strand; PAM type: YTN; PAM sequence: TTC
tgtgcctggctgatttcact

SEQ ID NO: 105025 - DNA, 20 bp, Artificial Sequence
  Description of Artificial Sequence: Synthetic oligonucleotide
  Target: SCN9A; (+) strand; PAM type: YTN; PAM sequence: CTG
tgcctggctgatttcactta

SEQ ID NO: 105026 - DNA, 20 bp, Artificial Sequence
  Description of Artificial Sequence: Synthetic oligonucleotide
  Target: SCN9A; (+) strand; PAM type: YTN; PAM sequence: CTG
gctgatttcacttaacataa

SEQ ID NO: 105027 - DNA, 20 bp, Artificial Sequence
  Description of Artificial Sequence: Synthetic oligonucleotide
  Target: SCN9A; (+) strand; PAM type: YTN; PAM sequence: CTG
atttcacttaacataatgtc

SEQ ID NO: 105028 - DNA, 20 bp, Artificial Sequence
  Description of Artificial Sequence: Synthetic oligonucleotide
  Target: SCN9A; (+) strand; PAM type: YTN; PAM sequence: TTT
cacttaacataatgtcctcc

SEQ ID NO: 105029 - DNA, 20 bp, Artificial Sequence
  Description of Artificial Sequence: Synthetic oligonucleotide
  Target: SCN9A; (+) strand; PAM type: YTN; PAM sequence: TTC
acttaacataatgtcctcca

SEQ ID NO: 105030 - DNA, 20 bp, Artificial Sequence
  Description of Artificial Sequence: Synthetic oligonucleotide
  Target: SCN9A; (+) strand; PAM type: YTN; PAM sequence: CTT
aacataatgtcctccaggtt

SEQ ID NO: 105031 - DNA, 20 bp, Artificial Sequence
  Description of Artificial Sequence: Synthetic oligonucleotide
  Target: SCN9A; (+) strand; PAM type: YTN; PAM sequence: TTA
acataatgtcctccaggttc

SEQ ID NO: 105032 - DNA, 20 bp, Artificial Sequence
  Description of Artificial Sequence: Synthetic oligonucleotide
  Target: SCN9A; (+) strand; PAM type: YTN; PAM sequence: CTC
caggttcattcatgttgcca

SEQ ID NO: 105033 - DNA, 20 bp, Artificial Sequence
  Description of Artificial Sequence: Synthetic oligonucleotide
  Target: SCN9A; (+) strand; PAM type: YTN; PAM sequence: TTC
attcatgttgccacaaataa

SEQ ID NO: 105034 - DNA, 20 bp, Artificial Sequence
  Description of Artificial Sequence: Synthetic oligonucleotide
  Target: SCN9A; (+) strand; PAM type: YTN; PAM sequence: TTC
atgttgccacaaataacagg

SEQ ID NO: 105035 - DNA, 20 bp, Artificial Sequence
  Description of Artificial Sequence: Synthetic oligonucleotide
  Target: SCN9A; (+) strand; PAM type: YTN; PAM sequence: TTG
ccacaaataacaggatttca

SEQ ID NO: 105036 - DNA, 20 bp, Artificial Sequence
  Description of Artificial Sequence: Synthetic oligonucleotide
  Target: SCN9A; (+) strand; PAM type: YTN; PAM sequence: TTT
cattatttcttatggctgaa

SEQ ID NO: 105037 - DNA, 20 bp, Artificial Sequence
  Description of Artificial Sequence: Synthetic oligonucleotide
  Target: SCN9A; (+) strand; PAM type: YTN; PAM sequence: TTC
attatttcttatggctgaat

SEQ ID NO: 105038 - DNA, 20 bp, Artificial Sequence
  Description of Artificial Sequence: Synthetic oligonucleotide
  Target: SCN9A; (+) strand; PAM type: YTN; PAM sequence: TTA
tttcttatggctgaatggcg

SEQ ID NO: 105039 - DNA, 20 bp, Artificial Sequence
  Description of Artificial Sequence: Synthetic oligonucleotide
  Target: SCN9A; (+) strand; PAM type: YTN; PAM sequence: TTT
cttatggctgaatggcgttc

SEQ ID NO: 105040 - DNA, 20 bp, Artificial Sequence
  Description of Artificial Sequence: Synthetic oligonucleotide
  Target: SCN9A; (+) strand; PAM type: YTN; PAM sequence: TTC
ttatggctgaatggcgttca

SEQ ID NO: 105041 - DNA, 20 bp, Artificial Sequence
  Description of Artificial Sequence: Synthetic oligonucleotide
  Target: SCN9A; (+) strand; PAM type: YTN; PAM sequence: CTT
atggctgaatggcgttcaat

SEQ ID NO: 105042 - DNA, 20 bp, Artificial Sequence
  Description of Artificial Sequence: Synthetic oligonucleotide
  Target: SCN9A; (+) strand; PAM type: YTN; PAM sequence: TTA
tggctgaatggcgttcaatt

SEQ ID NO: 105043 - DNA, 20 bp, Artificial Sequence
  Description of Artificial Sequence: Synthetic oligonucleotide
  Target: SCN9A; (+) strand; PAM type: YTN; PAM sequence: CTG
aatggcgttcaatttttctt

SEQ ID NO: 105044 - DNA, 20 bp, Artificial Sequence
  Description of Artificial Sequence: Synthetic oligonucleotide
  Target: SCN9A; (+) strand; PAM type: YTN; PAM sequence: TTC
aatttttcttatgtacattt

SEQ ID NO: 105045 - DNA, 20 bp, Artificial Sequence
  Description of Artificial Sequence: Synthetic oligonucleotide
  Target: SCN9A; (+) strand; PAM type: YTN; PAM sequence: TTT
ttcttatgtacattttcttt

SEQ ID NO: 105046 - DNA, 20 bp, Artificial Sequence
  Description of Artificial Sequence: Synthetic oligonucleotide
  Target: SCN9A; (+) strand; PAM type: YTN; PAM sequence: TTT
tcttatgtacattttcttta

SEQ ID NO: 105047 - DNA, 20 bp, Artificial Sequence
  Description of Artificial Sequence: Synthetic oligonucleotide
  Target: SCN9A; (+) strand; PAM type: YTN; PAM sequence: TTT
cttatgtacattttctttat

SEQ ID NO: 105048 - DNA, 20 bp, Artificial Sequence
  Description of Artificial Sequence: Synthetic oligonucleotide
  Target: SCN9A; (+) strand; PAM type: YTN; PAM sequence: TTC
ttatgtacattttctttatg

SEQ ID NO: 105049 - DNA, 20 bp, Artificial Sequence
  Description of Artificial Sequence: Synthetic oligonucleotide
  Target: SCN9A; (+) strand; PAM type: YTN; PAM sequence: CTT
atgtacattttctttatgca

SEQ ID NO: 105050 - DNA, 20 bp, Artificial Sequence
  Description of Artificial Sequence: Synthetic oligonucleotide
  Target: SCN9A; (+) strand; PAM type: YTN; PAM sequence: TTA
tgtacattttctttatgcat

SEQ ID NO: 105051 - DNA, 20 bp, Artificial Sequence
  Description of Artificial Sequence: Synthetic oligonucleotide
  Target: SCN9A; (+) strand; PAM type: YTN; PAM sequence: TTT
tctttatgcatttatttatt

SEQ ID NO: 105052 - DNA, 20 bp, Artificial Sequence
  Description of Artificial Sequence: Synthetic oligonucleotide
  Target: SCN9A; (+) strand; PAM type: YTN; PAM sequence: TTT
ctttatgcatttatttattt

SEQ ID NO: 105053 - DNA, 20 bp, Artificial Sequence
  Description of Artificial Sequence: Synthetic oligonucleotide
  Target: SCN9A; (+) strand; PAM type: YTN; PAM sequence: TTC
tttatgcatttatttattta

SEQ ID NO: 105054 - DNA, 20 bp, Artificial Sequence
  Description of Artificial Sequence: Synthetic oligonucleotide
  Target: SCN9A; (+) strand; PAM type: YTN; PAM sequence: CTT
tatgcatttatttatttacg

SEQ ID NO: 105055 - DNA, 20 bp, Artificial Sequence
  Description of Artificial Sequence: Synthetic oligonucleotide
  Target: SCN9A; (+) strand; PAM type: YTN; PAM sequence: TTT
atgcatttatttatttacga

SEQ ID NO: 105056 - DNA, 20 bp, Artificial Sequence
  Description of Artificial Sequence: Synthetic oligonucleotide
  Target: SCN9A; (+) strand; PAM type: YTN; PAM sequence: TTA
tgcatttatttatttacgat

SEQ ID NO: 105057 - DNA, 20 bp, Artificial Sequence
  Description of Artificial Sequence: Synthetic oligonucleotide
  Target: SCN9A; (+) strand; PAM type: YTN; PAM sequence: TTT
atttatttacgatcatttag

SEQ ID NO: 105058 - DNA, 20 bp, Artificial Sequence
  Description of Artificial Sequence: Synthetic oligonucleotide
  Target: SCN9A; (+) strand; PAM type: YTN; PAM sequence: TTA
tttatttacgatcatttagg

SEQ ID NO: 105059 - DNA, 20 bp, Artificial Sequence
  Description of Artificial Sequence: Synthetic oligonucleotide
  Target: SCN9A; (+) strand; PAM type: YTN; PAM sequence: TTT
atttacgatcatttaggtta

SEQ ID NO: 105060 - DNA, 20 bp, Artificial Sequence
  Description of Artificial Sequence: Synthetic oligonucleotide
  Target: SCN9A; (+) strand; PAM type: YTN; PAM sequence: TTA
tttacgatcatttaggttaa

SEQ ID NO: 105061 - DNA, 20 bp, Artificial Sequence
  Description of Artificial Sequence: Synthetic oligonucleotide
  Target: SCN9A; (+) strand; PAM type: YTN; PAM sequence: TTT
acgatcatttaggttaatat

SEQ ID NO: 105062 - DNA, 20 bp, Artificial Sequence
  Description of Artificial Sequence: Synthetic oligonucleotide
  Target: SCN9A; (+) strand; PAM type: YTN; PAM sequence: TTA
cgatcatttaggttaatatg

SEQ ID NO: 105063 - DNA, 20 bp, Artificial Sequence
  Description of Artificial Sequence: Synthetic oligonucleotide
  Target: SCN9A; (+) strand; PAM type: YTN; PAM sequence: TTT
aggttaatatgataacttgg

SEQ ID NO: 105064 - DNA, 20 bp, Artificial Sequence
  Description of Artificial Sequence: Synthetic oligonucleotide
  Target: SCN9A; (+) strand; PAM type: YTN; PAM sequence: TTA
ggttaatatgataacttggc

SEQ ID NO: 105065 - DNA, 20 bp, Artificial Sequence
  Description of Artificial Sequence: Synthetic oligonucleotide
  Target: SCN9A; (+) strand; PAM type: YTN; PAM sequence: TTA
atatgataacttggctattg

SEQ ID NO: 105066 - DNA, 20 bp, Artificial Sequence
  Description of Artificial Sequence: Synthetic oligonucleotide
  Target: SCN9A; (+) strand; PAM type: YTN; PAM sequence: CTT
ggctattgtgaacagtgcag

SEQ ID NO: 105067 - DNA, 20 bp, Artificial Sequence
  Description of Artificial Sequence: Synthetic oligonucleotide
  Target: SCN9A; (+) strand; PAM type: YTN; PAM sequence: TTG
gctattgtgaacagtgcagc

SEQ ID NO: 105068 - DNA, 20 bp, Artificial Sequence
  Description of Artificial Sequence: Synthetic oligonucleotide
  Target: SCN9A; (+) strand; PAM type: YTN; PAM sequence: CTA
ttgtgaacagtgcagcaata

SEQ ID NO: 105069 - DNA, 20 bp, Artificial Sequence
  Description of Artificial Sequence: Synthetic oligonucleotide
  Target: SCN9A; (+) strand; PAM type: YTN; PAM sequence: TTG
tgaacagtgcagcaataaac

SEQ ID NO: 105070 - DNA, 20 bp, Artificial Sequence
  Description of Artificial Sequence: Synthetic oligonucleotide
  Target: SCN9A; (+) strand; PAM type: YTN; PAM sequence: TTC
tatgtttactgtatctcttc

SEQ ID NO: 105071 - DNA, 20 bp, Artificial Sequence
  Description of Artificial Sequence: Synthetic oligonucleotide
  Target: SCN9A; (+) strand; PAM type: YTN; PAM sequence: CTA
tgtttactgtatctcttcaa

SEQ ID NO: 105072 - DNA, 20 bp, Artificial Sequence
  Description of Artificial Sequence: Synthetic oligonucleotide
  Target: SCN9A; (+) strand; PAM type: YTN; PAM sequence: TTT
actgtatctcttcaacatac

SEQ ID NO: 105073 - DNA, 20 bp, Artificial Sequence
  Description of Artificial Sequence: Synthetic oligonucleotide
  Target: SCN9A; (+) strand; PAM type: YTN; PAM sequence: TTA
ctgtatctcttcaacatact

SEQ ID NO: 105074 - DNA, 20 bp, Artificial Sequence
  Description of Artificial Sequence: Synthetic oligonucleotide
  Target: SCN9A; (+) strand; PAM type: YTN; PAM sequence: CTG
tatctcttcaacatactgat

SEQ ID NO: 105075 - DNA, 20 bp, Artificial Sequence
  Description of Artificial Sequence: Synthetic oligonucleotide
  Target: SCN9A; (+) strand; PAM type: YTN; PAM sequence: CTC
ttcaacatactgatttcatt

SEQ ID NO: 105076 - DNA, 20 bp, Artificial Sequence
  Description of Artificial Sequence: Synthetic oligonucleotide
  Target: SCN9A; (+) strand; PAM type: YTN; PAM sequence: CTT
caacatactgatttcatttc

SEQ ID NO: 105077 - DNA, 20 bp, Artificial Sequence
  Description of Artificial Sequence: Synthetic oligonucleotide
  Target: SCN9A; (+) strand; PAM type: YTN; PAM sequence: TTC
aacatactgatttcatttca

SEQ ID NO: 105078 - DNA, 20 bp, Artificial Sequence
  Description of Artificial Sequence: Synthetic oligonucleotide
  Target: SCN9A; (+) strand; PAM type: YTN; PAM sequence: CTG
atttcatttcatctggatat

SEQ ID NO: 105079 - DNA, 20 bp, Artificial Sequence
  Description of Artificial Sequence: Synthetic oligonucleotide
  Target: SCN9A; (+) strand; PAM type: YTN; PAM sequence: TTT
catttcatctggatatttac

SEQ ID NO: 105080 - DNA, 20 bp, Artificial Sequence
  Description of Artificial Sequence: Synthetic oligonucleotide
  Target: SCN9A; (+) strand; PAM type: YTN; PAM sequence: TTC
atttcatctggatatttact

SEQ ID NO: 105081 - DNA, 20 bp, Artificial Sequence
  Description of Artificial Sequence: Synthetic oligonucleotide
  Target: SCN9A; (+) strand; PAM type: YTN; PAM sequence: TTT
catctggatatttacttagt

SEQ ID NO: 105082 - DNA, 20 bp, Artificial Sequence
  Description of Artificial Sequence: Synthetic oligonucleotide
  Target: SCN9A; (+) strand; PAM type: YTN; PAM sequence: TTC
atctggatatttacttagta

SEQ ID NO: 105083 - DNA, 20 bp, Artificial Sequence
  Description of Artificial Sequence: Synthetic oligonucleotide
  Target: SCN9A; (+) strand; PAM type: YTN; PAM sequence: CTG
gatatttacttagtattggg

SEQ ID NO: 105084 - DNA, 20 bp, Artificial Sequence
  Description of Artificial Sequence: Synthetic oligonucleotide
  Target: SCN9A; (+) strand; PAM type: YTN; PAM sequence: TTT
acttagtattgggactgctg

SEQ ID NO: 105085 - DNA, 20 bp, Artificial Sequence
  Description of Artificial Sequence: Synthetic oligonucleotide
  Target: SCN9A; (+) strand; PAM type: YTN; PAM sequence: TTA
cttagtattgggactgctgg

SEQ ID NO: 105086 - DNA, 20 bp, Artificial Sequence
  Description of Artificial Sequence: Synthetic oligonucleotide
  Target: SCN9A; (+) strand; PAM type: YTN; PAM sequence: CTT
agtattgggactgctggatc

SEQ ID NO: 105087 - DNA, 20 bp, Artificial Sequence
  Description of Artificial Sequence: Synthetic oligonucleotide
  Target: SCN9A; (+) strand; PAM type: YTN; PAM sequence: TTA
gtattgggactgctggatca

SEQ ID NO: 105088 - DNA, 20 bp, Artificial Sequence
  Description of Artificial Sequence: Synthetic oligonucleotide
  Target: SCN9A; (+) strand; PAM type: YTN; PAM sequence: TTG
ggactgctggatcatatgaa

SEQ ID NO: 105089 - DNA, 20 bp, Artificial Sequence
  Description of Artificial Sequence: Synthetic oligonucleotide
  Target: SCN9A; (+) strand; PAM type: YTN; PAM sequence: CTG
ctggatcatatgaaaattct

SEQ ID NO: 105090 - DNA, 20 bp, Artificial Sequence
  Description of Artificial Sequence: Synthetic oligonucleotide
  Target: SCN9A; (+) strand; PAM type: YTN; PAM sequence: CTG
gatcatatgaaaattctatt

SEQ ID NO: 105091 - DNA, 20 bp, Artificial Sequence
  Description of Artificial Sequence: Synthetic oligonucleotide
  Target: SCN9A; (+) strand; PAM type: YTN; PAM sequence: TTC
tatttttaattttttaaaga

SEQ ID NO: 105092 - DNA, 20 bp, Artificial Sequence
  Description of Artificial Sequence: Synthetic oligonucleotide
  Target: SCN9A; (+) strand; PAM type: YTN; PAM sequence: CTA
tttttaattttttaaagaac

SEQ ID NO: 105093 - DNA, 20 bp, Artificial Sequence
  Description of Artificial Sequence: Synthetic oligonucleotide
  Target: SCN9A; (+) strand; PAM type: YTN; PAM sequence: TTT
ttaattttttaaagaacccc

SEQ ID NO: 105094 - DNA, 20 bp, Artificial Sequence
  Description of Artificial Sequence: Synthetic oligonucleotide
  Target: SCN9A; (+) strand; PAM type: YTN; PAM sequence: TTT
taattttttaaagaaccccc

SEQ ID NO: 105095 - DNA, 20 bp, Artificial Sequence
  Description of Artificial Sequence: Synthetic oligonucleotide
  Target: SCN9A; (+) strand; PAM type: YTN; PAM sequence: TTT
aattttttaaagaaccccca

SEQ ID NO: 105096 - DNA, 20 bp, Artificial Sequence
  Description of Artificial Sequence: Synthetic oligonucleotide
  Target: SCN9A; (+) strand; PAM type: YTN; PAM sequence: TTA
attttttaaagaacccccat

SEQ ID NO: 105097 - DNA, 20 bp, Artificial Sequence
  Description of Artificial Sequence: Synthetic oligonucleotide
  Target: SCN9A; (+) strand; PAM type: YTN; PAM sequence: TTT
tttaaagaacccccatatta

SEQ ID NO: 105098 - DNA, 20 bp, Artificial Sequence
  Description of Artificial Sequence: Synthetic oligonucleotide
  Target: SCN9A; (+) strand; PAM type: YTN; PAM sequence: TTT
ttaaagaacccccatattac

SEQ ID NO: 105099 - DNA, 20 bp, Artificial Sequence
  Description of Artificial Sequence: Synthetic oligonucleotide
  Target: SCN9A; (+) strand; PAM type: YTN; PAM sequence: TTT
taaagaacccccatattact

SEQ ID NO: 105100 - DNA, 20 bp, Artificial Sequence
  Description of Artificial Sequence: Synthetic oligonucleotide
  Target: SCN9A; (+) strand; PAM type: YTN; PAM sequence: TTT
aaagaacccccatattactt

SEQ ID NO: 105101 - DNA, 20 bp, Artificial Sequence
  Description of Artificial Sequence: Synthetic oligonucleotide
  Target: SCN9A; (+) strand; PAM type: YTN; PAM sequence: TTA
aagaacccccatattacttt

SEQ ID NO: 105102 - DNA, 20 bp, Artificial Sequence
  Description of Artificial Sequence: Synthetic oligonucleotide
  Target: SCN9A; (+) strand; PAM type: YTN; PAM sequence: TTA
ctttccataatggtggtact

SEQ ID NO: 105103 - DNA, 20 bp, Artificial Sequence
  Description of Artificial Sequence: Synthetic oligonucleotide
  Target: SCN9A; (+) strand; PAM type: YTN; PAM sequence: CTT
tccataatggtggtactaat

SEQ ID NO: 105104 - DNA, 20 bp, Artificial Sequence
  Description of Artificial Sequence: Synthetic oligonucleotide
  Target: SCN9A; (+) strand; PAM type: YTN; PAM sequence: TTT
ccataatggtggtactaatt

SEQ ID NO: 105105 - DNA, 20 bp, Artificial Sequence
  Description of Artificial Sequence: Synthetic oligonucleotide
  Target: SCN9A; (+) strand; PAM type: YTN; PAM sequence: TTC
cataatggtggtactaattt

SEQ ID NO: 105106 - DNA, 20 bp, Artificial Sequence
  Description of Artificial Sequence: Synthetic oligonucleotide
  Target: SCN9A; (+) strand; PAM type: YTN; PAM sequence: CTA
atttacattctcacaatcag

SEQ ID NO: 105107 - DNA, 20 bp, Artificial Sequence
  Description of Artificial Sequence: Synthetic oligonucleotide
  Target: SCN9A; (+) strand; PAM type: YTN; PAM sequence: TTT
acattctcacaatcagtgtg

SEQ ID NO: 105108 - DNA, 20 bp, Artificial Sequence
  Description of Artificial Sequence: Synthetic oligonucleotide
  Target: SCN9A; (+) strand; PAM type: YTN; PAM sequence: TTA
cattctcacaatcagtgtgt

SEQ ID NO: 105109 - DNA, 20 bp, Artificial Sequence
  Description of Artificial Sequence: Synthetic oligonucleotide
  Target: SCN9A; (+) strand; PAM type: YTN; PAM sequence: TTC
tcacaatcagtgtgtaagga

SEQ ID NO: 105110 - DNA, 20 bp, Artificial Sequence
  Description of Artificial Sequence: Synthetic oligonucleotide
  Target: SCN9A; (+) strand; PAM type: YTN; PAM sequence: CTC
acaatcagtgtgtaaggatt

SEQ ID NO: 105111 - DNA, 20 bp, Artificial Sequence
  Description of Artificial Sequence: Synthetic oligonucleotide
  Target: SCN9A; (+) strand; PAM type: YTN; PAM sequence: TTC
ccttttctccatatccttta

SEQ ID NO: 105112 - DNA, 20 bp, Artificial Sequence
  Description of Artificial Sequence: Synthetic oligonucleotide
  Target: SCN9A; (+) strand; PAM type: YTN; PAM sequence: CTT
ttctccatatcctttaaaca

SEQ ID NO: 105113 - DNA, 20 bp, Artificial Sequence
  Description of Artificial Sequence: Synthetic oligonucleotide
  Target: SCN9A; (+) strand; PAM type: YTN; PAM sequence: TTT
tctccatatcctttaaacac

SEQ ID NO: 105114 - DNA, 20 bp, Artificial Sequence
  Description of Artificial Sequence: Synthetic oligonucleotide
  Target: SCN9A; (+) strand; PAM type: YTN; PAM sequence: TTT
ctccatatcctttaaacact

SEQ ID NO: 105115 - DNA, 20 bp, Artificial Sequence
  Description of Artificial Sequence: Synthetic oligonucleotide
  Target: SCN9A; (+) strand; PAM type: YTN; PAM sequence: TTC
tccatatcctttaaacactt

SEQ ID NO: 105116 - DNA, 20 bp, Artificial Sequence
  Description of Artificial Sequence: Synthetic oligonucleotide
  Target: SCN9A; (+) strand; PAM type: YTN; PAM sequence: CTC
catatcctttaaacacttat

SEQ ID NO: 105117 - DNA, 20 bp, Artificial Sequence
  Description of Artificial Sequence: Synthetic oligonucleotide
  Target: SCN9A; (+) strand; PAM type: YTN; PAM sequence: CTT
taaacacttatatcttttga

SEQ ID NO: 105118 - DNA, 20 bp, Artificial Sequence
  Description of Artificial Sequence: Synthetic oligonucleotide
  Target: SCN9A; (+) strand; PAM type: YTN; PAM sequence: TTT
aaacacttatatcttttgat

SEQ ID NO: 105119 - DNA, 20 bp, Artificial Sequence
  Description of Artificial Sequence: Synthetic oligonucleotide
  Target: SCN9A; (+) strand; PAM type: YTN; PAM sequence: TTA
aacacttatatcttttgatt

SEQ ID NO: 105120 - DNA, 20 bp, Artificial Sequence
  Description of Artificial Sequence: Synthetic oligonucleotide
  Target: SCN9A; (+) strand; PAM type: YTN; PAM sequence: CTT
atatcttttgattttttgat

SEQ ID NO: 105121 - DNA, 20 bp, Artificial Sequence
  Description of Artificial Sequence: Synthetic oligonucleotide
  Target: SCN9A; (+) strand; PAM type: YTN; PAM sequence: TTA
tatcttttgattttttgatg

SEQ ID NO: 105122 - DNA, 20 bp, Artificial Sequence
  Description of Artificial Sequence: Synthetic oligonucleotide
  Target: SCN9A; (+) strand; PAM type: YTN; PAM sequence: CTT
ttgattttttgatggtagcc

SEQ ID NO: 105123 - DNA, 20 bp, Artificial Sequence
  Description of Artificial Sequence: Synthetic oligonucleotide
  Target: SCN9A; (+) strand; PAM type: YTN; PAM sequence: TTT
tgattttttgatggtagcca

SEQ ID NO: 105124 - DNA, 20 bp, Artificial Sequence
  Description of Artificial Sequence: Synthetic oligonucleotide
  Target: SCN9A; (+) strand; PAM type: YTN; PAM sequence: TTT
gattttttgatggtagccat

SEQ ID NO: 105125 - DNA, 20 bp, Artificial Sequence
  Description of Artificial Sequence: Synthetic oligonucleotide
  Target: SCN9A; (+) strand; PAM type: YTN; PAM sequence: TTG
attttttgatggtagccatt

SEQ ID NO: 105126 - DNA, 20 bp, Artificial Sequence
  Description of Artificial Sequence: Synthetic oligonucleotide
  Target: SCN9A; (+) strand; PAM type: YTN; PAM sequence: TTT
tttgatggtagccattttaa

SEQ ID NO: 105127 - DNA, 20 bp, Artificial Sequence
  Description of Artificial Sequence: Synthetic oligonucleotide
  Target: SCN9A; (+) strand; PAM type: YTN; PAM sequence: TTT
ttgatggtagccattttaac

SEQ ID NO: 105128 - DNA, 20 bp, Artificial Sequence
  Description of Artificial Sequence: Synthetic oligonucleotide
  Target: SCN9A; (+) strand; PAM type: YTN; PAM sequence: TTT
tgatggtagccattttaact

SEQ ID NO: 105129 - DNA, 20 bp, Artificial Sequence
  Description of Artificial Sequence: Synthetic oligonucleotide
  Target: SCN9A; (+) strand; PAM type: YTN; PAM sequence: TTT
gatggtagccattttaacta

SEQ ID NO: 105130 - DNA, 20 bp, Artificial Sequence
  Description of Artificial Sequence: Synthetic oligonucleotide
  Target: SCN9A; (+) strand; PAM type: YTN; PAM sequence: TTG
atggtagccattttaactag

SEQ ID NO: 105131 - DNA, 20 bp, Artificial Sequence
  Description of Artificial Sequence: Synthetic oligonucleotide
  Target: SCN9A; (+) strand; PAM type: YTN; PAM sequence: TTT
taactagggtgaggagatac

SEQ ID NO: 105132 - DNA, 20 bp, Artificial Sequence
  Description of Artificial Sequence: Synthetic oligonucleotide
  Target: SCN9A; (+) strand; PAM type: YTN; PAM sequence: TTT
aactagggtgaggagatacc

SEQ ID NO: 105133 - DNA, 20 bp, Artificial Sequence
  Description of Artificial Sequence: Synthetic oligonucleotide
  Target: SCN9A; (+) strand; PAM type: YTN; PAM sequence: TTA
actagggtgaggagatacct

SEQ ID NO: 105134 - DNA, 20 bp, Artificial Sequence
  Description of Artificial Sequence: Synthetic oligonucleotide
  Target: SCN9A; (+) strand; PAM type: YTN; PAM sequence: CTA
gggtgaggagatacctcaag

SEQ ID NO: 105135 - DNA, 20 bp, Artificial Sequence
  Description of Artificial Sequence: Synthetic oligonucleotide
  Target: SCN9A; (+) strand; PAM type: YTN; PAM sequence: CTC
aagataggtttgatttgcat

SEQ ID NO: 105136 - DNA, 20 bp, Artificial Sequence
  Description of Artificial Sequence: Synthetic oligonucleotide
  Target: SCN9A; (+) strand; PAM type: YTN; PAM sequence: TTT
gatttgcatttccctggtga

SEQ ID NO: 105137 - DNA, 20 bp, Artificial Sequence
  Description of Artificial Sequence: Synthetic oligonucleotide
  Target: SCN9A; (+) strand; PAM type: YTN; PAM sequence: TTG
atttgcatttccctggtgat

SEQ ID NO: 105138 - DNA, 20 bp, Artificial Sequence
  Description of Artificial Sequence: Synthetic oligonucleotide
  Target: SCN9A; (+) strand; PAM type: YTN; PAM sequence: TTT
gcatttccctggtgattagt

SEQ ID NO: 105139 - DNA, 20 bp, Artificial Sequence
  Description of Artificial Sequence: Synthetic oligonucleotide
  Target: SCN9A; (+) strand; PAM type: YTN; PAM sequence: TTG
catttccctggtgattagtg

SEQ ID NO: 105140 - DNA, 20 bp, Artificial Sequence
  Description of Artificial Sequence: Synthetic oligonucleotide
  Target: SCN9A; (+) strand; PAM type: YTN; PAM sequence: TTT
ccctggtgattagtgatgtt

SEQ ID NO: 105141 - DNA, 20 bp, Artificial Sequence
  Description of Artificial Sequence: Synthetic oligonucleotide
  Target: SCN9A; (+) strand; PAM type: YTN; PAM sequence: TTC
cctggtgattagtgatgttg

SEQ ID NO: 105142 - DNA, 20 bp, Artificial Sequence
  Description of Artificial Sequence: Synthetic oligonucleotide
  Target: SCN9A; (+) strand; PAM type: YTN; PAM sequence: CTG
gtgattagtgatgttgagca

SEQ ID NO: 105143 - DNA, 20 bp, Artificial Sequence
  Description of Artificial Sequence: Synthetic oligonucleotide
  Target: SCN9A; (+) strand; PAM type: YTN; PAM sequence: TTA
gtgatgttgagcatattttc

SEQ ID NO: 105144 - DNA, 20 bp, Artificial Sequence
  Description of Artificial Sequence: Synthetic oligonucleotide
  Target: SCN9A; (+) strand; PAM type: YTN; PAM sequence: TTG
agcatattttcatttatctg

SEQ ID NO: 105145 - DNA, 20 bp, Artificial Sequence
  Description of Artificial Sequence: Synthetic oligonucleotide
  Target: SCN9A; (+) strand; PAM type: YTN; PAM sequence: TTT
tcatttatctgttggcattt

SEQ ID NO: 105146 - DNA, 20 bp, Artificial Sequence
  Description of Artificial Sequence: Synthetic oligonucleotide
  Target: SCN9A; (+) strand; PAM type: YTN; PAM sequence: TTT
catttatctgttggcatttc

SEQ ID NO: 105147 - DNA, 20 bp, Artificial Sequence
  Description of Artificial Sequence: Synthetic oligonucleotide
  Target: SCN9A; (+) strand; PAM type: YTN; PAM sequence: TTC
atttatctgttggcatttct

SEQ ID NO: 105148 - DNA, 20 bp, Artificial Sequence
  Description of Artificial Sequence: Synthetic oligonucleotide
  Target: SCN9A; (+) strand; PAM type: YTN; PAM sequence: TTT
atctgttggcatttctttgt

SEQ ID NO: 105149 - DNA, 20 bp, Artificial Sequence
  Description of Artificial Sequence: Synthetic oligonucleotide
  Target: SCN9A; (+) strand; PAM type: YTN; PAM sequence: TTA
tctgttggcatttctttgtc

SEQ ID NO: 105150 - DNA, 20 bp, Artificial Sequence
  Description of Artificial Sequence: Synthetic oligonucleotide
  Target: SCN9A; (+) strand; PAM type: YTN; PAM sequence: CTG
ttggcatttctttgtcttct

SEQ ID NO: 105151 - DNA, 20 bp, Artificial Sequence
  Description of Artificial Sequence: Synthetic oligonucleotide
  Target: SCN9A; (+) strand; PAM type: YTN; PAM sequence: TTG
gcatttctttgtcttctttt

SEQ ID NO: 105152 - DNA, 20 bp, Artificial Sequence
  Description of Artificial Sequence: Synthetic oligonucleotide
  Target: SCN9A; (+) strand; PAM type: YTN; PAM sequence: TTT
ctttgtcttcttttgagaaa

SEQ ID NO: 105153 - DNA, 20 bp, Artificial Sequence
  Description of Artificial Sequence: Synthetic oligonucleotide
  Target: SCN9A; (+) strand; PAM type: YTN; PAM sequence: TTC
tttgtcttcttttgagaaat

SEQ ID NO: 105154 - DNA, 20 bp, Artificial Sequence
  Description of Artificial Sequence: Synthetic oligonucleotide
  Target: SCN9A; (+) strand; PAM type: YTN; PAM sequence: CTT
tgtcttcttttgagaaatat

SEQ ID NO: 105155 - DNA, 20 bp, Artificial Sequence
  Description of Artificial Sequence: Synthetic oligonucleotide
  Target: SCN9A; (+) strand; PAM type: YTN; PAM sequence: TTT
gtcttcttttgagaaatatc

SEQ ID NO: 105156 - DNA, 20 bp, Artificial Sequence
  Description of Artificial Sequence: Synthetic oligonucleotide
  Target: SCN9A; (+) strand; PAM type: YTN; PAM sequence: TTG
tcttcttttgagaaatatct

SEQ ID NO: 105157 - DNA, 20 bp, Artificial Sequence
  Description of Artificial Sequence: Synthetic oligonucleotide
  Target: SCN9A; (+) strand; PAM type: YTN; PAM sequence: CTT
cttttgagaaatatctattc

SEQ ID NO: 105158 - DNA, 20 bp, Artificial Sequence
  Description of Artificial Sequence: Synthetic oligonucleotide
  Target: SCN9A; (+) strand; PAM type: YTN; PAM sequence: TTC
ttttgagaaatatctattca

SEQ ID NO: 105159 - DNA, 20 bp, Artificial Sequence
  Description of Artificial Sequence: Synthetic oligonucleotide
  Target: SCN9A; (+) strand; PAM type: YTN; PAM sequence: CTT
ttgagaaatatctattcagg

SEQ ID NO: 105160 - DNA, 20 bp, Artificial Sequence
  Description of Artificial Sequence: Synthetic oligonucleotide
  Target: SCN9A; (+) strand; PAM type: YTN; PAM sequence: TTT
tgagaaatatctattcaggt

SEQ ID NO: 105161 - DNA, 20 bp, Artificial Sequence
  Description of Artificial Sequence: Synthetic oligonucleotide
  Target: SCN9A; (+) strand; PAM type: YTN; PAM sequence: TTT
gagaaatatctattcaggtc

SEQ ID NO: 105162 - DNA, 20 bp, Artificial Sequence
  Description of Artificial Sequence: Synthetic oligonucleotide
  Target: SCN9A; (+) strand; PAM type: YTN; PAM sequence: TTG
agaaatatctattcaggtct

SEQ ID NO: 105163 - DNA, 20 bp, Artificial Sequence
  Description of Artificial Sequence: Synthetic oligonucleotide
  Target: SCN9A; (+) strand; PAM type: YTN; PAM sequence: CTA
ttcaggtcttttgtccattt

SEQ ID NO: 105164 - DNA, 20 bp, Artificial Sequence
  Description of Artificial Sequence: Synthetic oligonucleotide
  Target: SCN9A; (+) strand; PAM type: YTN; PAM sequence: TTC
aggtcttttgtccatttttg

SEQ ID NO: 105165 - DNA, 20 bp, Artificial Sequence
  Description of Artificial Sequence: Synthetic oligonucleotide
  Target: SCN9A; (+) strand; PAM type: YTN; PAM sequence: CTT
ttgtccatttttgaattatt

SEQ ID NO: 105166 - DNA, 20 bp, Artificial Sequence
  Description of Artificial Sequence: Synthetic oligonucleotide
  Target: SCN9A; (+) strand; PAM type: YTN; PAM sequence: TTT
tgtccatttttgaattattt

SEQ ID NO: 105167 - DNA, 20 bp, Artificial Sequence
  Description of Artificial Sequence: Synthetic oligonucleotide
  Target: SCN9A; (+) strand; PAM type: YTN; PAM sequence: TTT
gtccatttttgaattatttg

SEQ ID NO: 105168 - DNA, 20 bp, Artificial Sequence
  Description of Artificial Sequence: Synthetic oligonucleotide
  Target: SCN9A; (+) strand; PAM type: YTN; PAM sequence: TTG
tccatttttgaattatttgt

SEQ ID NO: 105169 - DNA, 20 bp, Artificial Sequence
  Description of Artificial Sequence: Synthetic oligonucleotide
  Target: SCN9A; (+) strand; PAM type: YTN; PAM sequence: TTT
ttgaattatttgtttttttt

SEQ ID NO: 105170 - DNA, 20 bp, Artificial Sequence
  Description of Artificial Sequence: Synthetic oligonucleotide
  Target: SCN9A; (+) strand; PAM type: YTN; PAM sequence: TTT
tgaattatttgttttttttg

SEQ ID NO: 105171 - DNA, 20 bp, Artificial Sequence
  Description of Artificial Sequence: Synthetic oligonucleotide
  Target: SCN9A; (+) strand; PAM type: YTN; PAM sequence: TTT
gaattatttgttttttttgt

SEQ ID NO: 105172 - DNA, 20 bp, Artificial Sequence
  Description of Artificial Sequence: Synthetic oligonucleotide
  Target: SCN9A; (+) strand; PAM type: YTN; PAM sequence: TTG
aattatttgttttttttgtc

SEQ ID NO: 105173 - DNA, 20 bp, Artificial Sequence
  Description of Artificial Sequence: Synthetic oligonucleotide
  Target: SCN9A; (+) strand; PAM type: YTN; PAM sequence: TTA
tttgttttttttgtcgttgt

SEQ ID NO: 105174 - DNA, 20 bp, Artificial Sequence
  Description of Artificial Sequence: Synthetic oligonucleotide
  Target: SCN9A; (+) strand; PAM type: YTN; PAM sequence: TTT
gttttttttgtcgttgttga

SEQ ID NO: 105175 - DNA, 20 bp, Artificial Sequence
  Description of Artificial Sequence: Synthetic oligonucleotide
  Target: SCN9A; (+) strand; PAM type: YTN; PAM sequence: TTG
ttttttttgtcgttgttgag

SEQ ID NO: 105176 - DNA, 20 bp, Artificial Sequence
  Description of Artificial Sequence: Synthetic oligonucleotide
  Target: SCN9A; (+) strand; PAM type: YTN; PAM sequence: TTT
tttttgtcgttgttgagttg

SEQ ID NO: 105177 - DNA, 20 bp, Artificial Sequence
  Description of Artificial Sequence: Synthetic oligonucleotide
  Target: SCN9A; (+) strand; PAM type: YTN; PAM sequence: TTT
ttttgtcgttgttgagttgt

SEQ ID NO: 105178 - DNA, 20 bp, Artificial Sequence
  Description of Artificial Sequence: Synthetic oligonucleotide
  Target: SCN9A; (+) strand; PAM type: YTN; PAM sequence: TTT
tttgtcgttgttgagttgtt

SEQ ID NO: 105179 - DNA, 20 bp, Artificial Sequence
  Description of Artificial Sequence: Synthetic oligonucleotide
  Target: SCN9A; (+) strand; PAM type: YTN; PAM sequence: TTT
ttgtcgttgttgagttgttt

SEQ ID NO: 105180 - DNA, 20 bp, Artificial Sequence
  Description of Artificial Sequence: Synthetic oligonucleotide
  Target: SCN9A; (+) strand; PAM type: YTN; PAM sequence: TTT
tgtcgttgttgagttgtttg

SEQ ID NO: 105181 - DNA, 20 bp, Artificial Sequence
  Description of Artificial Sequence: Synthetic oligonucleotide
  Target: SCN9A; (+) strand; PAM type: YTN; PAM sequence: TTT
gtcgttgttgagttgtttga

SEQ ID NO: 105182 - DNA, 20 bp, Artificial Sequence
  Description of Artificial Sequence: Synthetic oligonucleotide
  Target: SCN9A; (+) strand; PAM type: YTN; PAM sequence: TTG
tcgttgttgagttgtttgag

SEQ ID NO: 105183 - DNA, 20 bp, Artificial Sequence
  Description of Artificial Sequence: Synthetic oligonucleotide
  Target: SCN9A; (+) strand; PAM type: YTN; PAM sequence: TTG
ttgagttgtttgagttcctt

SEQ ID NO: 105184 - DNA, 20 bp, Artificial Sequence
  Description of Artificial Sequence: Synthetic oligonucleotide
  Target: SCN9A; (+) strand; PAM type: YTN; PAM sequence: TTG
agttgtttgagttccttgta

SEQ ID NO: 105185 - DNA, 20 bp, Artificial Sequence
  Description of Artificial Sequence: Synthetic oligonucleotide
  Target: SCN9A; (+) strand; PAM type: YTN; PAM sequence: TTG
tttgagttccttgtatgttt

SEQ ID NO: 105186 - DNA, 20 bp, Artificial Sequence
  Description of Artificial Sequence: Synthetic oligonucleotide
  Target: SCN9A; (+) strand; PAM type: YTN; PAM sequence: TTT
gagttccttgtatgttttag

SEQ ID NO: 105187 - DNA, 20 bp, Artificial Sequence
  Description of Artificial Sequence: Synthetic oligonucleotide
  Target: SCN9A; (+) strand; PAM type: YTN; PAM sequence: TTG
agttccttgtatgttttaga

SEQ ID NO: 105188 - DNA, 20 bp, Artificial Sequence
  Description of Artificial Sequence: Synthetic oligonucleotide
  Target: SCN9A; (+) strand; PAM type: YTN; PAM sequence: TTC
cttgtatgttttagatatta

SEQ ID NO: 105189 - DNA, 20 bp, Artificial Sequence
  Description of Artificial Sequence: Synthetic oligonucleotide
  Target: SCN9A; (+) strand; PAM type: YTN; PAM sequence: CTT
gtatgttttagatattaacc

SEQ ID NO: 105190 - DNA, 20 bp, Artificial Sequence
  Description of Artificial Sequence: Synthetic oligonucleotide
  Target: SCN9A; (+) strand; PAM type: YTN; PAM sequence: TTG
tatgttttagatattaaccc

SEQ ID NO: 105191 - DNA, 20 bp, Artificial Sequence
  Description of Artificial Sequence: Synthetic oligonucleotide
  Target: SCN9A; (+) strand; PAM type: YTN; PAM sequence: TTT
tagatattaacccattatca

SEQ ID NO: 105192 - DNA, 20 bp, Artificial Sequence
  Description of Artificial Sequence: Synthetic oligonucleotide
  Target: SCN9A; (+) strand; PAM type: YTN; PAM sequence: TTT
agatattaacccattatcag

SEQ ID NO: 105193 - DNA, 20 bp, Artificial Sequence
  Description of Artificial Sequence: Synthetic oligonucleotide
  Target: SCN9A; (+) strand; PAM type: YTN; PAM sequence: TTA
gatattaacccattatcaga

SEQ ID NO: 105194 - DNA, 20 bp, Artificial Sequence
  Description of Artificial Sequence: Synthetic oligonucleotide
  Target: SCN9A; (+) strand; PAM type: YTN; PAM sequence: TTA
acccattatcagatgcatag

SEQ ID NO: 105195 - DNA, 20 bp, Artificial Sequence
  Description of Artificial Sequence: Synthetic oligonucleotide
  Target: SCN9A; (+) strand; PAM type: YTN; PAM sequence: TTA
tcagatgcatagtttacaaa

SEQ ID NO: 105196 - DNA, 20 bp, Artificial Sequence
  Description of Artificial Sequence: Synthetic oligonucleotide
  Target: SCN9A; (+) strand; PAM type: YTN; PAM sequence: TTT
acaaatttattttcccattc

SEQ ID NO: 105197 - DNA, 20 bp, Artificial Sequence
  Description of Artificial Sequence: Synthetic oligonucleotide
  Target: SCN9A; (+) strand; PAM type: YTN; PAM sequence: TTA
caaatttattttcccattct

SEQ ID NO: 105198 - DNA, 20 bp, Artificial Sequence
  Description of Artificial Sequence: Synthetic oligonucleotide
  Target: SCN9A; (+) strand; PAM type: YTN; PAM sequence: TTT
attttcccattctgtaggtt

SEQ ID NO: 105199 - DNA, 20 bp, Artificial Sequence
  Description of Artificial Sequence: Synthetic oligonucleotide
  Target: SCN9A; (+) strand; PAM type: YTN; PAM sequence: TTA
ttttcccattctgtaggtta

SEQ ID NO: 105200 - DNA, 20 bp, Artificial Sequence
  Description of Artificial Sequence: Synthetic oligonucleotide
  Target: SCN9A; (+) strand; PAM type: YTN; PAM sequence: TTT
tcccattctgtaggttatct

SEQ ID NO: 105201 - DNA, 20 bp, Artificial Sequence
  Description of Artificial Sequence: Synthetic oligonucleotide
  Target: SCN9A; (+) strand; PAM type: YTN; PAM sequence: TTT
cccattctgtaggttatctc

SEQ ID NO: 105202 - DNA, 20 bp, Artificial Sequence
  Description of Artificial Sequence: Synthetic oligonucleotide
  Target: SCN9A; (+) strand; PAM type: YTN; PAM sequence: TTC
ccattctgtaggttatctct

SEQ ID NO: 105203 - DNA, 20 bp, Artificial Sequence
  Description of Artificial Sequence: Synthetic oligonucleotide
  Target: SCN9A; (+) strand; PAM type: YTN; PAM sequence: TTC
tgtaggttatctcttcactc

SEQ ID NO: 105204 - DNA, 20 bp, Artificial Sequence
  Description of Artificial Sequence: Synthetic oligonucleotide
  Target: SCN9A; (+) strand; PAM type: YTN; PAM sequence: CTG
taggttatctcttcactcta

SEQ ID NO: 105205 - DNA, 20 bp, Artificial Sequence
  Description of Artificial Sequence: Synthetic oligonucleotide
  Target: SCN9A; (+) strand; PAM type: YTN; PAM sequence: TTA
tctcttcactctattgattg

SEQ ID NO: 105206 - DNA, 20 bp, Artificial Sequence
  Description of Artificial Sequence: Synthetic oligonucleotide
  Target: SCN9A; (+) strand; PAM type: YTN; PAM sequence: CTC
ttcactctattgattgtttg

SEQ ID NO: 105207 - DNA, 20 bp, Artificial Sequence
  Description of Artificial Sequence: Synthetic oligonucleotide
  Target: SCN9A; (+) strand; PAM type: YTN; PAM sequence: CTT
cactctattgattgtttgcc

SEQ ID NO: 105208 - DNA, 20 bp, Artificial Sequence
  Description of Artificial Sequence: Synthetic oligonucleotide
  Target: SCN9A; (+) strand; PAM type: YTN; PAM sequence: TTC
actctattgattgtttgcct

SEQ ID NO: 105209 - DNA, 20 bp, Artificial Sequence
  Description of Artificial Sequence: Synthetic oligonucleotide
  Target: SCN9A; (+) strand; PAM type: YTN; PAM sequence: CTC
tattgattgtttgccttgct

SEQ ID NO: 105210 - DNA, 20 bp, Artificial Sequence
  Description of Artificial Sequence: Synthetic oligonucleotide
  Target: SCN9A; (+) strand; PAM type: YTN; PAM sequence: CTA
ttgattgtttgccttgctgt

SEQ ID NO: 105211 - DNA, 20 bp, Artificial Sequence
  Description of Artificial Sequence: Synthetic oligonucleotide
  Target: SCN9A; (+) strand; PAM type: YTN; PAM sequence: TTG
attgtttgccttgctgtgca

SEQ ID NO: 105212 - DNA, 20 bp, Artificial Sequence
  Description of Artificial Sequence: Synthetic oligonucleotide
  Target: SCN9A; (+) strand; PAM type: YTN; PAM sequence: TTG
tttgccttgctgtgcagaag

SEQ ID NO: 105213 - DNA, 20 bp, Artificial Sequence
  Description of Artificial Sequence: Synthetic oligonucleotide
  Target: SCN9A; (+) strand; PAM type: YTN; PAM sequence: TTT
gccttgctgtgcagaagctt

SEQ ID NO: 105214 - DNA, 20 bp, Artificial Sequence
  Description of Artificial Sequence: Synthetic oligonucleotide
  Target: SCN9A; (+) strand; PAM type: YTN; PAM sequence: TTG
ccttgctgtgcagaagcttt

SEQ ID NO: 105215 - DNA, 20 bp, Artificial Sequence
  Description of Artificial Sequence: Synthetic oligonucleotide
  Target: SCN9A; (+) strand; PAM type: YTN; PAM sequence: CTT
gctgtgcagaagctttttag

SEQ ID NO: 105216 - DNA, 20 bp, Artificial Sequence
  Description of Artificial Sequence: Synthetic oligonucleotide
  Target: SCN9A; (+) strand; PAM type: YTN; PAM sequence: TTG
ctgtgcagaagctttttagt

SEQ ID NO: 105217 - DNA, 20 bp, Artificial Sequence
  Description of Artificial Sequence: Synthetic oligonucleotide
  Target: SCN9A; (+) strand; PAM type: YTN; PAM sequence: CTG
tgcagaagctttttagttta

SEQ ID NO: 105218 - DNA, 20 bp, Artificial Sequence
  Description of Artificial Sequence: Synthetic oligonucleotide
  Target: SCN9A; (+) strand; PAM type: YTN; PAM sequence: CTT
tttagtttaatataatccaa

SEQ ID NO: 105219 - DNA, 20 bp, Artificial Sequence
  Description of Artificial Sequence: Synthetic oligonucleotide
  Target: SCN9A; (+) strand; PAM type: YTN; PAM sequence: TTT
ttagtttaatataatccaat

SEQ ID NO: 105220 - DNA, 20 bp, Artificial Sequence
  Description of Artificial Sequence: Synthetic oligonucleotide
  Target: SCN9A; (+) strand; PAM type: YTN; PAM sequence: TTT
tagtttaatataatccaatt

SEQ ID NO: 105221 - DNA, 20 bp, Artificial Sequence
  Description of Artificial Sequence: Synthetic oligonucleotide
  Target: SCN9A; (+) strand; PAM type: YTN; PAM sequence: TTT
agtttaatataatccaattt

SEQ ID NO: 105222 - DNA, 20 bp, Artificial Sequence
  Description of Artificial Sequence: Synthetic oligonucleotide
  Target: SCN9A; (+) strand; PAM type: YTN; PAM sequence: TTA
gtttaatataatccaatttg

SEQ ID NO: 105223 - DNA, 20 bp, Artificial Sequence
  Description of Artificial Sequence: Synthetic oligonucleotide
  Target: SCN9A; (+) strand; PAM type: YTN; PAM sequence: TTT
aatataatccaatttgtcta

SEQ ID NO: 105224 - DNA, 20 bp, Artificial Sequence
  Description of Artificial Sequence: Synthetic oligonucleotide
  Target: SCN9A; (+) strand; PAM type: YTN; PAM sequence: TTA
atataatccaatttgtctat

SEQ ID NO: 105225 - DNA, 20 bp, Artificial Sequence
  Description of Artificial Sequence: Synthetic oligonucleotide
  Target: SCN9A; (+) strand; PAM type: YTN; PAM sequence: TTT
gtctatatttgcttttgttg

SEQ ID NO: 105226 - DNA, 20 bp, Artificial Sequence
  Description of Artificial Sequence: Synthetic oligonucleotide
  Target: SCN9A; (+) strand; PAM type: YTN; PAM sequence: TTG
tctatatttgcttttgttgc

SEQ ID NO: 105227 - DNA, 20 bp, Artificial Sequence
  Description of Artificial Sequence: Synthetic oligonucleotide
  Target: SCN9A; (+) strand; PAM type: YTN; PAM sequence: CTA
tatttgcttttgttgcctgt

SEQ ID NO: 105228 - DNA, 20 bp, Artificial Sequence
  Description of Artificial Sequence: Synthetic oligonucleotide
  Target: SCN9A; (+) strand; PAM type: YTN; PAM sequence: TTT
gcttttgttgcctgtgcttt

SEQ ID NO: 105229 - DNA, 20 bp, Artificial Sequence
  Description of Artificial Sequence: Synthetic oligonucleotide
  Target: SCN9A; (+) strand; PAM type: YTN; PAM sequence: TTG
cttttgttgcctgtgctttt

SEQ ID NO: 105230 - DNA, 20 bp, Artificial Sequence
  Description of Artificial Sequence: Synthetic oligonucleotide
  Target: SCN9A; (+) strand; PAM type: YTN; PAM sequence: CTT
ttgttgcctgtgctttttag

SEQ ID NO: 105231 - DNA, 20 bp, Artificial Sequence
  Description of Artificial Sequence: Synthetic oligonucleotide
  Target: SCN9A; (+) strand; PAM type: YTN; PAM sequence: TTT
tgttgcctgtgctttttagg

SEQ ID NO: 105232 - DNA, 20 bp, Artificial Sequence
  Description of Artificial Sequence: Synthetic oligonucleotide
  Target: SCN9A; (+) strand; PAM type: YTN; PAM sequence: TTT
gttgcctgtgctttttaggt

SEQ ID NO: 105233 - DNA, 20 bp, Artificial Sequence
  Description of Artificial Sequence: Synthetic oligonucleotide
  Target: SCN9A; (+) strand; PAM type: YTN; PAM sequence: TTG
ttgcctgtgctttttaggtt

SEQ ID NO: 105234 - DNA, 20 bp, Artificial Sequence
  Description of Artificial Sequence: Synthetic oligonucleotide
  Target: SCN9A; (+) strand; PAM type: YTN; PAM sequence: TTG
cctgtgctttttaggtttta

SEQ ID NO: 105235 - DNA, 20 bp, Artificial Sequence
  Description of Artificial Sequence: Synthetic oligonucleotide
  Target: SCN9A; (+) strand; PAM type: YTN; PAM sequence: CTG
tgctttttaggttttatcca

SEQ ID NO: 105236 - DNA, 20 bp, Artificial Sequence
  Description of Artificial Sequence: Synthetic oligonucleotide
  Target: SCN9A; (+) strand; PAM type: YTN; PAM sequence: CTT
tttaggttttatccaaaaaa

SEQ ID NO: 105237 - DNA, 20 bp, Artificial Sequence
  Description of Artificial Sequence: Synthetic oligonucleotide
  Target: SCN9A; (+) strand; PAM type: YTN; PAM sequence: TTT
ttaggttttatccaaaaaaa

SEQ ID NO: 105238 - DNA, 20 bp, Artificial Sequence
  Description of Artificial Sequence: Synthetic oligonucleotide
  Target: SCN9A; (+) strand; PAM type: YTN; PAM sequence: TTT
taggttttatccaaaaaaat

SEQ ID NO: 105239 - DNA, 20 bp, Artificial Sequence
  Description of Artificial Sequence: Synthetic oligonucleotide
  Target: SCN9A; (+) strand; PAM type: YTN; PAM sequence: TTT
aggttttatccaaaaaaatc

SEQ ID NO: 105240 - DNA, 20 bp, Artificial Sequence
  Description of Artificial Sequence: Synthetic oligonucleotide
  Target: SCN9A; (+) strand; PAM type: YTN; PAM sequence: TTA
ggttttatccaaaaaaatcc

SEQ ID NO: 105241 - DNA, 20 bp, Artificial Sequence
  Description of Artificial Sequence: Synthetic oligonucleotide
  Target: SCN9A; (+) strand; PAM type: YTN; PAM sequence: TTT
tatccaaaaaaatccttgcc

SEQ ID NO: 105242 - DNA, 20 bp, Artificial Sequence
  Description of Artificial Sequence: Synthetic oligonucleotide
  Target: SCN9A; (+) strand; PAM type: YTN; PAM sequence: TTT
atccaaaaaaatccttgcct

SEQ ID NO: 105243 - DNA, 20 bp, Artificial Sequence
  Description of Artificial Sequence: Synthetic oligonucleotide
  Target: SCN9A; (+) strand; PAM type: YTN; PAM sequence: TTA
tccaaaaaaatccttgccta

SEQ ID NO: 105244 - DNA, 20 bp, Artificial Sequence
  Description of Artificial Sequence: Synthetic oligonucleotide
  Target: SCN9A; (+) strand; PAM type: YTN; PAM sequence: CTT
gcctagaacaacatcatgaa

SEQ ID NO: 105245 - DNA, 20 bp, Artificial Sequence
  Description of Artificial Sequence: Synthetic oligonucleotide
  Target: SCN9A; (+) strand; PAM type: YTN; PAM sequence: TTG
cctagaacaacatcatgaag

SEQ ID NO: 105246 - DNA, 20 bp, Artificial Sequence
  Description of Artificial Sequence: Synthetic oligonucleotide
  Target: SCN9A; (+) strand; PAM type: YTN; PAM sequence: CTA
gaacaacatcatgaagcttt

SEQ ID NO: 105247 - DNA, 20 bp, Artificial Sequence
  Description of Artificial Sequence: Synthetic oligonucleotide
  Target: SCN9A; (+) strand; PAM type: YTN; PAM sequence: CTT
tccccctgttttttttcttc

SEQ ID NO: 105248 - DNA, 20 bp, Artificial Sequence
  Description of Artificial Sequence: Synthetic oligonucleotide
  Target: SCN9A; (+) strand; PAM type: YTN; PAM sequence: TTT
ccccctgttttttttcttct

SEQ ID NO: 105249 - DNA, 20 bp, Artificial Sequence
  Description of Artificial Sequence: Synthetic oligonucleotide
  Target: SCN9A; (+) strand; PAM type: YTN; PAM sequence: TTC
cccctgttttttttcttctc

SEQ ID NO: 105250 - DNA, 20 bp, Artificial Sequence
  Description of Artificial Sequence: Synthetic oligonucleotide
  Target: SCN9A; (+) strand; PAM type: YTN; PAM sequence: CTG
ttttttttcttctctaatag

SEQ ID NO: 105251 - DNA, 20 bp, Artificial Sequence
  Description of Artificial Sequence: Synthetic oligonucleotide
  Target: SCN9A; (+) strand; PAM type: YTN; PAM sequence: TTT
tttttcttctctaatagttg

SEQ ID NO: 105252 - DNA, 20 bp, Artificial Sequence
  Description of Artificial Sequence: Synthetic oligonucleotide
  Target: SCN9A; (+) strand; PAM type: YTN; PAM sequence: TTT
ttttcttctctaatagttgt

SEQ ID NO: 105253 - DNA, 20 bp, Artificial Sequence
  Description of Artificial Sequence: Synthetic oligonucleotide
  Target: SCN9A; (+) strand; PAM type: YTN; PAM sequence: TTT
tttcttctctaatagttgtg

SEQ ID NO: 105254 - DNA, 20 bp, Artificial Sequence
  Description of Artificial Sequence: Synthetic oligonucleotide
  Target: SCN9A; (+) strand; PAM type: YTN; PAM sequence: TTT
ttcttctctaatagttgtgt

SEQ ID NO: 105255 - DNA, 20 bp, Artificial Sequence
  Description of Artificial Sequence: Synthetic oligonucleotide
  Target: SCN9A; (+) strand; PAM type: YTN; PAM sequence: TTT
tcttctctaatagttgtgta

SEQ ID NO: 105256 - DNA, 20 bp, Artificial Sequence
  Description of Artificial Sequence: Synthetic oligonucleotide
  Target: SCN9A; (+) strand; PAM type: YTN; PAM sequence: TTT
cttctctaatagttgtgtag

SEQ ID NO: 105257 - DNA, 20 bp, Artificial Sequence
  Description of Artificial Sequence: Synthetic oligonucleotide
  Target: SCN9A; (+) strand; PAM type: YTN; PAM sequence: TTC
ttctctaatagttgtgtagt

SEQ ID NO: 105258 - DNA, 20 bp, Artificial Sequence
  Description of Artificial Sequence: Synthetic oligonucleotide
  Target: SCN9A; (+) strand; PAM type: YTN; PAM sequence: CTT
ctctaatagttgtgtagttt

SEQ ID NO: 105259 - DNA, 20 bp, Artificial Sequence
  Description of Artificial Sequence: Synthetic oligonucleotide
  Target: SCN9A; (+) strand; PAM type: YTN; PAM sequence: TTC
tctaatagttgtgtagtttt

SEQ ID NO: 105260 - DNA, 20 bp, Artificial Sequence
  Description of Artificial Sequence: Synthetic oligonucleotide
  Target: SCN9A; (+) strand; PAM type: YTN; PAM sequence: CTC
taatagttgtgtagttttca

SEQ ID NO: 105261 - DNA, 20 bp, Artificial Sequence
  Description of Artificial Sequence: Synthetic oligonucleotide
  Target: SCN9A; (+) strand; PAM type: YTN; PAM sequence: CTA
atagttgtgtagttttcagt

SEQ ID NO: 105262 - DNA, 20 bp, Artificial Sequence
  Description of Artificial Sequence: Synthetic oligonucleotide
  Target: SCN9A; (+) strand; PAM type: YTN; PAM sequence: TTG
tgtagttttcagtcttacat

SEQ ID NO: 105263 - DNA, 20 bp, Artificial Sequence
  Description of Artificial Sequence: Synthetic oligonucleotide
  Target: SCN9A; (+) strand; PAM type: YTN; PAM sequence: TTT
tcagtcttacatttaagtag

SEQ ID NO: 105264 - DNA, 20 bp, Artificial Sequence
  Description of Artificial Sequence: Synthetic oligonucleotide
  Target: SCN9A; (+) strand; PAM type: YTN; PAM sequence: TTT
cagtcttacatttaagtagt

SEQ ID NO: 105265 - DNA, 20 bp, Artificial Sequence
  Description of Artificial Sequence: Synthetic oligonucleotide
  Target: SCN9A; (+) strand; PAM type: YTN; PAM sequence: TTC
agtcttacatttaagtagtc

SEQ ID NO: 105266 - DNA, 20 bp, Artificial Sequence
  Description of Artificial Sequence: Synthetic oligonucleotide
  Target: SCN9A; (+) strand; PAM type: YTN; PAM sequence: CTT
acatttaagtagtctatttt

SEQ ID NO: 105267 - DNA, 20 bp, Artificial Sequence
  Description of Artificial Sequence: Synthetic oligonucleotide
  Target: SCN9A; (+) strand; PAM type: YTN; PAM sequence: TTA
catttaagtagtctattttg

SEQ ID NO: 105268 - DNA, 20 bp, Artificial Sequence
  Description of Artificial Sequence: Synthetic oligonucleotide
  Target: SCN9A; (+) strand; PAM type: YTN; PAM sequence: TTT
aagtagtctattttgagttg

SEQ ID NO: 105269 - DNA, 20 bp, Artificial Sequence
  Description of Artificial Sequence: Synthetic oligonucleotide
  Target: SCN9A; (+) strand; PAM type: YTN; PAM sequence: TTA
agtagtctattttgagttga

SEQ ID NO: 105270 - DNA, 20 bp, Artificial Sequence
  Description of Artificial Sequence: Synthetic oligonucleotide
  Target: SCN9A; (+) strand; PAM type: YTN; PAM sequence: CTA
ttttgagttgacttgtgtat

SEQ ID NO: 105271 - DNA, 20 bp, Artificial Sequence
  Description of Artificial Sequence: Synthetic oligonucleotide
  Target: SCN9A; (+) strand; PAM type: YTN; PAM sequence: TTT
tgagttgacttgtgtataaa

SEQ ID NO: 105272 - DNA, 20 bp, Artificial Sequence
  Description of Artificial Sequence: Synthetic oligonucleotide
  Target: SCN9A; (+) strand; PAM type: YTN; PAM sequence: TTT
gagttgacttgtgtataaag

SEQ ID NO: 105273 - DNA, 20 bp, Artificial Sequence
  Description of Artificial Sequence: Synthetic oligonucleotide
  Target: SCN9A; (+) strand; PAM type: YTN; PAM sequence: TTG
agttgacttgtgtataaagt

SEQ ID NO: 105274 - DNA, 20 bp, Artificial Sequence
  Description of Artificial Sequence: Synthetic oligonucleotide
  Target: SCN9A; (+) strand; PAM type: YTN; PAM sequence: TTG
acttgtgtataaagtaagag

SEQ ID NO: 105275 - DNA, 20 bp, Artificial Sequence
  Description of Artificial Sequence: Synthetic oligonucleotide
  Target: SCN9A; (+) strand; PAM type: YTN; PAM sequence: CTT
gtgtataaagtaagagataa

SEQ ID NO: 105276 - DNA, 20 bp, Artificial Sequence
  Description of Artificial Sequence: Synthetic oligonucleotide
  Target: SCN9A; (+) strand; PAM type: YTN; PAM sequence: TTG
tgtataaagtaagagataaa

SEQ ID NO: 105277 - DNA, 20 bp, Artificial Sequence
  Description of Artificial Sequence: Synthetic oligonucleotide
  Target: SCN9A; (+) strand; PAM type: YTN; PAM sequence: CTA
atttcattcttttgcatgtg

SEQ ID NO: 105278 - DNA, 20 bp, Artificial Sequence
  Description of Artificial Sequence: Synthetic oligonucleotide
  Target: SCN9A; (+) strand; PAM type: YTN; PAM sequence: TTT
cattcttttgcatgtggcta

SEQ ID NO: 105279 - DNA, 20 bp, Artificial Sequence
  Description of Artificial Sequence: Synthetic oligonucleotide
  Target: SCN9A; (+) strand; PAM type: YTN; PAM sequence: TTC
attcttttgcatgtggctat

SEQ ID NO: 105280 - DNA, 20 bp, Artificial Sequence
  Description of Artificial Sequence: Synthetic oligonucleotide
  Target: SCN9A; (+) strand; PAM type: YTN; PAM sequence: TTC
ttttgcatgtggctattcag

SEQ ID NO: 105281 - DNA, 20 bp, Artificial Sequence
  Description of Artificial Sequence: Synthetic oligonucleotide
  Target: SCN9A; (+) strand; PAM type: YTN; PAM sequence: CTT
ttgcatgtggctattcagtt

SEQ ID NO: 105282 - DNA, 20 bp, Artificial Sequence
  Description of Artificial Sequence: Synthetic oligonucleotide
  Target: SCN9A; (+) strand; PAM type: YTN; PAM sequence: TTT
tgcatgtggctattcagttt

SEQ ID NO: 105283 - DNA, 20 bp, Artificial Sequence
  Description of Artificial Sequence: Synthetic oligonucleotide
  Target: SCN9A; (+) strand; PAM type: YTN; PAM sequence: TTT
gcatgtggctattcagtttg

SEQ ID NO: 105284 - DNA, 20 bp, Artificial Sequence
  Description of Artificial Sequence: Synthetic oligonucleotide
  Target: SCN9A; (+) strand; PAM type: YTN; PAM sequence: TTG
catgtggctattcagtttgc

SEQ ID NO: 105285 - DNA, 20 bp, Artificial Sequence
  Description of Artificial Sequence: Synthetic oligonucleotide
  Target: SCN9A; (+) strand; PAM type: YTN; PAM sequence: CTA
ttcagtttgcccagaaccat

SEQ ID NO: 105286 - DNA, 20 bp, Artificial Sequence
  Description of Artificial Sequence: Synthetic oligonucleotide
  Target: SCN9A; (+) strand; PAM type: YTN; PAM sequence: TTC
agtttgcccagaaccattta

SEQ ID NO: 105287 - DNA, 20 bp, Artificial Sequence
  Description of Artificial Sequence: Synthetic oligonucleotide
  Target: SCN9A; (+) strand; PAM type: YTN; PAM sequence: TTT
gcccagaaccatttactaaa

SEQ ID NO: 105288 - DNA, 20 bp, Artificial Sequence
  Description of Artificial Sequence: Synthetic oligonucleotide
  Target: SCN9A; (+) strand; PAM type: YTN; PAM sequence: TTG
cccagaaccatttactaaag

SEQ ID NO: 105289 - DNA, 20 bp, Artificial Sequence
  Description of Artificial Sequence: Synthetic oligonucleotide
  Target: SCN9A; (+) strand; PAM type: YTN; PAM sequence: TTT
actaaagaggctgtcctttc

SEQ ID NO: 105290 - DNA, 20 bp, Artificial Sequence
  Description of Artificial Sequence: Synthetic oligonucleotide
  Target: SCN9A; (+) strand; PAM type: YTN; PAM sequence: TTA
ctaaagaggctgtcctttct

SEQ ID NO: 105291 - DNA, 20 bp, Artificial Sequence
  Description of Artificial Sequence: Synthetic oligonucleotide
  Target: SCN9A; (+) strand; PAM type: YTN; PAM sequence: CTA
aagaggctgtcctttctcta

SEQ ID NO: 105292 - DNA, 20 bp, Artificial Sequence
  Description of Artificial Sequence: Synthetic oligonucleotide
  Target: SCN9A; (+) strand; PAM type: YTN; PAM sequence: CTG
tcctttctctattataggta

SEQ ID NO: 105293 - DNA, 20 bp, Artificial Sequence
  Description of Artificial Sequence: Synthetic oligonucleotide
  Target: SCN9A; (+) strand; PAM type: YTN; PAM sequence: CTT
tctctattataggtacttgg

SEQ ID NO: 105294 - DNA, 20 bp, Artificial Sequence
  Description of Artificial Sequence: Synthetic oligonucleotide
  Target: SCN9A; (+) strand; PAM type: YTN; PAM sequence: TTT
ctctattataggtacttgga

SEQ ID NO: 105295 - DNA, 20 bp, Artificial Sequence
  Description of Artificial Sequence: Synthetic oligonucleotide
  Target: SCN9A; (+) strand; PAM type: YTN; PAM sequence: TTC
tctattataggtacttggaa

SEQ ID NO: 105296 - DNA, 20 bp, Artificial Sequence
  Description of Artificial Sequence: Synthetic oligonucleotide
  Target: SCN9A; (+) strand; PAM type: YTN; PAM sequence: CTC
tattataggtacttggaacc

SEQ ID NO: 105297 - DNA, 20 bp, Artificial Sequence
  Description of Artificial Sequence: Synthetic oligonucleotide
  Target: SCN9A; (+) strand; PAM type: YTN; PAM sequence: CTA
ttataggtacttggaacctt

SEQ ID NO: 105298 - DNA, 20 bp, Artificial Sequence
  Description of Artificial Sequence: Synthetic oligonucleotide
  Target: SCN9A; (+) strand; PAM type: YTN; PAM sequence: TTA
taggtacttggaaccttgtc

SEQ ID NO: 105299 - DNA, 20 bp, Artificial Sequence
  Description of Artificial Sequence: Synthetic oligonucleotide
  Target: SCN9A; (+) strand; PAM type: YTN; PAM sequence: CTT
ggaaccttgtcaaaactcag

SEQ ID NO: 105300 - DNA, 20 bp, Artificial Sequence
  Description of Artificial Sequence: Synthetic oligonucleotide
  Target: SCN9A; (+) strand; PAM type: YTN; PAM sequence: TTG
gaaccttgtcaaaactcagt

SEQ ID NO: 105301 - DNA, 20 bp, Artificial Sequence
  Description of Artificial Sequence: Synthetic oligonucleotide
  Target: SCN9A; (+) strand; PAM type: YTN; PAM sequence: CTT
gtcaaaactcagttgactgt

SEQ ID NO: 105302 - DNA, 20 bp, Artificial Sequence
  Description of Artificial Sequence: Synthetic oligonucleotide
  Target: SCN9A; (+) strand; PAM type: YTN; PAM sequence: TTG
tcaaaactcagttgactgta

SEQ ID NO: 105303 - DNA, 20 bp, Artificial Sequence
  Description of Artificial Sequence: Synthetic oligonucleotide
  Target: SCN9A; (+) strand; PAM type: YTN; PAM sequence: CTC
agttgactgtatatgtgtag

SEQ ID NO: 105304 - DNA, 20 bp, Artificial Sequence
  Description of Artificial Sequence: Synthetic oligonucleotide
  Target: SCN9A; (+) strand; PAM type: YTN; PAM sequence: TTG
actgtatatgtgtagattta

SEQ ID NO: 105305 - DNA, 20 bp, Artificial Sequence
  Description of Artificial Sequence: Synthetic oligonucleotide
  Target: SCN9A; (+) strand; PAM type: YTN; PAM sequence: CTG
tatatgtgtagatttatttc

SEQ ID NO: 105306 - DNA, 20 bp, Artificial Sequence
  Description of Artificial Sequence: Synthetic oligonucleotide
  Target: SCN9A; (+) strand; PAM type: YTN; PAM sequence: TTT
atttctgggctctctattct

SEQ ID NO: 105307 - DNA, 20 bp, Artificial Sequence
  Description of Artificial Sequence: Synthetic oligonucleotide
  Target: SCN9A; (+) strand; PAM type: YTN; PAM sequence: TTA
tttctgggctctctattctt

SEQ ID NO: 105308 - DNA, 20 bp, Artificial Sequence
  Description of Artificial Sequence: Synthetic oligonucleotide
  Target: SCN9A; (+) strand; PAM type: YTN; PAM sequence: TTT
ctgggctctctattcttatg

SEQ ID NO: 105309 - DNA, 20 bp, Artificial Sequence
  Description of Artificial Sequence: Synthetic oligonucleotide
  Target: SCN9A; (+) strand; PAM type: YTN; PAM sequence: TTC
tgggctctctattcttatgt

SEQ ID NO: 105310 - DNA, 20 bp, Artificial Sequence
  Description of Artificial Sequence: Synthetic oligonucleotide
  Target: SCN9A; (+) strand; PAM type: YTN; PAM sequence: CTG
ggctctctattcttatgtat

SEQ ID NO: 105311 - DNA, 20 bp, Artificial Sequence
  Description of Artificial Sequence: Synthetic oligonucleotide
  Target: SCN9A; (+) strand; PAM type: YTN; PAM sequence: CTC
tctattcttatgtattgctc

SEQ ID NO: 105312 - DNA, 20 bp, Artificial Sequence
  Description of Artificial Sequence: Synthetic oligonucleotide
  Target: SCN9A; (+) strand; PAM type: YTN; PAM sequence: CTC
tattcttatgtattgctctg

SEQ ID NO: 105313 - DNA, 20 bp, Artificial Sequence
  Description of Artificial Sequence: Synthetic oligonucleotide
  Target: SCN9A; (+) strand; PAM type: YTN; PAM sequence: CTA
ttcttatgtattgctctgtg

SEQ ID NO: 105314 - DNA, 20 bp, Artificial Sequence
  Description of Artificial Sequence: Synthetic oligonucleotide
  Target: SCN9A; (+) strand; PAM type: YTN; PAM sequence: TTC
ttatgtattgctctgtgtgt

SEQ ID NO: 105315 - DNA, 20 bp, Artificial Sequence
  Description of Artificial Sequence: Synthetic oligonucleotide
  Target: SCN9A; (+) strand; PAM type: YTN; PAM sequence: CTT
atgtattgctctgtgtgtct

SEQ ID NO: 105316 - DNA, 20 bp, Artificial Sequence
  Description of Artificial Sequence: Synthetic oligonucleotide
  Target: SCN9A; (+) strand; PAM type: YTN; PAM sequence: TTA
tgtattgctctgtgtgtctg

SEQ ID NO: 105317 - DNA, 20 bp, Artificial Sequence
  Description of Artificial Sequence: Synthetic oligonucleotide
  Target: SCN9A; (+) strand; PAM type: YTN; PAM sequence: TTG
ctctgtgtgtctgttttatg

SEQ ID NO: 105318 - DNA, 20 bp, Artificial Sequence
  Description of Artificial Sequence: Synthetic oligonucleotide
  Target: SCN9A; (+) strand; PAM type: YTN; PAM sequence: CTC
tgtgtgtctgttttatgtca

SEQ ID NO: 105319 - DNA, 20 bp, Artificial Sequence
  Description of Artificial Sequence: Synthetic oligonucleotide
  Target: SCN9A; (+) strand; PAM type: YTN; PAM sequence: CTG
tgtgtctgttttatgtcagt

SEQ ID NO: 105320 - DNA, 20 bp, Artificial Sequence
  Description of Artificial Sequence: Synthetic oligonucleotide
  Target: SCN9A; (+) strand; PAM type: YTN; PAM sequence: CTG
ttttatgtcagtatcattct

SEQ ID NO: 105321 - DNA, 20 bp, Artificial Sequence
  Description of Artificial Sequence: Synthetic oligonucleotide
  Target: SCN9A; (+) strand; PAM type: YTN; PAM sequence: TTT
tatgtcagtatcattctgtt

SEQ ID NO: 105322 - DNA, 20 bp, Artificial Sequence
  Description of Artificial Sequence: Synthetic oligonucleotide
  Target: SCN9A; (+) strand; PAM type: YTN; PAM sequence: TTT
atgtcagtatcattctgttt

SEQ ID NO: 105323 - DNA, 20 bp, Artificial Sequence
  Description of Artificial Sequence: Synthetic oligonucleotide
  Target: SCN9A; (+) strand; PAM type: YTN; PAM sequence: TTA
tgtcagtatcattctgtttg

SEQ ID NO: 105324 - DNA, 20 bp, Artificial Sequence
  Description of Artificial Sequence: Synthetic oligonucleotide
  Target: SCN9A; (+) strand; PAM type: YTN; PAM sequence: TTC
tgtttggttactatagcttt

SEQ ID NO: 105325 - DNA, 20 bp, Artificial Sequence
  Description of Artificial Sequence: Synthetic oligonucleotide
  Target: SCN9A; (+) strand; PAM type: YTN; PAM sequence: CTG
tttggttactatagctttat

SEQ ID NO: 105326 - DNA, 20 bp, Artificial Sequence
  Description of Artificial Sequence: Synthetic oligonucleotide
  Target: SCN9A; (+) strand; PAM type: YTN; PAM sequence: TTT
ggttactatagctttatagt

SEQ ID NO: 105327 - DNA, 20 bp, Artificial Sequence
  Description of Artificial Sequence: Synthetic oligonucleotide
  Target: SCN9A; (+) strand; PAM type: YTN; PAM sequence: TTG
gttactatagctttatagta

SEQ ID NO: 105328 - DNA, 20 bp, Artificial Sequence
  Description of Artificial Sequence: Synthetic oligonucleotide
  Target: SCN9A; (+) strand; PAM type: YTN; PAM sequence: TTA
ctatagctttatagtatgtt

SEQ ID NO: 105329 - DNA, 20 bp, Artificial Sequence
  Description of Artificial Sequence: Synthetic oligonucleotide
  Target: SCN9A; (+) strand; PAM type: YTN; PAM sequence: CTA
tagctttatagtatgttttg

SEQ ID NO: 105330 - DNA, 20 bp, Artificial Sequence
  Description of Artificial Sequence: Synthetic oligonucleotide
  Target: SCN9A; (+) strand; PAM type: YTN; PAM sequence: CTT
tatagtatgttttgaagtca

SEQ ID NO: 105331 - DNA, 20 bp, Artificial Sequence
  Description of Artificial Sequence: Synthetic oligonucleotide
  Target: SCN9A; (+) strand; PAM type: YTN; PAM sequence: TTT
atagtatgttttgaagtcag

SEQ ID NO: 105332 - DNA, 20 bp, Artificial Sequence
  Description of Artificial Sequence: Synthetic oligonucleotide
  Target: SCN9A; (+) strand; PAM type: YTN; PAM sequence: TTA
tagtatgttttgaagtcagt

SEQ ID NO: 105333 - DNA, 20 bp, Artificial Sequence
  Description of Artificial Sequence: Synthetic oligonucleotide
  Target: SCN9A; (+) strand; PAM type: YTN; PAM sequence: TTT
tgaagtcagttagtgtgaag

SEQ ID NO: 105334 - DNA, 20 bp, Artificial Sequence
  Description of Artificial Sequence: Synthetic oligonucleotide
  Target: SCN9A; (+) strand; PAM type: YTN; PAM sequence: TTT
gaagtcagttagtgtgaagc

SEQ ID NO: 105335 - DNA, 20 bp, Artificial Sequence
  Description of Artificial Sequence: Synthetic oligonucleotide
  Target: SCN9A; (+) strand; PAM type: YTN; PAM sequence: TTG
aagtcagttagtgtgaagcc

SEQ ID NO: 105336 - DNA, 20 bp, Artificial Sequence
  Description of Artificial Sequence: Synthetic oligonucleotide
  Target: SCN9A; (+) strand; PAM type: YTN; PAM sequence: TTA
gtgtgaagccatcagctttg

SEQ ID NO: 105337 - DNA, 20 bp, Artificial Sequence
  Description of Artificial Sequence: Synthetic oligonucleotide
  Target: SCN9A; (+) strand; PAM type: YTN; PAM sequence: CTT
tgttctttttgttccaggtt

SEQ ID NO: 105338 - DNA, 20 bp, Artificial Sequence
  Description of Artificial Sequence: Synthetic oligonucleotide
  Target: SCN9A; (+) strand; PAM type: YTN; PAM sequence: TTT
gttctttttgttccaggtta

SEQ ID NO: 105339 - DNA, 20 bp, Artificial Sequence
  Description of Artificial Sequence: Synthetic oligonucleotide
  Target: SCN9A; (+) strand; PAM type: YTN; PAM sequence: TTG
ttctttttgttccaggttac

SEQ ID NO: 105340 - DNA, 20 bp, Artificial Sequence
  Description of Artificial Sequence: Synthetic oligonucleotide
  Target: SCN9A; (+) strand; PAM type: YTN; PAM sequence: TTC
tttttgttccaggttacttg

SEQ ID NO: 105341 - DNA, 20 bp, Artificial Sequence
  Description of Artificial Sequence: Synthetic oligonucleotide
  Target: SCN9A; (+) strand; PAM type: YTN; PAM sequence: CTT
tttgttccaggttacttggg

SEQ ID NO: 105342 - DNA, 20 bp, Artificial Sequence
  Description of Artificial Sequence: Synthetic oligonucleotide
  Target: SCN9A; (+) strand; PAM type: YTN; PAM sequence: TTT
ttgttccaggttacttgggc

SEQ ID NO: 105343 - DNA, 20 bp, Artificial Sequence
  Description of Artificial Sequence: Synthetic oligonucleotide
  Target: SCN9A; (+) strand; PAM type: YTN; PAM sequence: TTT
tgttccaggttacttgggct

SEQ ID NO: 105344 - DNA, 20 bp, Artificial Sequence
  Description of Artificial Sequence: Synthetic oligonucleotide
  Target: SCN9A; (+) strand; PAM type: YTN; PAM sequence: TTT
gttccaggttacttgggcta

SEQ ID NO: 105345 - DNA, 20 bp, Artificial Sequence
  Description of Artificial Sequence: Synthetic oligonucleotide
  Target: SCN9A; (+) strand; PAM type: YTN; PAM sequence: TTG
ttccaggttacttgggctat

SEQ ID NO: 105346 - DNA, 20 bp, Artificial Sequence
  Description of Artificial Sequence: Synthetic oligonucleotide
  Target: SCN9A; (+) strand; PAM type: YTN; PAM sequence: TTC
caggttacttgggctattta

SEQ ID NO: 105347 - DNA, 20 bp, Artificial Sequence
  Description of Artificial Sequence: Synthetic oligonucleotide
  Target: SCN9A; (+) strand; PAM type: YTN; PAM sequence: TTA
cttgggctatttagggtctt

SEQ ID NO: 105348 - DNA, 20 bp, Artificial Sequence
  Description of Artificial Sequence: Synthetic oligonucleotide
  Target: SCN9A; (+) strand; PAM type: YTN; PAM sequence: CTT
gggctatttagggtcttttg

SEQ ID NO: 105349 - DNA, 20 bp, Artificial Sequence
  Description of Artificial Sequence: Synthetic oligonucleotide
  Target: SCN9A; (+) strand; PAM type: YTN; PAM sequence: TTG
ggctatttagggtcttttgt

SEQ ID NO: 105350 - DNA, 20 bp, Artificial Sequence
  Description of Artificial Sequence: Synthetic oligonucleotide
  Target: SCN9A; (+) strand; PAM type: YTN; PAM sequence: CTA
tttagggtcttttgtggttt

SEQ ID NO: 105351 - DNA, 20 bp, Artificial Sequence
  Description of Artificial Sequence: Synthetic oligonucleotide
  Target: SCN9A; (+) strand; PAM type: YTN; PAM sequence: TTT
agggtcttttgtggtttcat

SEQ ID NO: 105352 - DNA, 20 bp, Artificial Sequence
  Description of Artificial Sequence: Synthetic oligonucleotide
  Target: SCN9A; (+) strand; PAM type: YTN; PAM sequence: TTA
gggtcttttgtggtttcata

SEQ ID NO: 105353 - DNA, 20 bp, Artificial Sequence
  Description of Artificial Sequence: Synthetic oligonucleotide
  Target: SCN9A; (+) strand; PAM type: YTN; PAM sequence: CTT
ttgtggtttcatacaaatgt

SEQ ID NO: 105354 - DNA, 20 bp, Artificial Sequence
  Description of Artificial Sequence: Synthetic oligonucleotide
  Target: SCN9A; (+) strand; PAM type: YTN; PAM sequence: TTT
tgtggtttcatacaaatgtt

SEQ ID NO: 105355 - DNA, 20 bp, Artificial Sequence
  Description of Artificial Sequence: Synthetic oligonucleotide
  Target: SCN9A; (+) strand; PAM type: YTN; PAM sequence: TTT
gtggtttcatacaaatgtta

SEQ ID NO: 105356 - DNA, 20 bp, Artificial Sequence
  Description of Artificial Sequence: Synthetic oligonucleotide
  Target: SCN9A; (+) strand; PAM type: YTN; PAM sequence: TTG
tggtttcatacaaatgttag

SEQ ID NO: 105357 - DNA, 20 bp, Artificial Sequence
  Description of Artificial Sequence: Synthetic oligonucleotide
  Target: SCN9A; (+) strand; PAM type: YTN; PAM sequence: TTT
catacaaatgttaggacttt

SEQ ID NO: 105358 - DNA, 20 bp, Artificial Sequence
  Description of Artificial Sequence: Synthetic oligonucleotide
  Target: SCN9A; (+) strand; PAM type: YTN; PAM sequence: TTC
atacaaatgttaggactttt

SEQ ID NO: 105359 - DNA, 20 bp, Artificial Sequence
  Description of Artificial Sequence: Synthetic oligonucleotide
  Target: SCN9A; (+) strand; PAM type: YTN; PAM sequence: TTA
ggactttttttttttttttc

SEQ ID NO: 105360 - DNA, 20 bp, Artificial Sequence
  Description of Artificial Sequence: Synthetic oligonucleotide
  Target: SCN9A; (+) strand; PAM type: YTN; PAM sequence: CTT
tttttttttttttctgtaaa

SEQ ID NO: 105361 - DNA, 20 bp, Artificial Sequence
  Description of Artificial Sequence: Synthetic oligonucleotide
  Target: SCN9A; (+) strand; PAM type: YTN; PAM sequence: TTT
ttttttttttttctgtaaag

SEQ ID NO: 105362 - DNA, 20 bp, Artificial Sequence
  Description of Artificial Sequence: Synthetic oligonucleotide
  Target: SCN9A; (+) strand; PAM type: YTN; PAM sequence: TTT
tttttttttttctgtaaaga

SEQ ID NO: 105363 - DNA, 20 bp, Artificial Sequence
  Description of Artificial Sequence: Synthetic oligonucleotide
  Target: SCN9A; (+) strand; PAM type: YTN; PAM sequence: TTT
ttttttttttctgtaaagaa

SEQ ID NO: 105364 - DNA, 20 bp, Artificial Sequence
  Description of Artificial Sequence: Synthetic oligonucleotide
  Target: SCN9A; (+) strand; PAM type: YTN; PAM sequence: TTT
tttttttttctgtaaagaat

SEQ ID NO: 105365 - DNA, 20 bp, Artificial Sequence
  Description of Artificial Sequence: Synthetic oligonucleotide
  Target: SCN9A; (+) strand; PAM type: YTN; PAM sequence: TTT
ttttttttctgtaaagaatg

SEQ ID NO: 105366 - DNA, 20 bp, Artificial Sequence
  Description of Artificial Sequence: Synthetic oligonucleotide
  Target: SCN9A; (+) strand; PAM type: YTN; PAM sequence: TTT
tttttttctgtaaagaatgt

SEQ ID NO: 105367 - DNA, 20 bp, Artificial Sequence
  Description of Artificial Sequence: Synthetic oligonucleotide
  Target: SCN9A; (+) strand; PAM type: YTN; PAM sequence: TTT
ttttttctgtaaagaatgtc

SEQ ID NO: 105368 - DNA, 20 bp, Artificial Sequence
  Description of Artificial Sequence: Synthetic oligonucleotide
  Target: SCN9A; (+) strand; PAM type: YTN; PAM sequence: TTT
tttttctgtaaagaatgtca

SEQ ID NO: 105369 - DNA, 20 bp, Artificial Sequence
  Description of Artificial Sequence: Synthetic oligonucleotide
  Target: SCN9A; (+) strand; PAM type: YTN; PAM sequence: TTT
ttttctgtaaagaatgtcac

SEQ ID NO: 105370 - DNA, 20 bp, Artificial Sequence
  Description of Artificial Sequence: Synthetic oligonucleotide
  Target: SCN9A; (+) strand; PAM type: YTN; PAM sequence: TTT
tttctgtaaagaatgtcact

SEQ ID NO: 105371 - DNA, 20 bp, Artificial Sequence
  Description of Artificial Sequence: Synthetic oligonucleotide
  Target: SCN9A; (+) strand; PAM type: YTN; PAM sequence: TTT
ttctgtaaagaatgtcactg

SEQ ID NO: 105372 - DNA, 20 bp, Artificial Sequence
  Description of Artificial Sequence: Synthetic oligonucleotide
  Target: SCN9A; (+) strand; PAM type: YTN; PAM sequence: TTT
tctgtaaagaatgtcactgg

SEQ ID NO: 105373 - DNA, 20 bp, Artificial Sequence
  Description of Artificial Sequence: Synthetic oligonucleotide
  Target: SCN9A; (+) strand; PAM type: YTN; PAM sequence: TTT
ctgtaaagaatgtcactggt

SEQ ID NO: 105374 - DNA, 20 bp, Artificial Sequence
  Description of Artificial Sequence: Synthetic oligonucleotide
  Target: SCN9A; (+) strand; PAM type: YTN; PAM sequence: TTC
tgtaaagaatgtcactggta

SEQ ID NO: 105375 - DNA, 20 bp, Artificial Sequence
  Description of Artificial Sequence: Synthetic oligonucleotide
  Target: SCN9A; (+) strand; PAM type: YTN; PAM sequence: CTG
taaagaatgtcactggtatt

SEQ ID NO: 105376 - DNA, 20 bp, Artificial Sequence
  Description of Artificial Sequence: Synthetic oligonucleotide
  Target: SCN9A; (+) strand; PAM type: YTN; PAM sequence: CTG
gtattttgatagggattgca

SEQ ID NO: 105377 - DNA, 20 bp, Artificial Sequence
  Description of Artificial Sequence: Synthetic oligonucleotide
  Target: SCN9A; (+) strand; PAM type: YTN; PAM sequence: TTT
tgatagggattgcattaaac

SEQ ID NO: 105378 - DNA, 20 bp, Artificial Sequence
  Description of Artificial Sequence: Synthetic oligonucleotide
  Target: SCN9A; (+) strand; PAM type: YTN; PAM sequence: TTT
gatagggattgcattaaacc

SEQ ID NO: 105379 - DNA, 20 bp, Artificial Sequence
  Description of Artificial Sequence: Synthetic oligonucleotide
  Target: SCN9A; (+) strand; PAM type: YTN; PAM sequence: TTG
atagggattgcattaaacct

SEQ ID NO: 105380 - DNA, 20 bp, Artificial Sequence
  Description of Artificial Sequence: Synthetic oligonucleotide
  Target: SCN9A; (+) strand; PAM type: YTN; PAM sequence: TTG
cattaaacctgtagattgct

SEQ ID NO: 105381 - DNA, 20 bp, Artificial Sequence
  Description of Artificial Sequence: Synthetic oligonucleotide
  Target: SCN9A; (+) strand; PAM type: YTN; PAM sequence: TTA
aacctgtagattgctttggg

SEQ ID NO: 105382 - DNA, 20 bp, Artificial Sequence
  Description of Artificial Sequence: Synthetic oligonucleotide
  Target: SCN9A; (+) strand; PAM type: YTN; PAM sequence: CTG
tagattgctttgggtaatat

SEQ ID NO: 105383 - DNA, 20 bp, Artificial Sequence
  Description of Artificial Sequence: Synthetic oligonucleotide
  Target: SCN9A; (+) strand; PAM type: YTN; PAM sequence: TTG
ctttgggtaatatggacatt

SEQ ID NO: 105384 - DNA, 20 bp, Artificial Sequence
  Description of Artificial Sequence: Synthetic oligonucleotide
  Target: SCN9A; (+) strand; PAM type: YTN; PAM sequence: CTT
tgggtaatatggacatttta

SEQ ID NO: 105385 - DNA, 20 bp, Artificial Sequence
  Description of Artificial Sequence: Synthetic oligonucleotide
  Target: SCN9A; (+) strand; PAM type: YTN; PAM sequence: TTT
gggtaatatggacattttaa

SEQ ID NO: 105386 - DNA, 20 bp, Artificial Sequence
  Description of Artificial Sequence: Synthetic oligonucleotide
  Target: SCN9A; (+) strand; PAM type: YTN; PAM sequence: TTG
ggtaatatggacattttaaa

SEQ ID NO: 105387 - DNA, 20 bp, Artificial Sequence
  Description of Artificial Sequence: Synthetic oligonucleotide
  Target: SCN9A; (+) strand; PAM type: YTN; PAM sequence: TTT
taaaaataataattattcta

SEQ ID NO: 105388 - DNA, 20 bp, Artificial Sequence
  Description of Artificial Sequence: Synthetic oligonucleotide
  Target: SCN9A; (+) strand; PAM type: YTN; PAM sequence: TTT
aaaaataataattattctaa

SEQ ID NO: 105389 - DNA, 20 bp, Artificial Sequence
  Description of Artificial Sequence: Synthetic oligonucleotide
  Target: SCN9A; (+) strand; PAM type: YTN; PAM sequence: TTA
aaaataataattattctaat

SEQ ID NO: 105390 - DNA, 20 bp, Artificial Sequence
  Description of Artificial Sequence: Synthetic oligonucleotide
  Target: SCN9A; (+) strand; PAM type: YTN; PAM sequence: TTA
ttctaatccatgaacatgga

SEQ ID NO: 105391 - DNA, 20 bp, Artificial Sequence
  Description of Artificial Sequence: Synthetic oligonucleotide
  Target: SCN9A; (+) strand; PAM type: YTN; PAM sequence: TTC
taatccatgaacatggaata

SEQ ID NO: 105392 - DNA, 20 bp, Artificial Sequence
  Description of Artificial Sequence: Synthetic oligonucleotide
  Target: SCN9A; (+) strand; PAM type: YTN; PAM sequence: CTA
atccatgaacatggaatatc

SEQ ID NO: 105393 - DNA, 20 bp, Artificial Sequence
  Description of Artificial Sequence: Synthetic oligonucleotide
  Target: SCN9A; (+) strand; PAM type: YTN; PAM sequence: CTT
tccctttttgtgtcctcttc

SEQ ID NO: 105394 - DNA, 20 bp, Artificial Sequence
  Description of Artificial Sequence: Synthetic oligonucleotide
  Target: SCN9A; (+) strand; PAM type: YTN; PAM sequence: TTT
ccctttttgtgtcctcttca

SEQ ID NO: 105395 - DNA, 20 bp, Artificial Sequence
  Description of Artificial Sequence: Synthetic oligonucleotide
  Target: SCN9A; (+) strand; PAM type: YTN; PAM sequence: TTC
cctttttgtgtcctcttcaa

SEQ ID NO: 105396 - DNA, 20 bp, Artificial Sequence
  Description of Artificial Sequence: Synthetic oligonucleotide
  Target: SCN9A; (+) strand; PAM type: YTN; PAM sequence: CTT
tttgtgtcctcttcaatttc

SEQ ID NO: 105397 - DNA, 20 bp, Artificial Sequence
  Description of Artificial Sequence: Synthetic oligonucleotide
  Target: SCN9A; (+) strand; PAM type: YTN; PAM sequence: TTT
ttgtgtcctcttcaatttct

SEQ ID NO: 105398 - DNA, 20 bp, Artificial Sequence
  Description of Artificial Sequence: Synthetic oligonucleotide
  Target: SCN9A; (+) strand; PAM type: YTN; PAM sequence: TTT
tgtgtcctcttcaatttctc

SEQ ID NO: 105399 - DNA, 20 bp, Artificial Sequence
  Description of Artificial Sequence: Synthetic oligonucleotide
  Target: SCN9A; (+) strand; PAM type: YTN; PAM sequence: TTT
gtgtcctcttcaatttctct

SEQ ID NO: 105400 - DNA, 20 bp, Artificial Sequence
  Description of Artificial Sequence: Synthetic oligonucleotide
  Target: SCN9A; (+) strand; PAM type: YTN; PAM sequence: TTG
tgtcctcttcaatttctctc

SEQ ID NO: 105401 - DNA, 20 bp, Artificial Sequence
  Description of Artificial Sequence: Synthetic oligonucleotide
  Target: SCN9A; (+) strand; PAM type: YTN; PAM sequence: CTC
ttcaatttctctcaccaata

SEQ ID NO: 105402 - DNA, 20 bp, Artificial Sequence
  Description of Artificial Sequence: Synthetic oligonucleotide
  Target: SCN9A; (+) strand; PAM type: YTN; PAM sequence: CTT
caatttctctcaccaatatt

SEQ ID NO: 105403 - DNA, 20 bp, Artificial Sequence
  Description of Artificial Sequence: Synthetic oligonucleotide
  Target: SCN9A; (+) strand; PAM type: YTN; PAM sequence: TTC
aatttctctcaccaatattt

SEQ ID NO: 105404 - DNA, 20 bp, Artificial Sequence
  Description of Artificial Sequence: Synthetic oligonucleotide
  Target: SCN9A; (+) strand; PAM type: YTN; PAM sequence: TTT
ctctcaccaatattttatag

SEQ ID NO: 105405 - DNA, 20 bp, Artificial Sequence
  Description of Artificial Sequence: Synthetic oligonucleotide
  Target: SCN9A; (+) strand; PAM type: YTN; PAM sequence: TTC
tctcaccaatattttatagt

SEQ ID NO: 105406 - DNA, 20 bp, Artificial Sequence
  Description of Artificial Sequence: Synthetic oligonucleotide
  Target: SCN9A; (+) strand; PAM type: YTN; PAM sequence: CTC
tcaccaatattttatagttt

SEQ ID NO: 105407 - DNA, 20 bp, Artificial Sequence
  Description of Artificial Sequence: Synthetic oligonucleotide
  Target: SCN9A; (+) strand; PAM type: YTN; PAM sequence: CTC
accaatattttatagttttc

SEQ ID NO: 105408 - DNA, 20 bp, Artificial Sequence
  Description of Artificial Sequence: Synthetic oligonucleotide
  Target: SCN9A; (+) strand; PAM type: YTN; PAM sequence: TTT
tatagttttcattgtaaata

SEQ ID NO: 105409 - DNA, 20 bp, Artificial Sequence
  Description of Artificial Sequence: Synthetic oligonucleotide
  Target: SCN9A; (+) strand; PAM type: YTN; PAM sequence: TTT
atagttttcattgtaaatat

SEQ ID NO: 105410 - DNA, 20 bp, Artificial Sequence
  Description of Artificial Sequence: Synthetic oligonucleotide
  Target: SCN9A; (+) strand; PAM type: YTN; PAM sequence: TTA
tagttttcattgtaaatata

SEQ ID NO: 105411 - DNA, 20 bp, Artificial Sequence
  Description of Artificial Sequence: Synthetic oligonucleotide
  Target: SCN9A; (+) strand; PAM type: YTN; PAM sequence: TTT
tcattgtaaatatatttcac

SEQ ID NO: 105412 - DNA, 20 bp, Artificial Sequence
  Description of Artificial Sequence: Synthetic oligonucleotide
  Target: SCN9A; (+) strand; PAM type: YTN; PAM sequence: TTT
cattgtaaatatatttcacc

SEQ ID NO: 105413 - DNA, 20 bp, Artificial Sequence
  Description of Artificial Sequence: Synthetic oligonucleotide
  Target: SCN9A; (+) strand; PAM type: YTN; PAM sequence: TTC
attgtaaatatatttcacct

SEQ ID NO: 105414 - DNA, 20 bp, Artificial Sequence
  Description of Artificial Sequence: Synthetic oligonucleotide
  Target: SCN9A; (+) strand; PAM type: YTN; PAM sequence: TTG
taaatatatttcacctcctt

SEQ ID NO: 105415 - DNA, 20 bp, Artificial Sequence
  Description of Artificial Sequence: Synthetic oligonucleotide
  Target: SCN9A; (+) strand; PAM type: YTN; PAM sequence: TTT
cacctccttgtttaaattta

SEQ ID NO: 105416 - DNA, 20 bp, Artificial Sequence
  Description of Artificial Sequence: Synthetic oligonucleotide
  Target: SCN9A; (+) strand; PAM type: YTN; PAM sequence: TTC
acctccttgtttaaatttat

SEQ ID NO: 105417 - DNA, 20 bp, Artificial Sequence
  Description of Artificial Sequence: Synthetic oligonucleotide
  Target: SCN9A; (+) strand; PAM type: YTN; PAM sequence: CTC
cttgtttaaatttatttcta

SEQ ID NO: 105418 - DNA, 20 bp, Artificial Sequence
  Description of Artificial Sequence: Synthetic oligonucleotide
  Target: SCN9A; (+) strand; PAM type: YTN; PAM sequence: CTT
gtttaaatttatttctaggt

SEQ ID NO: 105419 - DNA, 20 bp, Artificial Sequence
  Description of Artificial Sequence: Synthetic oligonucleotide
  Target: SCN9A; (+) strand; PAM type: YTN; PAM sequence: TTG
tttaaatttatttctaggta

SEQ ID NO: 105420 - DNA, 20 bp, Artificial Sequence
  Description of Artificial Sequence: Synthetic oligonucleotide
  Target: SCN9A; (+) strand; PAM type: YTN; PAM sequence: TTT
aaatttatttctaggtattt

SEQ ID NO: 105421 - DNA, 20 bp, Artificial Sequence
  Description of Artificial Sequence: Synthetic oligonucleotide
  Target: SCN9A; (+) strand; PAM type: YTN; PAM sequence: TTA
aatttatttctaggtatttt

SEQ ID NO: 105422 - DNA, 20 bp, Artificial Sequence
  Description of Artificial Sequence: Synthetic oligonucleotide
  Target: SCN9A; (+) strand; PAM type: YTN; PAM sequence: TTT
atttctaggtattttatttt

SEQ ID NO: 105423 - DNA, 20 bp, Artificial Sequence
  Description of Artificial Sequence: Synthetic oligonucleotide
  Target: SCN9A; (+) strand; PAM type: YTN; PAM sequence: TTA
tttctaggtattttattttt

SEQ ID NO: 105424 - DNA, 20 bp, Artificial Sequence
  Description of Artificial Sequence: Synthetic oligonucleotide
  Target: SCN9A; (+) strand; PAM type: YTN; PAM sequence: TTT
ctaggtattttattttttgt

SEQ ID NO: 105425 - DNA, 20 bp, Artificial Sequence
  Description of Artificial Sequence: Synthetic oligonucleotide
  Target: SCN9A; (+) strand; PAM type: YTN; PAM sequence: TTC
taggtattttattttttgta

SEQ ID NO: 105426 - DNA, 20 bp, Artificial Sequence
  Description of Artificial Sequence: Synthetic oligonucleotide
  Target: SCN9A; (+) strand; PAM type: YTN; PAM sequence: CTA
ggtattttattttttgtagc

SEQ ID NO: 105427 - DNA, 20 bp, Artificial Sequence
  Description of Artificial Sequence: Synthetic oligonucleotide
  Target: SCN9A; (+) strand; PAM type: YTN; PAM sequence: TTT
tattttttgtagctattgta

SEQ ID NO: 105428 - DNA, 20 bp, Artificial Sequence
  Description of Artificial Sequence: Synthetic oligonucleotide
  Target: SCN9A; (+) strand; PAM type: YTN; PAM sequence: TTT
attttttgtagctattgtaa

SEQ ID NO: 105429 - DNA, 20 bp, Artificial Sequence
  Description of Artificial Sequence: Synthetic oligonucleotide
  Target: SCN9A; (+) strand; PAM type: YTN; PAM sequence: TTA
ttttttgtagctattgtaaa

SEQ ID NO: 105430 - DNA, 20 bp, Artificial Sequence
  Description of Artificial Sequence: Synthetic oligonucleotide
  Target: SCN9A; (+) strand; PAM type: YTN; PAM sequence: TTT
tttgtagctattgtaaatgg

SEQ ID NO: 105431 - DNA, 20 bp, Artificial Sequence
  Description of Artificial Sequence: Synthetic oligonucleotide
  Target: SCN9A; (+) strand; PAM type: YTN; PAM sequence: TTT
ttgtagctattgtaaatggg

SEQ ID NO: 105432 - DNA, 20 bp, Artificial Sequence
  Description of Artificial Sequence: Synthetic oligonucleotide
  Target: SCN9A; (+) strand; PAM type: YTN; PAM sequence: TTT
tgtagctattgtaaatggga

SEQ ID NO: 105433 - DNA, 20 bp, Artificial Sequence
  Description of Artificial Sequence: Synthetic oligonucleotide
  Target: SCN9A; (+) strand; PAM type: YTN; PAM sequence: TTT
gtagctattgtaaatgggat

SEQ ID NO: 105434 - DNA, 20 bp, Artificial Sequence
  Description of Artificial Sequence: Synthetic oligonucleotide
  Target: SCN9A; (+) strand; PAM type: YTN; PAM sequence: TTG
tagctattgtaaatgggatt

SEQ ID NO: 105435 - DNA, 20 bp, Artificial Sequence
  Description of Artificial Sequence: Synthetic oligonucleotide
  Target: SCN9A; (+) strand; PAM type: YTN; PAM sequence: CTA
ttgtaaatgggattgctttc

SEQ ID NO: 105436 - DNA, 20 bp, Artificial Sequence
  Description of Artificial Sequence: Synthetic oligonucleotide
  Target: SCN9A; (+) strand; PAM type: YTN; PAM sequence: TTG
taaatgggattgctttctta

SEQ ID NO: 105437 - DNA, 20 bp, Artificial Sequence
  Description of Artificial Sequence: Synthetic oligonucleotide
  Target: SCN9A; (+) strand; PAM type: YTN; PAM sequence: TTG
ctttcttattttcagattat

SEQ ID NO: 105438 - DNA, 20 bp, Artificial Sequence
  Description of Artificial Sequence: Synthetic oligonucleotide
  Target: SCN9A; (+) strand; PAM type: YTN; PAM sequence: CTT
tcttattttcagattatttg

SEQ ID NO: 105439 - DNA, 20 bp, Artificial Sequence
  Description of Artificial Sequence: Synthetic oligonucleotide
  Target: SCN9A; (+) strand; PAM type: YTN; PAM sequence: TTT
cttattttcagattatttgt

SEQ ID NO: 105440 - DNA, 20 bp, Artificial Sequence
  Description of Artificial Sequence: Synthetic oligonucleotide
  Target: SCN9A; (+) strand; PAM type: YTN; PAM sequence: TTC
ttattttcagattatttgtt

SEQ ID NO: 105441 - DNA, 20 bp, Artificial Sequence
  Description of Artificial Sequence: Synthetic oligonucleotide
  Target: SCN9A; (+) strand; PAM type: YTN; PAM sequence: CTT
attttcagattatttgttgt

SEQ ID NO: 105442 - DNA, 20 bp, Artificial Sequence
  Description of Artificial Sequence: Synthetic oligonucleotide
  Target: SCN9A; (+) strand; PAM type: YTN; PAM sequence: TTA
ttttcagattatttgttgtt

SEQ ID NO: 105443 - DNA, 20 bp, Artificial Sequence
  Description of Artificial Sequence: Synthetic oligonucleotide
  Target: SCN9A; (+) strand; PAM type: YTN; PAM sequence: TTT
tcagattatttgttgttaac

SEQ ID NO: 105444 - DNA, 20 bp, Artificial Sequence
  Description of Artificial Sequence: Synthetic oligonucleotide
  Target: SCN9A; (+) strand; PAM type: YTN; PAM sequence: TTT
cagattatttgttgttaaca

SEQ ID NO: 105445 - DNA, 20 bp, Artificial Sequence
  Description of Artificial Sequence: Synthetic oligonucleotide
  Target: SCN9A; (+) strand; PAM type: YTN; PAM sequence: TTC
agattatttgttgttaacat

SEQ ID NO: 105446 - DNA, 20 bp, Artificial Sequence
  Description of Artificial Sequence: Synthetic oligonucleotide
  Target: SCN9A; (+) strand; PAM type: YTN; PAM sequence: TTA
tttgttgttaacatatagaa

SEQ ID NO: 105447 - DNA, 20 bp, Artificial Sequence
  Description of Artificial Sequence: Synthetic oligonucleotide
  Target: SCN9A; (+) strand; PAM type: YTN; PAM sequence: TTT
gttgttaacatatagaaata

SEQ ID NO: 105448 - DNA, 20 bp, Artificial Sequence
  Description of Artificial Sequence: Synthetic oligonucleotide
  Target: SCN9A; (+) strand; PAM type: YTN; PAM sequence: TTG
ttgttaacatatagaaataa

SEQ ID NO: 105449 - DNA, 20 bp, Artificial Sequence
  Description of Artificial Sequence: Synthetic oligonucleotide
  Target: SCN9A; (+) strand; PAM type: YTN; PAM sequence: TTG
ttaacatatagaaataatat

SEQ ID NO: 105450 - DNA, 20 bp, Artificial Sequence
  Description of Artificial Sequence: Synthetic oligonucleotide
  Target: SCN9A; (+) strand; PAM type: YTN; PAM sequence: TTA
acatatagaaataatattga

SEQ ID NO: 105451 - DNA, 20 bp, Artificial Sequence
  Description of Artificial Sequence: Synthetic oligonucleotide
  Target: SCN9A; (+) strand; PAM type: YTN; PAM sequence: TTG
atttttgcatgttgattttg

SEQ ID NO: 105452 - DNA, 20 bp, Artificial Sequence
  Description of Artificial Sequence: Synthetic oligonucleotide
  Target: SCN9A; (+) strand; PAM type: YTN; PAM sequence: TTT
ttgcatgttgattttgtgtc

SEQ ID NO: 105453 - DNA, 20 bp, Artificial Sequence
  Description of Artificial Sequence: Synthetic oligonucleotide
  Target: SCN9A; (+) strand; PAM type: YTN; PAM sequence: TTT
tgcatgttgattttgtgtcc

SEQ ID NO: 105454 - DNA, 20 bp, Artificial Sequence
  Description of Artificial Sequence: Synthetic oligonucleotide
  Target: SCN9A; (+) strand; PAM type: YTN; PAM sequence: TTT
gcatgttgattttgtgtcct

SEQ ID NO: 105455 - DNA, 20 bp, Artificial Sequence
  Description of Artificial Sequence: Synthetic oligonucleotide
  Target: SCN9A; (+) strand; PAM type: YTN; PAM sequence: TTG
catgttgattttgtgtcctc

SEQ ID NO: 105456 - DNA, 20 bp, Artificial Sequence
  Description of Artificial Sequence: Synthetic oligonucleotide
  Target: SCN9A; (+) strand; PAM type: YTN; PAM sequence: TTG
attttgtgtcctccaacatt

SEQ ID NO: 105457 - DNA, 20 bp, Artificial Sequence
  Description of Artificial Sequence: Synthetic oligonucleotide
  Target: SCN9A; (+) strand; PAM type: YTN; PAM sequence: TTT
tgtgtcctccaacattactg

SEQ ID NO: 105458 - DNA, 20 bp, Artificial Sequence
  Description of Artificial Sequence: Synthetic oligonucleotide
  Target: SCN9A; (+) strand; PAM type: YTN; PAM sequence: TTT
gtgtcctccaacattactga

SEQ ID NO: 105459 - DNA, 20 bp, Artificial Sequence
  Description of Artificial Sequence: Synthetic oligonucleotide
  Target: SCN9A; (+) strand; PAM type: YTN; PAM sequence: TTG
tgtcctccaacattactgaa

SEQ ID NO: 105460 - DNA, 20 bp, Artificial Sequence
  Description of Artificial Sequence: Synthetic oligonucleotide
  Target: SCN9A; (+) strand; PAM type: YTN; PAM sequence: CTC
caacattactgaattcattt

SEQ ID NO: 105461 - DNA, 20 bp, Artificial Sequence
  Description of Artificial Sequence: Synthetic oligonucleotide
  Target: SCN9A; (+) strand; PAM type: YTN; PAM sequence: TTA
ctgaattcatttatgaaatc

SEQ ID NO: 105462 - DNA, 20 bp, Artificial Sequence
  Description of Artificial Sequence: Synthetic oligonucleotide
  Target: SCN9A; (+) strand; PAM type: YTN; PAM sequence: CTG
aattcatttatgaaatctac

SEQ ID NO: 105463 - DNA, 20 bp, Artificial Sequence
  Description of Artificial Sequence: Synthetic oligonucleotide
  Target: SCN9A; (+) strand; PAM type: YTN; PAM sequence: TTC
atttatgaaatctactactt

SEQ ID NO: 105464 - DNA, 20 bp, Artificial Sequence
  Description of Artificial Sequence: Synthetic oligonucleotide
  Target: SCN9A; (+) strand; PAM type: YTN; PAM sequence: TTT
atgaaatctactactttttt

SEQ ID NO: 105465 - DNA, 20 bp, Artificial Sequence
  Description of Artificial Sequence: Synthetic oligonucleotide
  Target: SCN9A; (+) strand; PAM type: YTN; PAM sequence: TTA
tgaaatctactacttttttt

SEQ ID NO: 105466 - DNA, 20 bp, Artificial Sequence
  Description of Artificial Sequence: Synthetic oligonucleotide
  Target: SCN9A; (+) strand; PAM type: YTN; PAM sequence: CTA
ctactttttttcatggggtc

SEQ ID NO: 105467 - DNA, 20 bp, Artificial Sequence
  Description of Artificial Sequence: Synthetic oligonucleotide
  Target: SCN9A; (+) strand; PAM type: YTN; PAM sequence: CTA
ctttttttcatggggtcatt

SEQ ID NO: 105468 - DNA, 20 bp, Artificial Sequence
  Description of Artificial Sequence: Synthetic oligonucleotide
  Target: SCN9A; (+) strand; PAM type: YTN; PAM sequence: CTT
tttttcatggggtcattaga

SEQ ID NO: 105469 - DNA, 20 bp, Artificial Sequence
  Description of Artificial Sequence: Synthetic oligonucleotide
  Target: SCN9A; (+) strand; PAM type: YTN; PAM sequence: TTT
ttttcatggggtcattagaa

SEQ ID NO: 105470 - DNA, 20 bp, Artificial Sequence
  Description of Artificial Sequence: Synthetic oligonucleotide
  Target: SCN9A; (+) strand; PAM type: YTN; PAM sequence: TTT
tttcatggggtcattagaac

SEQ ID NO: 105471 - DNA, 20 bp, Artificial Sequence
  Description of Artificial Sequence: Synthetic oligonucleotide
  Target: SCN9A; (+) strand; PAM type: YTN; PAM sequence: TTT
ttcatggggtcattagaact

SEQ ID NO: 105472 - DNA, 20 bp, Artificial Sequence
  Description of Artificial Sequence: Synthetic oligonucleotide
  Target: SCN9A; (+) strand; PAM type: YTN; PAM sequence: TTT
tcatggggtcattagaactc

SEQ ID NO: 105473 - DNA, 20 bp, Artificial Sequence
  Description of Artificial Sequence: Synthetic oligonucleotide
  Target: SCN9A; (+) strand; PAM type: YTN; PAM sequence: TTT
catggggtcattagaactct

SEQ ID NO: 105474 - DNA, 20 bp, Artificial Sequence
  Description of Artificial Sequence: Synthetic oligonucleotide
  Target: SCN9A; (+) strand; PAM type: YTN; PAM sequence: TTC
atggggtcattagaactctc

SEQ ID NO: 105475 - DNA, 20 bp, Artificial Sequence
  Description of Artificial Sequence: Synthetic oligonucleotide
  Target: SCN9A; (+) strand; PAM type: YTN; PAM sequence: TTA
gaactctctatatctaagat

SEQ ID NO: 105476 - DNA, 20 bp, Artificial Sequence
  Description of Artificial Sequence: Synthetic oligonucleotide
  Target: SCN9A; (+) strand; PAM type: YTN; PAM sequence: CTC
tctatatctaagatcagatc

SEQ ID NO: 105477 - DNA, 20 bp, Artificial Sequence
  Description of Artificial Sequence: Synthetic oligonucleotide
  Target: SCN9A; (+) strand; PAM type: YTN; PAM sequence: CTC
tatatctaagatcagatcat

SEQ ID NO: 105478 - DNA, 20 bp, Artificial Sequence
  Description of Artificial Sequence: Synthetic oligonucleotide
  Target: SCN9A; (+) strand; PAM type: YTN; PAM sequence: CTA
tatctaagatcagatcatat

SEQ ID NO: 105479 - DNA, 20 bp, Artificial Sequence
  Description of Artificial Sequence: Synthetic oligonucleotide
  Target: SCN9A; (+) strand; PAM type: YTN; PAM sequence: CTA
agatcagatcatataaaaac

SEQ ID NO: 105480 - DNA, 20 bp, Artificial Sequence
  Description of Artificial Sequence: Synthetic oligonucleotide
  Target: SCN9A; (+) strand; PAM type: YTN; PAM sequence: TTT
gacttccttctttccaattt

SEQ ID NO: 105481 - DNA, 20 bp, Artificial Sequence
  Description of Artificial Sequence: Synthetic oligonucleotide
  Target: SCN9A; (+) strand; PAM type: YTN; PAM sequence: TTG
acttccttctttccaattta

SEQ ID NO: 105482 - DNA, 20 bp, Artificial Sequence
  Description of Artificial Sequence: Synthetic oligonucleotide
  Target: SCN9A; (+) strand; PAM type: YTN; PAM sequence: CTT
ccttctttccaatttaaatg

SEQ ID NO: 105483 - DNA, 20 bp, Artificial Sequence
  Description of Artificial Sequence: Synthetic oligonucleotide
  Target: SCN9A; (+) strand; PAM type: YTN; PAM sequence: TTC
cttctttccaatttaaatgt

SEQ ID NO: 105484 - DNA, 20 bp, Artificial Sequence
  Description of Artificial Sequence: Synthetic oligonucleotide
  Target: SCN9A; (+) strand; PAM type: YTN; PAM sequence: CTT
ctttccaatttaaatgtcct

SEQ ID NO: 105485 - DNA, 20 bp, Artificial Sequence
  Description of Artificial Sequence: Synthetic oligonucleotide
  Target: SCN9A; (+) strand; PAM type: YTN; PAM sequence: TTC
tttccaatttaaatgtcctt

SEQ ID NO: 105486 - DNA, 20 bp, Artificial Sequence
  Description of Artificial Sequence: Synthetic oligonucleotide
  Target: SCN9A; (+) strand; PAM type: YTN; PAM sequence: CTT
tccaatttaaatgtccttta

SEQ ID NO: 105487 - DNA, 20 bp, Artificial Sequence
  Description of Artificial Sequence: Synthetic oligonucleotide
  Target: SCN9A; (+) strand; PAM type: YTN; PAM sequence: TTT
ccaatttaaatgtcctttat

SEQ ID NO: 105488 - DNA, 20 bp, Artificial Sequence
  Description of Artificial Sequence: Synthetic oligonucleotide
  Target: SCN9A; (+) strand; PAM type: YTN; PAM sequence: TTC
caatttaaatgtcctttatt

SEQ ID NO: 105489 - DNA, 20 bp, Artificial Sequence
  Description of Artificial Sequence: Synthetic oligonucleotide
  Target: SCN9A; (+) strand; PAM type: YTN; PAM sequence: TTT
aaatgtcctttatttctttc

SEQ ID NO: 105490 - DNA, 20 bp, Artificial Sequence
  Description of Artificial Sequence: Synthetic oligonucleotide
  Target: SCN9A; (+) strand; PAM type: YTN; PAM sequence: TTA
aatgtcctttatttctttct

SEQ ID NO: 105491 - DNA, 20 bp, Artificial Sequence
  Description of Artificial Sequence: Synthetic oligonucleotide
  Target: SCN9A; (+) strand; PAM type: YTN; PAM sequence: CTT
tatttctttctcttgcctga

SEQ ID NO: 105492 - DNA, 20 bp, Artificial Sequence
  Description of Artificial Sequence: Synthetic oligonucleotide
  Target: SCN9A; (+) strand; PAM type: YTN; PAM sequence: TTT
atttctttctcttgcctgat

SEQ ID NO: 105493 - DNA, 20 bp, Artificial Sequence
  Description of Artificial Sequence: Synthetic oligonucleotide
  Target: SCN9A; (+) strand; PAM type: YTN; PAM sequence: TTA
tttctttctcttgcctgatt

SEQ ID NO: 105494 - DNA, 20 bp, Artificial Sequence
  Description of Artificial Sequence: Synthetic oligonucleotide
  Target: SCN9A; (+) strand; PAM type: YTN; PAM sequence: TTT
ctttctcttgcctgattgct

SEQ ID NO: 105495 - DNA, 20 bp, Artificial Sequence
  Description of Artificial Sequence: Synthetic oligonucleotide
  Target: SCN9A; (+) strand; PAM type: YTN; PAM sequence: TTC
tttctcttgcctgattgctc

SEQ ID NO: 105496 - DNA, 20 bp, Artificial Sequence
  Description of Artificial Sequence: Synthetic oligonucleotide
  Target: SCN9A; (+) strand; PAM type: YTN; PAM sequence: CTT
tctcttgcctgattgctctg

SEQ ID NO: 105497 - DNA, 20 bp, Artificial Sequence
  Description of Artificial Sequence: Synthetic oligonucleotide
  Target: SCN9A; (+) strand; PAM type: YTN; PAM sequence: TTT
ctcttgcctgattgctctgg

SEQ ID NO: 105498 - DNA, 20 bp, Artificial Sequence
  Description of Artificial Sequence: Synthetic oligonucleotide
  Target: SCN9A; (+) strand; PAM type: YTN; PAM sequence: TTC
tcttgcctgattgctctggc

SEQ ID NO: 105499 - DNA, 20 bp, Artificial Sequence
  Description of Artificial Sequence: Synthetic oligonucleotide
  Target: SCN9A; (+) strand; PAM type: YTN; PAM sequence: CTC
ttgcctgattgctctggcta

SEQ ID NO: 105500 - DNA, 20 bp, Artificial Sequence
  Description of Artificial Sequence: Synthetic oligonucleotide
  Target: SCN9A; (+) strand; PAM type: YTN; PAM sequence: CTT
gcctgattgctctggctaga

SEQ ID NO: 105501 - DNA, 20 bp, Artificial Sequence
  Description of Artificial Sequence: Synthetic oligonucleotide
  Target: SCN9A; (+) strand; PAM type: YTN; PAM sequence: TTG
cctgattgctctggctagaa

SEQ ID NO: 105502 - DNA, 20 bp, Artificial Sequence
  Description of Artificial Sequence: Synthetic oligonucleotide
  Target: SCN9A; (+) strand; PAM type: YTN; PAM sequence: CTG
attgctctggctagaacttc

SEQ ID NO: 105503 - DNA, 20 bp, Artificial Sequence
  Description of Artificial Sequence: Synthetic oligonucleotide
  Target: SCN9A; (+) strand; PAM type: YTN; PAM sequence: TTG
ctctggctagaacttcatta

SEQ ID NO: 105504 - DNA, 20 bp, Artificial Sequence
  Description of Artificial Sequence: Synthetic oligonucleotide
  Target: SCN9A; (+) strand; PAM type: YTN; PAM sequence: CTC
tggctagaacttcattacta

SEQ ID NO: 105505 - DNA, 20 bp, Artificial Sequence
  Description of Artificial Sequence: Synthetic oligonucleotide
  Target: SCN9A; (+) strand; PAM type: YTN; PAM sequence: CTG
gctagaacttcattactatg

SEQ ID NO: 105506 - DNA, 20 bp, Artificial Sequence
  Description of Artificial Sequence: Synthetic oligonucleotide
  Target: SCN9A; (+) strand; PAM type: YTN; PAM sequence: CTA
gaacttcattactatgttga

SEQ ID NO: 105507 - DNA, 20 bp, Artificial Sequence
  Description of Artificial Sequence: Synthetic oligonucleotide
  Target: SCN9A; (+) strand; PAM type: YTN; PAM sequence: CTT
cattactatgttgaataaaa

SEQ ID NO: 105508 - DNA, 20 bp, Artificial Sequence
  Description of Artificial Sequence: Synthetic oligonucleotide
  Target: SCN9A; (+) strand; PAM type: YTN; PAM sequence: TTC
attactatgttgaataaaag

SEQ ID NO: 105509 - DNA, 20 bp, Artificial Sequence
  Description of Artificial Sequence: Synthetic oligonucleotide
  Target: SCN9A; (+) strand; PAM type: YTN; PAM sequence: TTA
ctatgttgaataaaagtagt

SEQ ID NO: 105510 - DNA, 20 bp, Artificial Sequence
  Description of Artificial Sequence: Synthetic oligonucleotide
  Target: SCN9A; (+) strand; PAM type: YTN; PAM sequence: CTA
tgttgaataaaagtagtgaa

SEQ ID NO: 105511 - DNA, 20 bp, Artificial Sequence
  Description of Artificial Sequence: Synthetic oligonucleotide
  Target: SCN9A; (+) strand; PAM type: YTN; PAM sequence: TTG
aataaaagtagtgaaagtgg

SEQ ID NO: 105512 - DNA, 20 bp, Artificial Sequence
  Description of Artificial Sequence: Synthetic oligonucleotide
  Target: SCN9A; (+) strand; PAM type: YTN; PAM sequence: CTT
atcttgttccagatcttgga

SEQ ID NO: 105513 - DNA, 20 bp, Artificial Sequence
  Description of Artificial Sequence: Synthetic oligonucleotide
  Target: SCN9A; (+) strand; PAM type: YTN; PAM sequence: TTA
tcttgttccagatcttggag

SEQ ID NO: 105514 - DNA, 20 bp, Artificial Sequence
  Description of Artificial Sequence: Synthetic oligonucleotide
  Target: SCN9A; (+) strand; PAM type: YTN; PAM sequence: CTT
gttccagatcttggagagaa

SEQ ID NO: 105515 - DNA, 20 bp, Artificial Sequence
  Description of Artificial Sequence: Synthetic oligonucleotide
  Target: SCN9A; (+) strand; PAM type: YTN; PAM sequence: TTG
ttccagatcttggagagaaa

SEQ ID NO: 105516 - DNA, 20 bp, Artificial Sequence
  Description of Artificial Sequence: Synthetic oligonucleotide
  Target: SCN9A; (+) strand; PAM type: YTN; PAM sequence: TTC
cagatcttggagagaaagct

SEQ ID NO: 105517 - DNA, 20 bp, Artificial Sequence
  Description of Artificial Sequence: Synthetic oligonucleotide
  Target: SCN9A; (+) strand; PAM type: YTN; PAM sequence: CTT
ggagagaaagctttcagctc

SEQ ID NO: 105518 - DNA, 20 bp, Artificial Sequence
  Description of Artificial Sequence: Synthetic oligonucleotide
  Target: SCN9A; (+) strand; PAM type: YTN; PAM sequence: TTG
gagagaaagctttcagctct

SEQ ID NO: 105519 - DNA, 20 bp, Artificial Sequence
  Description of Artificial Sequence: Synthetic oligonucleotide
  Target: SCN9A; (+) strand; PAM type: YTN; PAM sequence: CTT
tcagctcttccctggttagt

SEQ ID NO: 105520 - DNA, 20 bp, Artificial Sequence
  Description of Artificial Sequence: Synthetic oligonucleotide
  Target: SCN9A; (+) strand; PAM type: YTN; PAM sequence: TTT
cagctcttccctggttagta

SEQ ID NO: 105521 - DNA, 20 bp, Artificial Sequence
  Description of Artificial Sequence: Synthetic oligonucleotide
  Target: SCN9A; (+) strand; PAM type: YTN; PAM sequence: TTC
agctcttccctggttagtat

SEQ ID NO: 105522 - DNA, 20 bp, Artificial Sequence
  Description of Artificial Sequence: Synthetic oligonucleotide
  Target: SCN9A; (+) strand; PAM type: YTN; PAM sequence: CTC
ttccctggttagtatcatgt

SEQ ID NO: 105523 - DNA, 20 bp, Artificial Sequence
  Description of Artificial Sequence: Synthetic oligonucleotide
  Target: SCN9A; (+) strand; PAM type: YTN; PAM sequence: CTT
ccctggttagtatcatgtta

SEQ ID NO: 105524 - DNA, 20 bp, Artificial Sequence
  Description of Artificial Sequence: Synthetic oligonucleotide
  Target: SCN9A; (+) strand; PAM type: YTN; PAM sequence: TTC
cctggttagtatcatgttag

SEQ ID NO: 105525 - DNA, 20 bp, Artificial Sequence
  Description of Artificial Sequence: Synthetic oligonucleotide
  Target: SCN9A; (+) strand; PAM type: YTN; PAM sequence: CTG
gttagtatcatgttagctgt

SEQ ID NO: 105526 - DNA, 20 bp, Artificial Sequence
  Description of Artificial Sequence: Synthetic oligonucleotide
  Target: SCN9A; (+) strand; PAM type: YTN; PAM sequence: TTA
gtatcatgttagctgtgggt

SEQ ID NO: 105527 - DNA, 20 bp, Artificial Sequence
  Description of Artificial Sequence: Synthetic oligonucleotide
  Target: SCN9A; (+) strand; PAM type: YTN; PAM sequence: TTA
gctgtgggtttgttacatat

SEQ ID NO: 105528 - DNA, 20 bp, Artificial Sequence
  Description of Artificial Sequence: Synthetic oligonucleotide
  Target: SCN9A; (+) strand; PAM type: YTN; PAM sequence: CTG
tgggtttgttacatatggcc

SEQ ID NO: 105529 - DNA, 20 bp, Artificial Sequence
  Description of Artificial Sequence: Synthetic oligonucleotide
  Target: SCN9A; (+) strand; PAM type: YTN; PAM sequence: TTT
gttacatatggccttcatta

SEQ ID NO: 105530 - DNA, 20 bp, Artificial Sequence
  Description of Artificial Sequence: Synthetic oligonucleotide
  Target: SCN9A; (+) strand; PAM type: YTN; PAM sequence: TTG
ttacatatggccttcattac

SEQ ID NO: 105531 - DNA, 20 bp, Artificial Sequence
  Description of Artificial Sequence: Synthetic oligonucleotide
  Target: SCN9A; (+) strand; PAM type: YTN; PAM sequence: TTA
catatggccttcattacatt

SEQ ID NO: 105532 - DNA, 20 bp, Artificial Sequence
  Description of Artificial Sequence: Synthetic oligonucleotide
  Target: SCN9A; (+) strand; PAM type: YTN; PAM sequence: CTT
cattacattaaggtatgttt

SEQ ID NO: 105533 - DNA, 20 bp, Artificial Sequence
  Description of Artificial Sequence: Synthetic oligonucleotide
  Target: SCN9A; (+) strand; PAM type: YTN; PAM sequence: TTC
attacattaaggtatgtttc

SEQ ID NO: 105534 - DNA, 20 bp, Artificial Sequence
  Description of Artificial Sequence: Synthetic oligonucleotide
  Target: SCN9A; (+) strand; PAM type: YTN; PAM sequence: TTA
cattaaggtatgtttcttct

SEQ ID NO: 105535 - DNA, 20 bp, Artificial Sequence
  Description of Artificial Sequence: Synthetic oligonucleotide
  Target: SCN9A; (+) strand; PAM type: YTN; PAM sequence: TTA
aggtatgtttcttctatact

SEQ ID NO: 105536 - DNA, 20 bp, Artificial Sequence
  Description of Artificial Sequence: Synthetic oligonucleotide
  Target: SCN9A; (+) strand; PAM type: YTN; PAM sequence: TTT
cttctatacttaatttgttg

SEQ ID NO: 105537 - DNA, 20 bp, Artificial Sequence
  Description of Artificial Sequence: Synthetic oligonucleotide
  Target: SCN9A; (+) strand; PAM type: YTN; PAM sequence: TTC
ttctatacttaatttgttga

SEQ ID NO: 105538 - DNA, 20 bp, Artificial Sequence
  Description of Artificial Sequence: Synthetic oligonucleotide
  Target: SCN9A; (+) strand; PAM type: YTN; PAM sequence: CTT
ctatacttaatttgttgata

SEQ ID NO: 105539 - DNA, 20 bp, Artificial Sequence
  Description of Artificial Sequence: Synthetic oligonucleotide
  Target: SCN9A; (+) strand; PAM type: YTN; PAM sequence: TTC
tatacttaatttgttgataa

SEQ ID NO: 105540 - DNA, 20 bp, Artificial Sequence
  Description of Artificial Sequence: Synthetic oligonucleotide
  Target: SCN9A; (+) strand; PAM type: YTN; PAM sequence: CTA
tacttaatttgttgataatt

SEQ ID NO: 105541 - DNA, 20 bp, Artificial Sequence
  Description of Artificial Sequence: Synthetic oligonucleotide
  Target: SCN9A; (+) strand; PAM type: YTN; PAM sequence: CTT
aatttgttgataatttttat

SEQ ID NO: 105542 - DNA, 20 bp, Artificial Sequence
  Description of Artificial Sequence: Synthetic oligonucleotide
  Target: SCN9A; (+) strand; PAM type: YTN; PAM sequence: TTA
atttgttgataatttttatc

SEQ ID NO: 105543 - DNA, 20 bp, Artificial Sequence
  Description of Artificial Sequence: Synthetic oligonucleotide
  Target: SCN9A; (+) strand; PAM type: YTN; PAM sequence: TTT
gttgataatttttatcaaat

SEQ ID NO: 105544 - DNA, 20 bp, Artificial Sequence
  Description of Artificial Sequence: Synthetic oligonucleotide
  Target: SCN9A; (+) strand; PAM type: YTN; PAM sequence: TTG
ttgataatttttatcaaata

SEQ ID NO: 105545 - DNA, 20 bp, Artificial Sequence
  Description of Artificial Sequence: Synthetic oligonucleotide
  Target: SCN9A; (+) strand; PAM type: YTN; PAM sequence: TTG
ataatttttatcaaataaag

SEQ ID NO: 105546 - DNA, 20 bp, Artificial Sequence
  Description of Artificial Sequence: Synthetic oligonucleotide
  Target: SCN9A; (+) strand; PAM type: YTN; PAM sequence: TTT
ttatcaaataaaggatactg

SEQ ID NO: 105547 - DNA, 20 bp, Artificial Sequence
  Description of Artificial Sequence: Synthetic oligonucleotide
  Target: SCN9A; (+) strand; PAM type: YTN; PAM sequence: TTT
tatcaaataaaggatactgg

SEQ ID NO: 105548 - DNA, 20 bp, Artificial Sequence
  Description of Artificial Sequence: Synthetic oligonucleotide
  Target: SCN9A; (+) strand; PAM type: YTN; PAM sequence: TTT
atcaaataaaggatactgga

SEQ ID NO: 105549 - DNA, 20 bp, Artificial Sequence
  Description of Artificial Sequence: Synthetic oligonucleotide
  Target: SCN9A; (+) strand; PAM type: YTN; PAM sequence: TTA
tcaaataaaggatactggat

SEQ ID NO: 105550 - DNA, 20 bp, Artificial Sequence
  Description of Artificial Sequence: Synthetic oligonucleotide
  Target: SCN9A; (+) strand; PAM type: YTN; PAM sequence: CTG
gattttataaaatgcttttt

SEQ ID NO: 105551 - DNA, 20 bp, Artificial Sequence
  Description of Artificial Sequence: Synthetic oligonucleotide
  Target: SCN9A; (+) strand; PAM type: YTN; PAM sequence: TTT
tataaaatgctttttctctg

SEQ ID NO: 105552 - DNA, 20 bp, Artificial Sequence
  Description of Artificial Sequence: Synthetic oligonucleotide
  Target: SCN9A; (+) strand; PAM type: YTN; PAM sequence: TTT
ataaaatgctttttctctgt

SEQ ID NO: 105553 - DNA, 20 bp, Artificial Sequence
  Description of Artificial Sequence: Synthetic oligonucleotide
  Target: SCN9A; (+) strand; PAM type: YTN; PAM sequence: TTA
taaaatgctttttctctgtc

SEQ ID NO: 105554 - DNA, 20 bp, Artificial Sequence
  Description of Artificial Sequence: Synthetic oligonucleotide
  Target: SCN9A; (+) strand; PAM type: YTN; PAM sequence: CTT
tttctctgtctattgagatg

SEQ ID NO: 105555 - DNA, 20 bp, Artificial Sequence
  Description of Artificial Sequence: Synthetic oligonucleotide
  Target: SCN9A; (+) strand; PAM type: YTN; PAM sequence: TTT
ttctctgtctattgagatga

SEQ ID NO: 105556 - DNA, 20 bp, Artificial Sequence
  Description of Artificial Sequence: Synthetic oligonucleotide
  Target: SCN9A; (+) strand; PAM type: YTN; PAM sequence: TTT
tctctgtctattgagatgat

SEQ ID NO: 105557 - DNA, 20 bp, Artificial Sequence
  Description of Artificial Sequence: Synthetic oligonucleotide
  Target: SCN9A; (+) strand; PAM type: YTN; PAM sequence: TTT
ctctgtctattgagatgatt

SEQ ID NO: 105558 - DNA, 20 bp, Artificial Sequence
  Description of Artificial Sequence: Synthetic oligonucleotide
  Target: SCN9A; (+) strand; PAM type: YTN; PAM sequence: TTC
tctgtctattgagatgatta

SEQ ID NO: 105559 - DNA, 20 bp, Artificial Sequence
  Description of Artificial Sequence: Synthetic oligonucleotide
  Target: SCN9A; (+) strand; PAM type: YTN; PAM sequence: CTC
tgtctattgagatgattata

SEQ ID NO: 105560 - DNA, 20 bp, Artificial Sequence
  Description of Artificial Sequence: Synthetic oligonucleotide
  Target: SCN9A; (+) strand; PAM type: YTN; PAM sequence: CTG
tctattgagatgattatatg

SEQ ID NO: 105561 - DNA, 20 bp, Artificial Sequence
  Description of Artificial Sequence: Synthetic oligonucleotide
  Target: SCN9A; (+) strand; PAM type: YTN; PAM sequence: CTA
ttgagatgattatatggttt

SEQ ID NO: 105562 - DNA, 20 bp, Artificial Sequence
  Description of Artificial Sequence: Synthetic oligonucleotide
  Target: SCN9A; (+) strand; PAM type: YTN; PAM sequence: TTG
agatgattatatggttttta

SEQ ID NO: 105563 - DNA, 20 bp, Artificial Sequence
  Description of Artificial Sequence: Synthetic oligonucleotide
  Target: SCN9A; (+) strand; PAM type: YTN; PAM sequence: TTA
tatggtttttatgtttcatt

SEQ ID NO: 105564 - DNA, 20 bp, Artificial Sequence
  Description of Artificial Sequence: Synthetic oligonucleotide
  Target: SCN9A; (+) strand; PAM type: YTN; PAM sequence: TTT
ttatgtttcattctgttgat

SEQ ID NO: 105565 - DNA, 20 bp, Artificial Sequence
  Description of Artificial Sequence: Synthetic oligonucleotide
  Target: SCN9A; (+) strand; PAM type: YTN; PAM sequence: TTT
tatgtttcattctgttgata

SEQ ID NO: 105566 - DNA, 20 bp, Artificial Sequence
  Description of Artificial Sequence: Synthetic oligonucleotide
  Target: SCN9A; (+) strand; PAM type: YTN; PAM sequence: TTT
atgtttcattctgttgatat

SEQ ID NO: 105567 - DNA, 20 bp, Artificial Sequence
  Description of Artificial Sequence: Synthetic oligonucleotide
  Target: SCN9A; (+) strand; PAM type: YTN; PAM sequence: TTA
tgtttcattctgttgatata

SEQ ID NO: 105568 - DNA, 20 bp, Artificial Sequence
  Description of Artificial Sequence: Synthetic oligonucleotide
  Target: SCN9A; (+) strand; PAM type: YTN; PAM sequence: TTT
cattctgttgatataatata

SEQ ID NO: 105569 - DNA, 20 bp, Artificial Sequence
  Description of Artificial Sequence: Synthetic oligonucleotide
  Target: SCN9A; (+) strand; PAM type: YTN; PAM sequence: TTC
attctgttgatataatatag

SEQ ID NO: 105570 - DNA, 20 bp, Artificial Sequence
  Description of Artificial Sequence: Synthetic oligonucleotide
  Target: SCN9A; (+) strand; PAM type: YTN; PAM sequence: TTC
tgttgatataatatagaaag

SEQ ID NO: 105571 - DNA, 20 bp, Artificial Sequence
  Description of Artificial Sequence: Synthetic oligonucleotide
  Target: SCN9A; (+) strand; PAM type: YTN; PAM sequence: CTG
ttgatataatatagaaagtt

SEQ ID NO: 105572 - DNA, 20 bp, Artificial Sequence
  Description of Artificial Sequence: Synthetic oligonucleotide
  Target: SCN9A; (+) strand; PAM type: YTN; PAM sequence: TTG
atataatatagaaagtttat

SEQ ID NO: 105573 - DNA, 20 bp, Artificial Sequence
  Description of Artificial Sequence: Synthetic oligonucleotide
  Target: SCN9A; (+) strand; PAM type: YTN; PAM sequence: TTT
attgttctgcaaatgttgaa

SEQ ID NO: 105574 - DNA, 20 bp, Artificial Sequence
  Description of Artificial Sequence: Synthetic oligonucleotide
  Target: SCN9A; (+) strand; PAM type: YTN; PAM sequence: TTA
ttgttctgcaaatgttgaaa

SEQ ID NO: 105575 - DNA, 20 bp, Artificial Sequence
  Description of Artificial Sequence: Synthetic oligonucleotide
  Target: SCN9A; (+) strand; PAM type: YTN; PAM sequence: TTG
ttctgcaaatgttgaaacat

SEQ ID NO: 105576 - DNA, 20 bp, Artificial Sequence
  Description of Artificial Sequence: Synthetic oligonucleotide
  Target: SCN9A; (+) strand; PAM type: YTN; PAM sequence: TTC
tgcaaatgttgaaacatctt

SEQ ID NO: 105577 - DNA, 20 bp, Artificial Sequence
  Description of Artificial Sequence: Synthetic oligonucleotide
  Target: SCN9A; (+) strand; PAM type: YTN; PAM sequence: CTG
caaatgttgaaacatctttg

SEQ ID NO: 105578 - DNA, 20 bp, Artificial Sequence
  Description of Artificial Sequence: Synthetic oligonucleotide
  Target: SCN9A; (+) strand; PAM type: YTN; PAM sequence: TTG
aaacatctttgcatccctgg

SEQ ID NO: 105579 - DNA, 20 bp, Artificial Sequence
  Description of Artificial Sequence: Synthetic oligonucleotide
  Target: SCN9A; (+) strand; PAM type: YTN; PAM sequence: CTT
tgcatccctgggacgatttc

SEQ ID NO: 105580 - DNA, 20 bp, Artificial Sequence
  Description of Artificial Sequence: Synthetic oligonucleotide
  Target: SCN9A; (+) strand; PAM type: YTN; PAM sequence: TTT
gcatccctgggacgatttcc

SEQ ID NO: 105581 - DNA, 20 bp, Artificial Sequence
  Description of Artificial Sequence: Synthetic oligonucleotide
  Target: SCN9A; (+) strand; PAM type: YTN; PAM sequence: TTG
catccctgggacgatttcca

SEQ ID NO: 105582 - DNA, 20 bp, Artificial Sequence
  Description of Artificial Sequence: Synthetic oligonucleotide
  Target: SCN9A; (+) strand; PAM type: YTN; PAM sequence: CTG
ggacgatttccagttgagca

SEQ ID NO: 105583 - DNA, 20 bp, Artificial Sequence
  Description of Artificial Sequence: Synthetic oligonucleotide
  Target: SCN9A; (+) strand; PAM type: YTN; PAM sequence: TTT
ccagttgagcatggtgaata

SEQ ID NO: 105584 - DNA, 20 bp, Artificial Sequence
  Description of Artificial Sequence: Synthetic oligonucleotide
  Target: SCN9A; (+) strand; PAM type: YTN; PAM sequence: TTC
cagttgagcatggtgaataa

SEQ ID NO: 105585 - DNA, 20 bp, Artificial Sequence
  Description of Artificial Sequence: Synthetic oligonucleotide
  Target: SCN9A; (+) strand; PAM type: YTN; PAM sequence: TTG
agcatggtgaataatctttt

SEQ ID NO: 105586 - DNA, 20 bp, Artificial Sequence
  Description of Artificial Sequence: Synthetic oligonucleotide
  Target: SCN9A; (+) strand; PAM type: YTN; PAM sequence: CTT
tttgataggctgttggattt

SEQ ID NO: 105587 - DNA, 20 bp, Artificial Sequence
  Description of Artificial Sequence: Synthetic oligonucleotide
  Target: SCN9A; (+) strand; PAM type: YTN; PAM sequence: TTT
ttgataggctgttggatttg

SEQ ID NO: 105588 - DNA, 20 bp, Artificial Sequence
  Description of Artificial Sequence: Synthetic oligonucleotide
  Target: SCN9A; (+) strand; PAM type: YTN; PAM sequence: TTT
tgataggctgttggatttga

SEQ ID NO: 105589 - DNA, 20 bp, Artificial Sequence
  Description of Artificial Sequence: Synthetic oligonucleotide
  Target: SCN9A; (+) strand; PAM type: YTN; PAM sequence: TTT
gataggctgttggatttgag

SEQ ID NO: 105590 - DNA, 20 bp, Artificial Sequence
  Description of Artificial Sequence: Synthetic oligonucleotide
  Target: SCN9A; (+) strand; PAM type: YTN; PAM sequence: TTG
ataggctgttggatttgagt

SEQ ID NO: 105591 - DNA, 20 bp, Artificial Sequence
  Description of Artificial Sequence: Synthetic oligonucleotide
  Target: SCN9A; (+) strand; PAM type: YTN; PAM sequence: CTG
ttggatttgagttgctagta

SEQ ID NO: 105592 - DNA, 20 bp, Artificial Sequence
  Description of Artificial Sequence: Synthetic oligonucleotide
  Target: SCN9A; (+) strand; PAM type: YTN; PAM sequence: TTG
gatttgagttgctagtattt

SEQ ID NO: 105593 - DNA, 20 bp, Artificial Sequence
  Description of Artificial Sequence: Synthetic oligonucleotide
  Target: SCN9A; (+) strand; PAM type: YTN; PAM sequence: TTT
gagttgctagtattttgttg

SEQ ID NO: 105594 - DNA, 20 bp, Artificial Sequence
  Description of Artificial Sequence: Synthetic oligonucleotide
  Target: SCN9A; (+) strand; PAM type: YTN; PAM sequence: TTG
agttgctagtattttgttgg

SEQ ID NO: 105595 - DNA, 20 bp, Artificial Sequence
  Description of Artificial Sequence: Synthetic oligonucleotide
  Target: SCN9A; (+) strand; PAM type: YTN; PAM sequence: TTG
ctagtattttgttggggcat

SEQ ID NO: 105596 - DNA, 20 bp, Artificial Sequence
  Description of Artificial Sequence: Synthetic oligonucleotide
  Target: SCN9A; (+) strand; PAM type: YTN; PAM sequence: CTA
gtattttgttggggcatttt

SEQ ID NO: 105597 - DNA, 20 bp, Artificial Sequence
  Description of Artificial Sequence: Synthetic oligonucleotide
  Target: SCN9A; (+) strand; PAM type: YTN; PAM sequence: TTT
tgttggggcattttgcatct

SEQ ID NO: 105598 - DNA, 20 bp, Artificial Sequence
  Description of Artificial Sequence: Synthetic oligonucleotide
  Target: SCN9A; (+) strand; PAM type: YTN; PAM sequence: TTT
gttggggcattttgcatctg

SEQ ID NO: 105599 - DNA, 20 bp, Artificial Sequence
  Description of Artificial Sequence: Synthetic oligonucleotide
  Target: SCN9A; (+) strand; PAM type: YTN; PAM sequence: TTG
ttggggcattttgcatctgt

SEQ ID NO: 105600 - DNA, 20 bp, Artificial Sequence
  Description of Artificial Sequence: Synthetic oligonucleotide
  Target: SCN9A; (+) strand; PAM type: YTN; PAM sequence: TTG
gggcattttgcatctgtgtt

SEQ ID NO: 105601 - DNA, 20 bp, Artificial Sequence
  Description of Artificial Sequence: Synthetic oligonucleotide
  Target: SCN9A; (+) strand; PAM type: YTN; PAM sequence: TTT
tgcatctgtgttcatcaggg

SEQ ID NO: 105602 - DNA, 20 bp, Artificial Sequence
  Description of Artificial Sequence: Synthetic oligonucleotide
  Target: SCN9A; (+) strand; PAM type: YTN; PAM sequence: TTT
gcatctgtgttcatcaggga

SEQ ID NO: 105603 - DNA, 20 bp, Artificial Sequence
  Description of Artificial Sequence: Synthetic oligonucleotide
  Target: SCN9A; (+) strand; PAM type: YTN; PAM sequence: TTG
catctgtgttcatcagggat

SEQ ID NO: 105604 - DNA, 20 bp, Artificial Sequence
  Description of Artificial Sequence: Synthetic oligonucleotide
  Target: SCN9A; (+) strand; PAM type: YTN; PAM sequence: CTG
tgttcatcagggatagtggc

SEQ ID NO: 105605 - DNA, 20 bp, Artificial Sequence
  Description of Artificial Sequence: Synthetic oligonucleotide
  Target: SCN9A; (+) strand; PAM type: YTN; PAM sequence: TTC
atcagggatagtggccttca

SEQ ID NO: 105606 - DNA, 20 bp, Artificial Sequence
  Description of Artificial Sequence: Synthetic oligonucleotide
  Target: SCN9A; (+) strand; PAM type: YTN; PAM sequence: CTT
cagctttcttttcgtgtgtg

SEQ ID NO: 105607 - DNA, 20 bp, Artificial Sequence
  Description of Artificial Sequence: Synthetic oligonucleotide
  Target: SCN9A; (+) strand; PAM type: YTN; PAM sequence: TTC
agctttcttttcgtgtgtgt

SEQ ID NO: 105608 - DNA, 20 bp, Artificial Sequence
  Description of Artificial Sequence: Synthetic oligonucleotide
  Target: SCN9A; (+) strand; PAM type: YTN; PAM sequence: CTT
tcttttcgtgtgtgtgtgtc

SEQ ID NO: 105609 - DNA, 20 bp, Artificial Sequence
  Description of Artificial Sequence: Synthetic oligonucleotide
  Target: SCN9A; (+) strand; PAM type: YTN; PAM sequence: TTT
cttttcgtgtgtgtgtgtcc

SEQ ID NO: 105610 - DNA, 20 bp, Artificial Sequence
  Description of Artificial Sequence: Synthetic oligonucleotide
  Target: SCN9A; (+) strand; PAM type: YTN; PAM sequence: TTC
ttttcgtgtgtgtgtgtccc

SEQ ID NO: 105611 - DNA, 20 bp, Artificial Sequence
  Description of Artificial Sequence: Synthetic oligonucleotide
  Target: SCN9A; (+) strand; PAM type: YTN; PAM sequence: CTT
ttcgtgtgtgtgtgtccctg

SEQ ID NO: 105612 - DNA, 20 bp, Artificial Sequence
  Description of Artificial Sequence: Synthetic oligonucleotide
  Target: SCN9A; (+) strand; PAM type: YTN; PAM sequence: TTT
tcgtgtgtgtgtgtccctgt

SEQ ID NO: 105613 - DNA, 20 bp, Artificial Sequence
  Description of Artificial Sequence: Synthetic oligonucleotide
  Target: SCN9A; (+) strand; PAM type: YTN; PAM sequence: TTT
cgtgtgtgtgtgtccctgtc

SEQ ID NO: 105614 - DNA, 20 bp, Artificial Sequence
  Description of Artificial Sequence: Synthetic oligonucleotide
  Target: SCN9A; (+) strand; PAM type: YTN; PAM sequence: TTC
gtgtgtgtgtgtccctgtct

SEQ ID NO: 105615 - DNA, 20 bp, Artificial Sequence
  Description of Artificial Sequence: Synthetic oligonucleotide
  Target: SCN9A; (+) strand; PAM type: YTN; PAM sequence: CTG
tcttgttctggtattggggt

SEQ ID NO: 105616 - DNA, 20 bp, Artificial Sequence
  Description of Artificial Sequence: Synthetic oligonucleotide
  Target: SCN9A; (+) strand; PAM type: YTN; PAM sequence: CTT
gttctggtattggggtaata

SEQ ID NO: 105617 - DNA, 20 bp, Artificial Sequence
  Description of Artificial Sequence: Synthetic oligonucleotide
  Target: SCN9A; (+) strand; PAM type: YTN; PAM sequence: TTG
ttctggtattggggtaatat

SEQ ID NO: 105618 - DNA, 20 bp, Artificial Sequence
  Description of Artificial Sequence: Synthetic oligonucleotide
  Target: SCN9A; (+) strand; PAM type: YTN; PAM sequence: TTC
tggtattggggtaatattgg

SEQ ID NO: 105619 - DNA, 20 bp, Artificial Sequence
  Description of Artificial Sequence: Synthetic oligonucleotide
  Target: SCN9A; (+) strand; PAM type: YTN; PAM sequence: CTG
gtattggggtaatattggcc

SEQ ID NO: 105620 - DNA, 20 bp, Artificial Sequence
  Description of Artificial Sequence: Synthetic oligonucleotide
  Target: SCN9A; (+) strand; PAM type: YTN; PAM sequence: TTG
gggtaatattggccttgtag

SEQ ID NO: 105621 - DNA, 20 bp, Artificial Sequence
  Description of Artificial Sequence: Synthetic oligonucleotide
  Target: SCN9A; (+) strand; PAM type: YTN; PAM sequence: TTG
gccttgtagaatgaatttag

SEQ ID NO: 105622 - DNA, 20 bp, Artificial Sequence
  Description of Artificial Sequence: Synthetic oligonucleotide
  Target: SCN9A; (+) strand; PAM type: YTN; PAM sequence: CTT
gtagaatgaatttagaagaa

SEQ ID NO: 105623 - DNA, 20 bp, Artificial Sequence
  Description of Artificial Sequence: Synthetic oligonucleotide
  Target: SCN9A; (+) strand; PAM type: YTN; PAM sequence: TTG
tagaatgaatttagaagaat

SEQ ID NO: 105624 - DNA, 20 bp, Artificial Sequence
  Description of Artificial Sequence: Synthetic oligonucleotide
  Target: SCN9A; (+) strand; PAM type: YTN; PAM sequence: TTT
agaagaattcctttcctttt

SEQ ID NO: 105625 - DNA, 20 bp, Artificial Sequence
  Description of Artificial Sequence: Synthetic oligonucleotide
  Target: SCN9A; (+) strand; PAM type: YTN; PAM sequence: TTA
gaagaattcctttccttttg

SEQ ID NO: 105626 - DNA, 20 bp, Artificial Sequence
  Description of Artificial Sequence: Synthetic oligonucleotide
  Target: SCN9A; (+) strand; PAM type: YTN; PAM sequence: TTC
ctttccttttgatttttttg

SEQ ID NO: 105627 - DNA, 20 bp, Artificial Sequence
  Description of Artificial Sequence: Synthetic oligonucleotide
  Target: SCN9A; (+) strand; PAM type: YTN; PAM sequence: CTT
tccttttgatttttttggaa

SEQ ID NO: 105628 - DNA, 20 bp, Artificial Sequence
  Description of Artificial Sequence: Synthetic oligonucleotide
  Target: SCN9A; (+) strand; PAM type: YTN; PAM sequence: TTT
ccttttgatttttttggaat

SEQ ID NO: 105629 - DNA, 20 bp, Artificial Sequence
  Description of Artificial Sequence: Synthetic oligonucleotide
  Target: SCN9A; (+) strand; PAM type: YTN; PAM sequence: TTC
cttttgatttttttggaata

SEQ ID NO: 105630 - DNA, 20 bp, Artificial Sequence
  Description of Artificial Sequence: Synthetic oligonucleotide
  Target: SCN9A; (+) strand; PAM type: YTN; PAM sequence: CTT
ttgatttttttggaataatt

SEQ ID NO: 105631 - DNA, 20 bp, Artificial Sequence
  Description of Artificial Sequence: Synthetic oligonucleotide
  Target: SCN9A; (+) strand; PAM type: YTN; PAM sequence: TTT
tgatttttttggaataattt

SEQ ID NO: 105632 - DNA, 20 bp, Artificial Sequence
  Description of Artificial Sequence: Synthetic oligonucleotide
  Target: SCN9A; (+) strand; PAM type: YTN; PAM sequence: TTT
gatttttttggaataattta

SEQ ID NO: 105633 - DNA, 20 bp, Artificial Sequence
  Description of Artificial Sequence: Synthetic oligonucleotide
  Target: SCN9A; (+) strand; PAM type: YTN; PAM sequence: TTG
atttttttggaataatttaa

SEQ ID NO: 105634 - DNA, 20 bp, Artificial Sequence
  Description of Artificial Sequence: Synthetic oligonucleotide
  Target: SCN9A; (+) strand; PAM type: YTN; PAM sequence: TTT
ttttggaataatttaagaag

SEQ ID NO: 105635 - DNA, 20 bp, Artificial Sequence
  Description of Artificial Sequence: Synthetic oligonucleotide
  Target: SCN9A; (+) strand; PAM type: YTN; PAM sequence: TTT
tttggaataatttaagaaga

SEQ ID NO: 105636 - DNA, 20 bp, Artificial Sequence
  Description of Artificial Sequence: Synthetic oligonucleotide
  Target: SCN9A; (+) strand; PAM type: YTN; PAM sequence: TTT
ttggaataatttaagaagaa

SEQ ID NO: 105637 - DNA, 20 bp, Artificial Sequence
  Description of Artificial Sequence: Synthetic oligonucleotide
  Target: SCN9A; (+) strand; PAM type: YTN; PAM sequence: TTT
tggaataatttaagaagaat

SEQ ID NO: 105638 - DNA, 20 bp, Artificial Sequence
  Description of Artificial Sequence: Synthetic oligonucleotide
  Target: SCN9A; (+) strand; PAM type: YTN; PAM sequence: TTT
ggaataatttaagaagaatt

SEQ ID NO: 105639 - DNA, 20 bp, Artificial Sequence
  Description of Artificial Sequence: Synthetic oligonucleotide
  Target: SCN9A; (+) strand; PAM type: YTN; PAM sequence: TTG
gaataatttaagaagaatta

SEQ ID NO: 105640 - DNA, 20 bp, Artificial Sequence
  Description of Artificial Sequence: Synthetic oligonucleotide
  Target: SCN9A; (+) strand; PAM type: YTN; PAM sequence: TTT
aagaagaattagtattagtt

SEQ ID NO: 105641 - DNA, 20 bp, Artificial Sequence
  Description of Artificial Sequence: Synthetic oligonucleotide
  Target: SCN9A; (+) strand; PAM type: YTN; PAM sequence: TTA
agaagaattagtattagttc

SEQ ID NO: 105642 - DNA, 20 bp, Artificial Sequence
  Description of Artificial Sequence: Synthetic oligonucleotide
  Target: SCN9A; (+) strand; PAM type: YTN; PAM sequence: TTA
gtattagttcttctttaaat

SEQ ID NO: 105643 - DNA, 20 bp, Artificial Sequence
  Description of Artificial Sequence: Synthetic oligonucleotide
  Target: SCN9A; (+) strand; PAM type: YTN; PAM sequence: TTA
gttcttctttaaatgtttgg

SEQ ID NO: 105644 - DNA, 20 bp, Artificial Sequence
  Description of Artificial Sequence: Synthetic oligonucleotide
  Target: SCN9A; (+) strand; PAM type: YTN; PAM sequence: TTC
ttctttaaatgtttggtaga

SEQ ID NO: 105645 - DNA, 20 bp, Artificial Sequence
  Description of Artificial Sequence: Synthetic oligonucleotide
  Target: SCN9A; (+) strand; PAM type: YTN; PAM sequence: CTT
ctttaaatgtttggtagaat

SEQ ID NO: 105646 - DNA, 20 bp, Artificial Sequence
  Description of Artificial Sequence: Synthetic oligonucleotide
  Target: SCN9A; (+) strand; PAM type: YTN; PAM sequence: TTC
tttaaatgtttggtagaatt

SEQ ID NO: 105647 - DNA, 20 bp, Artificial Sequence
  Description of Artificial Sequence: Synthetic oligonucleotide
  Target: SCN9A; (+) strand; PAM type: YTN; PAM sequence: CTT
taaatgtttggtagaattca

SEQ ID NO: 105648 - DNA, 20 bp, Artificial Sequence
  Description of Artificial Sequence: Synthetic oligonucleotide
  Target: SCN9A; (+) strand; PAM type: YTN; PAM sequence: TTT
aaatgtttggtagaattcat

SEQ ID NO: 105649 - DNA, 20 bp, Artificial Sequence
  Description of Artificial Sequence: Synthetic oligonucleotide
  Target: SCN9A; (+) strand; PAM type: YTN; PAM sequence: TTA
aatgtttggtagaattcatc

SEQ ID NO: 105650 - DNA, 20 bp, Artificial Sequence
  Description of Artificial Sequence: Synthetic oligonucleotide
  Target: SCN9A; (+) strand; PAM type: YTN; PAM sequence: TTT
ggtagaattcatcagtgaag

SEQ ID NO: 105651 - DNA, 20 bp, Artificial Sequence
  Description of Artificial Sequence: Synthetic oligonucleotide
  Target: SCN9A; (+) strand; PAM type: YTN; PAM sequence: TTG
gtagaattcatcagtgaagc

SEQ ID NO: 105652 - DNA, 20 bp, Artificial Sequence
  Description of Artificial Sequence: Synthetic oligonucleotide
  Target: SCN9A; (+) strand; PAM type: YTN; PAM sequence: TTC
atcagtgaagccatgtggtc

SEQ ID NO: 105653 - DNA, 20 bp, Artificial Sequence
  Description of Artificial Sequence: Synthetic oligonucleotide
  Target: SCN9A; (+) strand; PAM type: YTN; PAM sequence: CTG
gacttttctttgctaggaga

SEQ ID NO: 105654 - DNA, 20 bp, Artificial Sequence
  Description of Artificial Sequence: Synthetic oligonucleotide
  Target: SCN9A; (+) strand; PAM type: YTN; PAM sequence: CTT
ttctttgctaggagagattt

SEQ ID NO: 105655 - DNA, 20 bp, Artificial Sequence
  Description of Artificial Sequence: Synthetic oligonucleotide
  Target: SCN9A; (+) strand; PAM type: YTN; PAM sequence: TTT
tctttgctaggagagatttt

SEQ ID NO: 105656 - DNA, 20 bp, Artificial Sequence
  Description of Artificial Sequence: Synthetic oligonucleotide
  Target: SCN9A; (+) strand; PAM type: YTN; PAM sequence: TTT
ctttgctaggagagatttta

SEQ ID NO: 105657 - DNA, 20 bp, Artificial Sequence
  Description of Artificial Sequence: Synthetic oligonucleotide
  Target: SCN9A; (+) strand; PAM type: YTN; PAM sequence: TTC
tttgctaggagagattttat

SEQ ID NO: 105658 - DNA, 20 bp, Artificial Sequence
  Description of Artificial Sequence: Synthetic oligonucleotide
  Target: SCN9A; (+) strand; PAM type: YTN; PAM sequence: CTT
tgctaggagagattttatta

SEQ ID NO: 105659 - DNA, 20 bp, Artificial Sequence
  Description of Artificial Sequence: Synthetic oligonucleotide
  Target: SCN9A; (+) strand; PAM type: YTN; PAM sequence: TTT
gctaggagagattttattac

SEQ ID NO: 105660 - DNA, 20 bp, Artificial Sequence
  Description of Artificial Sequence: Synthetic oligonucleotide
  Target: SCN9A; (+) strand; PAM type: YTN; PAM sequence: TTG
ctaggagagattttattact

SEQ ID NO: 105661 - DNA, 20 bp, Artificial Sequence
  Description of Artificial Sequence: Synthetic oligonucleotide
  Target: SCN9A; (+) strand; PAM type: YTN; PAM sequence: CTA
ggagagattttattactgat

SEQ ID NO: 105662 - DNA, 20 bp, Artificial Sequence
  Description of Artificial Sequence: Synthetic oligonucleotide
  Target: SCN9A; (+) strand; PAM type: YTN; PAM sequence: TTT
tattactgattcaatcttgt

SEQ ID NO: 105663 - DNA, 20 bp, Artificial Sequence
  Description of Artificial Sequence: Synthetic oligonucleotide
  Target: SCN9A; (+) strand; PAM type: YTN; PAM sequence: TTT
attactgattcaatcttgtt

SEQ ID NO: 105664 - DNA, 20 bp, Artificial Sequence
  Description of Artificial Sequence: Synthetic oligonucleotide
  Target: SCN9A; (+) strand; PAM type: YTN; PAM sequence: TTA
ttactgattcaatcttgtta

SEQ ID NO: 105665 - DNA, 20 bp, Artificial Sequence
  Description of Artificial Sequence: Synthetic oligonucleotide
  Target: SCN9A; (+) strand; PAM type: YTN; PAM sequence: TTA
ctgattcaatcttgttactc

SEQ ID NO: 105666 - DNA, 20 bp, Artificial Sequence
  Description of Artificial Sequence: Synthetic oligonucleotide
  Target: SCN9A; (+) strand; PAM type: YTN; PAM sequence: CTG
attcaatcttgttactcatt

SEQ ID NO: 105667 - DNA, 20 bp, Artificial Sequence
  Description of Artificial Sequence: Synthetic oligonucleotide
  Target: SCN9A; (+) strand; PAM type: YTN; PAM sequence: TTC
aatcttgttactcattattg

SEQ ID NO: 105668 - DNA, 20 bp, Artificial Sequence
  Description of Artificial Sequence: Synthetic oligonucleotide
  Target: SCN9A; (+) strand; PAM type: YTN; PAM sequence: CTT
gttactcattattggtctgt

SEQ ID NO: 105669 - DNA, 20 bp, Artificial Sequence
  Description of Artificial Sequence: Synthetic oligonucleotide
  Target: SCN9A; (+) strand; PAM type: YTN; PAM sequence: TTG
ttactcattattggtctgtt

SEQ ID NO: 105670 - DNA, 20 bp, Artificial Sequence
  Description of Artificial Sequence: Synthetic oligonucleotide
  Target: SCN9A; (+) strand; PAM type: YTN; PAM sequence: TTA
ctcattattggtctgtttga

SEQ ID NO: 105671 - DNA, 20 bp, Artificial Sequence
  Description of Artificial Sequence: Synthetic oligonucleotide
  Target: SCN9A; (+) strand; PAM type: YTN; PAM sequence: CTC
attattggtctgtttgagtt

SEQ ID NO: 105672 - DNA, 20 bp, Artificial Sequence
  Description of Artificial Sequence: Synthetic oligonucleotide
  Target: SCN9A; (+) strand; PAM type: YTN; PAM sequence: TTA
ttggtctgtttgagttttcc

SEQ ID NO: 105673 - DNA, 20 bp, Artificial Sequence
  Description of Artificial Sequence: Synthetic oligonucleotide
  Target: SCN9A; (+) strand; PAM type: YTN; PAM sequence: TTG
gtctgtttgagttttccatt

SEQ ID NO: 105674 - DNA, 20 bp, Artificial Sequence
  Description of Artificial Sequence: Synthetic oligonucleotide
  Target: SCN9A; (+) strand; PAM type: YTN; PAM sequence: CTG
tttgagttttccatttcttc

SEQ ID NO: 105675 - DNA, 20 bp, Artificial Sequence
  Description of Artificial Sequence: Synthetic oligonucleotide
  Target: SCN9A; (+) strand; PAM type: YTN; PAM sequence: TTT
gagttttccatttcttcatg

SEQ ID NO: 105676 - DNA, 20 bp, Artificial Sequence
  Description of Artificial Sequence: Synthetic oligonucleotide
  Target: SCN9A; (+) strand; PAM type: YTN; PAM sequence: TTG
agttttccatttcttcatga

SEQ ID NO: 105677 - DNA, 20 bp, Artificial Sequence
  Description of Artificial Sequence: Synthetic oligonucleotide
  Target: SCN9A; (+) strand; PAM type: YTN; PAM sequence: TTT
tccatttcttcatgatacag

SEQ ID NO: 105678 - DNA, 20 bp, Artificial Sequence
  Description of Artificial Sequence: Synthetic oligonucleotide
  Target: SCN9A; (+) strand; PAM type: YTN; PAM sequence: TTT
ccatttcttcatgatacagt

SEQ ID NO: 105679 - DNA, 20 bp, Artificial Sequence
  Description of Artificial Sequence: Synthetic oligonucleotide
  Target: SCN9A; (+) strand; PAM type: YTN; PAM sequence: TTC
catttcttcatgatacagtc

SEQ ID NO: 105680 - DNA, 20 bp, Artificial Sequence
  Description of Artificial Sequence: Synthetic oligonucleotide
  Target: SCN9A; (+) strand; PAM type: YTN; PAM sequence: TTT
cttcatgatacagtcttggc

SEQ ID NO: 105681 - DNA, 20 bp, Artificial Sequence
  Description of Artificial Sequence: Synthetic oligonucleotide
  Target: SCN9A; (+) strand; PAM type: YTN; PAM sequence: TTC
ttcatgatacagtcttggca

SEQ ID NO: 105682 - DNA, 20 bp, Artificial Sequence
  Description of Artificial Sequence: Synthetic oligonucleotide
  Target: SCN9A; (+) strand; PAM type: YTN; PAM sequence: CTT
catgatacagtcttggcaag

SEQ ID NO: 105683 - DNA, 20 bp, Artificial Sequence
  Description of Artificial Sequence: Synthetic oligonucleotide
  Target: SCN9A; (+) strand; PAM type: YTN; PAM sequence: TTC
atgatacagtcttggcaagt

SEQ ID NO: 105684 - DNA, 20 bp, Artificial Sequence
  Description of Artificial Sequence: Synthetic oligonucleotide
  Target: SCN9A; (+) strand; PAM type: YTN; PAM sequence: CTT
ggcaagttgtatgtgttgag

SEQ ID NO: 105685 - DNA, 20 bp, Artificial Sequence
  Description of Artificial Sequence: Synthetic oligonucleotide
  Target: SCN9A; (+) strand; PAM type: YTN; PAM sequence: TTG
gcaagttgtatgtgttgagt

SEQ ID NO: 105686 - DNA, 20 bp, Artificial Sequence
  Description of Artificial Sequence: Synthetic oligonucleotide
  Target: SCN9A; (+) strand; PAM type: YTN; PAM sequence: TTG
tatgtgttgagtaatttatc

SEQ ID NO: 105687 - DNA, 20 bp, Artificial Sequence
  Description of Artificial Sequence: Synthetic oligonucleotide
  Target: SCN9A; (+) strand; PAM type: YTN; PAM sequence: TTG
agtaatttatcaatttccat

SEQ ID NO: 105688 - DNA, 20 bp, Artificial Sequence
  Description of Artificial Sequence: Synthetic oligonucleotide
  Target: SCN9A; (+) strand; PAM type: YTN; PAM sequence: TTT
atcaatttccattaggtttt

SEQ ID NO: 105689 - DNA, 20 bp, Artificial Sequence
  Description of Artificial Sequence: Synthetic oligonucleotide
  Target: SCN9A; (+) strand; PAM type: YTN; PAM sequence: TTA
tcaatttccattaggttttc

SEQ ID NO: 105690 - DNA, 20 bp, Artificial Sequence
  Description of Artificial Sequence: Synthetic oligonucleotide
  Target: SCN9A; (+) strand; PAM type: YTN; PAM sequence: TTT
ccattaggttttccaatttg

SEQ ID NO: 105691 - DNA, 20 bp, Artificial Sequence
  Description of Artificial Sequence: Synthetic oligonucleotide
  Target: SCN9A; (+) strand; PAM type: YTN; PAM sequence: TTC
cattaggttttccaatttgt

SEQ ID NO: 105692 - DNA, 20 bp, Artificial Sequence
  Description of Artificial Sequence: Synthetic oligonucleotide
  Target: SCN9A; (+) strand; PAM type: YTN; PAM sequence: TTA
ggttttccaatttgttggag

SEQ ID NO: 105693 - DNA, 20 bp, Artificial Sequence
  Description of Artificial Sequence: Synthetic oligonucleotide
  Target: SCN9A; (+) strand; PAM type: YTN; PAM sequence: TTT
tccaatttgttggagtatga

SEQ ID NO: 105694 - DNA, 20 bp, Artificial Sequence
  Description of Artificial Sequence: Synthetic oligonucleotide
  Target: SCN9A; (+) strand; PAM type: YTN; PAM sequence: TTT
ccaatttgttggagtatgat

SEQ ID NO: 105695 - DNA, 20 bp, Artificial Sequence
  Description of Artificial Sequence: Synthetic oligonucleotide
  Target: SCN9A; (+) strand; PAM type: YTN; PAM sequence: TTC
caatttgttggagtatgatt

SEQ ID NO: 105696 - DNA, 20 bp, Artificial Sequence
  Description of Artificial Sequence: Synthetic oligonucleotide
  Target: SCN9A; (+) strand; PAM type: YTN; PAM sequence: TTT
gttggagtatgattgttcat

SEQ ID NO: 105697 - DNA, 20 bp, Artificial Sequence
  Description of Artificial Sequence: Synthetic oligonucleotide
  Target: SCN9A; (+) strand; PAM type: YTN; PAM sequence: TTG
ttggagtatgattgttcata

SEQ ID NO: 105698 - DNA, 20 bp, Artificial Sequence
  Description of Artificial Sequence: Synthetic oligonucleotide
  Target: SCN9A; (+) strand; PAM type: YTN; PAM sequence: TTG
gagtatgattgttcatagta

SEQ ID NO: 105699 - DNA, 20 bp, Artificial Sequence
  Description of Artificial Sequence: Synthetic oligonucleotide
  Target: SCN9A; (+) strand; PAM type: YTN; PAM sequence: TTG
ttcatagtagtctctattga

SEQ ID NO: 105700 - DNA, 20 bp, Artificial Sequence
  Description of Artificial Sequence: Synthetic oligonucleotide
  Target: SCN9A; (+) strand; PAM type: YTN; PAM sequence: TTC
atagtagtctctattgatca

SEQ ID NO: 105701 - DNA, 20 bp, Artificial Sequence
  Description of Artificial Sequence: Synthetic oligonucleotide
  Target: SCN9A; (+) strand; PAM type: YTN; PAM sequence: CTC
tattgatcagtagctgctgc

SEQ ID NO: 105702 - DNA, 20 bp, Artificial Sequence
  Description of Artificial Sequence: Synthetic oligonucleotide
  Target: SCN9A; (+) strand; PAM type: YTN; PAM sequence: CTA
ttgatcagtagctgctgcaa

SEQ ID NO: 105703 - DNA, 20 bp, Artificial Sequence
  Description of Artificial Sequence: Synthetic oligonucleotide
  Target: SCN9A; (+) strand; PAM type: YTN; PAM sequence: TTG
atcagtagctgctgcaaacg

SEQ ID NO: 105704 - DNA, 20 bp, Artificial Sequence
  Description of Artificial Sequence: Synthetic oligonucleotide
  Target: SCN9A; (+) strand; PAM type: YTN; PAM sequence: CTG
ctgcaaacgttgttaatgat

SEQ ID NO: 105705 - DNA, 20 bp, Artificial Sequence
  Description of Artificial Sequence: Synthetic oligonucleotide
  Target: SCN9A; (+) strand; PAM type: YTN; PAM sequence: CTG
caaacgttgttaatgattct

SEQ ID NO: 105706 - DNA, 20 bp, Artificial Sequence
  Description of Artificial Sequence: Synthetic oligonucleotide
  Target: SCN9A; (+) strand; PAM type: YTN; PAM sequence: TTG
ttaatgattctgaagttgca

SEQ ID NO: 105707 - DNA, 20 bp, Artificial Sequence
  Description of Artificial Sequence: Synthetic oligonucleotide
  Target: SCN9A; (+) strand; PAM type: YTN; PAM sequence: TTA
atgattctgaagttgcatcc

SEQ ID NO: 105708 - DNA, 20 bp, Artificial Sequence
  Description of Artificial Sequence: Synthetic oligonucleotide
  Target: SCN9A; (+) strand; PAM type: YTN; PAM sequence: TTC
tgaagttgcatccaaattta

SEQ ID NO: 105709 - DNA, 20 bp, Artificial Sequence
  Description of Artificial Sequence: Synthetic oligonucleotide
  Target: SCN9A; (+) strand; PAM type: YTN; PAM sequence: CTG
aagttgcatccaaatttagg

SEQ ID NO: 105710 - DNA, 20 bp, Artificial Sequence
  Description of Artificial Sequence: Synthetic oligonucleotide
  Target: SCN9A; (+) strand; PAM type: YTN; PAM sequence: TTG
catccaaatttaggcaaaca

SEQ ID NO: 105711 - DNA, 20 bp, Artificial Sequence
  Description of Artificial Sequence: Synthetic oligonucleotide
  Target: SCN9A; (+) strand; PAM type: YTN; PAM sequence: TTT
aggcaaacaattcaaaggat

SEQ ID NO: 105712 - DNA, 20 bp, Artificial Sequence
  Description of Artificial Sequence: Synthetic oligonucleotide
  Target: SCN9A; (+) strand; PAM type: YTN; PAM sequence: TTA
ggcaaacaattcaaaggata

SEQ ID NO: 105713 - DNA, 20 bp, Artificial Sequence
  Description of Artificial Sequence: Synthetic oligonucleotide
  Target: SCN9A; (+) strand; PAM type: YTN; PAM sequence: TTC
aaaggatatgatccagaaca

SEQ ID NO: 105714 - DNA, 20 bp, Artificial Sequence
  Description of Artificial Sequence: Synthetic oligonucleotide
  Target: SCN9A; (+) strand; PAM type: YTN; PAM sequence: TTT
gtaataaagtccccaagtat

SEQ ID NO: 105715 - DNA, 20 bp, Artificial Sequence
  Description of Artificial Sequence: Synthetic oligonucleotide
  Target: SCN9A; (+) strand; PAM type: YTN; PAM sequence: TTG
taataaagtccccaagtatg

SEQ ID NO: 105716 - DNA, 20 bp, Artificial Sequence
  Description of Artificial Sequence: Synthetic oligonucleotide
  Target: SCN9A; (+) strand; PAM type: YTN; PAM sequence: CTT
tcacacactaaaattctgaa

SEQ ID NO: 105717 - DNA, 20 bp, Artificial Sequence
  Description of Artificial Sequence: Synthetic oligonucleotide
  Target: SCN9A; (+) strand; PAM type: YTN; PAM sequence: TTT
cacacactaaaattctgaag

SEQ ID NO: 105718 - DNA, 20 bp, Artificial Sequence
  Description of Artificial Sequence: Synthetic oligonucleotide
  Target: SCN9A; (+) strand; PAM type: YTN; PAM sequence: TTC
acacactaaaattctgaagc

SEQ ID NO: 105719 - DNA, 20 bp, Artificial Sequence
  Description of Artificial Sequence: Synthetic oligonucleotide
  Target: SCN9A; (+) strand; PAM type: YTN; PAM sequence: CTA
aaattctgaagcactgatct

SEQ ID NO: 105720 - DNA, 20 bp, Artificial Sequence
  Description of Artificial Sequence: Synthetic oligonucleotide
  Target: SCN9A; (+) strand; PAM type: YTN; PAM sequence: TTC
tgaagcactgatcttcatca

SEQ ID NO: 105721 - DNA, 20 bp, Artificial Sequence
  Description of Artificial Sequence: Synthetic oligonucleotide
  Target: SCN9A; (+) strand; PAM type: YTN; PAM sequence: CTG
aagcactgatcttcatcacg

SEQ ID NO: 105722 - DNA, 20 bp, Artificial Sequence
  Description of Artificial Sequence: Synthetic oligonucleotide
  Target: SCN9A; (+) strand; PAM type: YTN; PAM sequence: CTG
atcttcatcacgctatctct

SEQ ID NO: 105723 - DNA, 20 bp, Artificial Sequence
  Description of Artificial Sequence: Synthetic oligonucleotide
  Target: SCN9A; (+) strand; PAM type: YTN; PAM sequence: CTT
catcacgctatctcttttaa

SEQ ID NO: 105724 - DNA, 20 bp, Artificial Sequence
  Description of Artificial Sequence: Synthetic oligonucleotide
  Target: SCN9A; (+) strand; PAM type: YTN; PAM sequence: TTC
atcacgctatctcttttaaa

SEQ ID NO: 105725 - DNA, 20 bp, Artificial Sequence
  Description of Artificial Sequence: Synthetic oligonucleotide
  Target: SCN9A; (+) strand; PAM type: YTN; PAM sequence: CTA
tctcttttaaattcaatctg

SEQ ID NO: 105726 - DNA, 20 bp, Artificial Sequence
  Description of Artificial Sequence: Synthetic oligonucleotide
  Target: SCN9A; (+) strand; PAM type: YTN; PAM sequence: CTC
ttttaaattcaatctgtaac

SEQ ID NO: 105727 - DNA, 20 bp, Artificial Sequence
  Description of Artificial Sequence: Synthetic oligonucleotide
  Target: SCN9A; (+) strand; PAM type: YTN; PAM sequence: CTT
ttaaattcaatctgtaacca

SEQ ID NO: 105728 - DNA, 20 bp, Artificial Sequence
  Description of Artificial Sequence: Synthetic oligonucleotide
  Target: SCN9A; (+) strand; PAM type: YTN; PAM sequence: TTT
taaattcaatctgtaaccaa

SEQ ID NO: 105729 - DNA, 20 bp, Artificial Sequence
  Description of Artificial Sequence: Synthetic oligonucleotide
  Target: SCN9A; (+) strand; PAM type: YTN; PAM sequence: TTT
aaattcaatctgtaaccaat

SEQ ID NO: 105730 - DNA, 20 bp, Artificial Sequence
  Description of Artificial Sequence: Synthetic oligonucleotide
  Target: SCN9A; (+) strand; PAM type: YTN; PAM sequence: TTA
aattcaatctgtaaccaata

SEQ ID NO: 105731 - DNA, 20 bp, Artificial Sequence
  Description of Artificial Sequence: Synthetic oligonucleotide
  Target: SCN9A; (+) strand; PAM type: YTN; PAM sequence: TTC
aatctgtaaccaatagctac

SEQ ID NO: 105732 - DNA, 20 bp, Artificial Sequence
  Description of Artificial Sequence: Synthetic oligonucleotide
  Target: SCN9A; (+) strand; PAM type: YTN; PAM sequence: CTG
taaccaatagctacttacag

SEQ ID NO: 105733 - DNA, 20 bp, Artificial Sequence
  Description of Artificial Sequence: Synthetic oligonucleotide
  Target: SCN9A; (+) strand; PAM type: YTN; PAM sequence: CTA
cttacagtgtgtatataagc

SEQ ID NO: 105734 - DNA, 20 bp, Artificial Sequence
  Description of Artificial Sequence: Synthetic oligonucleotide
  Target: SCN9A; (+) strand; PAM type: YTN; PAM sequence: CTT
acagtgtgtatataagcact

SEQ ID NO: 105735 - DNA, 20 bp, Artificial Sequence
  Description of Artificial Sequence: Synthetic oligonucleotide
  Target: SCN9A; (+) strand; PAM type: YTN; PAM sequence: TTA
cagtgtgtatataagcactc

SEQ ID NO: 105736 - DNA, 20 bp, Artificial Sequence
  Description of Artificial Sequence: Synthetic oligonucleotide
  Target: SCN9A; (+) strand; PAM type: YTN; PAM sequence: CTC
aattccatacttataataat

SEQ ID NO: 105737 - DNA, 20 bp, Artificial Sequence
  Description of Artificial Sequence: Synthetic oligonucleotide
  Target: SCN9A; (+) strand; PAM type: YTN; PAM sequence: TTC
catacttataataattgtac

SEQ ID NO: 105738 - DNA, 20 bp, Artificial Sequence
  Description of Artificial Sequence: Synthetic oligonucleotide
  Target: SCN9A; (+) strand; PAM type: YTN; PAM sequence: CTT
ataataattgtacattgagc

SEQ ID NO: 105739 - DNA, 20 bp, Artificial Sequence
  Description of Artificial Sequence: Synthetic oligonucleotide
  Target: SCN9A; (+) strand; PAM type: YTN; PAM sequence: TTA
taataattgtacattgagca

SEQ ID NO: 105740 - DNA, 20 bp, Artificial Sequence
  Description of Artificial Sequence: Synthetic oligonucleotide
  Target: SCN9A; (+) strand; PAM type: YTN; PAM sequence: TTG
tacattgagcacttttcaat

SEQ ID NO: 105741 - DNA, 20 bp, Artificial Sequence
  Description of Artificial Sequence: Synthetic oligonucleotide
  Target: SCN9A; (+) strand; PAM type: YTN; PAM sequence: TTG
agcacttttcaataagcatt

SEQ ID NO: 105742 - DNA, 20 bp, Artificial Sequence
  Description of Artificial Sequence: Synthetic oligonucleotide
  Target: SCN9A; (+) strand; PAM type: YTN; PAM sequence: CTT
ttcaataagcatttgtctaa

SEQ ID NO: 105743 - DNA, 20 bp, Artificial Sequence
  Description of Artificial Sequence: Synthetic oligonucleotide
  Target: SCN9A; (+) strand; PAM type: YTN; PAM sequence: TTT
tcaataagcatttgtctaat

SEQ ID NO: 105744 - DNA, 20 bp, Artificial Sequence
  Description of Artificial Sequence: Synthetic oligonucleotide
  Target: SCN9A; (+) strand; PAM type: YTN; PAM sequence: TTT
caataagcatttgtctaatt

SEQ ID NO: 105745 - DNA, 20 bp, Artificial Sequence
  Description of Artificial Sequence: Synthetic oligonucleotide
  Target: SCN9A; (+) strand; PAM type: YTN; PAM sequence: TTC
aataagcatttgtctaatta

SEQ ID NO: 105746 - DNA, 20 bp, Artificial Sequence
  Description of Artificial Sequence: Synthetic oligonucleotide
  Target: SCN9A; (+) strand; PAM type: YTN; PAM sequence: TTT
gtctaattatttatgagaat

SEQ ID NO: 105747 - DNA, 20 bp, Artificial Sequence
  Description of Artificial Sequence: Synthetic oligonucleotide
  Target: SCN9A; (+) strand; PAM type: YTN; PAM sequence: TTG
tctaattatttatgagaatc

SEQ ID NO: 105748 - DNA, 20 bp, Artificial Sequence
  Description of Artificial Sequence: Synthetic oligonucleotide
  Target: SCN9A; (+) strand; PAM type: YTN; PAM sequence: CTA
attatttatgagaatcatat

SEQ ID NO: 105749 - DNA, 20 bp, Artificial Sequence
  Description of Artificial Sequence: Synthetic oligonucleotide
  Target: SCN9A; (+) strand; PAM type: YTN; PAM sequence: TTA
tttatgagaatcatataatc

SEQ ID NO: 105750 - DNA, 20 bp, Artificial Sequence
  Description of Artificial Sequence: Synthetic oligonucleotide
  Target: SCN9A; (+) strand; PAM type: YTN; PAM sequence: TTT
atgagaatcatataatcttt

SEQ ID NO: 105751 - DNA, 20 bp, Artificial Sequence
  Description of Artificial Sequence: Synthetic oligonucleotide
  Target: SCN9A; (+) strand; PAM type: YTN; PAM sequence: TTA
tgagaatcatataatcttta

SEQ ID NO: 105752 - DNA, 20 bp, Artificial Sequence
  Description of Artificial Sequence: Synthetic oligonucleotide
  Target: SCN9A; (+) strand; PAM type: YTN; PAM sequence: CTT
tattacaatctattttacac

SEQ ID NO: 105753 - DNA, 20 bp, Artificial Sequence
  Description of Artificial Sequence: Synthetic oligonucleotide
  Target: SCN9A; (+) strand; PAM type: YTN; PAM sequence: TTT
attacaatctattttacaca

SEQ ID NO: 105754 - DNA, 20 bp, Artificial Sequence
  Description of Artificial Sequence: Synthetic oligonucleotide
  Target: SCN9A; (+) strand; PAM type: YTN; PAM sequence: TTA
ttacaatctattttacacat

SEQ ID NO: 105755 - DNA, 20 bp, Artificial Sequence
  Description of Artificial Sequence: Synthetic oligonucleotide
  Target: SCN9A; (+) strand; PAM type: YTN; PAM sequence: TTA
caatctattttacacataaa

SEQ ID NO: 105756 - DNA, 20 bp, Artificial Sequence
  Description of Artificial Sequence: Synthetic oligonucleotide
  Target: SCN9A; (+) strand; PAM type: YTN; PAM sequence: CTA
ttttacacataaataaactg

SEQ ID NO: 105757 - DNA, 20 bp, Artificial Sequence
  Description of Artificial Sequence: Synthetic oligonucleotide
  Target: SCN9A; (+) strand; PAM type: YTN; PAM sequence: TTT
tacacataaataaactgaaa

SEQ ID NO: 105758 - DNA, 20 bp, Artificial Sequence
  Description of Artificial Sequence: Synthetic oligonucleotide
  Target: SCN9A; (+) strand; PAM type: YTN; PAM sequence: TTT
acacataaataaactgaaaa

SEQ ID NO: 105759 - DNA, 20 bp, Artificial Sequence
  Description of Artificial Sequence: Synthetic oligonucleotide
  Target: SCN9A; (+) strand; PAM type: YTN; PAM sequence: TTA
cacataaataaactgaaaaa

SEQ ID NO: 105760 - DNA, 20 bp, Artificial Sequence
  Description of Artificial Sequence: Synthetic oligonucleotide
  Target: SCN9A; (+) strand; PAM type: YTN; PAM sequence: CTG
aaaaaaatgtttttgtaaat

SEQ ID NO: 105761 - DNA, 20 bp, Artificial Sequence
  Description of Artificial Sequence: Synthetic oligonucleotide
  Target: SCN9A; (+) strand; PAM type: YTN; PAM sequence: TTT
ttgtaaattgctcaaggtct

SEQ ID NO: 105762 - DNA, 20 bp, Artificial Sequence
  Description of Artificial Sequence: Synthetic oligonucleotide
  Target: SCN9A; (+) strand; PAM type: YTN; PAM sequence: TTT
tgtaaattgctcaaggtctt

SEQ ID NO: 105763 - DNA, 20 bp, Artificial Sequence
  Description of Artificial Sequence: Synthetic oligonucleotide
  Target: SCN9A; (+) strand; PAM type: YTN; PAM sequence: TTT
gtaaattgctcaaggtctta

SEQ ID NO: 105764 - DNA, 20 bp, Artificial Sequence
  Description of Artificial Sequence: Synthetic oligonucleotide
  Target: SCN9A; (+) strand; PAM type: YTN; PAM sequence: TTG
taaattgctcaaggtcttat

SEQ ID NO: 105765 - DNA, 20 bp, Artificial Sequence
  Description of Artificial Sequence: Synthetic oligonucleotide
  Target: SCN9A; (+) strand; PAM type: YTN; PAM sequence: TTG
ctcaaggtcttatcaaaagc

SEQ ID NO: 105766 - DNA, 20 bp, Artificial Sequence
  Description of Artificial Sequence: Synthetic oligonucleotide
  Target: SCN9A; (+) strand; PAM type: YTN; PAM sequence: CTC
aaggtcttatcaaaagctaa

SEQ ID NO: 105767 - DNA, 20 bp, Artificial Sequence
  Description of Artificial Sequence: Synthetic oligonucleotide
  Target: SCN9A; (+) strand; PAM type: YTN; PAM sequence: CTT
atcaaaagctaagatttgag

SEQ ID NO: 105768 - DNA, 20 bp, Artificial Sequence
  Description of Artificial Sequence: Synthetic oligonucleotide
  Target: SCN9A; (+) strand; PAM type: YTN; PAM sequence: TTA
tcaaaagctaagatttgagg

SEQ ID NO: 105769 - DNA, 20 bp, Artificial Sequence
  Description of Artificial Sequence: Synthetic oligonucleotide
  Target: SCN9A; (+) strand; PAM type: YTN; PAM sequence: CTA
agatttgaggcaaatattct

SEQ ID NO: 105770 - DNA, 20 bp, Artificial Sequence
  Description of Artificial Sequence: Synthetic oligonucleotide
  Target: SCN9A; (+) strand; PAM type: YTN; PAM sequence: TTT
gaggcaaatattctatctta

SEQ ID NO: 105771 - DNA, 20 bp, Artificial Sequence
  Description of Artificial Sequence: Synthetic oligonucleotide
  Target: SCN9A; (+) strand; PAM type: YTN; PAM sequence: TTG
aggcaaatattctatcttaa

SEQ ID NO: 105772 - DNA, 20 bp, Artificial Sequence
  Description of Artificial Sequence: Synthetic oligonucleotide
  Target: SCN9A; (+) strand; PAM type: YTN; PAM sequence: TTC
tatcttaaaaagtggcattc

SEQ ID NO: 105773 - DNA, 20 bp, Artificial Sequence
  Description of Artificial Sequence: Synthetic oligonucleotide
  Target: SCN9A; (+) strand; PAM type: YTN; PAM sequence: CTA
tcttaaaaagtggcattctt

SEQ ID NO: 105774 - DNA, 20 bp, Artificial Sequence
  Description of Artificial Sequence: Synthetic oligonucleotide
  Target: SCN9A; (+) strand; PAM type: YTN; PAM sequence: CTT
aaaaagtggcattcttaact

SEQ ID NO: 105775 - DNA, 20 bp, Artificial Sequence
  Description of Artificial Sequence: Synthetic oligonucleotide
  Target: SCN9A; (+) strand; PAM type: YTN; PAM sequence: TTA
aaaagtggcattcttaacta

SEQ ID NO: 105776 - DNA, 20 bp, Artificial Sequence
  Description of Artificial Sequence: Synthetic oligonucleotide
  Target: SCN9A; (+) strand; PAM type: YTN; PAM sequence: TTC
ttaactatatcccaaggtag

SEQ ID NO: 105777 - DNA, 20 bp, Artificial Sequence
  Description of Artificial Sequence: Synthetic oligonucleotide
  Target: SCN9A; (+) strand; PAM type: YTN; PAM sequence: CTT
aactatatcccaaggtagtg

SEQ ID NO: 105778 - DNA, 20 bp, Artificial Sequence
  Description of Artificial Sequence: Synthetic oligonucleotide
  Target: SCN9A; (+) strand; PAM type: YTN; PAM sequence: TTA
actatatcccaaggtagtgg

SEQ ID NO: 105779 - DNA, 20 bp, Artificial Sequence
  Description of Artificial Sequence: Synthetic oligonucleotide
  Target: SCN9A; (+) strand; PAM type: YTN; PAM sequence: CTA
tatcccaaggtagtggctaa

SEQ ID NO: 105780 - DNA, 20 bp, Artificial Sequence
  Description of Artificial Sequence: Synthetic oligonucleotide
  Target: SCN9A; (+) strand; PAM type: YTN; PAM sequence: CTA
agacttaatgacataaatat

SEQ ID NO: 105781 - DNA, 20 bp, Artificial Sequence
  Description of Artificial Sequence: Synthetic oligonucleotide
  Target: SCN9A; (+) strand; PAM type: YTN; PAM sequence: CTT
aatgacataaatatataaat

SEQ ID NO: 105782 - DNA, 20 bp, Artificial Sequence
  Description of Artificial Sequence: Synthetic oligonucleotide
  Target: SCN9A; (+) strand; PAM type: YTN; PAM sequence: TTA
atgacataaatatataaatt

SEQ ID NO: 105783 - DNA, 20 bp, Artificial Sequence
  Description of Artificial Sequence: Synthetic oligonucleotide
  Target: SCN9A; (+) strand; PAM type: YTN; PAM sequence: TTA
ggagttactttctattgggt

SEQ ID NO: 105784 - DNA, 20 bp, Artificial Sequence
  Description of Artificial Sequence: Synthetic oligonucleotide
  Target: SCN9A; (+) strand; PAM type: YTN; PAM sequence: TTA
ctttctattgggtaattcaa

SEQ ID NO: 105785 - DNA, 20 bp, Artificial Sequence
  Description of Artificial Sequence: Synthetic oligonucleotide
  Target: SCN9A; (+) strand; PAM type: YTN; PAM sequence: CTT
tctattgggtaattcaattt

SEQ ID NO: 105786 - DNA, 20 bp, Artificial Sequence
  Description of Artificial Sequence: Synthetic oligonucleotide
  Target: SCN9A; (+) strand; PAM type: YTN; PAM sequence: TTT
ctattgggtaattcaatttg

SEQ ID NO: 105787 - DNA, 20 bp, Artificial Sequence
  Description of Artificial Sequence: Synthetic oligonucleotide
  Target: SCN9A; (+) strand; PAM type: YTN; PAM sequence: TTC
tattgggtaattcaatttgc

SEQ ID NO: 105788 - DNA, 20 bp, Artificial Sequence
  Description of Artificial Sequence: Synthetic oligonucleotide
  Target: SCN9A; (+) strand; PAM type: YTN; PAM sequence: CTA
ttgggtaattcaatttgcct

SEQ ID NO: 105789 - DNA, 20 bp, Artificial Sequence
  Description of Artificial Sequence: Synthetic oligonucleotide
  Target: SCN9A; (+) strand; PAM type: YTN; PAM sequence: TTG
ggtaattcaatttgcctctt

SEQ ID NO: 105790 - DNA, 20 bp, Artificial Sequence
  Description of Artificial Sequence: Synthetic oligonucleotide
  Target: SCN9A; (+) strand; PAM type: YTN; PAM sequence: TTC
aatttgcctctttggctcat

SEQ ID NO: 105791 - DNA, 20 bp, Artificial Sequence
  Description of Artificial Sequence: Synthetic oligonucleotide
  Target: SCN9A; (+) strand; PAM type: YTN; PAM sequence: TTT
gcctctttggctcatccagg

SEQ ID NO: 105792 - DNA, 20 bp, Artificial Sequence
  Description of Artificial Sequence: Synthetic oligonucleotide
  Target: SCN9A; (+) strand; PAM type: YTN; PAM sequence: TTG
cctctttggctcatccaggc

SEQ ID NO: 105793 - DNA, 20 bp, Artificial Sequence
  Description of Artificial Sequence: Synthetic oligonucleotide
  Target: SCN9A; (+) strand; PAM type: YTN; PAM sequence: CTC
tttggctcatccaggctcat

SEQ ID NO: 105794 - DNA, 20 bp, Artificial Sequence
  Description of Artificial Sequence: Synthetic oligonucleotide
  Target: SCN9A; (+) strand; PAM type: YTN; PAM sequence: CTT
tggctcatccaggctcatca

SEQ ID NO: 105795 - DNA, 20 bp, Artificial Sequence
  Description of Artificial Sequence: Synthetic oligonucleotide
  Target: SCN9A; (+) strand; PAM type: YTN; PAM sequence: TTT
ggctcatccaggctcatcac

SEQ ID NO: 105796 - DNA, 20 bp, Artificial Sequence
  Description of Artificial Sequence: Synthetic oligonucleotide
  Target: SCN9A; (+) strand; PAM type: YTN; PAM sequence: TTG
gctcatccaggctcatcaca

SEQ ID NO: 105797 - DNA, 20 bp, Artificial Sequence
  Description of Artificial Sequence: Synthetic oligonucleotide
  Target: SCN9A; (+) strand; PAM type: YTN; PAM sequence: CTC
atccaggctcatcacaaaca

SEQ ID NO: 105798 - DNA, 20 bp, Artificial Sequence
  Description of Artificial Sequence: Synthetic oligonucleotide
  Target: SCN9A; (+) strand; PAM type: YTN; PAM sequence: CTC
atcacaaacacaaccatcac

SEQ ID NO: 105799 - DNA, 20 bp, Artificial Sequence
  Description of Artificial Sequence: Synthetic oligonucleotide
  Target: SCN9A; (+) strand; PAM type: YTN; PAM sequence: CTA
tttcaaaggcatctcagata

SEQ ID NO: 105800 - DNA, 20 bp, Artificial Sequence
  Description of Artificial Sequence: Synthetic oligonucleotide
  Target: SCN9A; (+) strand; PAM type: YTN; PAM sequence: TTT
caaaggcatctcagatacga

SEQ ID NO: 105801 - DNA, 20 bp, Artificial Sequence
  Description of Artificial Sequence: Synthetic oligonucleotide
  Target: SCN9A; (+) strand; PAM type: YTN; PAM sequence: TTC
aaaggcatctcagatacgaa

SEQ ID NO: 105802 - DNA, 20 bp, Artificial Sequence
  Description of Artificial Sequence: Synthetic oligonucleotide
  Target: SCN9A; (+) strand; PAM type: YTN; PAM sequence: CTC
agatacgaaaaaaataaaag

SEQ ID NO: 105803 - DNA, 20 bp, Artificial Sequence
  Description of Artificial Sequence: Synthetic oligonucleotide
  Target: SCN9A; (+) strand; PAM type: YTN; PAM sequence: TTG
caaaagagggaattcacagt

SEQ ID NO: 105804 - DNA, 20 bp, Artificial Sequence
  Description of Artificial Sequence: Synthetic oligonucleotide
  Target: SCN9A; (+) strand; PAM type: YTN; PAM sequence: TTC
acagttcaagactctgggaa

SEQ ID NO: 105805 - DNA, 20 bp, Artificial Sequence
  Description of Artificial Sequence: Synthetic oligonucleotide
  Target: SCN9A; (+) strand; PAM type: YTN; PAM sequence: TTC
aagactctgggaactcaagt

SEQ ID NO: 105806 - DNA, 20 bp, Artificial Sequence
  Description of Artificial Sequence: Synthetic oligonucleotide
  Target: SCN9A; (+) strand; PAM type: YTN; PAM sequence: CTC
tgggaactcaagtgggagat

SEQ ID NO: 105807 - DNA, 20 bp, Artificial Sequence
  Description of Artificial Sequence: Synthetic oligonucleotide
  Target: SCN9A; (+) strand; PAM type: YTN; PAM sequence: CTG
ggaactcaagtgggagatga

SEQ ID NO: 105808 - DNA, 20 bp, Artificial Sequence
  Description of Artificial Sequence: Synthetic oligonucleotide
  Target: SCN9A; (+) strand; PAM type: YTN; PAM sequence: CTC
aagtgggagatgaagattat

SEQ ID NO: 105809 - DNA, 20 bp, Artificial Sequence
  Description of Artificial Sequence: Synthetic oligonucleotide
  Target: SCN9A; (+) strand; PAM type: YTN; PAM sequence: TTA
tgagaattagagcaggaaaa

SEQ ID NO: 105810 - DNA, 20 bp, Artificial Sequence
  Description of Artificial Sequence: Synthetic oligonucleotide
  Target: SCN9A; (+) strand; PAM type: YTN; PAM sequence: TTA
gagcaggaaaagttagcata

SEQ ID NO: 105811 - DNA, 20 bp, Artificial Sequence
  Description of Artificial Sequence: Synthetic oligonucleotide
  Target: SCN9A; (+) strand; PAM type: YTN; PAM sequence: TTA
gcataggaggattaaagaca

SEQ ID NO: 105812 - DNA, 20 bp, Artificial Sequence
  Description of Artificial Sequence: Synthetic oligonucleotide
  Target: SCN9A; (+) strand; PAM type: YTN; PAM sequence: TTA
aagacattttagacaaataa

SEQ ID NO: 105813 - DNA, 20 bp, Artificial Sequence
  Description of Artificial Sequence: Synthetic oligonucleotide
  Target: SCN9A; (+) strand; PAM type: YTN; PAM sequence: TTT
tagacaaataaataaaatgt

SEQ ID NO: 105814 - DNA, 20 bp, Artificial Sequence
  Description of Artificial Sequence: Synthetic oligonucleotide
  Target: SCN9A; (+) strand; PAM type: YTN; PAM sequence: TTT
agacaaataaataaaatgta

SEQ ID NO: 105815 - DNA, 20 bp, Artificial Sequence
  Description of Artificial Sequence: Synthetic oligonucleotide
  Target: SCN9A; (+) strand; PAM type: YTN; PAM sequence: TTA
gacaaataaataaaatgtac

SEQ ID NO: 105816 - DNA, 20 bp, Artificial Sequence
  Description of Artificial Sequence: Synthetic oligonucleotide
  Target: SCN9A; (+) strand; PAM type: YTN; PAM sequence: CTA
ttttagtgatctgaatggga

SEQ ID NO: 105817 - DNA, 20 bp, Artificial Sequence
  Description of Artificial Sequence: Synthetic oligonucleotide
  Target: SCN9A; (+) strand; PAM type: YTN; PAM sequence: TTT
tagtgatctgaatgggaaaa

SEQ ID NO: 105818 - DNA, 20 bp, Artificial Sequence
  Description of Artificial Sequence: Synthetic oligonucleotide
  Target: SCN9A; (+) strand; PAM type: YTN; PAM sequence: TTT
agtgatctgaatgggaaaac

SEQ ID NO: 105819 - DNA, 20 bp, Artificial Sequence
  Description of Artificial Sequence: Synthetic oligonucleotide
  Target: SCN9A; (+) strand; PAM type: YTN; PAM sequence: TTA
gtgatctgaatgggaaaaca

SEQ ID NO: 105820 - DNA, 20 bp, Artificial Sequence
  Description of Artificial Sequence: Synthetic oligonucleotide
  Target: SCN9A; (+) strand; PAM type: YTN; PAM sequence: CTG
aatgggaaaacaaaacaaaa

SEQ ID NO: 105821 - DNA, 20 bp, Artificial Sequence
  Description of Artificial Sequence: Synthetic oligonucleotide
  Target: SCN9A; (+) strand; PAM type: YTN; PAM sequence: TTT
aaactggaaacattttaatc

SEQ ID NO: 105822 - DNA, 20 bp, Artificial Sequence
  Description of Artificial Sequence: Synthetic oligonucleotide
  Target: SCN9A; (+) strand; PAM type: YTN; PAM sequence: TTA
aactggaaacattttaatct

SEQ ID NO: 105823 - DNA, 20 bp, Artificial Sequence
  Description of Artificial Sequence: Synthetic oligonucleotide
  Target: SCN9A; (+) strand; PAM type: YTN; PAM sequence: CTG
gaaacattttaatctgaaga

SEQ ID NO: 105824 - DNA, 20 bp, Artificial Sequence
  Description of Artificial Sequence: Synthetic oligonucleotide
  Target: SCN9A; (+) strand; PAM type: YTN; PAM sequence: TTT
taatctgaagaggctggaaa

SEQ ID NO: 105825 - DNA, 20 bp, Artificial Sequence
  Description of Artificial Sequence: Synthetic oligonucleotide
  Target: SCN9A; (+) strand; PAM type: YTN; PAM sequence: TTT
aatctgaagaggctggaaag

SEQ ID NO: 105826 - DNA, 20 bp, Artificial Sequence
  Description of Artificial Sequence: Synthetic oligonucleotide
  Target: SCN9A; (+) strand; PAM type: YTN; PAM sequence: TTA
atctgaagaggctggaaaga

SEQ ID NO: 105827 - DNA, 20 bp, Artificial Sequence
  Description of Artificial Sequence: Synthetic oligonucleotide
  Target: SCN9A; (+) strand; PAM type: YTN; PAM sequence: CTG
aagaggctggaaagaaagac

SEQ ID NO: 105828 - DNA, 20 bp, Artificial Sequence
  Description of Artificial Sequence: Synthetic oligonucleotide
  Target: SCN9A; (+) strand; PAM type: YTN; PAM sequence: CTG
gaaagaaagaccttagatgt

SEQ ID NO: 105829 - DNA, 20 bp, Artificial Sequence
  Description of Artificial Sequence: Synthetic oligonucleotide
  Target: SCN9A; (+) strand; PAM type: YTN; PAM sequence: CTT
agatgtaaggtttttatagt

SEQ ID NO: 105830 - DNA, 20 bp, Artificial Sequence
  Description of Artificial Sequence: Synthetic oligonucleotide
  Target: SCN9A; (+) strand; PAM type: YTN; PAM sequence: TTA
gatgtaaggtttttatagtt

SEQ ID NO: 105831 - DNA, 20 bp, Artificial Sequence
  Description of Artificial Sequence: Synthetic oligonucleotide
  Target: SCN9A; (+) strand; PAM type: YTN; PAM sequence: TTT
ttatagttgaccacagctta

SEQ ID NO: 105832 - DNA, 20 bp, Artificial Sequence
  Description of Artificial Sequence: Synthetic oligonucleotide
  Target: SCN9A; (+) strand; PAM type: YTN; PAM sequence: TTT
tatagttgaccacagcttaa

SEQ ID NO: 105833 - DNA, 20 bp, Artificial Sequence
  Description of Artificial Sequence: Synthetic oligonucleotide
  Target: SCN9A; (+) strand; PAM type: YTN; PAM sequence: TTT
atagttgaccacagcttaat

SEQ ID NO: 105834 - DNA, 20 bp, Artificial Sequence
  Description of Artificial Sequence: Synthetic oligonucleotide
  Target: SCN9A; (+) strand; PAM type: YTN; PAM sequence: TTA
tagttgaccacagcttaata

SEQ ID NO: 105835 - DNA, 20 bp, Artificial Sequence
  Description of Artificial Sequence: Synthetic oligonucleotide
  Target: SCN9A; (+) strand; PAM type: YTN; PAM sequence: TTG
accacagcttaatatcttat

SEQ ID NO: 105836 - DNA, 20 bp, Artificial Sequence
  Description of Artificial Sequence: Synthetic oligonucleotide
  Target: SCN9A; (+) strand; PAM type: YTN; PAM sequence: CTT
aatatcttatcaaacaaatt

SEQ ID NO: 105837 - DNA, 20 bp, Artificial Sequence
  Description of Artificial Sequence: Synthetic oligonucleotide
  Target: SCN9A; (+) strand; PAM type: YTN; PAM sequence: TTA
atatcttatcaaacaaattt

SEQ ID NO: 105838 - DNA, 20 bp, Artificial Sequence
  Description of Artificial Sequence: Synthetic oligonucleotide
  Target: SCN9A; (+) strand; PAM type: YTN; PAM sequence: CTT
atcaaacaaatttcctctag

SEQ ID NO: 105839 - DNA, 20 bp, Artificial Sequence
  Description of Artificial Sequence: Synthetic oligonucleotide
  Target: SCN9A; (+) strand; PAM type: YTN; PAM sequence: TTA
tcaaacaaatttcctctaga

SEQ ID NO: 105840 - DNA, 20 bp, Artificial Sequence
  Description of Artificial Sequence: Synthetic oligonucleotide
  Target: SCN9A; (+) strand; PAM type: YTN; PAM sequence: TTT
cctctagatcttgaaccttc

SEQ ID NO: 105841 - DNA, 20 bp, Artificial Sequence
  Description of Artificial Sequence: Synthetic oligonucleotide
  Target: SCN9A; (+) strand; PAM type: YTN; PAM sequence: TTC
ctctagatcttgaaccttca

SEQ ID NO: 105842 - DNA, 20 bp, Artificial Sequence
  Description of Artificial Sequence: Synthetic oligonucleotide
  Target: SCN9A; (+) strand; PAM type: YTN; PAM sequence: CTC
tagatcttgaaccttcatta

SEQ ID NO: 105843 - DNA, 20 bp, Artificial Sequence
  Description of Artificial Sequence: Synthetic oligonucleotide
  Target: SCN9A; (+) strand; PAM type: YTN; PAM sequence: CTA
gatcttgaaccttcattatt

SEQ ID NO: 105844 - DNA, 20 bp, Artificial Sequence
  Description of Artificial Sequence: Synthetic oligonucleotide
  Target: SCN9A; (+) strand; PAM type: YTN; PAM sequence: CTT
gaaccttcattatttctcaa

SEQ ID NO: 105845 - DNA, 20 bp, Artificial Sequence
  Description of Artificial Sequence: Synthetic oligonucleotide
  Target: SCN9A; (+) strand; PAM type: YTN; PAM sequence: TTG
aaccttcattatttctcaat

SEQ ID NO: 105846 - DNA, 20 bp, Artificial Sequence
  Description of Artificial Sequence: Synthetic oligonucleotide
  Target: SCN9A; (+) strand; PAM type: YTN; PAM sequence: CTT
cattatttctcaattcttat

SEQ ID NO: 105847 - DNA, 20 bp, Artificial Sequence
  Description of Artificial Sequence: Synthetic oligonucleotide
  Target: SCN9A; (+) strand; PAM type: YTN; PAM sequence: TTC
attatttctcaattcttata

SEQ ID NO: 105848 - DNA, 20 bp, Artificial Sequence
  Description of Artificial Sequence: Synthetic oligonucleotide
  Target: SCN9A; (+) strand; PAM type: YTN; PAM sequence: TTA
tttctcaattcttatatttt

SEQ ID NO: 105849 - DNA, 20 bp, Artificial Sequence
  Description of Artificial Sequence: Synthetic oligonucleotide
  Target: SCN9A; (+) strand; PAM type: YTN; PAM sequence: TTT
ctcaattcttatattttcag

SEQ ID NO: 105850 - DNA, 20 bp, Artificial Sequence
  Description of Artificial Sequence: Synthetic oligonucleotide
  Target: SCN9A; (+) strand; PAM type: YTN; PAM sequence: TTC
tcaattcttatattttcagg

SEQ ID NO: 105851 - DNA, 20 bp, Artificial Sequence
  Description of Artificial Sequence: Synthetic oligonucleotide
  Target: SCN9A; (+) strand; PAM type: YTN; PAM sequence: CTC
aattcttatattttcaggta

SEQ ID NO: 105852 - DNA, 20 bp, Artificial Sequence
  Description of Artificial Sequence: Synthetic oligonucleotide
  Target: SCN9A; (+) strand; PAM type: YTN; PAM sequence: TTC
ttatattttcaggtaggttt

SEQ ID NO: 105853 - DNA, 20 bp, Artificial Sequence
  Description of Artificial Sequence: Synthetic oligonucleotide
  Target: SCN9A; (+) strand; PAM type: YTN; PAM sequence: CTT
atattttcaggtaggtttgt

SEQ ID NO: 105854 - DNA, 20 bp, Artificial Sequence
  Description of Artificial Sequence: Synthetic oligonucleotide
  Target: SCN9A; (+) strand; PAM type: YTN; PAM sequence: TTA
tattttcaggtaggtttgtc

SEQ ID NO: 105855 - DNA, 20 bp, Artificial Sequence
  Description of Artificial Sequence: Synthetic oligonucleotide
  Target: SCN9A; (+) strand; PAM type: YTN; PAM sequence: TTT
tcaggtaggtttgtctatac

SEQ ID NO: 105856 - DNA, 20 bp, Artificial Sequence
  Description of Artificial Sequence: Synthetic oligonucleotide
  Target: SCN9A; (+) strand; PAM type: YTN; PAM sequence: TTT
caggtaggtttgtctatact

SEQ ID NO: 105857 - DNA, 20 bp, Artificial Sequence
  Description of Artificial Sequence: Synthetic oligonucleotide
  Target: SCN9A; (+) strand; PAM type: YTN; PAM sequence: TTC
aggtaggtttgtctatactt

SEQ ID NO: 105858 - DNA, 20 bp, Artificial Sequence
  Description of Artificial Sequence: Synthetic oligonucleotide
  Target: SCN9A; (+) strand; PAM type: YTN; PAM sequence: TTT
gtctatacttaatatgacat

SEQ ID NO: 105859 - DNA, 20 bp, Artificial Sequence
  Description of Artificial Sequence: Synthetic oligonucleotide
  Target: SCN9A; (+) strand; PAM type: YTN; PAM sequence: TTG
tctatacttaatatgacata

SEQ ID NO: 105860 - DNA, 20 bp, Artificial Sequence
  Description of Artificial Sequence: Synthetic oligonucleotide
  Target: SCN9A; (+) strand; PAM type: YTN; PAM sequence: CTA
tacttaatatgacatacttt

SEQ ID NO: 105861 - DNA, 20 bp, Artificial Sequence
  Description of Artificial Sequence: Synthetic oligonucleotide
  Target: SCN9A; (+) strand; PAM type: YTN; PAM sequence: CTT
aatatgacatactttgagat

SEQ ID NO: 105862 - DNA, 20 bp, Artificial Sequence
  Description of Artificial Sequence: Synthetic oligonucleotide
  Target: SCN9A; (+) strand; PAM type: YTN; PAM sequence: TTA
atatgacatactttgagata

SEQ ID NO: 105863 - DNA, 20 bp, Artificial Sequence
  Description of Artificial Sequence: Synthetic oligonucleotide
  Target: SCN9A; (+) strand; PAM type: YTN; PAM sequence: CTT
tgagatacgtcatggaaaat

SEQ ID NO: 105864 - DNA, 20 bp, Artificial Sequence
  Description of Artificial Sequence: Synthetic oligonucleotide
  Target: SCN9A; (+) strand; PAM type: YTN; PAM sequence: TTT
gagatacgtcatggaaaatt

SEQ ID NO: 105865 - DNA, 20 bp, Artificial Sequence
  Description of Artificial Sequence: Synthetic oligonucleotide
  Target: SCN9A; (+) strand; PAM type: YTN; PAM sequence: TTG
agatacgtcatggaaaattt

SEQ ID NO: 105866 - DNA, 20 bp, Artificial Sequence
  Description of Artificial Sequence: Synthetic oligonucleotide
  Target: SCN9A; (+) strand; PAM type: YTN; PAM sequence: TTT
tttatgaagaagggtaaact

SEQ ID NO: 105867 - DNA, 20 bp, Artificial Sequence
  Description of Artificial Sequence: Synthetic oligonucleotide
  Target: SCN9A; (+) strand; PAM type: YTN; PAM sequence: TTT
ttatgaagaagggtaaactt

SEQ ID NO: 105868 - DNA, 20 bp, Artificial Sequence
  Description of Artificial Sequence: Synthetic oligonucleotide
  Target: SCN9A; (+) strand; PAM type: YTN; PAM sequence: TTT
tatgaagaagggtaaacttt

SEQ ID NO: 105869 - DNA, 20 bp, Artificial Sequence
  Description of Artificial Sequence: Synthetic oligonucleotide
  Target: SCN9A; (+) strand; PAM type: YTN; PAM sequence: TTT
atgaagaagggtaaactttc

SEQ ID NO: 105870 - DNA, 20 bp, Artificial Sequence
  Description of Artificial Sequence: Synthetic oligonucleotide
  Target: SCN9A; (+) strand; PAM type: YTN; PAM sequence: TTA
tgaagaagggtaaactttca

SEQ ID NO: 105871 - DNA, 20 bp, Artificial Sequence
  Description of Artificial Sequence: Synthetic oligonucleotide
  Target: SCN9A; (+) strand; PAM type: YTN; PAM sequence: CTT
tcaaagttcataattagaag

SEQ ID NO: 105872 - DNA, 20 bp, Artificial Sequence
  Description of Artificial Sequence: Synthetic oligonucleotide
  Target: SCN9A; (+) strand; PAM type: YTN; PAM sequence: TTT
caaagttcataattagaagt

SEQ ID NO: 105873 - DNA, 20 bp, Artificial Sequence
  Description of Artificial Sequence: Synthetic oligonucleotide
  Target: SCN9A; (+) strand; PAM type: YTN; PAM sequence: TTC
aaagttcataattagaagtc

SEQ ID NO: 105874 - DNA, 20 bp, Artificial Sequence
  Description of Artificial Sequence: Synthetic oligonucleotide
  Target: SCN9A; (+) strand; PAM type: YTN; PAM sequence: TTC
ataattagaagtcagtagca

SEQ ID NO: 105875 - DNA, 20 bp, Artificial Sequence
  Description of Artificial Sequence: Synthetic oligonucleotide
  Target: SCN9A; (+) strand; PAM type: YTN; PAM sequence: TTA
gaagtcagtagcactaagaa

SEQ ID NO: 105876 - DNA, 20 bp, Artificial Sequence
  Description of Artificial Sequence: Synthetic oligonucleotide
  Target: SCN9A; (+) strand; PAM type: YTN; PAM sequence: CTA
agaacctgagttcttaagta

SEQ ID NO: 105877 - DNA, 20 bp, Artificial Sequence
  Description of Artificial Sequence: Synthetic oligonucleotide
  Target: SCN9A; (+) strand; PAM type: YTN; PAM sequence: CTG
agttcttaagtaataataat

SEQ ID NO: 105878 - DNA, 20 bp, Artificial Sequence
  Description of Artificial Sequence: Synthetic oligonucleotide
  Target: SCN9A; (+) strand; PAM type: YTN; PAM sequence: TTC
ttaagtaataataatgatgc

SEQ ID NO: 105879 - DNA, 20 bp, Artificial Sequence
  Description of Artificial Sequence: Synthetic oligonucleotide
  Target: SCN9A; (+) strand; PAM type: YTN; PAM sequence: CTT
aagtaataataatgatgcag

SEQ ID NO: 105880 - DNA, 20 bp, Artificial Sequence
  Description of Artificial Sequence: Synthetic oligonucleotide
  Target: SCN9A; (+) strand; PAM type: YTN; PAM sequence: TTA
agtaataataatgatgcaga

SEQ ID NO: 105881 - DNA, 20 bp, Artificial Sequence
  Description of Artificial Sequence: Synthetic oligonucleotide
  Target: SCN9A; (+) strand; PAM type: YTN; PAM sequence: CTT
tttttaaaatggcttgctaa

SEQ ID NO: 105882 - DNA, 20 bp, Artificial Sequence
  Description of Artificial Sequence: Synthetic oligonucleotide
  Target: SCN9A; (+) strand; PAM type: YTN; PAM sequence: TTT
ttttaaaatggcttgctaat

SEQ ID NO: 105883 - DNA, 20 bp, Artificial Sequence
  Description of Artificial Sequence: Synthetic oligonucleotide
  Target: SCN9A; (+) strand; PAM type: YTN; PAM sequence: TTT
tttaaaatggcttgctaatt

SEQ ID NO: 105884 - DNA, 20 bp, Artificial Sequence
  Description of Artificial Sequence: Synthetic oligonucleotide
  Target: SCN9A; (+) strand; PAM type: YTN; PAM sequence: TTT
ttaaaatggcttgctaattc

SEQ ID NO: 105885 - DNA, 20 bp, Artificial Sequence
  Description of Artificial Sequence: Synthetic oligonucleotide
  Target: SCN9A; (+) strand; PAM type: YTN; PAM sequence: TTT
taaaatggcttgctaattca

SEQ ID NO: 105886 - DNA, 20 bp, Artificial Sequence
  Description of Artificial Sequence: Synthetic oligonucleotide
  Target: SCN9A; (+) strand; PAM type: YTN; PAM sequence: TTT
aaaatggcttgctaattcaa

SEQ ID NO: 105887 - DNA, 20 bp, Artificial Sequence
  Description of Artificial Sequence: Synthetic oligonucleotide
  Target: SCN9A; (+) strand; PAM type: YTN; PAM sequence: TTA
aaatggcttgctaattcaaa

SEQ ID NO: 105888 - DNA, 20 bp, Artificial Sequence
  Description of Artificial Sequence: Synthetic oligonucleotide
  Target: SCN9A; (+) strand; PAM type: YTN; PAM sequence: CTT
gctaattcaaacactatgct

SEQ ID NO: 105889 - DNA, 20 bp, Artificial Sequence
  Description of Artificial Sequence: Synthetic oligonucleotide
  Target: SCN9A; (+) strand; PAM type: YTN; PAM sequence: TTG
ctaattcaaacactatgcta

SEQ ID NO: 105890 - DNA, 20 bp, Artificial Sequence
  Description of Artificial Sequence: Synthetic oligonucleotide
  Target: SCN9A; (+) strand; PAM type: YTN; PAM sequence: CTA
attcaaacactatgctacat

SEQ ID NO: 105891 - DNA, 20 bp, Artificial Sequence
  Description of Artificial Sequence: Synthetic oligonucleotide
  Target: SCN9A; (+) strand; PAM type: YTN; PAM sequence: TTC
aaacactatgctacatgact

SEQ ID NO: 105892 - DNA, 20 bp, Artificial Sequence
  Description of Artificial Sequence: Synthetic oligonucleotide
  Target: SCN9A; (+) strand; PAM type: YTN; PAM sequence: CTA
tgctacatgacttaaaaata

SEQ ID NO: 105893 - DNA, 20 bp, Artificial Sequence
  Description of Artificial Sequence: Synthetic oligonucleotide
  Target: SCN9A; (+) strand; PAM type: YTN; PAM sequence: CTA
catgacttaaaaatactagc

SEQ ID NO: 105894 - DNA, 20 bp, Artificial Sequence
  Description of Artificial Sequence: Synthetic oligonucleotide
  Target: SCN9A; (+) strand; PAM type: YTN; PAM sequence: CTT
aaaaatactagcttgtgtat

SEQ ID NO: 105895 - DNA, 20 bp, Artificial Sequence
  Description of Artificial Sequence: Synthetic oligonucleotide
  Target: SCN9A; (+) strand; PAM type: YTN; PAM sequence: TTA
aaaatactagcttgtgtatc

SEQ ID NO: 105896 - DNA, 20 bp, Artificial Sequence
  Description of Artificial Sequence: Synthetic oligonucleotide
  Target: SCN9A; (+) strand; PAM type: YTN; PAM sequence: CTA
gcttgtgtatctgttactac

SEQ ID NO: 105897 - DNA, 20 bp, Artificial Sequence
  Description of Artificial Sequence: Synthetic oligonucleotide
  Target: SCN9A; (+) strand; PAM type: YTN; PAM sequence: CTT
gtgtatctgttactacaacc

SEQ ID NO: 105898 - DNA, 20 bp, Artificial Sequence
  Description of Artificial Sequence: Synthetic oligonucleotide
  Target: SCN9A; (+) strand; PAM type: YTN; PAM sequence: TTG
tgtatctgttactacaacct

SEQ ID NO: 105899 - DNA, 20 bp, Artificial Sequence
  Description of Artificial Sequence: Synthetic oligonucleotide
  Target: SCN9A; (+) strand; PAM type: YTN; PAM sequence: CTG
ttactacaacctctaaggta

SEQ ID NO: 105900 - DNA, 20 bp, Artificial Sequence
  Description of Artificial Sequence: Synthetic oligonucleotide
  Target: SCN9A; (+) strand; PAM type: YTN; PAM sequence: TTA
ctacaacctctaaggtagcc

SEQ ID NO: 105901 - DNA, 20 bp, Artificial Sequence
  Description of Artificial Sequence: Synthetic oligonucleotide
  Target: SCN9A; (+) strand; PAM type: YTN; PAM sequence: CTA
caacctctaaggtagccaca

SEQ ID NO: 105902 - DNA, 20 bp, Artificial Sequence
  Description of Artificial Sequence: Synthetic oligonucleotide
  Target: SCN9A; (+) strand; PAM type: YTN; PAM sequence: CTC
taaggtagccacaaactcct

SEQ ID NO: 105903 - DNA, 20 bp, Artificial Sequence
  Description of Artificial Sequence: Synthetic oligonucleotide
  Target: SCN9A; (+) strand; PAM type: YTN; PAM sequence: CTA
aggtagccacaaactcctgt

SEQ ID NO: 105904 - DNA, 20 bp, Artificial Sequence
  Description of Artificial Sequence: Synthetic oligonucleotide
  Target: SCN9A; (+) strand; PAM type: YTN; PAM sequence: CTC
ctgtatatttaattgtgcat

SEQ ID NO: 105905 - DNA, 20 bp, Artificial Sequence
  Description of Artificial Sequence: Synthetic oligonucleotide
  Target: SCN9A; (+) strand; PAM type: YTN; PAM sequence: CTG
tatatttaattgtgcatacc

SEQ ID NO: 105906 - DNA, 20 bp, Artificial Sequence
  Description of Artificial Sequence: Synthetic oligonucleotide
  Target: SCN9A; (+) strand; PAM type: YTN; PAM sequence: TTT
aattgtgcataccatggaaa

SEQ ID NO: 105907 - DNA, 20 bp, Artificial Sequence
  Description of Artificial Sequence: Synthetic oligonucleotide
  Target: SCN9A; (+) strand; PAM type: YTN; PAM sequence: TTA
attgtgcataccatggaaat

SEQ ID NO: 105908 - DNA, 20 bp, Artificial Sequence
  Description of Artificial Sequence: Synthetic oligonucleotide
  Target: SCN9A; (+) strand; PAM type: YTN; PAM sequence: TTG
tgcataccatggaaatgtaa

SEQ ID NO: 105909 - DNA, 20 bp, Artificial Sequence
  Description of Artificial Sequence: Synthetic oligonucleotide
  Target: SCN9A; (+) strand; PAM type: YTN; PAM sequence: CTC
ttttatcatatagatataac

SEQ ID NO: 105910 - DNA, 20 bp, Artificial Sequence
  Description of Artificial Sequence: Synthetic oligonucleotide
  Target: SCN9A; (+) strand; PAM type: YTN; PAM sequence: CTT
ttatcatatagatataacca

SEQ ID NO: 105911 - DNA, 20 bp, Artificial Sequence
  Description of Artificial Sequence: Synthetic oligonucleotide
  Target: SCN9A; (+) strand; PAM type: YTN; PAM sequence: TTT
tatcatatagatataaccat

SEQ ID NO: 105912 - DNA, 20 bp, Artificial Sequence
  Description of Artificial Sequence: Synthetic oligonucleotide
  Target: SCN9A; (+) strand; PAM type: YTN; PAM sequence: TTT
atcatatagatataaccatt

SEQ ID NO: 105913 - DNA, 20 bp, Artificial Sequence
  Description of Artificial Sequence: Synthetic oligonucleotide
  Target: SCN9A; (+) strand; PAM type: YTN; PAM sequence: TTA
tcatatagatataaccatta

SEQ ID NO: 105914 - DNA, 20 bp, Artificial Sequence
  Description of Artificial Sequence: Synthetic oligonucleotide
  Target: SCN9A; (+) strand; PAM type: YTN; PAM sequence: TTA
tgtaatgagaaaaaaattag

SEQ ID NO: 105915 - DNA, 20 bp, Artificial Sequence
  Description of Artificial Sequence: Synthetic oligonucleotide
  Target: SCN9A; (+) strand; PAM type: YTN; PAM sequence: TTA
gtgaaaatcaagaatattag

SEQ ID NO: 105916 - DNA, 20 bp, Artificial Sequence
  Description of Artificial Sequence: Synthetic oligonucleotide
  Target: SCN9A; (+) strand; PAM type: YTN; PAM sequence: TTA
gaatattaacatcaaatgat

SEQ ID NO: 105917 - DNA, 20 bp, Artificial Sequence
  Description of Artificial Sequence: Synthetic oligonucleotide
  Target: SCN9A; (+) strand; PAM type: YTN; PAM sequence: TTA
acatcaaatgatttttagac

SEQ ID NO: 105918 - DNA, 20 bp, Artificial Sequence
  Description of Artificial Sequence: Synthetic oligonucleotide
  Target: SCN9A; (+) strand; PAM type: YTN; PAM sequence: TTT
ttagacaactcagtttatag

SEQ ID NO: 105919 - DNA, 20 bp, Artificial Sequence
  Description of Artificial Sequence: Synthetic oligonucleotide
  Target: SCN9A; (+) strand; PAM type: YTN; PAM sequence: TTT
tagacaactcagtttatagg

SEQ ID NO: 105920 - DNA, 20 bp, Artificial Sequence
  Description of Artificial Sequence: Synthetic oligonucleotide
  Target: SCN9A; (+) strand; PAM type: YTN; PAM sequence: TTT
agacaactcagtttataggg

SEQ ID NO: 105921 - DNA, 20 bp, Artificial Sequence
  Description of Artificial Sequence: Synthetic oligonucleotide
  Target: SCN9A; (+) strand; PAM type: YTN; PAM sequence: TTA
gacaactcagtttatagggc

SEQ ID NO: 105922 - DNA, 20 bp, Artificial Sequence
  Description of Artificial Sequence: Synthetic oligonucleotide
  Target: SCN9A; (+) strand; PAM type: YTN; PAM sequence: CTC
agtttatagggcactagatt

SEQ ID NO: 105923 - DNA, 20 bp, Artificial Sequence
  Description of Artificial Sequence: Synthetic oligonucleotide
  Target: SCN9A; (+) strand; PAM type: YTN; PAM sequence: TTT
atagggcactagatttcata

SEQ ID NO: 105924 - DNA, 20 bp, Artificial Sequence
  Description of Artificial Sequence: Synthetic oligonucleotide
  Target: SCN9A; (+) strand; PAM type: YTN; PAM sequence: TTA
tagggcactagatttcatac

SEQ ID NO: 105925 - DNA, 20 bp, Artificial Sequence
  Description of Artificial Sequence: Synthetic oligonucleotide
  Target: SCN9A; (+) strand; PAM type: YTN; PAM sequence: CTA
gatttcatacgctttcggaa

SEQ ID NO: 105926 - DNA, 20 bp, Artificial Sequence
  Description of Artificial Sequence: Synthetic oligonucleotide
  Target: SCN9A; (+) strand; PAM type: YTN; PAM sequence: TTT
catacgctttcggaagggct

SEQ ID NO: 105927 - DNA, 20 bp, Artificial Sequence
  Description of Artificial Sequence: Synthetic oligonucleotide
  Target: SCN9A; (+) strand; PAM type: YTN; PAM sequence: TTC
atacgctttcggaagggctc

SEQ ID NO: 105928 - DNA, 20 bp, Artificial Sequence
  Description of Artificial Sequence: Synthetic oligonucleotide
  Target: SCN9A; (+) strand; PAM type: YTN; PAM sequence: CTT
tcggaagggctcatggaata

SEQ ID NO: 105929 - DNA, 20 bp, Artificial Sequence
  Description of Artificial Sequence: Synthetic oligonucleotide
  Target: SCN9A; (+) strand; PAM type: YTN; PAM sequence: TTT
cggaagggctcatggaataa

SEQ ID NO: 105930 - DNA, 20 bp, Artificial Sequence
  Description of Artificial Sequence: Synthetic oligonucleotide
  Target: SCN9A; (+) strand; PAM type: YTN; PAM sequence: TTC
ggaagggctcatggaataag

SEQ ID NO: 105931 - DNA, 20 bp, Artificial Sequence
  Description of Artificial Sequence: Synthetic oligonucleotide
  Target: SCN9A; (+) strand; PAM type: YTN; PAM sequence: CTC
atggaataagtgacagagta

SEQ ID NO: 105932 - DNA, 20 bp, Artificial Sequence
  Description of Artificial Sequence: Synthetic oligonucleotide
  Target: SCN9A; (+) strand; PAM type: YTN; PAM sequence: TTT
tatgaatggttaaaataatc

SEQ ID NO: 105933 - DNA, 20 bp, Artificial Sequence
  Description of Artificial Sequence: Synthetic oligonucleotide
  Target: SCN9A; (+) strand; PAM type: YTN; PAM sequence: TTT
atgaatggttaaaataatct

SEQ ID NO: 105934 - DNA, 20 bp, Artificial Sequence
  Description of Artificial Sequence: Synthetic oligonucleotide
  Target: SCN9A; (+) strand; PAM type: YTN; PAM sequence: TTA
tgaatggttaaaataatcta

SEQ ID NO: 105935 - DNA, 20 bp, Artificial Sequence
  Description of Artificial Sequence: Synthetic oligonucleotide
  Target: SCN9A; (+) strand; PAM type: YTN; PAM sequence: TTA
aaataatctatttcagttat

SEQ ID NO: 105936 - DNA, 20 bp, Artificial Sequence
  Description of Artificial Sequence: Synthetic oligonucleotide
  Target: SCN9A; (+) strand; PAM type: YTN; PAM sequence: CTA
tttcagttataaaatacaaa

SEQ ID NO: 105937 - DNA, 20 bp, Artificial Sequence
  Description of Artificial Sequence: Synthetic oligonucleotide
  Target: SCN9A; (+) strand; PAM type: YTN; PAM sequence: TTT
cagttataaaatacaaataa

SEQ ID NO: 105938 - DNA, 20 bp, Artificial Sequence
  Description of Artificial Sequence: Synthetic oligonucleotide
  Target: SCN9A; (+) strand; PAM type: YTN; PAM sequence: TTC
agttataaaatacaaataaa

SEQ ID NO: 105939 - DNA, 20 bp, Artificial Sequence
  Description of Artificial Sequence: Synthetic oligonucleotide
  Target: SCN9A; (+) strand; PAM type: YTN; PAM sequence: TTA
taaaatacaaataaaatcac

SEQ ID NO: 105940 - DNA, 20 bp, Artificial Sequence
  Description of Artificial Sequence: Synthetic oligonucleotide
  Target: SCN9A; (+) strand; PAM type: YTN; PAM sequence: CTA
gttataaaagatagctaacc

SEQ ID NO: 105941 - DNA, 20 bp, Artificial Sequence
  Description of Artificial Sequence: Synthetic oligonucleotide
  Target: SCN9A; (+) strand; PAM type: YTN; PAM sequence: TTA
taaaagatagctaaccatta

SEQ ID NO: 105942 - DNA, 20 bp, Artificial Sequence
  Description of Artificial Sequence: Synthetic oligonucleotide
  Target: SCN9A; (+) strand; PAM type: YTN; PAM sequence: CTA
accattatgacaacacacct

SEQ ID NO: 105943 - DNA, 20 bp, Artificial Sequence
  Description of Artificial Sequence: Synthetic oligonucleotide
  Target: SCN9A; (+) strand; PAM type: YTN; PAM sequence: TTA
tgacaacacaccttcatctg

SEQ ID NO: 105944 - DNA, 20 bp, Artificial Sequence
  Description of Artificial Sequence: Synthetic oligonucleotide
  Target: SCN9A; (+) strand; PAM type: YTN; PAM sequence: CTT
catctgcatgccacagatat

SEQ ID NO: 105945 - DNA, 20 bp, Artificial Sequence
  Description of Artificial Sequence: Synthetic oligonucleotide
  Target: SCN9A; (+) strand; PAM type: YTN; PAM sequence: TTC
atctgcatgccacagatata

SEQ ID NO: 105946 - DNA, 20 bp, Artificial Sequence
  Description of Artificial Sequence: Synthetic oligonucleotide
  Target: SCN9A; (+) strand; PAM type: YTN; PAM sequence: CTG
catgccacagatatataaat

SEQ ID NO: 105947 - DNA, 20 bp, Artificial Sequence
  Description of Artificial Sequence: Synthetic oligonucleotide
  Target: SCN9A; (+) strand; PAM type: YTN; PAM sequence: TTC
tatagctgcatggctttata

SEQ ID NO: 105948 - DNA, 20 bp, Artificial Sequence
  Description of Artificial Sequence: Synthetic oligonucleotide
  Target: SCN9A; (+) strand; PAM type: YTN; PAM sequence: CTA
tagctgcatggctttatacc

SEQ ID NO: 105949 - DNA, 20 bp, Artificial Sequence
  Description of Artificial Sequence: Synthetic oligonucleotide
  Target: SCN9A; (+) strand; PAM type: YTN; PAM sequence: CTG
catggctttataccccaggg

SEQ ID NO: 105950 - DNA, 20 bp, Artificial Sequence
  Description of Artificial Sequence: Synthetic oligonucleotide
  Target: SCN9A; (+) strand; PAM type: YTN; PAM sequence: CTT
tataccccaggggagacaaa

SEQ ID NO: 105951 - DNA, 20 bp, Artificial Sequence
  Description of Artificial Sequence: Synthetic oligonucleotide
  Target: SCN9A; (+) strand; PAM type: YTN; PAM sequence: TTT
ataccccaggggagacaaat

SEQ ID NO: 105952 - DNA, 20 bp, Artificial Sequence
  Description of Artificial Sequence: Synthetic oligonucleotide
  Target: SCN9A; (+) strand; PAM type: YTN; PAM sequence: TTA
taccccaggggagacaaatt

SEQ ID NO: 105953 - DNA, 20 bp, Artificial Sequence
  Description of Artificial Sequence: Synthetic oligonucleotide
  Target: SCN9A; (+) strand; PAM type: YTN; PAM sequence: TTA
ttaagtccaataggaatgtt

SEQ ID NO: 105954 - DNA, 20 bp, Artificial Sequence
  Description of Artificial Sequence: Synthetic oligonucleotide
  Target: SCN9A; (+) strand; PAM type: YTN; PAM sequence: TTA
agtccaataggaatgtttgt

SEQ ID NO: 105955 - DNA, 20 bp, Artificial Sequence
  Description of Artificial Sequence: Synthetic oligonucleotide
  Target: SCN9A; (+) strand; PAM type: YTN; PAM sequence: TTT
gttttgtgtttcaaatggac

SEQ ID NO: 105956 - DNA, 20 bp, Artificial Sequence
  Description of Artificial Sequence: Synthetic oligonucleotide
  Target: SCN9A; (+) strand; PAM type: YTN; PAM sequence: TTG
ttttgtgtttcaaatggaca

SEQ ID NO: 105957 - DNA, 20 bp, Artificial Sequence
  Description of Artificial Sequence: Synthetic oligonucleotide
  Target: SCN9A; (+) strand; PAM type: YTN; PAM sequence: TTT
tgtgtttcaaatggacaaag

SEQ ID NO: 105958 - DNA, 20 bp, Artificial Sequence
  Description of Artificial Sequence: Synthetic oligonucleotide
  Target: SCN9A; (+) strand; PAM type: YTN; PAM sequence: TTT
gtgtttcaaatggacaaaga

SEQ ID NO: 105959 - DNA, 20 bp, Artificial Sequence
  Description of Artificial Sequence: Synthetic oligonucleotide
  Target: SCN9A; (+) strand; PAM type: YTN; PAM sequence: TTG
tgtttcaaatggacaaagag

SEQ ID NO: 105960 - DNA, 20 bp, Artificial Sequence
  Description of Artificial Sequence: Synthetic oligonucleotide
  Target: SCN9A; (+) strand; PAM type: YTN; PAM sequence: TTT
caaatggacaaagagaggac

SEQ ID NO: 105961 - DNA, 20 bp, Artificial Sequence
  Description of Artificial Sequence: Synthetic oligonucleotide
  Target: SCN9A; (+) strand; PAM type: YTN; PAM sequence: TTC
aaatggacaaagagaggaca

SEQ ID NO: 105962 - DNA, 20 bp, Artificial Sequence
  Description of Artificial Sequence: Synthetic oligonucleotide
  Target: SCN9A; (+) strand; PAM type: YTN; PAM sequence: TTC
cattgagctataagtcacaa

SEQ ID NO: 105963 - DNA, 20 bp, Artificial Sequence
  Description of Artificial Sequence: Synthetic oligonucleotide
  Target: SCN9A; (+) strand; PAM type: YTN; PAM sequence: TTG
agctataagtcacaagccta

SEQ ID NO: 105964 - DNA, 20 bp, Artificial Sequence
  Description of Artificial Sequence: Synthetic oligonucleotide
  Target: SCN9A; (+) strand; PAM type: YTN; PAM sequence: CTA
taagtcacaagcctaggact

SEQ ID NO: 105965 - DNA, 20 bp, Artificial Sequence
  Description of Artificial Sequence: Synthetic oligonucleotide
  Target: SCN9A; (+) strand; PAM type: YTN; PAM sequence: CTA
ggactcttgacatggctctg

SEQ ID NO: 105966 - DNA, 20 bp, Artificial Sequence
  Description of Artificial Sequence: Synthetic oligonucleotide
  Target: SCN9A; (+) strand; PAM type: YTN; PAM sequence: CTC
ttgacatggctctgccttta

SEQ ID NO: 105967 - DNA, 20 bp, Artificial Sequence
  Description of Artificial Sequence: Synthetic oligonucleotide
  Target: SCN9A; (+) strand; PAM type: YTN; PAM sequence: CTT
gacatggctctgcctttata

SEQ ID NO: 105968 - DNA, 20 bp, Artificial Sequence
  Description of Artificial Sequence: Synthetic oligonucleotide
  Target: SCN9A; (+) strand; PAM type: YTN; PAM sequence: TTG
acatggctctgcctttataa

SEQ ID NO: 105969 - DNA, 20 bp, Artificial Sequence
  Description of Artificial Sequence: Synthetic oligonucleotide
  Target: SCN9A; (+) strand; PAM type: YTN; PAM sequence: CTC
tgcctttataactgtataac

SEQ ID NO: 105970 - DNA, 20 bp, Artificial Sequence
  Description of Artificial Sequence: Synthetic oligonucleotide
  Target: SCN9A; (+) strand; PAM type: YTN; PAM sequence: CTG
cctttataactgtataactc

SEQ ID NO: 105971 - DNA, 20 bp, Artificial Sequence
  Description of Artificial Sequence: Synthetic oligonucleotide
  Target: SCN9A; (+) strand; PAM type: YTN; PAM sequence: CTT
tataactgtataactctata

SEQ ID NO: 105972 - DNA, 20 bp, Artificial Sequence
  Description of Artificial Sequence: Synthetic oligonucleotide
  Target: SCN9A; (+) strand; PAM type: YTN; PAM sequence: TTT
ataactgtataactctataa

SEQ ID NO: 105973 - DNA, 20 bp, Artificial Sequence
  Description of Artificial Sequence: Synthetic oligonucleotide
  Target: SCN9A; (+) strand; PAM type: YTN; PAM sequence: TTA
taactgtataactctataac

SEQ ID NO: 105974 - DNA, 20 bp, Artificial Sequence
  Description of Artificial Sequence: Synthetic oligonucleotide
  Target: SCN9A; (+) strand; PAM type: YTN; PAM sequence: CTG
tataactctataactctaga

SEQ ID NO: 105975 - DNA, 20 bp, Artificial Sequence
  Description of Artificial Sequence: Synthetic oligonucleotide
  Target: SCN9A; (+) strand; PAM type: YTN; PAM sequence: CTC
tataactctagatttataac

SEQ ID NO: 105976 - DNA, 20 bp, Artificial Sequence
  Description of Artificial Sequence: Synthetic oligonucleotide
  Target: SCN9A; (+) strand; PAM type: YTN; PAM sequence: CTA
taactctagatttataactg

SEQ ID NO: 105977 - DNA, 20 bp, Artificial Sequence
  Description of Artificial Sequence: Synthetic oligonucleotide
  Target: SCN9A; (+) strand; PAM type: YTN; PAM sequence: CTC
tagatttataactgtataac

SEQ ID NO: 105978 - DNA, 20 bp, Artificial Sequence
  Description of Artificial Sequence: Synthetic oligonucleotide
  Target: SCN9A; (+) strand; PAM type: YTN; PAM sequence: CTA
gatttataactgtataactc

SEQ ID NO: 105979 - DNA, 20 bp, Artificial Sequence
  Description of Artificial Sequence: Synthetic oligonucleotide
  Target: SCN9A; (+) strand; PAM type: YTN; PAM sequence: TTT
ataactgtataactctagct

SEQ ID NO: 105980 - DNA, 20 bp, Artificial Sequence
  Description of Artificial Sequence: Synthetic oligonucleotide
  Target: SCN9A; (+) strand; PAM type: YTN; PAM sequence: TTA
taactgtataactctagctt

SEQ ID NO: 105981 - DNA, 20 bp, Artificial Sequence
  Description of Artificial Sequence: Synthetic oligonucleotide
  Target: SCN9A; (+) strand; PAM type: YTN; PAM sequence: CTG
tataactctagctttataac

SEQ ID NO: 105982 - DNA, 20 bp, Artificial Sequence
  Description of Artificial Sequence: Synthetic oligonucleotide
  Target: SCN9A; (+) strand; PAM type: YTN; PAM sequence: CTC
tagctttataactgtgaata

SEQ ID NO: 105983 - DNA, 20 bp, Artificial Sequence
  Description of Artificial Sequence: Synthetic oligonucleotide
  Target: SCN9A; (+) strand; PAM type: YTN; PAM sequence: CTA
gctttataactgtgaataaa

SEQ ID NO: 105984 - DNA, 20 bp, Artificial Sequence
  Description of Artificial Sequence: Synthetic oligonucleotide
  Target: SCN9A; (+) strand; PAM type: YTN; PAM sequence: CTT
tataactgtgaataaaatca

SEQ ID NO: 105985 - DNA, 20 bp, Artificial Sequence
  Description of Artificial Sequence: Synthetic oligonucleotide
  Target: SCN9A; (+) strand; PAM type: YTN; PAM sequence: TTT
ataactgtgaataaaatcac

SEQ ID NO: 105986 - DNA, 20 bp, Artificial Sequence
  Description of Artificial Sequence: Synthetic oligonucleotide
  Target: SCN9A; (+) strand; PAM type: YTN; PAM sequence: TTA
taactgtgaataaaatcact

SEQ ID NO: 105987 - DNA, 20 bp, Artificial Sequence
  Description of Artificial Sequence: Synthetic oligonucleotide
  Target: SCN9A; (+) strand; PAM type: YTN; PAM sequence: CTG
tgaataaaatcacttccttt

SEQ ID NO: 105988 - DNA, 20 bp, Artificial Sequence
  Description of Artificial Sequence: Synthetic oligonucleotide
  Target: SCN9A; (+) strand; PAM type: YTN; PAM sequence: CTT
ccttttaatgagtctgcttt

SEQ ID NO: 105989 - DNA, 20 bp, Artificial Sequence
  Description of Artificial Sequence: Synthetic oligonucleotide
  Target: SCN9A; (+) strand; PAM type: YTN; PAM sequence: TTC
cttttaatgagtctgctttt

SEQ ID NO: 105990 - DNA, 20 bp, Artificial Sequence
  Description of Artificial Sequence: Synthetic oligonucleotide
  Target: SCN9A; (+) strand; PAM type: YTN; PAM sequence: CTT
ttaatgagtctgctttttca

SEQ ID NO: 105991 - DNA, 20 bp, Artificial Sequence
  Description of Artificial Sequence: Synthetic oligonucleotide
  Target: SCN9A; (+) strand; PAM type: YTN; PAM sequence: TTT
taatgagtctgctttttcag

SEQ ID NO: 105992 - DNA, 20 bp, Artificial Sequence
  Description of Artificial Sequence: Synthetic oligonucleotide
  Target: SCN9A; (+) strand; PAM type: YTN; PAM sequence: TTT
aatgagtctgctttttcagt

SEQ ID NO: 105993 - DNA, 20 bp, Artificial Sequence
  Description of Artificial Sequence: Synthetic oligonucleotide
  Target: SCN9A; (+) strand; PAM type: YTN; PAM sequence: TTA
atgagtctgctttttcagtt

SEQ ID NO: 105994 - DNA, 20 bp, Artificial Sequence
  Description of Artificial Sequence: Synthetic oligonucleotide
  Target: SCN9A; (+) strand; PAM type: YTN; PAM sequence: CTG
ctttttcagttagaaaatga

SEQ ID NO: 105995 - DNA, 20 bp, Artificial Sequence
  Description of Artificial Sequence: Synthetic oligonucleotide
  Target: SCN9A; (+) strand; PAM type: YTN; PAM sequence: CTT
tttcagttagaaaatgaagt

SEQ ID NO: 105996 - DNA, 20 bp, Artificial Sequence
  Description of Artificial Sequence: Synthetic oligonucleotide
  Target: SCN9A; (+) strand; PAM type: YTN; PAM sequence: TTT
ttcagttagaaaatgaagtg

SEQ ID NO: 105997 - DNA, 20 bp, Artificial Sequence
  Description of Artificial Sequence: Synthetic oligonucleotide
  Target: SCN9A; (+) strand; PAM type: YTN; PAM sequence: TTT
tcagttagaaaatgaagtgc

SEQ ID NO: 105998 - DNA, 20 bp, Artificial Sequence
  Description of Artificial Sequence: Synthetic oligonucleotide
  Target: SCN9A; (+) strand; PAM type: YTN; PAM sequence: TTT
cagttagaaaatgaagtgct

SEQ ID NO: 105999 - DNA, 20 bp, Artificial Sequence
  Description of Artificial Sequence: Synthetic oligonucleotide
  Target: SCN9A; (+) strand; PAM type: YTN; PAM sequence: TTC
agttagaaaatgaagtgcta

SEQ ID NO: 106000 - DNA, 20 bp, Artificial Sequence
  Description of Artificial Sequence: Synthetic oligonucleotide
  Target: SCN9A; (+) strand; PAM type: YTN; PAM sequence: TTA
gaaaatgaagtgctaaatgg

SEQ ID NO: 106001 - DNA, 20 bp, Artificial Sequence
  Description of Artificial Sequence: Synthetic oligonucleotide
  Target: SCN9A; (+) strand; PAM type: YTN; PAM sequence: CTA
aatggaaagttctataaggt

SEQ ID NO: 106002 - DNA, 20 bp, Artificial Sequence
  Description of Artificial Sequence: Synthetic oligonucleotide
  Target: SCN9A; (+) strand; PAM type: YTN; PAM sequence: TTC
tataaggttcccttaaaaat

SEQ ID NO: 106003 - DNA, 20 bp, Artificial Sequence
  Description of Artificial Sequence: Synthetic oligonucleotide
  Target: SCN9A; (+) strand; PAM type: YTN; PAM sequence: CTA
taaggttcccttaaaaatgt

SEQ ID NO: 106004 - DNA, 20 bp, Artificial Sequence
  Description of Artificial Sequence: Synthetic oligonucleotide
  Target: SCN9A; (+) strand; PAM type: YTN; PAM sequence: TTC
ccttaaaaatgttgcaactc

SEQ ID NO: 106005 - DNA, 20 bp, Artificial Sequence
  Description of Artificial Sequence: Synthetic oligonucleotide
  Target: SCN9A; (+) strand; PAM type: YTN; PAM sequence: CTT
aaaaatgttgcaactcaaca

SEQ ID NO: 106006 - DNA, 20 bp, Artificial Sequence
  Description of Artificial Sequence: Synthetic oligonucleotide
  Target: SCN9A; (+) strand; PAM type: YTN; PAM sequence: TTA
aaaatgttgcaactcaacat

SEQ ID NO: 106007 - DNA, 20 bp, Artificial Sequence
  Description of Artificial Sequence: Synthetic oligonucleotide
  Target: SCN9A; (+) strand; PAM type: YTN; PAM sequence: TTG
caactcaacatactaagaat

SEQ ID NO: 106008 - DNA, 20 bp, Artificial Sequence
  Description of Artificial Sequence: Synthetic oligonucleotide
  Target: SCN9A; (+) strand; PAM type: YTN; PAM sequence: CTC
aacatactaagaataagaat

SEQ ID NO: 106009 - DNA, 20 bp, Artificial Sequence
  Description of Artificial Sequence: Synthetic oligonucleotide
  Target: SCN9A; (+) strand; PAM type: YTN; PAM sequence: CTA
agaataagaattttgtcagc

SEQ ID NO: 106010 - DNA, 20 bp, Artificial Sequence
  Description of Artificial Sequence: Synthetic oligonucleotide
  Target: SCN9A; (+) strand; PAM type: YTN; PAM sequence: TTT
tgtcagcagctaaggagatc

SEQ ID NO: 106011 - DNA, 20 bp, Artificial Sequence
  Description of Artificial Sequence: Synthetic oligonucleotide
  Target: SCN9A; (+) strand; PAM type: YTN; PAM sequence: TTT
gtcagcagctaaggagatcc

SEQ ID NO: 106012 - DNA, 20 bp, Artificial Sequence
  Description of Artificial Sequence: Synthetic oligonucleotide
  Target: SCN9A; (+) strand; PAM type: YTN; PAM sequence: TTG
tcagcagctaaggagatcca

SEQ ID NO: 106013 - DNA, 20 bp, Artificial Sequence
  Description of Artificial Sequence: Synthetic oligonucleotide
  Target: SCN9A; (+) strand; PAM type: YTN; PAM sequence: CTA
aggagatccatgaaaggtca

SEQ ID NO: 106014 - DNA, 20 bp, Artificial Sequence
  Description of Artificial Sequence: Synthetic oligonucleotide
  Target: SCN9A; (+) strand; PAM type: YTN; PAM sequence: TTG
actttaaatgaaagaaaaat

SEQ ID NO: 106015 - DNA, 20 bp, Artificial Sequence
  Description of Artificial Sequence: Synthetic oligonucleotide
  Target: SCN9A; (+) strand; PAM type: YTN; PAM sequence: CTT
taaatgaaagaaaaatgaac

SEQ ID NO: 106016 - DNA, 20 bp, Artificial Sequence
  Description of Artificial Sequence: Synthetic oligonucleotide
  Target: SCN9A; (+) strand; PAM type: YTN; PAM sequence: TTT
aaatgaaagaaaaatgaaca

SEQ ID NO: 106017 - DNA, 20 bp, Artificial Sequence
  Description of Artificial Sequence: Synthetic oligonucleotide
  Target: SCN9A; (+) strand; PAM type: YTN; PAM sequence: TTA
aatgaaagaaaaatgaacag

SEQ ID NO: 106018 - DNA, 20 bp, Artificial Sequence
  Description of Artificial Sequence: Synthetic oligonucleotide
  Target: SCN9A; (+) strand; PAM type: YTN; PAM sequence: TTC
ctcataaatgttaagaaata

SEQ ID NO: 106019 - DNA, 20 bp, Artificial Sequence
  Description of Artificial Sequence: Synthetic oligonucleotide
  Target: SCN9A; (+) strand; PAM type: YTN; PAM sequence: CTC
ataaatgttaagaaataatt

SEQ ID NO: 106020 - DNA, 20 bp, Artificial Sequence
  Description of Artificial Sequence: Synthetic oligonucleotide
  Target: SCN9A; (+) strand; PAM type: YTN; PAM sequence: TTA
agaaataatttcagaagtct

SEQ ID NO: 106021 - DNA, 20 bp, Artificial Sequence
  Description of Artificial Sequence: Synthetic oligonucleotide
  Target: SCN9A; (+) strand; PAM type: YTN; PAM sequence: TTT
cagaagtctttggttgactt

SEQ ID NO: 106022 - DNA, 20 bp, Artificial Sequence
  Description of Artificial Sequence: Synthetic oligonucleotide
  Target: SCN9A; (+) strand; PAM type: YTN; PAM sequence: TTC
agaagtctttggttgacttt

SEQ ID NO: 106023 - DNA, 20 bp, Artificial Sequence
  Description of Artificial Sequence: Synthetic oligonucleotide
  Target: SCN9A; (+) strand; PAM type: YTN; PAM sequence: CTT
tggttgactttccccagctc

SEQ ID NO: 106024 - DNA, 20 bp, Artificial Sequence
  Description of Artificial Sequence: Synthetic oligonucleotide
  Target: SCN9A; (+) strand; PAM type: YTN; PAM sequence: TTT
ggttgactttccccagctcc

SEQ ID NO: 106025 - DNA, 20 bp, Artificial Sequence
  Description of Artificial Sequence: Synthetic oligonucleotide
  Target: SCN9A; (+) strand; PAM type: YTN; PAM sequence: TTG
gttgactttccccagctcct

SEQ ID NO: 106026 - DNA, 20 bp, Artificial Sequence
  Description of Artificial Sequence: Synthetic oligonucleotide
  Target: SCN9A; (+) strand; PAM type: YTN; PAM sequence: TTG
actttccccagctcctgaag

SEQ ID NO: 106027 - DNA, 20 bp, Artificial Sequence
  Description of Artificial Sequence: Synthetic oligonucleotide
  Target: SCN9A; (+) strand; PAM type: YTN; PAM sequence: CTT
tccccagctcctgaagtgct

SEQ ID NO: 106028 - DNA, 20 bp, Artificial Sequence
  Description of Artificial Sequence: Synthetic oligonucleotide
  Target: SCN9A; (+) strand; PAM type: YTN; PAM sequence: TTT
ccccagctcctgaagtgctt

SEQ ID NO: 106029 - DNA, 20 bp, Artificial Sequence
  Description of Artificial Sequence: Synthetic oligonucleotide
  Target: SCN9A; (+) strand; PAM type: YTN; PAM sequence: TTC
cccagctcctgaagtgcttt

SEQ ID NO: 106030 - DNA, 20 bp, Artificial Sequence
  Description of Artificial Sequence: Synthetic oligonucleotide
  Target: SCN9A; (+) strand; PAM type: YTN; PAM sequence: CTC
ctgaagtgctttaacaccta

SEQ ID NO: 106031 - DNA, 20 bp, Artificial Sequence
  Description of Artificial Sequence: Synthetic oligonucleotide
  Target: SCN9A; (+) strand; PAM type: YTN; PAM sequence: CTG
aagtgctttaacacctagaa

SEQ ID NO: 106032 - DNA, 20 bp, Artificial Sequence
  Description of Artificial Sequence: Synthetic oligonucleotide
  Target: SCN9A; (+) strand; PAM type: YTN; PAM sequence: CTT
taacacctagaatccaagtt

SEQ ID NO: 106033 - DNA, 20 bp, Artificial Sequence
  Description of Artificial Sequence: Synthetic oligonucleotide
  Target: SCN9A; (+) strand; PAM type: YTN; PAM sequence: TTT
aacacctagaatccaagttt

SEQ ID NO: 106034 - DNA, 20 bp, Artificial Sequence
  Description of Artificial Sequence: Synthetic oligonucleotide
  Target: SCN9A; (+) strand; PAM type: YTN; PAM sequence: TTA
acacctagaatccaagtttt

SEQ ID NO: 106035 - DNA, 20 bp, Artificial Sequence
  Description of Artificial Sequence: Synthetic oligonucleotide
  Target: SCN9A; (+) strand; PAM type: YTN; PAM sequence: CTA
gaatccaagttttattctga

SEQ ID NO: 106036 - DNA, 20 bp, Artificial Sequence
  Description of Artificial Sequence: Synthetic oligonucleotide
  Target: SCN9A; (+) strand; PAM type: YTN; PAM sequence: TTT
tattctgagagcaactgtct

SEQ ID NO: 106037 - DNA, 20 bp, Artificial Sequence
  Description of Artificial Sequence: Synthetic oligonucleotide
  Target: SCN9A; (+) strand; PAM type: YTN; PAM sequence: TTT
attctgagagcaactgtctg

SEQ ID NO: 106038 - DNA, 20 bp, Artificial Sequence
  Description of Artificial Sequence: Synthetic oligonucleotide
  Target: SCN9A; (+) strand; PAM type: YTN; PAM sequence: TTA
ttctgagagcaactgtctgc

SEQ ID NO: 106039 - DNA, 20 bp, Artificial Sequence
  Description of Artificial Sequence: Synthetic oligonucleotide
  Target: SCN9A; (+) strand; PAM type: YTN; PAM sequence: TTC
tgagagcaactgtctgccag

SEQ ID NO: 106040 - DNA, 20 bp, Artificial Sequence
  Description of Artificial Sequence: Synthetic oligonucleotide
  Target: SCN9A; (+) strand; PAM type: YTN; PAM sequence: CTG
agagcaactgtctgccaggc

SEQ ID NO: 106041 - DNA, 20 bp, Artificial Sequence
  Description of Artificial Sequence: Synthetic oligonucleotide
  Target: SCN9A; (+) strand; PAM type: YTN; PAM sequence: CTG
tctgccaggcaattggagtt

SEQ ID NO: 106042 - DNA, 20 bp, Artificial Sequence
  Description of Artificial Sequence: Synthetic oligonucleotide
  Target: SCN9A; (+) strand; PAM type: YTN; PAM sequence: CTG
ccaggcaattggagtttata

SEQ ID NO: 106043 - DNA, 20 bp, Artificial Sequence
  Description of Artificial Sequence: Synthetic oligonucleotide
  Target: SCN9A; (+) strand; PAM type: YTN; PAM sequence: TTG
gagtttataattttaatctt

SEQ ID NO: 106044 - DNA, 20 bp, Artificial Sequence
  Description of Artificial Sequence: Synthetic oligonucleotide
  Target: SCN9A; (+) strand; PAM type: YTN; PAM sequence: TTT
ataattttaatcttctttaa

SEQ ID NO: 106045 - DNA, 20 bp, Artificial Sequence
  Description of Artificial Sequence: Synthetic oligonucleotide
  Target: SCN9A; (+) strand; PAM type: YTN; PAM sequence: TTA
taattttaatcttctttaaa

SEQ ID NO: 106046 - DNA, 20 bp, Artificial Sequence
  Description of Artificial Sequence: Synthetic oligonucleotide
  Target: SCN9A; (+) strand; PAM type: YTN; PAM sequence: TTT
taatcttctttaaatgggtg

SEQ ID NO: 106047 - DNA, 20 bp, Artificial Sequence
  Description of Artificial Sequence: Synthetic oligonucleotide
  Target: SCN9A; (+) strand; PAM type: YTN; PAM sequence: TTT
aatcttctttaaatgggtga

SEQ ID NO: 106048 - DNA, 20 bp, Artificial Sequence
  Description of Artificial Sequence: Synthetic oligonucleotide
  Target: SCN9A; (+) strand; PAM type: YTN; PAM sequence: TTA
atcttctttaaatgggtgac

SEQ ID NO: 106049 - DNA, 20 bp, Artificial Sequence
  Description of Artificial Sequence: Synthetic oligonucleotide
  Target: SCN9A; (+) strand; PAM type: YTN; PAM sequence: CTT
ctttaaatgggtgacagagt

SEQ ID NO: 106050 - DNA, 20 bp, Artificial Sequence
  Description of Artificial Sequence: Synthetic oligonucleotide
  Target: SCN9A; (+) strand; PAM type: YTN; PAM sequence: TTC
tttaaatgggtgacagagtt

SEQ ID NO: 106051 - DNA, 20 bp, Artificial Sequence
  Description of Artificial Sequence: Synthetic oligonucleotide
  Target: SCN9A; (+) strand; PAM type: YTN; PAM sequence: CTT
taaatgggtgacagagttag

SEQ ID NO: 106052 - DNA, 20 bp, Artificial Sequence
  Description of Artificial Sequence: Synthetic oligonucleotide
  Target: SCN9A; (+) strand; PAM type: YTN; PAM sequence: TTT
aaatgggtgacagagttagt

SEQ ID NO: 106053 - DNA, 20 bp, Artificial Sequence
  Description of Artificial Sequence: Synthetic oligonucleotide
  Target: SCN9A; (+) strand; PAM type: YTN; PAM sequence: TTA
aatgggtgacagagttagtt

SEQ ID NO: 106054 - DNA, 20 bp, Artificial Sequence
  Description of Artificial Sequence: Synthetic oligonucleotide
  Target: SCN9A; (+) strand; PAM type: YTN; PAM sequence: TTA
gttagaaaaaaataggtgac

SEQ ID NO: 106055 - DNA, 20 bp, Artificial Sequence
  Description of Artificial Sequence: Synthetic oligonucleotide
  Target: SCN9A; (+) strand; PAM type: YTN; PAM sequence: TTA
gaaaaaaataggtgactgag

SEQ ID NO: 106056 - DNA, 20 bp, Artificial Sequence
  Description of Artificial Sequence: Synthetic oligonucleotide
  Target: SCN9A; (+) strand; PAM type: YTN; PAM sequence: CTG
agttagtttccctttccata

SEQ ID NO: 106057 - DNA, 20 bp, Artificial Sequence
  Description of Artificial Sequence: Synthetic oligonucleotide
  Target: SCN9A; (+) strand; PAM type: YTN; PAM sequence: TTA
gtttccctttccatatgata

SEQ ID NO: 106058 - DNA, 20 bp, Artificial Sequence
  Description of Artificial Sequence: Synthetic oligonucleotide
  Target: SCN9A; (+) strand; PAM type: YTN; PAM sequence: TTT
ccctttccatatgatactaa

SEQ ID NO: 106059 - DNA, 20 bp, Artificial Sequence
  Description of Artificial Sequence: Synthetic oligonucleotide
  Target: SCN9A; (+) strand; PAM type: YTN; PAM sequence: TTC
cctttccatatgatactaaa

SEQ ID NO: 106060 - DNA, 20 bp, Artificial Sequence
  Description of Artificial Sequence: Synthetic oligonucleotide
  Target: SCN9A; (+) strand; PAM type: YTN; PAM sequence: CTT
tccatatgatactaaaccta

SEQ ID NO: 106061 - DNA, 20 bp, Artificial Sequence
  Description of Artificial Sequence: Synthetic oligonucleotide
  Target: SCN9A; (+) strand; PAM type: YTN; PAM sequence: TTT
ccatatgatactaaacctag

SEQ ID NO: 106062 - DNA, 20 bp, Artificial Sequence
  Description of Artificial Sequence: Synthetic oligonucleotide
  Target: SCN9A; (+) strand; PAM type: YTN; PAM sequence: TTC
catatgatactaaacctaga

SEQ ID NO: 106063 - DNA, 20 bp, Artificial Sequence
  Description of Artificial Sequence: Synthetic oligonucleotide
  Target: SCN9A; (+) strand; PAM type: YTN; PAM sequence: CTA
aacctagatgcctgctcctt

SEQ ID NO: 106064 - DNA, 20 bp, Artificial Sequence
  Description of Artificial Sequence: Synthetic oligonucleotide
  Target: SCN9A; (+) strand; PAM type: YTN; PAM sequence: CTA
gatgcctgctccttaaaagg

SEQ ID NO: 106065 - DNA, 20 bp, Artificial Sequence
  Description of Artificial Sequence: Synthetic oligonucleotide
  Target: SCN9A; (+) strand; PAM type: YTN; PAM sequence: CTG
ctccttaaaaggcatacgtg

SEQ ID NO: 106066 - DNA, 20 bp, Artificial Sequence
  Description of Artificial Sequence: Synthetic oligonucleotide
  Target: SCN9A; (+) strand; PAM type: YTN; PAM sequence: CTC
cttaaaaggcatacgtggaa

SEQ ID NO: 106067 - DNA, 20 bp, Artificial Sequence
  Description of Artificial Sequence: Synthetic oligonucleotide
  Target: SCN9A; (+) strand; PAM type: YTN; PAM sequence: CTT
aaaaggcatacgtggaatct

SEQ ID NO: 106068 - DNA, 20 bp, Artificial Sequence
  Description of Artificial Sequence: Synthetic oligonucleotide
  Target: SCN9A; (+) strand; PAM type: YTN; PAM sequence: TTA
aaaggcatacgtggaatctg

SEQ ID NO: 106069 - DNA, 20 bp, Artificial Sequence
  Description of Artificial Sequence: Synthetic oligonucleotide
  Target: SCN9A; (+) strand; PAM type: YTN; PAM sequence: CTG
attttctaactttaagctga

SEQ ID NO: 106070 - DNA, 20 bp, Artificial Sequence
  Description of Artificial Sequence: Synthetic oligonucleotide
  Target: SCN9A; (+) strand; PAM type: YTN; PAM sequence: TTT
tctaactttaagctgaaatg

SEQ ID NO: 106071 - DNA, 20 bp, Artificial Sequence
  Description of Artificial Sequence: Synthetic oligonucleotide
  Target: SCN9A; (+) strand; PAM type: YTN; PAM sequence: TTT
ctaactttaagctgaaatga

SEQ ID NO: 106072 - DNA, 20 bp, Artificial Sequence
  Description of Artificial Sequence: Synthetic oligonucleotide
  Target: SCN9A; (+) strand; PAM type: YTN; PAM sequence: TTC
taactttaagctgaaatgaa

SEQ ID NO: 106073 - DNA, 20 bp, Artificial Sequence
  Description of Artificial Sequence: Synthetic oligonucleotide
  Target: SCN9A; (+) strand; PAM type: YTN; PAM sequence: CTA
actttaagctgaaatgaaca

SEQ ID NO: 106074 - DNA, 20 bp, Artificial Sequence
  Description of Artificial Sequence: Synthetic oligonucleotide
  Target: SCN9A; (+) strand; PAM type: YTN; PAM sequence: CTT
taagctgaaatgaacacggt

SEQ ID NO: 106075 - DNA, 20 bp, Artificial Sequence
  Description of Artificial Sequence: Synthetic oligonucleotide
  Target: SCN9A; (+) strand; PAM type: YTN; PAM sequence: TTT
aagctgaaatgaacacggtt

SEQ ID NO: 106076 - DNA, 20 bp, Artificial Sequence
  Description of Artificial Sequence: Synthetic oligonucleotide
  Target: SCN9A; (+) strand; PAM type: YTN; PAM sequence: TTA
agctgaaatgaacacggttt

SEQ ID NO: 106077 - DNA, 20 bp, Artificial Sequence
  Description of Artificial Sequence: Synthetic oligonucleotide
  Target: SCN9A; (+) strand; PAM type: YTN; PAM sequence: CTG
aaatgaacacggttttaaaa

SEQ ID NO: 106078 - DNA, 20 bp, Artificial Sequence
  Description of Artificial Sequence: Synthetic oligonucleotide
  Target: SCN9A; (+) strand; PAM type: YTN; PAM sequence: TTT
taaaattttgggagtattac

SEQ ID NO: 106079 - DNA, 20 bp, Artificial Sequence
  Description of Artificial Sequence: Synthetic oligonucleotide
  Target: SCN9A; (+) strand; PAM type: YTN; PAM sequence: TTT
aaaattttgggagtattact

SEQ ID NO: 106080 - DNA, 20 bp, Artificial Sequence
  Description of Artificial Sequence: Synthetic oligonucleotide
  Target: SCN9A; (+) strand; PAM type: YTN; PAM sequence: TTA
aaattttgggagtattactt

SEQ ID NO: 106081 - DNA, 20 bp, Artificial Sequence
  Description of Artificial Sequence: Synthetic oligonucleotide
  Target: SCN9A; (+) strand; PAM type: YTN; PAM sequence: TTT
tgggagtattacttcttcca

SEQ ID NO: 106082 - DNA, 20 bp, Artificial Sequence
  Description of Artificial Sequence: Synthetic oligonucleotide
  Target: SCN9A; (+) strand; PAM type: YTN; PAM sequence: TTT
gggagtattacttcttccat

SEQ ID NO: 106083 - DNA, 20 bp, Artificial Sequence
  Description of Artificial Sequence: Synthetic oligonucleotide
  Target: SCN9A; (+) strand; PAM type: YTN; PAM sequence: TTG
ggagtattacttcttccatg

SEQ ID NO: 106084 - DNA, 20 bp, Artificial Sequence
  Description of Artificial Sequence: Synthetic oligonucleotide
  Target: SCN9A; (+) strand; PAM type: YTN; PAM sequence: TTA
cttcttccatgtagaacatt

SEQ ID NO: 106085 - DNA, 20 bp, Artificial Sequence
  Description of Artificial Sequence: Synthetic oligonucleotide
  Target: SCN9A; (+) strand; PAM type: YTN; PAM sequence: CTT
cttccatgtagaacatttta

SEQ ID NO: 106086 - DNA, 20 bp, Artificial Sequence
  Description of Artificial Sequence: Synthetic oligonucleotide
  Target: SCN9A; (+) strand; PAM type: YTN; PAM sequence: TTC
ttccatgtagaacattttaa

SEQ ID NO: 106087 - DNA, 20 bp, Artificial Sequence
  Description of Artificial Sequence: Synthetic oligonucleotide
  Target: SCN9A; (+) strand; PAM type: YTN; PAM sequence: CTT
ccatgtagaacattttaaaa

SEQ ID NO: 106088 - DNA, 20 bp, Artificial Sequence
  Description of Artificial Sequence: Synthetic oligonucleotide
  Target: SCN9A; (+) strand; PAM type: YTN; PAM sequence: TTC
catgtagaacattttaaaat

SEQ ID NO: 106089 - DNA, 20 bp, Artificial Sequence
  Description of Artificial Sequence: Synthetic oligonucleotide
  Target: SCN9A; (+) strand; PAM type: YTN; PAM sequence: TTT
taaaatatacaaataaaata

SEQ ID NO: 106090 - DNA, 20 bp, Artificial Sequence
  Description of Artificial Sequence: Synthetic oligonucleotide
  Target: SCN9A; (+) strand; PAM type: YTN; PAM sequence: TTT
aaaatatacaaataaaatac

SEQ ID NO: 106091 - DNA, 20 bp, Artificial Sequence
  Description of Artificial Sequence: Synthetic oligonucleotide
  Target: SCN9A; (+) strand; PAM type: YTN; PAM sequence: TTA
aaatatacaaataaaataca

SEQ ID NO: 106092 - DNA, 20 bp, Artificial Sequence
  Description of Artificial Sequence: Synthetic oligonucleotide
  Target: SCN9A; (+) strand; PAM type: YTN; PAM sequence: CTG
gccttctgtatccctgggtc

SEQ ID NO: 106093 - DNA, 20 bp, Artificial Sequence
  Description of Artificial Sequence: Synthetic oligonucleotide
  Target: SCN9A; (+) strand; PAM type: YTN; PAM sequence: CTT
ctgtatccctgggtcccaca

SEQ ID NO: 106094 - DNA, 20 bp, Artificial Sequence
  Description of Artificial Sequence: Synthetic oligonucleotide
  Target: SCN9A; (+) strand; PAM type: YTN; PAM sequence: TTC
tgtatccctgggtcccacat

SEQ ID NO: 106095 - DNA, 20 bp, Artificial Sequence
  Description of Artificial Sequence: Synthetic oligonucleotide
  Target: SCN9A; (+) strand; PAM type: YTN; PAM sequence: CTG
tatccctgggtcccacatct

SEQ ID NO: 106096 - DNA, 20 bp, Artificial Sequence
  Description of Artificial Sequence: Synthetic oligonucleotide
  Target: SCN9A; (+) strand; PAM type: YTN; PAM sequence: CTG
ggtcccacatctgtagagtc

SEQ ID NO: 106097 - DNA, 20 bp, Artificial Sequence
  Description of Artificial Sequence: Synthetic oligonucleotide
  Target: SCN9A; (+) strand; PAM type: YTN; PAM sequence: CTG
tagagtcaaccaactacaga

SEQ ID NO: 106098 - DNA, 20 bp, Artificial Sequence
  Description of Artificial Sequence: Synthetic oligonucleotide
  Target: SCN9A; (+) strand; PAM type: YTN; PAM sequence: CTA
cagatggaaaataattggaa

SEQ ID NO: 106099 - DNA, 20 bp, Artificial Sequence
  Description of Artificial Sequence: Synthetic oligonucleotide
  Target: SCN9A; (+) strand; PAM type: YTN; PAM sequence: TTG
gaaaaaataaatataaaaat

SEQ ID NO: 106100 - DNA, 20 bp, Artificial Sequence
  Description of Artificial Sequence: Synthetic oligonucleotide
  Target: SCN9A; (+) strand; PAM type: YTN; PAM sequence: TTT
acattgtgtcagtgatttac

SEQ ID NO: 106101 - DNA, 20 bp, Artificial Sequence
  Description of Artificial Sequence: Synthetic oligonucleotide
  Target: SCN9A; (+) strand; PAM type: YTN; PAM sequence: TTA
cattgtgtcagtgatttact

SEQ ID NO: 106102 - DNA, 20 bp, Artificial Sequence
  Description of Artificial Sequence: Synthetic oligonucleotide
  Target: SCN9A; (+) strand; PAM type: YTN; PAM sequence: TTG
tgtcagtgatttacttttac

SEQ ID NO: 106103 - DNA, 20 bp, Artificial Sequence
  Description of Artificial Sequence: Synthetic oligonucleotide
  Target: SCN9A; (+) strand; PAM type: YTN; PAM sequence: TTT
acttttacattataagtaat

SEQ ID NO: 106104 - DNA, 20 bp, Artificial Sequence
  Description of Artificial Sequence: Synthetic oligonucleotide
  Target: SCN9A; (+) strand; PAM type: YTN; PAM sequence: TTA
cttttacattataagtaatc

SEQ ID NO: 106105 - DNA, 20 bp, Artificial Sequence
  Description of Artificial Sequence: Synthetic oligonucleotide
  Target: SCN9A; (+) strand; PAM type: YTN; PAM sequence: CTT
ttacattataagtaatctga

SEQ ID NO: 106106 - DNA, 20 bp, Artificial Sequence
  Description of Artificial Sequence: Synthetic oligonucleotide
  Target: SCN9A; (+) strand; PAM type: YTN; PAM sequence: TTT
tacattataagtaatctgaa

SEQ ID NO: 106107 - DNA, 20 bp, Artificial Sequence
  Description of Artificial Sequence: Synthetic oligonucleotide
  Target: SCN9A; (+) strand; PAM type: YTN; PAM sequence: TTT
acattataagtaatctgaag

SEQ ID NO: 106108 - DNA, 20 bp, Artificial Sequence
  Description of Artificial Sequence: Synthetic oligonucleotide
  Target: SCN9A; (+) strand; PAM type: YTN; PAM sequence: TTA
cattataagtaatctgaaga

SEQ ID NO: 106109 - DNA, 20 bp, Artificial Sequence
  Description of Artificial Sequence: Synthetic oligonucleotide
  Target: SCN9A; (+) strand; PAM type: YTN; PAM sequence: TTA
taagtaatctgaagataatt

SEQ ID NO: 106110 - DNA, 20 bp, Artificial Sequence
  Description of Artificial Sequence: Synthetic oligonucleotide
  Target: SCN9A; (+) strand; PAM type: YTN; PAM sequence: CTG
aagataatttaaagtgtaca

SEQ ID NO: 106111 - DNA, 20 bp, Artificial Sequence
  Description of Artificial Sequence: Synthetic oligonucleotide
  Target: SCN9A; (+) strand; PAM type: YTN; PAM sequence: TTT
aaagtgtacatatgagagga

SEQ ID NO: 106112 - DNA, 20 bp, Artificial Sequence
  Description of Artificial Sequence: Synthetic oligonucleotide
  Target: SCN9A; (+) strand; PAM type: YTN; PAM sequence: TTA
aagtgtacatatgagaggat

SEQ ID NO: 106113 - DNA, 20 bp, Artificial Sequence
  Description of Artificial Sequence: Synthetic oligonucleotide
  Target: SCN9A; (+) strand; PAM type: YTN; PAM sequence: TTT
tatggtaaacattgtgccat

SEQ ID NO: 106114 - DNA, 20 bp, Artificial Sequence
  Description of Artificial Sequence: Synthetic oligonucleotide
  Target: SCN9A; (+) strand; PAM type: YTN; PAM sequence: TTT
atggtaaacattgtgccatt

SEQ ID NO: 106115 - DNA, 20 bp, Artificial Sequence
  Description of Artificial Sequence: Synthetic oligonucleotide
  Target: SCN9A; (+) strand; PAM type: YTN; PAM sequence: TTA
tggtaaacattgtgccattt

SEQ ID NO: 106116 - DNA, 20 bp, Artificial Sequence
  Description of Artificial Sequence: Synthetic oligonucleotide
  Target: SCN9A; (+) strand; PAM type: YTN; PAM sequence: TTG
tgccattttatataaaggaa

SEQ ID NO: 106117 - DNA, 20 bp, Artificial Sequence
  Description of Artificial Sequence: Synthetic oligonucleotide
  Target: SCN9A; (+) strand; PAM type: YTN; PAM sequence: TTT
tatataaaggaattgagcat

SEQ ID NO: 106118 - DNA, 20 bp, Artificial Sequence
  Description of Artificial Sequence: Synthetic oligonucleotide
  Target: SCN9A; (+) strand; PAM type: YTN; PAM sequence: TTT
atataaaggaattgagcatc

SEQ ID NO: 106119 - DNA, 20 bp, Artificial Sequence
  Description of Artificial Sequence: Synthetic oligonucleotide
  Target: SCN9A; (+) strand; PAM type: YTN; PAM sequence: TTA
tataaaggaattgagcatct

SEQ ID NO: 106120 - DNA, 20 bp, Artificial Sequence
  Description of Artificial Sequence: Synthetic oligonucleotide
  Target: SCN9A; (+) strand; PAM type: YTN; PAM sequence: TTG
agcatctgcagattttagtc

SEQ ID NO: 106121 - DNA, 20 bp, Artificial Sequence
  Description of Artificial Sequence: Synthetic oligonucleotide
  Target: SCN9A; (+) strand; PAM type: YTN; PAM sequence: CTG
cagattttagtctctgtggg

SEQ ID NO: 106122 - DNA, 20 bp, Artificial Sequence
  Description of Artificial Sequence: Synthetic oligonucleotide
  Target: SCN9A; (+) strand; PAM type: YTN; PAM sequence: TTT
tagtctctgtggggggcctt

SEQ ID NO: 106123 - DNA, 20 bp, Artificial Sequence
  Description of Artificial Sequence: Synthetic oligonucleotide
  Target: SCN9A; (+) strand; PAM type: YTN; PAM sequence: TTT
agtctctgtggggggccttc

SEQ ID NO: 106124 - DNA, 20 bp, Artificial Sequence
  Description of Artificial Sequence: Synthetic oligonucleotide
  Target: SCN9A; (+) strand; PAM type: YTN; PAM sequence: TTA
gtctctgtggggggccttca

SEQ ID NO: 106125 - DNA, 20 bp, Artificial Sequence
  Description of Artificial Sequence: Synthetic oligonucleotide
  Target: SCN9A; (+) strand; PAM type: YTN; PAM sequence: CTC
tgtggggggccttcaaacta

SEQ ID NO: 106126 - DNA, 20 bp, Artificial Sequence
  Description of Artificial Sequence: Synthetic oligonucleotide
  Target: SCN9A; (+) strand; PAM type: YTN; PAM sequence: CTG
tggggggccttcaaactact

SEQ ID NO: 106127 - DNA, 20 bp, Artificial Sequence
  Description of Artificial Sequence: Synthetic oligonucleotide
  Target: SCN9A; (+) strand; PAM type: YTN; PAM sequence: CTT
caaactactcgcccatagat

SEQ ID NO: 106128 - DNA, 20 bp, Artificial Sequence
  Description of Artificial Sequence: Synthetic oligonucleotide
  Target: SCN9A; (+) strand; PAM type: YTN; PAM sequence: TTC
aaactactcgcccatagata

SEQ ID NO: 106129 - DNA, 20 bp, Artificial Sequence
  Description of Artificial Sequence: Synthetic oligonucleotide
  Target: SCN9A; (+) strand; PAM type: YTN; PAM sequence: CTA
ctcgcccatagatatcgagg

SEQ ID NO: 106130 - DNA, 20 bp, Artificial Sequence
  Description of Artificial Sequence: Synthetic oligonucleotide
  Target: SCN9A; (+) strand; PAM type: YTN; PAM sequence: CTC
gcccatagatatcgagggat

SEQ ID NO: 106131 - DNA, 20 bp, Artificial Sequence
  Description of Artificial Sequence: Synthetic oligonucleotide
  Target: SCN9A; (+) strand; PAM type: YTN; PAM sequence: CTA
gatttgattccttactttac

SEQ ID NO: 106132 - DNA, 20 bp, Artificial Sequence
  Description of Artificial Sequence: Synthetic oligonucleotide
  Target: SCN9A; (+) strand; PAM type: YTN; PAM sequence: TTT
gattccttactttaccgtct

SEQ ID NO: 106133 - DNA, 20 bp, Artificial Sequence
  Description of Artificial Sequence: Synthetic oligonucleotide
  Target: SCN9A; (+) strand; PAM type: YTN; PAM sequence: TTG
attccttactttaccgtctt

SEQ ID NO: 106134 - DNA, 20 bp, Artificial Sequence
  Description of Artificial Sequence: Synthetic oligonucleotide
  Target: SCN9A; (+) strand; PAM type: YTN; PAM sequence: TTC
cttactttaccgtcttggaa

SEQ ID NO: 106135 - DNA, 20 bp, Artificial Sequence
  Description of Artificial Sequence: Synthetic oligonucleotide
  Target: SCN9A; (+) strand; PAM type: YTN; PAM sequence: CTT
actttaccgtcttggaaaaa

SEQ ID NO: 106136 - DNA, 20 bp, Artificial Sequence
  Description of Artificial Sequence: Synthetic oligonucleotide
  Target: SCN9A; (+) strand; PAM type: YTN; PAM sequence: TTA
ctttaccgtcttggaaaaaa

SEQ ID NO: 106137 - DNA, 20 bp, Artificial Sequence
  Description of Artificial Sequence: Synthetic oligonucleotide
  Target: SCN9A; (+) strand; PAM type: YTN; PAM sequence: CTT
taccgtcttggaaaaaatgt

SEQ ID NO: 106138 - DNA, 20 bp, Artificial Sequence
  Description of Artificial Sequence: Synthetic oligonucleotide
  Target: SCN9A; (+) strand; PAM type: YTN; PAM sequence: TTT
accgtcttggaaaaaatgtc

SEQ ID NO: 106139 - DNA, 20 bp, Artificial Sequence
  Description of Artificial Sequence: Synthetic oligonucleotide
  Target: SCN9A; (+) strand; PAM type: YTN; PAM sequence: TTA
ccgtcttggaaaaaatgtcc

SEQ ID NO: 106140 - DNA, 20 bp, Artificial Sequence
  Description of Artificial Sequence: Synthetic oligonucleotide
  Target: SCN9A; (+) strand; PAM type: YTN; PAM sequence: CTT
ggaaaaaatgtccttggcta

SEQ ID NO: 106141 - DNA, 20 bp, Artificial Sequence
  Description of Artificial Sequence: Synthetic oligonucleotide
  Target: SCN9A; (+) strand; PAM type: YTN; PAM sequence: TTG
gaaaaaatgtccttggctac

SEQ ID NO: 106142 - DNA, 20 bp, Artificial Sequence
  Description of Artificial Sequence: Synthetic oligonucleotide
  Target: SCN9A; (+) strand; PAM type: YTN; PAM sequence: CTT
ggctacatagaaacatatat

SEQ ID NO: 106143 - DNA, 20 bp, Artificial Sequence
  Description of Artificial Sequence: Synthetic oligonucleotide
  Target: SCN9A; (+) strand; PAM type: YTN; PAM sequence: TTG
gctacatagaaacatatatc

SEQ ID NO: 106144 - DNA, 20 bp, Artificial Sequence
  Description of Artificial Sequence: Synthetic oligonucleotide
  Target: SCN9A; (+) strand; PAM type: YTN; PAM sequence: CTA
catagaaacatatatcatga

SEQ ID NO: 106145 - DNA, 20 bp, Artificial Sequence
  Description of Artificial Sequence: Synthetic oligonucleotide
  Target: SCN9A; (+) strand; PAM type: YTN; PAM sequence: TTT
atttatttaatcatttattc

SEQ ID NO: 106146 - DNA, 20 bp, Artificial Sequence
  Description of Artificial Sequence: Synthetic oligonucleotide
  Target: SCN9A; (+) strand; PAM type: YTN; PAM sequence: TTA
tttatttaatcatttattca

SEQ ID NO: 106147 - DNA, 20 bp, Artificial Sequence
  Description of Artificial Sequence: Synthetic oligonucleotide
  Target: SCN9A; (+) strand; PAM type: YTN; PAM sequence: TTT
atttaatcatttattcactc

SEQ ID NO: 106148 - DNA, 20 bp, Artificial Sequence
  Description of Artificial Sequence: Synthetic oligonucleotide
  Target: SCN9A; (+) strand; PAM type: YTN; PAM sequence: TTA
tttaatcatttattcactca

SEQ ID NO: 106149 - DNA, 20 bp, Artificial Sequence
  Description of Artificial Sequence: Synthetic oligonucleotide
  Target: SCN9A; (+) strand; PAM type: YTN; PAM sequence: TTT
aatcatttattcactcaatt

SEQ ID NO: 106150 - DNA, 20 bp, Artificial Sequence
  Description of Artificial Sequence: Synthetic oligonucleotide
  Target: SCN9A; (+) strand; PAM type: YTN; PAM sequence: TTA
atcatttattcactcaatta

SEQ ID NO: 106151 - DNA, 20 bp, Artificial Sequence
  Description of Artificial Sequence: Synthetic oligonucleotide
  Target: SCN9A; (+) strand; PAM type: YTN; PAM sequence: TTT
attcactcaattaaatatag

SEQ ID NO: 106152 - DNA, 20 bp, Artificial Sequence
  Description of Artificial Sequence: Synthetic oligonucleotide
  Target: SCN9A; (+) strand; PAM type: YTN; PAM sequence: TTA
ttcactcaattaaatataga

SEQ ID NO: 106153 - DNA, 20 bp, Artificial Sequence
  Description of Artificial Sequence: Synthetic oligonucleotide
  Target: SCN9A; (+) strand; PAM type: YTN; PAM sequence: TTC
actcaattaaatatagagca

SEQ ID NO: 106154 - DNA, 20 bp, Artificial Sequence
  Description of Artificial Sequence: Synthetic oligonucleotide
  Target: SCN9A; (+) strand; PAM type: YTN; PAM sequence: CTC
aattaaatatagagcatttt

SEQ ID NO: 106155 - DNA, 20 bp, Artificial Sequence
  Description of Artificial Sequence: Synthetic oligonucleotide
  Target: SCN9A; (+) strand; PAM type: YTN; PAM sequence: TTA
aatatagagcattttatttt

SEQ ID NO: 106156 - DNA, 20 bp, Artificial Sequence
  Description of Artificial Sequence: Synthetic oligonucleotide
  Target: SCN9A; (+) strand; PAM type: YTN; PAM sequence: TTT
tattttattttgttttaatt

SEQ ID NO: 106157 - DNA, 20 bp, Artificial Sequence
  Description of Artificial Sequence: Synthetic oligonucleotide
  Target: SCN9A; (+) strand; PAM type: YTN; PAM sequence: TTT
attttattttgttttaattt

SEQ ID NO: 106158 - DNA, 20 bp, Artificial Sequence
  Description of Artificial Sequence: Synthetic oligonucleotide
  Target: SCN9A; (+) strand; PAM type: YTN; PAM sequence: TTA
ttttattttgttttaattta

SEQ ID NO: 106159 - DNA, 20 bp, Artificial Sequence
  Description of Artificial Sequence: Synthetic oligonucleotide
  Target: SCN9A; (+) strand; PAM type: YTN; PAM sequence: TTT
tattttgttttaatttaatt

SEQ ID NO: 106160 - DNA, 20 bp, Artificial Sequence
  Description of Artificial Sequence: Synthetic oligonucleotide
  Target: SCN9A; (+) strand; PAM type: YTN; PAM sequence: TTT
attttgttttaatttaattt

SEQ ID NO: 106161 - DNA, 20 bp, Artificial Sequence
  Description of Artificial Sequence: Synthetic oligonucleotide
  Target: SCN9A; (+) strand; PAM type: YTN; PAM sequence: TTA
ttttgttttaatttaattta

SEQ ID NO: 106162 - DNA, 20 bp, Artificial Sequence
  Description of Artificial Sequence: Synthetic oligonucleotide
  Target: SCN9A; (+) strand; PAM type: YTN; PAM sequence: TTT
tgttttaatttaatttaatc

SEQ ID NO: 106163 - DNA, 20 bp, Artificial Sequence
  Description of Artificial Sequence: Synthetic oligonucleotide
  Target: SCN9A; (+) strand; PAM type: YTN; PAM sequence: TTT
gttttaatttaatttaatct

SEQ ID NO: 106164 - DNA, 20 bp, Artificial Sequence
  Description of Artificial Sequence: Synthetic oligonucleotide
  Target: SCN9A; (+) strand; PAM type: YTN; PAM sequence: TTG
ttttaatttaatttaatctt

SEQ ID NO: 106165 - DNA, 20 bp, Artificial Sequence
  Description of Artificial Sequence: Synthetic oligonucleotide
  Target: SCN9A; (+) strand; PAM type: YTN; PAM sequence: TTT
taatttaatttaatcttatg

SEQ ID NO: 106166 - DNA, 20 bp, Artificial Sequence
  Description of Artificial Sequence: Synthetic oligonucleotide
  Target: SCN9A; (+) strand; PAM type: YTN; PAM sequence: TTT
aatttaatttaatcttatgt

SEQ ID NO: 106167 - DNA, 20 bp, Artificial Sequence
  Description of Artificial Sequence: Synthetic oligonucleotide
  Target: SCN9A; (+) strand; PAM type: YTN; PAM sequence: TTA
atttaatttaatcttatgta

SEQ ID NO: 106168 - DNA, 20 bp, Artificial Sequence
  Description of Artificial Sequence: Synthetic oligonucleotide
  Target: SCN9A; (+) strand; PAM type: YTN; PAM sequence: TTT
aatttaatcttatgtattta

SEQ ID NO: 106169 - DNA, 20 bp, Artificial Sequence
  Description of Artificial Sequence: Synthetic oligonucleotide
  Target: SCN9A; (+) strand; PAM type: YTN; PAM sequence: TTA
atttaatcttatgtatttaa

SEQ ID NO: 106170 - DNA, 20 bp, Artificial Sequence
  Description of Artificial Sequence: Synthetic oligonucleotide
  Target: SCN9A; (+) strand; PAM type: YTN; PAM sequence: TTT
aatcttatgtatttaattta

SEQ ID NO: 106171 - DNA, 20 bp, Artificial Sequence
  Description of Artificial Sequence: Synthetic oligonucleotide
  Target: SCN9A; (+) strand; PAM type: YTN; PAM sequence: TTA
atcttatgtatttaatttaa

SEQ ID NO: 106172 - DNA, 20 bp, Artificial Sequence
  Description of Artificial Sequence: Synthetic oligonucleotide
  Target: SCN9A; (+) strand; PAM type: YTN; PAM sequence: CTT
atgtatttaatttaatctta

SEQ ID NO: 106173 - DNA, 20 bp, Artificial Sequence
  Description of Artificial Sequence: Synthetic oligonucleotide
  Target: SCN9A; (+) strand; PAM type: YTN; PAM sequence: TTA
tgtatttaatttaatcttat

SEQ ID NO: 106174 - DNA, 20 bp, Artificial Sequence
  Description of Artificial Sequence: Synthetic oligonucleotide
  Target: SCN9A; (+) strand; PAM type: YTN; PAM sequence: TTT
aatttaatcttatgtattga

SEQ ID NO: 106175 - DNA, 20 bp, Artificial Sequence
  Description of Artificial Sequence: Synthetic oligonucleotide
  Target: SCN9A; (+) strand; PAM type: YTN; PAM sequence: TTA
atttaatcttatgtattgat

SEQ ID NO: 106176 - DNA, 20 bp, Artificial Sequence
  Description of Artificial Sequence: Synthetic oligonucleotide
  Target: SCN9A; (+) strand; PAM type: YTN; PAM sequence: TTT
aatcttatgtattgattttt

SEQ ID NO: 106177 - DNA, 20 bp, Artificial Sequence
  Description of Artificial Sequence: Synthetic oligonucleotide
  Target: SCN9A; (+) strand; PAM type: YTN; PAM sequence: TTA
atcttatgtattgatttttt

SEQ ID NO: 106178 - DNA, 20 bp, Artificial Sequence
  Description of Artificial Sequence: Synthetic oligonucleotide
  Target: SCN9A; (+) strand; PAM type: YTN; PAM sequence: CTT
atgtattgattttttttgag

SEQ ID NO: 106179 - DNA, 20 bp, Artificial Sequence
  Description of Artificial Sequence: Synthetic oligonucleotide
  Target: SCN9A; (+) strand; PAM type: YTN; PAM sequence: TTA
tgtattgattttttttgaga

SEQ ID NO: 106180 - DNA, 20 bp, Artificial Sequence
  Description of Artificial Sequence: Synthetic oligonucleotide
  Target: SCN9A; (+) strand; PAM type: YTN; PAM sequence: TTG
attttttttgagacagagtc

SEQ ID NO: 106181 - DNA, 20 bp, Artificial Sequence
  Description of Artificial Sequence: Synthetic oligonucleotide
  Target: SCN9A; (+) strand; PAM type: YTN; PAM sequence: TTT
tttttgagacagagtctcac

SEQ ID NO: 106182 - DNA, 20 bp, Artificial Sequence
  Description of Artificial Sequence: Synthetic oligonucleotide
  Target: SCN9A; (+) strand; PAM type: YTN; PAM sequence: TTT
ttttgagacagagtctcact

SEQ ID NO: 106183 - DNA, 20 bp, Artificial Sequence
  Description of Artificial Sequence: Synthetic oligonucleotide
  Target: SCN9A; (+) strand; PAM type: YTN; PAM sequence: TTT
tttgagacagagtctcactc

SEQ ID NO: 106184 - DNA, 20 bp, Artificial Sequence
  Description of Artificial Sequence: Synthetic oligonucleotide
  Target: SCN9A; (+) strand; PAM type: YTN; PAM sequence: TTT
ttgagacagagtctcactct

SEQ ID NO: 106185 - DNA, 20 bp, Artificial Sequence
  Description of Artificial Sequence: Synthetic oligonucleotide
  Target: SCN9A; (+) strand; PAM type: YTN; PAM sequence: TTT
tgagacagagtctcactctg

SEQ ID NO: 106186 - DNA, 20 bp, Artificial Sequence
  Description of Artificial Sequence: Synthetic oligonucleotide
  Target: SCN9A; (+) strand; PAM type: YTN; PAM sequence: TTT
gagacagagtctcactctgt

SEQ ID NO: 106187 - DNA, 20 bp, Artificial Sequence
  Description of Artificial Sequence: Synthetic oligonucleotide
  Target: SCN9A; (+) strand; PAM type: YTN; PAM sequence: TTG
agacagagtctcactctgta

SEQ ID NO: 106188 - DNA, 20 bp, Artificial Sequence
  Description of Artificial Sequence: Synthetic oligonucleotide
  Target: SCN9A; (+) strand; PAM type: YTN; PAM sequence: CTC
actctgtagtccaagctgga

SEQ ID NO: 106189 - DNA, 20 bp, Artificial Sequence
  Description of Artificial Sequence: Synthetic oligonucleotide
  Target: SCN9A; (+) strand; PAM type: YTN; PAM sequence: CTC
tgtagtccaagctggagtgc

SEQ ID NO: 106190 - DNA, 20 bp, Artificial Sequence
  Description of Artificial Sequence: Synthetic oligonucleotide
  Target: SCN9A; (+) strand; PAM type: YTN; PAM sequence: CTG
tagtccaagctggagtgcag

SEQ ID NO: 106191 - DNA, 20 bp, Artificial Sequence
  Description of Artificial Sequence: Synthetic oligonucleotide
  Target: SCN9A; (+) strand; PAM type: YTN; PAM sequence: CTG
gagtgcagcggtgcgatctt

SEQ ID NO: 106192 - DNA, 20 bp, Artificial Sequence
  Description of Artificial Sequence: Synthetic oligonucleotide
  Target: SCN9A; (+) strand; PAM type: YTN; PAM sequence: CTT
ggcttactgcaacctccgcc

SEQ ID NO: 106193 - DNA, 20 bp, Artificial Sequence
  Description of Artificial Sequence: Synthetic oligonucleotide
  Target: SCN9A; (+) strand; PAM type: YTN; PAM sequence: TTG
gcttactgcaacctccgcct

SEQ ID NO: 106194 - DNA, 20 bp, Artificial Sequence
  Description of Artificial Sequence: Synthetic oligonucleotide
  Target: SCN9A; (+) strand; PAM type: YTN; PAM sequence: CTT
actgcaacctccgcctctgg

SEQ ID NO: 106195 - DNA, 20 bp, Artificial Sequence
  Description of Artificial Sequence: Synthetic oligonucleotide
  Target: SCN9A; (+) strand; PAM type: YTN; PAM sequence: TTA
ctgcaacctccgcctctgga

SEQ ID NO: 106196 - DNA, 20 bp, Artificial Sequence
  Description of Artificial Sequence: Synthetic oligonucleotide
  Target: SCN9A; (+) strand; PAM type: YTN; PAM sequence: CTG
caacctccgcctctggagct

SEQ ID NO: 106197 - DNA, 20 bp, Artificial Sequence
  Description of Artificial Sequence: Synthetic oligonucleotide
  Target: SCN9A; (+) strand; PAM type: YTN; PAM sequence: CTC
cgcctctggagctcaagtga

SEQ ID NO: 106198 - DNA, 20 bp, Artificial Sequence
  Description of Artificial Sequence: Synthetic oligonucleotide
  Target: SCN9A; (+) strand; PAM type: YTN; PAM sequence: CTC
tggagctcaagtgattctca

SEQ ID NO: 106199 - DNA, 20 bp, Artificial Sequence
  Description of Artificial Sequence: Synthetic oligonucleotide
  Target: SCN9A; (+) strand; PAM type: YTN; PAM sequence: CTG
gagctcaagtgattctcatg

SEQ ID NO: 106200 - DNA, 20 bp, Artificial Sequence
  Description of Artificial Sequence: Synthetic oligonucleotide
  Target: SCN9A; (+) strand; PAM type: YTN; PAM sequence: CTC
aagtgattctcatgcctcag

SEQ ID NO: 106201 - DNA, 20 bp, Artificial Sequence
  Description of Artificial Sequence: Synthetic oligonucleotide
  Target: SCN9A; (+) strand; PAM type: YTN; PAM sequence: TTC
tcatgcctcagcctcctgag

SEQ ID NO: 106202 - DNA, 20 bp, Artificial Sequence
  Description of Artificial Sequence: Synthetic oligonucleotide
  Target: SCN9A; (+) strand; PAM type: YTN; PAM sequence: CTC
atgcctcagcctcctgagca

SEQ ID NO: 106203 - DNA, 20 bp, Artificial Sequence
  Description of Artificial Sequence: Synthetic oligonucleotide
  Target: SCN9A; (+) strand; PAM type: YTN; PAM sequence: CTC
agcctcctgagcattttact

SEQ ID NO: 106204 - DNA, 20 bp, Artificial Sequence
  Description of Artificial Sequence: Synthetic oligonucleotide
  Target: SCN9A; (+) strand; PAM type: YTN; PAM sequence: CTC
ctgagcattttactgatata

SEQ ID NO: 106205 - DNA, 20 bp, Artificial Sequence
  Description of Artificial Sequence: Synthetic oligonucleotide
  Target: SCN9A; (+) strand; PAM type: YTN; PAM sequence: CTG
agcattttactgatatatat

SEQ ID NO: 106206 - DNA, 20 bp, Artificial Sequence
  Description of Artificial Sequence: Synthetic oligonucleotide
  Target: SCN9A; (+) strand; PAM type: YTN; PAM sequence: TTT
tactgatatatatatatata

SEQ ID NO: 106207 - DNA, 20 bp, Artificial Sequence
  Description of Artificial Sequence: Synthetic oligonucleotide
  Target: SCN9A; (+) strand; PAM type: YTN; PAM sequence: TTT
actgatatatatatatatat

SEQ ID NO: 106208 - DNA, 20 bp, Artificial Sequence
  Description of Artificial Sequence: Synthetic oligonucleotide
  Target: SCN9A; (+) strand; PAM type: YTN; PAM sequence: TTA
ctgatatatatatatatata

SEQ ID NO: 106209 - DNA, 20 bp, Artificial Sequence
  Description of Artificial Sequence: Synthetic oligonucleotide
  Target: SCN9A; (+) strand; PAM type: YTN; PAM sequence: CTG
atatatatatatatatatat

SEQ ID NO: 106210 - DNA, 20 bp, Artificial Sequence
  Description of Artificial Sequence: Synthetic oligonucleotide
  Target: SCN9A; (+) strand; PAM type: YTN; PAM sequence: TTA
ttccatataatctcgttttc

SEQ ID NO: 106211 - DNA, 20 bp, Artificial Sequence
  Description of Artificial Sequence: Synthetic oligonucleotide
  Target: SCN9A; (+) strand; PAM type: YTN; PAM sequence: TTC
catataatctcgttttccaa

SEQ ID NO: 106212 - DNA, 20 bp, Artificial Sequence
  Description of Artificial Sequence: Synthetic oligonucleotide
  Target: SCN9A; (+) strand; PAM type: YTN; PAM sequence: CTC
gttttccaagtccactataa

SEQ ID NO: 106213 - DNA, 20 bp, Artificial Sequence
  Description of Artificial Sequence: Synthetic oligonucleotide
  Target: SCN9A; (+) strand; PAM type: YTN; PAM sequence: TTT
tccaagtccactataaattc

SEQ ID NO: 106214 - DNA, 20 bp, Artificial Sequence
  Description of Artificial Sequence: Synthetic oligonucleotide
  Target: SCN9A; (+) strand; PAM type: YTN; PAM sequence: TTT
ccaagtccactataaattca

SEQ ID NO: 106215 - DNA, 20 bp, Artificial Sequence
  Description of Artificial Sequence: Synthetic oligonucleotide
  Target: SCN9A; (+) strand; PAM type: YTN; PAM sequence: TTC
caagtccactataaattcat

SEQ ID NO: 106216 - DNA, 20 bp, Artificial Sequence
  Description of Artificial Sequence: Synthetic oligonucleotide
  Target: SCN9A; (+) strand; PAM type: YTN; PAM sequence: CTA
taaattcatggagggtggag

SEQ ID NO: 106217 - DNA, 20 bp, Artificial Sequence
  Description of Artificial Sequence: Synthetic oligonucleotide
  Target: SCN9A; (+) strand; PAM type: YTN; PAM sequence: TTC
atggagggtggagtcttagt

SEQ ID NO: 106218 - DNA, 20 bp, Artificial Sequence
  Description of Artificial Sequence: Synthetic oligonucleotide
  Target: SCN9A; (+) strand; PAM type: YTN; PAM sequence: CTT
agtaagttaaggagatagaa

SEQ ID NO: 106219 - DNA, 20 bp, Artificial Sequence
  Description of Artificial Sequence: Synthetic oligonucleotide
  Target: SCN9A; (+) strand; PAM type: YTN; PAM sequence: TTA
gtaagttaaggagatagaag

SEQ ID NO: 106220 - DNA, 20 bp, Artificial Sequence
  Description of Artificial Sequence: Synthetic oligonucleotide
  Target: SCN9A; (+) strand; PAM type: YTN; PAM sequence: TTA
aggagatagaagatatttgg

SEQ ID NO: 106221 - DNA, 20 bp, Artificial Sequence
  Description of Artificial Sequence: Synthetic oligonucleotide
  Target: SCN9A; (+) strand; PAM type: YTN; PAM sequence: TTT
ggtaaatatctgtcaaatac

SEQ ID NO: 106222 - DNA, 20 bp, Artificial Sequence
  Description of Artificial Sequence: Synthetic oligonucleotide
  Target: SCN9A; (+) strand; PAM type: YTN; PAM sequence: TTG
gtaaatatctgtcaaatact

SEQ ID NO: 106223 - DNA, 20 bp, Artificial Sequence
  Description of Artificial Sequence: Synthetic oligonucleotide
  Target: SCN9A; (+) strand; PAM type: YTN; PAM sequence: CTG
tcaaatactttctaacatga

SEQ ID NO: 106224 - DNA, 20 bp, Artificial Sequence
  Description of Artificial Sequence: Synthetic oligonucleotide
  Target: SCN9A; (+) strand; PAM type: YTN; PAM sequence: CTT
tctaacatgagctagagaaa

SEQ ID NO: 106225 - DNA, 20 bp, Artificial Sequence
  Description of Artificial Sequence: Synthetic oligonucleotide
  Target: SCN9A; (+) strand; PAM type: YTN; PAM sequence: TTT
ctaacatgagctagagaaaa

SEQ ID NO: 106226 - DNA, 20 bp, Artificial Sequence
  Description of Artificial Sequence: Synthetic oligonucleotide
  Target: SCN9A; (+) strand; PAM type: YTN; PAM sequence: TTC
taacatgagctagagaaaac

SEQ ID NO: 106227 - DNA, 20 bp, Artificial Sequence
  Description of Artificial Sequence: Synthetic oligonucleotide
  Target: SCN9A; (+) strand; PAM type: YTN; PAM sequence: CTA
acatgagctagagaaaacaa

SEQ ID NO: 106228 - DNA, 20 bp, Artificial Sequence
  Description of Artificial Sequence: Synthetic oligonucleotide
  Target: SCN9A; (+) strand; PAM type: YTN; PAM sequence: CTA
gagaaaacaaaagattattt

SEQ ID NO: 106229 - DNA, 20 bp, Artificial Sequence
  Description of Artificial Sequence: Synthetic oligonucleotide
  Target: SCN9A; (+) strand; PAM type: YTN; PAM sequence: TTA
tttttaaatgatgccttaag

SEQ ID NO: 106230 - DNA, 20 bp, Artificial Sequence
  Description of Artificial Sequence: Synthetic oligonucleotide
  Target: SCN9A; (+) strand; PAM type: YTN; PAM sequence: TTT
ttaaatgatgccttaagact

SEQ ID NO: 106231 - DNA, 20 bp, Artificial Sequence
  Description of Artificial Sequence: Synthetic oligonucleotide
  Target: SCN9A; (+) strand; PAM type: YTN; PAM sequence: TTT
taaatgatgccttaagactt

SEQ ID NO: 106232 - DNA, 20 bp, Artificial Sequence
  Description of Artificial Sequence: Synthetic oligonucleotide
  Target: SCN9A; (+) strand; PAM type: YTN; PAM sequence: TTT
aaatgatgccttaagacttg

SEQ ID NO: 106233 - DNA, 20 bp, Artificial Sequence
  Description of Artificial Sequence: Synthetic oligonucleotide
  Target: SCN9A; (+) strand; PAM type: YTN; PAM sequence: TTA
aatgatgccttaagacttga

SEQ ID NO: 106234 - DNA, 20 bp, Artificial Sequence
  Description of Artificial Sequence: Synthetic oligonucleotide
  Target: SCN9A; (+) strand; PAM type: YTN; PAM sequence: CTT
aagacttgaaagcaatctca

SEQ ID NO: 106235 - DNA, 20 bp, Artificial Sequence
  Description of Artificial Sequence: Synthetic oligonucleotide
  Target: SCN9A; (+) strand; PAM type: YTN; PAM sequence: TTA
agacttgaaagcaatctcat

SEQ ID NO: 106236 - DNA, 20 bp, Artificial Sequence
  Description of Artificial Sequence: Synthetic oligonucleotide
  Target: SCN9A; (+) strand; PAM type: YTN; PAM sequence: CTT
gaaagcaatctcataaaagt

SEQ ID NO: 106237 - DNA, 20 bp, Artificial Sequence
  Description of Artificial Sequence: Synthetic oligonucleotide
  Target: SCN9A; (+) strand; PAM type: YTN; PAM sequence: TTG
aaagcaatctcataaaagta

SEQ ID NO: 106238 - DNA, 20 bp, Artificial Sequence
  Description of Artificial Sequence: Synthetic oligonucleotide
  Target: SCN9A; (+) strand; PAM type: YTN; PAM sequence: CTC
ataaaagtaatttgtaatac

SEQ ID NO: 106239 - DNA, 20 bp, Artificial Sequence
  Description of Artificial Sequence: Synthetic oligonucleotide
  Target: SCN9A; (+) strand; PAM type: YTN; PAM sequence: TTT
gtaatacggttgttatattt

SEQ ID NO: 106240 - DNA, 20 bp, Artificial Sequence
  Description of Artificial Sequence: Synthetic oligonucleotide
  Target: SCN9A; (+) strand; PAM type: YTN; PAM sequence: TTG
taatacggttgttatatttc

SEQ ID NO: 106241 - DNA, 20 bp, Artificial Sequence
  Description of Artificial Sequence: Synthetic oligonucleotide
  Target: SCN9A; (+) strand; PAM type: YTN; PAM sequence: TTG
ttatatttcacaataaaaat

SEQ ID NO: 106242 - DNA, 20 bp, Artificial Sequence
  Description of Artificial Sequence: Synthetic oligonucleotide
  Target: SCN9A; (+) strand; PAM type: YTN; PAM sequence: TTA
tatttcacaataaaaataaa

SEQ ID NO: 106243 - DNA, 20 bp, Artificial Sequence
  Description of Artificial Sequence: Synthetic oligonucleotide
  Target: SCN9A; (+) strand; PAM type: YTN; PAM sequence: TTT
cacaataaaaataaaactca

SEQ ID NO: 106244 - DNA, 20 bp, Artificial Sequence
  Description of Artificial Sequence: Synthetic oligonucleotide
  Target: SCN9A; (+) strand; PAM type: YTN; PAM sequence: TTC
acaataaaaataaaactcaa

SEQ ID NO: 106245 - DNA, 20 bp, Artificial Sequence
  Description of Artificial Sequence: Synthetic oligonucleotide
  Target: SCN9A; (+) strand; PAM type: YTN; PAM sequence: CTC
aatacataccttgactcact

SEQ ID NO: 106246 - DNA, 20 bp, Artificial Sequence
  Description of Artificial Sequence: Synthetic oligonucleotide
  Target: SCN9A; (+) strand; PAM type: YTN; PAM sequence: CTT
gactcactagaaatatgcag

SEQ ID NO: 106247 - DNA, 20 bp, Artificial Sequence
  Description of Artificial Sequence: Synthetic oligonucleotide
  Target: SCN9A; (+) strand; PAM type: YTN; PAM sequence: TTG
actcactagaaatatgcagg

SEQ ID NO: 106248 - DNA, 20 bp, Artificial Sequence
  Description of Artificial Sequence: Synthetic oligonucleotide
  Target: SCN9A; (+) strand; PAM type: YTN; PAM sequence: CTC
actagaaatatgcaggtaag

SEQ ID NO: 106249 - DNA, 20 bp, Artificial Sequence
  Description of Artificial Sequence: Synthetic oligonucleotide
  Target: SCN9A; (+) strand; PAM type: YTN; PAM sequence: CTA
gaaatatgcaggtaagggtg

SEQ ID NO: 106250 - DNA, 20 bp, Artificial Sequence
  Description of Artificial Sequence: Synthetic oligonucleotide
  Target: SCN9A; (+) strand; PAM type: YTN; PAM sequence: TTT
taaagagttcctgttctcaa

SEQ ID NO: 106251 - DNA, 20 bp, Artificial Sequence
  Description of Artificial Sequence: Synthetic oligonucleotide
  Target: SCN9A; (+) strand; PAM type: YTN; PAM sequence: TTT
aaagagttcctgttctcaat

SEQ ID NO: 106252 - DNA, 20 bp, Artificial Sequence
  Description of Artificial Sequence: Synthetic oligonucleotide
  Target: SCN9A; (+) strand; PAM type: YTN; PAM sequence: TTA
aagagttcctgttctcaatg

SEQ ID NO: 106253 - DNA, 20 bp, Artificial Sequence
  Description of Artificial Sequence: Synthetic oligonucleotide
  Target: SCN9A; (+) strand; PAM type: YTN; PAM sequence: TTC
ctgttctcaatgaatttaca

SEQ ID NO: 106254 - DNA, 20 bp, Artificial Sequence
  Description of Artificial Sequence: Synthetic oligonucleotide
  Target: SCN9A; (+) strand; PAM type: YTN; PAM sequence: CTG
ttctcaatgaatttacagta

SEQ ID NO: 106255 - DNA, 20 bp, Artificial Sequence
  Description of Artificial Sequence: Synthetic oligonucleotide
  Target: SCN9A; (+) strand; PAM type: YTN; PAM sequence: TTC
tcaatgaatttacagtacta

SEQ ID NO: 106256 - DNA, 20 bp, Artificial Sequence
  Description of Artificial Sequence: Synthetic oligonucleotide
  Target: SCN9A; (+) strand; PAM type: YTN; PAM sequence: CTC
aatgaatttacagtactatt

SEQ ID NO: 106257 - DNA, 20 bp, Artificial Sequence
  Description of Artificial Sequence: Synthetic oligonucleotide
  Target: SCN9A; (+) strand; PAM type: YTN; PAM sequence: TTT
acagtactatttgatgcata

SEQ ID NO: 106258 - DNA, 20 bp, Artificial Sequence
  Description of Artificial Sequence: Synthetic oligonucleotide
  Target: SCN9A; (+) strand; PAM type: YTN; PAM sequence: TTA
cagtactatttgatgcatac

SEQ ID NO: 106259 - DNA, 20 bp, Artificial Sequence
  Description of Artificial Sequence: Synthetic oligonucleotide
  Target: SCN9A; (+) strand; PAM type: YTN; PAM sequence: CTA
tttgatgcataccataattt

SEQ ID NO: 106260 - DNA, 20 bp, Artificial Sequence
  Description of Artificial Sequence: Synthetic oligonucleotide
  Target: SCN9A; (+) strand; PAM type: YTN; PAM sequence: TTT
gatgcataccataatttctc

SEQ ID NO: 106261 - DNA, 20 bp, Artificial Sequence
  Description of Artificial Sequence: Synthetic oligonucleotide
  Target: SCN9A; (+) strand; PAM type: YTN; PAM sequence: TTG
atgcataccataatttctca

SEQ ID NO: 106262 - DNA, 20 bp, Artificial Sequence
  Description of Artificial Sequence: Synthetic oligonucleotide
  Target: SCN9A; (+) strand; PAM type: YTN; PAM sequence: TTT
ctcaaaaaattaaaatttaa

SEQ ID NO: 106263 - DNA, 20 bp, Artificial Sequence
  Description of Artificial Sequence: Synthetic oligonucleotide
  Target: SCN9A; (+) strand; PAM type: YTN; PAM sequence: TTC
tcaaaaaattaaaatttaag

SEQ ID NO: 106264 - DNA, 20 bp, Artificial Sequence
  Description of Artificial Sequence: Synthetic oligonucleotide
  Target: SCN9A; (+) strand; PAM type: YTN; PAM sequence: CTC
aaaaaattaaaatttaagat

SEQ ID NO: 106265 - DNA, 20 bp, Artificial Sequence
  Description of Artificial Sequence: Synthetic oligonucleotide
  Target: SCN9A; (+) strand; PAM type: YTN; PAM sequence: TTA
aaatttaagattactgaatc

SEQ ID NO: 106266 - DNA, 20 bp, Artificial Sequence
  Description of Artificial Sequence: Synthetic oligonucleotide
  Target: SCN9A; (+) strand; PAM type: YTN; PAM sequence: TTT
aagattactgaatccaggaa

SEQ ID NO: 106267 - DNA, 20 bp, Artificial Sequence
  Description of Artificial Sequence: Synthetic oligonucleotide
  Target: SCN9A; (+) strand; PAM type: YTN; PAM sequence: TTA
agattactgaatccaggaag

SEQ ID NO: 106268 - DNA, 20 bp, Artificial Sequence
  Description of Artificial Sequence: Synthetic oligonucleotide
  Target: SCN9A; (+) strand; PAM type: YTN; PAM sequence: TTA
ctgaatccaggaagaagtat

SEQ ID NO: 106269 - DNA, 20 bp, Artificial Sequence
  Description of Artificial Sequence: Synthetic oligonucleotide
  Target: SCN9A; (+) strand; PAM type: YTN; PAM sequence: CTG
aatccaggaagaagtataaa

SEQ ID NO: 106270 - DNA, 20 bp, Artificial Sequence
  Description of Artificial Sequence: Synthetic oligonucleotide
  Target: SCN9A; (+) strand; PAM type: YTN; PAM sequence: TTG
tttgcggttcaaaaatgaga

SEQ ID NO: 106271 - DNA, 20 bp, Artificial Sequence
  Description of Artificial Sequence: Synthetic oligonucleotide
  Target: SCN9A; (+) strand; PAM type: YTN; PAM sequence: TTT
gcggttcaaaaatgagaagg

SEQ ID NO: 106272 - DNA, 20 bp, Artificial Sequence
  Description of Artificial Sequence: Synthetic oligonucleotide
  Target: SCN9A; (+) strand; PAM type: YTN; PAM sequence: TTG
cggttcaaaaatgagaaggg

SEQ ID NO: 106273 - DNA, 20 bp, Artificial Sequence
  Description of Artificial Sequence: Synthetic oligonucleotide
  Target: SCN9A; (+) strand; PAM type: YTN; PAM sequence: TTC
aaaaatgagaagggactaca

SEQ ID NO: 106274 - DNA, 20 bp, Artificial Sequence
  Description of Artificial Sequence: Synthetic oligonucleotide
  Target: SCN9A; (+) strand; PAM type: YTN; PAM sequence: CTA
catccatttggggagaaatt

SEQ ID NO: 106275 - DNA, 20 bp, Artificial Sequence
  Description of Artificial Sequence: Synthetic oligonucleotide
  Target: SCN9A; (+) strand; PAM type: YTN; PAM sequence: TTT
ggggagaaattaggagggat

SEQ ID NO: 106276 - DNA, 20 bp, Artificial Sequence
  Description of Artificial Sequence: Synthetic oligonucleotide
  Target: SCN9A; (+) strand; PAM type: YTN; PAM sequence: TTG
gggagaaattaggagggatg

SEQ ID NO: 106277 - DNA, 20 bp, Artificial Sequence
  Description of Artificial Sequence: Synthetic oligonucleotide
  Target: SCN9A; (+) strand; PAM type: YTN; PAM sequence: TTA
ggagggatgaaataaataac

SEQ ID NO: 106278 - DNA, 20 bp, Artificial Sequence
  Description of Artificial Sequence: Synthetic oligonucleotide
  Target: SCN9A; (+) strand; PAM type: YTN; PAM sequence: TTT
tgagaacattgagtatggtt

SEQ ID NO: 106279 - DNA, 20 bp, Artificial Sequence
  Description of Artificial Sequence: Synthetic oligonucleotide
  Target: SCN9A; (+) strand; PAM type: YTN; PAM sequence: TTT
gagaacattgagtatggttc

SEQ ID NO: 106280 - DNA, 20 bp, Artificial Sequence
  Description of Artificial Sequence: Synthetic oligonucleotide
  Target: SCN9A; (+) strand; PAM type: YTN; PAM sequence: TTG
agaacattgagtatggttct

SEQ ID NO: 106281 - DNA, 20 bp, Artificial Sequence
  Description of Artificial Sequence: Synthetic oligonucleotide
  Target: SCN9A; (+) strand; PAM type: YTN; PAM sequence: TTG
agtatggttctaaacatttt

SEQ ID NO: 106282 - DNA, 20 bp, Artificial Sequence
  Description of Artificial Sequence: Synthetic oligonucleotide
  Target: SCN9A; (+) strand; PAM type: YTN; PAM sequence: TTC
taaacattttacatgtatta

SEQ ID NO: 106283 - DNA, 20 bp, Artificial Sequence
  Description of Artificial Sequence: Synthetic oligonucleotide
  Target: SCN9A; (+) strand; PAM type: YTN; PAM sequence: CTA
aacattttacatgtattaac

SEQ ID NO: 106284 - DNA, 20 bp, Artificial Sequence
  Description of Artificial Sequence: Synthetic oligonucleotide
  Target: SCN9A; (+) strand; PAM type: YTN; PAM sequence: TTT
tacatgtattaacgtgttaa

SEQ ID NO: 106285 - DNA, 20 bp, Artificial Sequence
  Description of Artificial Sequence: Synthetic oligonucleotide
  Target: SCN9A; (+) strand; PAM type: YTN; PAM sequence: TTT
acatgtattaacgtgttaat

SEQ ID NO: 106286 - DNA, 20 bp, Artificial Sequence
  Description of Artificial Sequence: Synthetic oligonucleotide
  Target: SCN9A; (+) strand; PAM type: YTN; PAM sequence: TTA
catgtattaacgtgttaatt

SEQ ID NO: 106287 - DNA, 20 bp, Artificial Sequence
  Description of Artificial Sequence: Synthetic oligonucleotide
  Target: SCN9A; (+) strand; PAM type: YTN; PAM sequence: TTA
acgtgttaattcatttaacc

SEQ ID NO: 106288 - DNA, 20 bp, Artificial Sequence
  Description of Artificial Sequence: Synthetic oligonucleotide
  Target: SCN9A; (+) strand; PAM type: YTN; PAM sequence: TTA
attcatttaaccctgaccca

SEQ ID NO: 106289 - DNA, 20 bp, Artificial Sequence
  Description of Artificial Sequence: Synthetic oligonucleotide
  Target: SCN9A; (+) strand; PAM type: YTN; PAM sequence: TTC
atttaaccctgacccaactg

SEQ ID NO: 106290 - DNA, 20 bp, Artificial Sequence
  Description of Artificial Sequence: Synthetic oligonucleotide
  Target: SCN9A; (+) strand; PAM type: YTN; PAM sequence: TTT
aaccctgacccaactgcgat

SEQ ID NO: 106291 - DNA, 20 bp, Artificial Sequence
  Description of Artificial Sequence: Synthetic oligonucleotide
  Target: SCN9A; (+) strand; PAM type: YTN; PAM sequence: TTA
accctgacccaactgcgatt

SEQ ID NO: 106292 - DNA, 20 bp, Artificial Sequence
  Description of Artificial Sequence: Synthetic oligonucleotide
  Target: SCN9A; (+) strand; PAM type: YTN; PAM sequence: CTG
acccaactgcgatttaagta

SEQ ID NO: 106293 - DNA, 20 bp, Artificial Sequence
  Description of Artificial Sequence: Synthetic oligonucleotide
  Target: SCN9A; (+) strand; PAM type: YTN; PAM sequence: CTG
cgatttaagtattaacaatt

SEQ ID NO: 106294 - DNA, 20 bp, Artificial Sequence
  Description of Artificial Sequence: Synthetic oligonucleotide
  Target: SCN9A; (+) strand; PAM type: YTN; PAM sequence: TTT
aagtattaacaatttaatag

SEQ ID NO: 106295 - DNA, 20 bp, Artificial Sequence
  Description of Artificial Sequence: Synthetic oligonucleotide
  Target: SCN9A; (+) strand; PAM type: YTN; PAM sequence: TTA
agtattaacaatttaataga

SEQ ID NO: 106296 - DNA, 20 bp, Artificial Sequence
  Description of Artificial Sequence: Synthetic oligonucleotide
  Target: SCN9A; (+) strand; PAM type: YTN; PAM sequence: TTA
acaatttaatagatgataaa

SEQ ID NO: 106297 - DNA, 20 bp, Artificial Sequence
  Description of Artificial Sequence: Synthetic oligonucleotide
  Target: SCN9A; (+) strand; PAM type: YTN; PAM sequence: TTT
aatagatgataaatacaagg

SEQ ID NO: 106298 - DNA, 20 bp, Artificial Sequence
  Description of Artificial Sequence: Synthetic oligonucleotide
  Target: SCN9A; (+) strand; PAM type: YTN; PAM sequence: TTA
atagatgataaatacaaggg

SEQ ID NO: 106299 - DNA, 20 bp, Artificial Sequence
  Description of Artificial Sequence: Synthetic oligonucleotide
  Target: SCN9A; (+) strand; PAM type: YTN; PAM sequence: CTT
gaaggattttgactggagaa

SEQ ID NO: 106300 - DNA, 20 bp, Artificial Sequence
  Description of Artificial Sequence: Synthetic oligonucleotide
  Target: SCN9A; (+) strand; PAM type: YTN; PAM sequence: TTG
aaggattttgactggagaag

SEQ ID NO: 106301 - DNA, 20 bp, Artificial Sequence
  Description of Artificial Sequence: Synthetic oligonucleotide
  Target: SCN9A; (+) strand; PAM type: YTN; PAM sequence: TTT
tgactggagaaggaaatccc

SEQ ID NO: 106302 - DNA, 20 bp, Artificial Sequence
  Description of Artificial Sequence: Synthetic oligonucleotide
  Target: SCN9A; (+) strand; PAM type: YTN; PAM sequence: TTT
gactggagaaggaaatccca

SEQ ID NO: 106303 - DNA, 20 bp, Artificial Sequence
  Description of Artificial Sequence: Synthetic oligonucleotide
  Target: SCN9A; (+) strand; PAM type: YTN; PAM sequence: TTG
actggagaaggaaatcccaa

SEQ ID NO: 106304 - DNA, 20 bp, Artificial Sequence
  Description of Artificial Sequence: Synthetic oligonucleotide
  Target: SCN9A; (+) strand; PAM type: YTN; PAM sequence: CTG
gagaaggaaatcccaagcaa

SEQ ID NO: 106305 - DNA, 20 bp, Artificial Sequence
  Description of Artificial Sequence: Synthetic oligonucleotide
  Target: SCN9A; (+) strand; PAM type: YTN; PAM sequence: TTT
atgacctaaaaggaaattgg

SEQ ID NO: 106306 - DNA, 20 bp, Artificial Sequence
  Description of Artificial Sequence: Synthetic oligonucleotide
  Target: SCN9A; (+) strand; PAM type: YTN; PAM sequence: TTA
tgacctaaaaggaaattggt

SEQ ID NO: 106307 - DNA, 20 bp, Artificial Sequence
  Description of Artificial Sequence: Synthetic oligonucleotide
  Target: SCN9A; (+) strand; PAM type: YTN; PAM sequence: CTA
aaaggaaattggtttggtac

SEQ ID NO: 106308 - DNA, 20 bp, Artificial Sequence
  Description of Artificial Sequence: Synthetic oligonucleotide
  Target: SCN9A; (+) strand; PAM type: YTN; PAM sequence: TTG
gtttggtacaggtaaaaatc

SEQ ID NO: 106309 - DNA, 20 bp, Artificial Sequence
  Description of Artificial Sequence: Synthetic oligonucleotide
  Target: SCN9A; (+) strand; PAM type: YTN; PAM sequence: TTT
ggtacaggtaaaaatctatg

SEQ ID NO: 106310 - DNA, 20 bp, Artificial Sequence
  Description of Artificial Sequence: Synthetic oligonucleotide
  Target: SCN9A; (+) strand; PAM type: YTN; PAM sequence: TTG
gtacaggtaaaaatctatgg

SEQ ID NO: 106311 - DNA, 20 bp, Artificial Sequence
  Description of Artificial Sequence: Synthetic oligonucleotide
  Target: SCN9A; (+) strand; PAM type: YTN; PAM sequence: CTA
tgggtgagcactaggagata

SEQ ID NO: 106312 - DNA, 20 bp, Artificial Sequence
  Description of Artificial Sequence: Synthetic oligonucleotide
  Target: SCN9A; (+) strand; PAM type: YTN; PAM sequence: CTA
ggagatagagctggtcaaag

SEQ ID NO: 106313 - DNA, 20 bp, Artificial Sequence
  Description of Artificial Sequence: Synthetic oligonucleotide
  Target: SCN9A; (+) strand; PAM type: YTN; PAM sequence: CTG
gtcaaagctggttagggcca

SEQ ID NO: 106314 - DNA, 20 bp, Artificial Sequence
  Description of Artificial Sequence: Synthetic oligonucleotide
  Target: SCN9A; (+) strand; PAM type: YTN; PAM sequence: CTG
gttagggccatagtgtgaag

SEQ ID NO: 106315 - DNA, 20 bp, Artificial Sequence
  Description of Artificial Sequence: Synthetic oligonucleotide
  Target: SCN9A; (+) strand; PAM type: YTN; PAM sequence: TTA
gggccatagtgtgaaggctt

SEQ ID NO: 106316 - DNA, 20 bp, Artificial Sequence
  Description of Artificial Sequence: Synthetic oligonucleotide
  Target: SCN9A; (+) strand; PAM type: YTN; PAM sequence: CTT
tgtgcacagtacataattcg

SEQ ID NO: 106317 - DNA, 20 bp, Artificial Sequence
  Description of Artificial Sequence: Synthetic oligonucleotide
  Target: SCN9A; (+) strand; PAM type: YTN; PAM sequence: TTT
gtgcacagtacataattcga

SEQ ID NO: 106318 - DNA, 20 bp, Artificial Sequence
  Description of Artificial Sequence: Synthetic oligonucleotide
  Target: SCN9A; (+) strand; PAM type: YTN; PAM sequence: TTG
tgcacagtacataattcgag

SEQ ID NO: 106319 - DNA, 20 bp, Artificial Sequence
  Description of Artificial Sequence: Synthetic oligonucleotide
  Target: SCN9A; (+) strand; PAM type: YTN; PAM sequence: TTC
gagactttggggatggccag

SEQ ID NO: 106320 - DNA, 20 bp, Artificial Sequence
  Description of Artificial Sequence: Synthetic oligonucleotide
  Target: SCN9A; (+) strand; PAM type: YTN; PAM sequence: CTT
tggggatggccaggcgtggt

SEQ ID NO: 106321 - DNA, 20 bp, Artificial Sequence
  Description of Artificial Sequence: Synthetic oligonucleotide
  Target: SCN9A; (+) strand; PAM type: YTN; PAM sequence: TTT
ggggatggccaggcgtggtg

SEQ ID NO: 106322 - DNA, 20 bp, Artificial Sequence
  Description of Artificial Sequence: Synthetic oligonucleotide
  Target: SCN9A; (+) strand; PAM type: YTN; PAM sequence: TTG
gggatggccaggcgtggtgg

SEQ ID NO: 106323 - DNA, 20 bp, Artificial Sequence
  Description of Artificial Sequence: Synthetic oligonucleotide
  Target: SCN9A; (+) strand; PAM type: YTN; PAM sequence: CTC
actcctgtaatctcagcaac

SEQ ID NO: 106324 - DNA, 20 bp, Artificial Sequence
  Description of Artificial Sequence: Synthetic oligonucleotide
  Target: SCN9A; (+) strand; PAM type: YTN; PAM sequence: CTC
ctgtaatctcagcaactggg

SEQ ID NO: 106325 - DNA, 20 bp, Artificial Sequence
  Description of Artificial Sequence: Synthetic oligonucleotide
  Target: SCN9A; (+) strand; PAM type: YTN; PAM sequence: CTG
taatctcagcaactggggaa

SEQ ID NO: 106326 - DNA, 20 bp, Artificial Sequence
  Description of Artificial Sequence: Synthetic oligonucleotide
  Target: SCN9A; (+) strand; PAM type: YTN; PAM sequence: CTC
agcaactggggaaaaagttt

SEQ ID NO: 106327 - DNA, 20 bp, Artificial Sequence
  Description of Artificial Sequence: Synthetic oligonucleotide
  Target: SCN9A; (+) strand; PAM type: YTN; PAM sequence: CTG
gggaaaaagtttgaagaatt

SEQ ID NO: 106328 - DNA, 20 bp, Artificial Sequence
  Description of Artificial Sequence: Synthetic oligonucleotide
  Target: SCN9A; (+) strand; PAM type: YTN; PAM sequence: TTT
gaagaattgcctgagtccag

SEQ ID NO: 106329 - DNA, 20 bp, Artificial Sequence
  Description of Artificial Sequence: Synthetic oligonucleotide
  Target: SCN9A; (+) strand; PAM type: YTN; PAM sequence: TTG
aagaattgcctgagtccagt

SEQ ID NO: 106330 - DNA, 20 bp, Artificial Sequence
  Description of Artificial Sequence: Synthetic oligonucleotide
  Target: SCN9A; (+) strand; PAM type: YTN; PAM sequence: TTG
cctgagtccagtagtttgag

SEQ ID NO: 106331 - DNA, 20 bp, Artificial Sequence
  Description of Artificial Sequence: Synthetic oligonucleotide
  Target: SCN9A; (+) strand; PAM type: YTN; PAM sequence: CTG
agtccagtagtttgagacca

SEQ ID NO: 106332 - DNA, 20 bp, Artificial Sequence
  Description of Artificial Sequence: Synthetic oligonucleotide
  Target: SCN9A; (+) strand; PAM type: YTN; PAM sequence: TTT
gagaccagcctgggaaacat

SEQ ID NO: 106333 - DNA, 20 bp, Artificial Sequence
  Description of Artificial Sequence: Synthetic oligonucleotide
  Target: SCN9A; (+) strand; PAM type: YTN; PAM sequence: TTG
agaccagcctgggaaacata

SEQ ID NO: 106334 - DNA, 20 bp, Artificial Sequence
  Description of Artificial Sequence: Synthetic oligonucleotide
  Target: SCN9A; (+) strand; PAM type: YTN; PAM sequence: CTG
ggaaacatagtgaaaccttg

SEQ ID NO: 106335 - DNA, 20 bp, Artificial Sequence
  Description of Artificial Sequence: Synthetic oligonucleotide
  Target: SCN9A; (+) strand; PAM type: YTN; PAM sequence: CTT
gtctctacaaacttttttaa

SEQ ID NO: 106336 - DNA, 20 bp, Artificial Sequence
  Description of Artificial Sequence: Synthetic oligonucleotide
  Target: SCN9A; (+) strand; PAM type: YTN; PAM sequence: TTG
tctctacaaacttttttaaa

SEQ ID NO: 106337 - DNA, 20 bp, Artificial Sequence
  Description of Artificial Sequence: Synthetic oligonucleotide
  Target: SCN9A; (+) strand; PAM type: YTN; PAM sequence: CTC
tacaaacttttttaaaaaaa

SEQ ID NO: 106338 - DNA, 20 bp, Artificial Sequence
  Description of Artificial Sequence: Synthetic oligonucleotide
  Target: SCN9A; (+) strand; PAM type: YTN; PAM sequence: CTA
caaacttttttaaaaaaatt

SEQ ID NO: 106339 - DNA, 20 bp, Artificial Sequence
  Description of Artificial Sequence: Synthetic oligonucleotide
  Target: SCN9A; (+) strand; PAM type: YTN; PAM sequence: CTT
ttttaaaaaaattagctggg

SEQ ID NO: 106340 - DNA, 20 bp, Artificial Sequence
  Description of Artificial Sequence: Synthetic oligonucleotide
  Target: SCN9A; (+) strand; PAM type: YTN; PAM sequence: TTT
tttaaaaaaattagctgggt

SEQ ID NO: 106341 - DNA, 20 bp, Artificial Sequence
  Description of Artificial Sequence: Synthetic oligonucleotide
  Target: SCN9A; (+) strand; PAM type: YTN; PAM sequence: TTT
ttaaaaaaattagctgggtg

SEQ ID NO: 106342 - DNA, 20 bp, Artificial Sequence
  Description of Artificial Sequence: Synthetic oligonucleotide
  Target: SCN9A; (+) strand; PAM type: YTN; PAM sequence: TTT
taaaaaaattagctgggtgt

SEQ ID NO: 106343 - DNA, 20 bp, Artificial Sequence
  Description of Artificial Sequence: Synthetic oligonucleotide
  Target: SCN9A; (+) strand; PAM type: YTN; PAM sequence: TTT
aaaaaaattagctgggtgtt

SEQ ID NO: 106344 - DNA, 20 bp, Artificial Sequence
  Description of Artificial Sequence: Synthetic oligonucleotide
  Target: SCN9A; (+) strand; PAM type: YTN; PAM sequence: TTA
aaaaaattagctgggtgttg

SEQ ID NO: 106345 - DNA, 20 bp, Artificial Sequence
  Description of Artificial Sequence: Synthetic oligonucleotide
  Target: SCN9A; (+) strand; PAM type: YTN; PAM sequence: TTA
gctgggtgttgtggcatggg

SEQ ID NO: 106346 - DNA, 20 bp, Artificial Sequence
  Description of Artificial Sequence: Synthetic oligonucleotide
  Target: SCN9A; (+) strand; PAM type: YTN; PAM sequence: CTG
ggtgttgtggcatgggtgtg

SEQ ID NO: 106347 - DNA, 20 bp, Artificial Sequence
  Description of Artificial Sequence: Synthetic oligonucleotide
  Target: SCN9A; (+) strand; PAM type: YTN; PAM sequence: TTG
tggcatgggtgtgtagtccc

SEQ ID NO: 106348 - DNA, 20 bp, Artificial Sequence
  Description of Artificial Sequence: Synthetic oligonucleotide
  Target: SCN9A; (+) strand; PAM type: YTN; PAM sequence: CTC
aggaggtggaggcaggagga

SEQ ID NO: 106349 - DNA, 20 bp, Artificial Sequence
  Description of Artificial Sequence: Synthetic oligonucleotide
  Target: SCN9A; (+) strand; PAM type: YTN; PAM sequence: CTT
gagcccaggagttcaaggtt

SEQ ID NO: 106350 - DNA, 20 bp, Artificial Sequence
  Description of Artificial Sequence: Synthetic oligonucleotide
  Target: SCN9A; (+) strand; PAM type: YTN; PAM sequence: TTG
agcccaggagttcaaggttg

SEQ ID NO: 106351 - DNA, 20 bp, Artificial Sequence
  Description of Artificial Sequence: Synthetic oligonucleotide
  Target: SCN9A; (+) strand; PAM type: YTN; PAM sequence: TTC
aaggttgcagtaagctatga

SEQ ID NO: 106352 - DNA, 20 bp, Artificial Sequence
  Description of Artificial Sequence: Synthetic oligonucleotide
  Target: SCN9A; (+) strand; PAM type: YTN; PAM sequence: TTG
cagtaagctatgatagcacc

SEQ ID NO: 106353 - DNA, 20 bp, Artificial Sequence
  Description of Artificial Sequence: Synthetic oligonucleotide
  Target: SCN9A; (+) strand; PAM type: YTN; PAM sequence: CTA
tgatagcaccactgtactcc

SEQ ID NO: 106354 - DNA, 20 bp, Artificial Sequence
  Description of Artificial Sequence: Synthetic oligonucleotide
  Target: SCN9A; (+) strand; PAM type: YTN; PAM sequence: CTG
tactccagactgggcaacag

SEQ ID NO: 106355 - DNA, 20 bp, Artificial Sequence
  Description of Artificial Sequence: Synthetic oligonucleotide
  Target: SCN9A; (+) strand; PAM type: YTN; PAM sequence: CTC
cagactgggcaacagagtga

SEQ ID NO: 106356 - DNA, 20 bp, Artificial Sequence
  Description of Artificial Sequence: Synthetic oligonucleotide
  Target: SCN9A; (+) strand; PAM type: YTN; PAM sequence: CTG
ggcaacagagtgagacctgt

SEQ ID NO: 106357 - DNA, 20 bp, Artificial Sequence
  Description of Artificial Sequence: Synthetic oligonucleotide
  Target: SCN9A; (+) strand; PAM type: YTN; PAM sequence: CTG
tctccgttttttaaaaaaaa

SEQ ID NO: 106358 - DNA, 20 bp, Artificial Sequence
  Description of Artificial Sequence: Synthetic oligonucleotide
  Target: SCN9A; (+) strand; PAM type: YTN; PAM sequence: CTC
cgttttttaaaaaaaagaag

SEQ ID NO: 106359 - DNA, 20 bp, Artificial Sequence
  Description of Artificial Sequence: Synthetic oligonucleotide
  Target: SCN9A; (+) strand; PAM type: YTN; PAM sequence: TTT
tttaaaaaaaagaagagaga

SEQ ID NO: 106360 - DNA, 20 bp, Artificial Sequence
  Description of Artificial Sequence: Synthetic oligonucleotide
  Target: SCN9A; (+) strand; PAM type: YTN; PAM sequence: TTT
ttaaaaaaaagaagagagag

SEQ ID NO: 106361 - DNA, 20 bp, Artificial Sequence
  Description of Artificial Sequence: Synthetic oligonucleotide
  Target: SCN9A; (+) strand; PAM type: YTN; PAM sequence: TTT
taaaaaaaagaagagagaga

SEQ ID NO: 106362 - DNA, 20 bp, Artificial Sequence
  Description of Artificial Sequence: Synthetic oligonucleotide
  Target: SCN9A; (+) strand; PAM type: YTN; PAM sequence: TTT
aaaaaaaagaagagagagag

SEQ ID NO: 106363 - DNA, 20 bp, Artificial Sequence
  Description of Artificial Sequence: Synthetic oligonucleotide
  Target: SCN9A; (+) strand; PAM type: YTN; PAM sequence: TTA
aaaaaaagaagagagagaga

SEQ ID NO: 106364 - DNA, 20 bp, Artificial Sequence
  Description of Artificial Sequence: Synthetic oligonucleotide
  Target: SCN9A; (+) strand; PAM type: YTN; PAM sequence: CTT
tgcggatcatggatacatca

SEQ ID NO: 106365 - DNA, 20 bp, Artificial Sequence
  Description of Artificial Sequence: Synthetic oligonucleotide
  Target: SCN9A; (+) strand; PAM type: YTN; PAM sequence: TTT
gcggatcatggatacatcat

SEQ ID NO: 106366 - DNA, 20 bp, Artificial Sequence
  Description of Artificial Sequence: Synthetic oligonucleotide
  Target: SCN9A; (+) strand; PAM type: YTN; PAM sequence: TTG
cggatcatggatacatcatg

SEQ ID NO: 106367 - DNA, 20 bp, Artificial Sequence
  Description of Artificial Sequence: Synthetic oligonucleotide
  Target: SCN9A; (+) strand; PAM type: YTN; PAM sequence: TTA
ggactgaatctgcatgagcg

SEQ ID NO: 106368 - DNA, 20 bp, Artificial Sequence
  Description of Artificial Sequence: Synthetic oligonucleotide
  Target: SCN9A; (+) strand; PAM type: YTN; PAM sequence: CTG
aatctgcatgagcgaaaata

SEQ ID NO: 106369 - DNA, 20 bp, Artificial Sequence
  Description of Artificial Sequence: Synthetic oligonucleotide
  Target: SCN9A; (+) strand; PAM type: YTN; PAM sequence: CTG
catgagcgaaaataatcaaa

SEQ ID NO: 106370 - DNA, 20 bp, Artificial Sequence
  Description of Artificial Sequence: Synthetic oligonucleotide
  Target: SCN9A; (+) strand; PAM type: YTN; PAM sequence: CTA
gagtaaatgcaaaatggaag

SEQ ID NO: 106371 - DNA, 20 bp, Artificial Sequence
  Description of Artificial Sequence: Synthetic oligonucleotide
  Target: SCN9A; (+) strand; PAM type: YTN; PAM sequence: TTG
agactctgcttgaaatggtt

SEQ ID NO: 106372 - DNA, 20 bp, Artificial Sequence
  Description of Artificial Sequence: Synthetic oligonucleotide
  Target: SCN9A; (+) strand; PAM type: YTN; PAM sequence: CTC
tgcttgaaatggtttaggca

SEQ ID NO: 106373 - DNA, 20 bp, Artificial Sequence
  Description of Artificial Sequence: Synthetic oligonucleotide
  Target: SCN9A; (+) strand; PAM type: YTN; PAM sequence: CTG
cttgaaatggtttaggcaaa

SEQ ID NO: 106374 - DNA, 20 bp, Artificial Sequence
  Description of Artificial Sequence: Synthetic oligonucleotide
  Target: SCN9A; (+) strand; PAM type: YTN; PAM sequence: CTT
gaaatggtttaggcaaaaag

SEQ ID NO: 106375 - DNA, 20 bp, Artificial Sequence
  Description of Artificial Sequence: Synthetic oligonucleotide
  Target: SCN9A; (+) strand; PAM type: YTN; PAM sequence: TTG
aaatggtttaggcaaaaagt

SEQ ID NO: 106376 - DNA, 20 bp, Artificial Sequence
  Description of Artificial Sequence: Synthetic oligonucleotide
  Target: SCN9A; (+) strand; PAM type: YTN; PAM sequence: TTT
aggcaaaaagtagtgagtac

SEQ ID NO: 106377 - DNA, 20 bp, Artificial Sequence
  Description of Artificial Sequence: Synthetic oligonucleotide
  Target: SCN9A; (+) strand; PAM type: YTN; PAM sequence: TTA
ggcaaaaagtagtgagtaca

SEQ ID NO: 106378 - DNA, 20 bp, Artificial Sequence
  Description of Artificial Sequence: Synthetic oligonucleotide
  Target: SCN9A; (+) strand; PAM type: YTN; PAM sequence: TTC
aaacaggcactgtggaggga

SEQ ID NO: 106379 - DNA, 20 bp, Artificial Sequence
  Description of Artificial Sequence: Synthetic oligonucleotide
  Target: SCN9A; (+) strand; PAM type: YTN; PAM sequence: CTG
tggagggagactgtgtaact

SEQ ID NO: 106380 - DNA, 20 bp, Artificial Sequence
  Description of Artificial Sequence: Synthetic oligonucleotide
  Target: SCN9A; (+) strand; PAM type: YTN; PAM sequence: CTG
tgtaacttttcaactgacag

SEQ ID NO: 106381 - DNA, 20 bp, Artificial Sequence
  Description of Artificial Sequence: Synthetic oligonucleotide
  Target: SCN9A; (+) strand; PAM type: YTN; PAM sequence: CTT
ttcaactgacaggaaacatg

SEQ ID NO: 106382 - DNA, 20 bp, Artificial Sequence
  Description of Artificial Sequence: Synthetic oligonucleotide
  Target: SCN9A; (+) strand; PAM type: YTN; PAM sequence: TTT
tcaactgacaggaaacatgg

SEQ ID NO: 106383 - DNA, 20 bp, Artificial Sequence
  Description of Artificial Sequence: Synthetic oligonucleotide
  Target: SCN9A; (+) strand; PAM type: YTN; PAM sequence: TTT
caactgacaggaaacatggg

SEQ ID NO: 106384 - DNA, 20 bp, Artificial Sequence
  Description of Artificial Sequence: Synthetic oligonucleotide
  Target: SCN9A; (+) strand; PAM type: YTN; PAM sequence: TTC
aactgacaggaaacatggga

SEQ ID NO: 106385 - DNA, 20 bp, Artificial Sequence
  Description of Artificial Sequence: Synthetic oligonucleotide
  Target: SCN9A; (+) strand; PAM type: YTN; PAM sequence: CTG
acaggaaacatgggatgaag

SEQ ID NO: 106386 - DNA, 20 bp, Artificial Sequence
  Description of Artificial Sequence: Synthetic oligonucleotide
  Target: SCN9A; (+) strand; PAM type: YTN; PAM sequence: CTC
aaagatacctttgagctttc

SEQ ID NO: 106387 - DNA, 20 bp, Artificial Sequence
  Description of Artificial Sequence: Synthetic oligonucleotide
  Target: SCN9A; (+) strand; PAM type: YTN; PAM sequence: CTT
tgagctttctcatacagcta

SEQ ID NO: 106388 - DNA, 20 bp, Artificial Sequence
  Description of Artificial Sequence: Synthetic oligonucleotide
  Target: SCN9A; (+) strand; PAM type: YTN; PAM sequence: TTT
gagctttctcatacagctaa

SEQ ID NO: 106389 - DNA, 20 bp, Artificial Sequence
  Description of Artificial Sequence: Synthetic oligonucleotide
  Target: SCN9A; (+) strand; PAM type: YTN; PAM sequence: TTG
agctttctcatacagctaag

SEQ ID NO: 106390 - DNA, 20 bp, Artificial Sequence
  Description of Artificial Sequence: Synthetic oligonucleotide
  Target: SCN9A; (+) strand; PAM type: YTN; PAM sequence: CTT
tctcatacagctaagtaaga

SEQ ID NO: 106391 - DNA, 20 bp, Artificial Sequence
  Description of Artificial Sequence: Synthetic oligonucleotide
  Target: SCN9A; (+) strand; PAM type: YTN; PAM sequence: TTT
ctcatacagctaagtaagat

SEQ ID NO: 106392 - DNA, 20 bp, Artificial Sequence
  Description of Artificial Sequence: Synthetic oligonucleotide
  Target: SCN9A; (+) strand; PAM type: YTN; PAM sequence: TTC
tcatacagctaagtaagatt

SEQ ID NO: 106393 - DNA, 20 bp, Artificial Sequence
  Description of Artificial Sequence: Synthetic oligonucleotide
  Target: SCN9A; (+) strand; PAM type: YTN; PAM sequence: CTC
atacagctaagtaagattaa

SEQ ID NO: 106394 - DNA, 20 bp, Artificial Sequence
  Description of Artificial Sequence: Synthetic oligonucleotide
  Target: SCN9A; (+) strand; PAM type: YTN; PAM sequence: CTA
agtaagattaaatcaattat

SEQ ID NO: 106395 - DNA, 20 bp, Artificial Sequence
  Description of Artificial Sequence: Synthetic oligonucleotide
  Target: SCN9A; (+) strand; PAM type: YTN; PAM sequence: TTA
aatcaattattaagaactag

SEQ ID NO: 106396 - DNA, 20 bp, Artificial Sequence
  Description of Artificial Sequence: Synthetic oligonucleotide
  Target: SCN9A; (+) strand; PAM type: YTN; PAM sequence: TTA
ttaagaactagtaagaaaac

SEQ ID NO: 106397 - DNA, 20 bp, Artificial Sequence
  Description of Artificial Sequence: Synthetic oligonucleotide
  Target: SCN9A; (+) strand; PAM type: YTN; PAM sequence: TTA
agaactagtaagaaaacttt

SEQ ID NO: 106398 - DNA, 20 bp, Artificial Sequence
  Description of Artificial Sequence: Synthetic oligonucleotide
  Target: SCN9A; (+) strand; PAM type: YTN; PAM sequence: CTA
gtaagaaaactttaccagat

SEQ ID NO: 106399 - DNA, 20 bp, Artificial Sequence
  Description of Artificial Sequence: Synthetic oligonucleotide
  Target: SCN9A; (+) strand; PAM type: YTN; PAM sequence: CTT
taccagatgaatcttcagga

SEQ ID NO: 106400 - DNA, 20 bp, Artificial Sequence
  Description of Artificial Sequence: Synthetic oligonucleotide
  Target: SCN9A; (+) strand; PAM type: YTN; PAM sequence: TTT
accagatgaatcttcaggaa

SEQ ID NO: 106401 - DNA, 20 bp, Artificial Sequence
  Description of Artificial Sequence: Synthetic oligonucleotide
  Target: SCN9A; (+) strand; PAM type: YTN; PAM sequence: TTA
ccagatgaatcttcaggaag

SEQ ID NO: 106402 - DNA, 20 bp, Artificial Sequence
  Description of Artificial Sequence: Synthetic oligonucleotide
  Target: SCN9A; (+) strand; PAM type: YTN; PAM sequence: CTT
caggaagctgttgtgtaaag

SEQ ID NO: 106403 - DNA, 20 bp, Artificial Sequence
  Description of Artificial Sequence: Synthetic oligonucleotide
  Target: SCN9A; (+) strand; PAM type: YTN; PAM sequence: TTC
aggaagctgttgtgtaaagt

SEQ ID NO: 106404 - DNA, 20 bp, Artificial Sequence
  Description of Artificial Sequence: Synthetic oligonucleotide
  Target: SCN9A; (+) strand; PAM type: YTN; PAM sequence: CTG
ttgtgtaaagtcacgcacaa

SEQ ID NO: 106405 - DNA, 20 bp, Artificial Sequence
  Description of Artificial Sequence: Synthetic oligonucleotide
  Target: SCN9A; (+) strand; PAM type: YTN; PAM sequence: TTG
tgtaaagtcacgcacaaaaa

SEQ ID NO: 106406 - DNA, 20 bp, Artificial Sequence
  Description of Artificial Sequence: Synthetic oligonucleotide
  Target: SCN9A; (+) strand; PAM type: YTN; PAM sequence: CTA
tccatcactacatgcaatgt

SEQ ID NO: 106407 - DNA, 20 bp, Artificial Sequence
  Description of Artificial Sequence: Synthetic oligonucleotide
  Target: SCN9A; (+) strand; PAM type: YTN; PAM sequence: CTA
catgcaatgttaagaagaac

SEQ ID NO: 106408 - DNA, 20 bp, Artificial Sequence
  Description of Artificial Sequence: Synthetic oligonucleotide
  Target: SCN9A; (+) strand; PAM type: YTN; PAM sequence: TTA
agaagaacttatgacaatag

SEQ ID NO: 106409 - DNA, 20 bp, Artificial Sequence
  Description of Artificial Sequence: Synthetic oligonucleotide
  Target: SCN9A; (+) strand; PAM type: YTN; PAM sequence: CTT
atgacaatagaaatatgaaa

SEQ ID NO: 106410 - DNA, 20 bp, Artificial Sequence
  Description of Artificial Sequence: Synthetic oligonucleotide
  Target: SCN9A; (+) strand; PAM type: YTN; PAM sequence: TTA
tgacaatagaaatatgaaat

SEQ ID NO: 106411 - DNA, 20 bp, Artificial Sequence
  Description of Artificial Sequence: Synthetic oligonucleotide
  Target: SCN9A; (+) strand; PAM type: YTN; PAM sequence: TTT
tcattcatttcatactaatt

SEQ ID NO: 106412 - DNA, 20 bp, Artificial Sequence
  Description of Artificial Sequence: Synthetic oligonucleotide
  Target: SCN9A; (+) strand; PAM type: YTN; PAM sequence: TTT
cattcatttcatactaattg

SEQ ID NO: 106413 - DNA, 20 bp, Artificial Sequence
  Description of Artificial Sequence: Synthetic oligonucleotide
  Target: SCN9A; (+) strand; PAM type: YTN; PAM sequence: TTC
attcatttcatactaattgt

SEQ ID NO: 106414 - DNA, 20 bp, Artificial Sequence
  Description of Artificial Sequence: Synthetic oligonucleotide
  Target: SCN9A; (+) strand; PAM type: YTN; PAM sequence: TTC
atttcatactaattgttaat

SEQ ID NO: 106415 - DNA, 20 bp, Artificial Sequence
  Description of Artificial Sequence: Synthetic oligonucleotide
  Target: SCN9A; (+) strand; PAM type: YTN; PAM sequence: TTT
catactaattgttaatatga

SEQ ID NO: 106416 - DNA, 20 bp, Artificial Sequence
  Description of Artificial Sequence: Synthetic oligonucleotide
  Target: SCN9A; (+) strand; PAM type: YTN; PAM sequence: TTC
atactaattgttaatatgaa

SEQ ID NO: 106417 - DNA, 20 bp, Artificial Sequence
  Description of Artificial Sequence: Synthetic oligonucleotide
  Target: SCN9A; (+) strand; PAM type: YTN; PAM sequence: CTA
attgttaatatgaaacacaa

SEQ ID NO: 106418 - DNA, 20 bp, Artificial Sequence
  Description of Artificial Sequence: Synthetic oligonucleotide
  Target: SCN9A; (+) strand; PAM type: YTN; PAM sequence: TTG
ttaatatgaaacacaaagta

SEQ ID NO: 106419 - DNA, 20 bp, Artificial Sequence
  Description of Artificial Sequence: Synthetic oligonucleotide
  Target: SCN9A; (+) strand; PAM type: YTN; PAM sequence: TTA
atatgaaacacaaagtatat

SEQ ID NO: 106420 - DNA, 20 bp, Artificial Sequence
  Description of Artificial Sequence: Synthetic oligonucleotide
  Target: SCN9A; (+) strand; PAM type: YTN; PAM sequence: TTC
ttaccactttgctgtattca

SEQ ID NO: 106421 - DNA, 20 bp, Artificial Sequence
  Description of Artificial Sequence: Synthetic oligonucleotide
  Target: SCN9A; (+) strand; PAM type: YTN; PAM sequence: CTT
accactttgctgtattcact

SEQ ID NO: 106422 - DNA, 20 bp, Artificial Sequence
  Description of Artificial Sequence: Synthetic oligonucleotide
  Target: SCN9A; (+) strand; PAM type: YTN; PAM sequence: TTA
ccactttgctgtattcacta

SEQ ID NO: 106423 - DNA, 20 bp, Artificial Sequence
  Description of Artificial Sequence: Synthetic oligonucleotide
  Target: SCN9A; (+) strand; PAM type: YTN; PAM sequence: CTT
tgctgtattcactatccgaa

SEQ ID NO: 106424 - DNA, 20 bp, Artificial Sequence
  Description of Artificial Sequence: Synthetic oligonucleotide
  Target: SCN9A; (+) strand; PAM type: YTN; PAM sequence: TTT
gctgtattcactatccgaat

SEQ ID NO: 106425 - DNA, 20 bp, Artificial Sequence
  Description of Artificial Sequence: Synthetic oligonucleotide
  Target: SCN9A; (+) strand; PAM type: YTN; PAM sequence: TTG
ctgtattcactatccgaatc

SEQ ID NO: 106426 - DNA, 20 bp, Artificial Sequence
  Description of Artificial Sequence: Synthetic oligonucleotide
  Target: SCN9A; (+) strand; PAM type: YTN; PAM sequence: CTG
tattcactatccgaatcact

SEQ ID NO: 106427 - DNA, 20 bp, Artificial Sequence
  Description of Artificial Sequence: Synthetic oligonucleotide
  Target: SCN9A; (+) strand; PAM type: YTN; PAM sequence: TTC
actatccgaatcactgctaa

SEQ ID NO: 106428 - DNA, 20 bp, Artificial Sequence
  Description of Artificial Sequence: Synthetic oligonucleotide
  Target: SCN9A; (+) strand; PAM type: YTN; PAM sequence: CTA
tccgaatcactgctaagttc

SEQ ID NO: 106429 - DNA, 20 bp, Artificial Sequence
  Description of Artificial Sequence: Synthetic oligonucleotide
  Target: SCN9A; (+) strand; PAM type: YTN; PAM sequence: CTG
ctaagttcctcagcattcat

SEQ ID NO: 106430 - DNA, 20 bp, Artificial Sequence
  Description of Artificial Sequence: Synthetic oligonucleotide
  Target: SCN9A; (+) strand; PAM type: YTN; PAM sequence: CTA
agttcctcagcattcatatt

SEQ ID NO: 106431 - DNA, 20 bp, Artificial Sequence
  Description of Artificial Sequence: Synthetic oligonucleotide
  Target: SCN9A; (+) strand; PAM type: YTN; PAM sequence: TTC
ctcagcattcatattttcca

SEQ ID NO: 106432 - DNA, 20 bp, Artificial Sequence
  Description of Artificial Sequence: Synthetic oligonucleotide
  Target: SCN9A; (+) strand; PAM type: YTN; PAM sequence: CTC
agcattcatattttccaaat

SEQ ID NO: 106433 - DNA, 20 bp, Artificial Sequence
  Description of Artificial Sequence: Synthetic oligonucleotide
  Target: SCN9A; (+) strand; PAM type: YTN; PAM sequence: TTC
atattttccaaatcggattc

SEQ ID NO: 106434 - DNA, 20 bp, Artificial Sequence
  Description of Artificial Sequence: Synthetic oligonucleotide
  Target: SCN9A; (+) strand; PAM type: YTN; PAM sequence: TTT
tccaaatcggattccccagg

SEQ ID NO: 106435 - DNA, 20 bp, Artificial Sequence
  Description of Artificial Sequence: Synthetic oligonucleotide
  Target: SCN9A; (+) strand; PAM type: YTN; PAM sequence: TTT
ccaaatcggattccccaggt

SEQ ID NO: 106436 - DNA, 20 bp, Artificial Sequence
  Description of Artificial Sequence: Synthetic oligonucleotide
  Target: SCN9A; (+) strand; PAM type: YTN; PAM sequence: TTC
caaatcggattccccaggtg

SEQ ID NO: 106437 - DNA, 20 bp, Artificial Sequence
  Description of Artificial Sequence: Synthetic oligonucleotide
  Target: SCN9A; (+) strand; PAM type: YTN; PAM sequence: TTC
cccaggtgcaattggcactg

SEQ ID NO: 106438 - DNA, 20 bp, Artificial Sequence
  Description of Artificial Sequence: Synthetic oligonucleotide
  Target: SCN9A; (+) strand; PAM type: YTN; PAM sequence: TTG
gcactgtcactgtgaggctg

SEQ ID NO: 106439 - DNA, 20 bp, Artificial Sequence
  Description of Artificial Sequence: Synthetic oligonucleotide
  Target: SCN9A; (+) strand; PAM type: YTN; PAM sequence: CTG
tcactgtgaggctgggattg

SEQ ID NO: 106440 - DNA, 20 bp, Artificial Sequence
  Description of Artificial Sequence: Synthetic oligonucleotide
  Target: SCN9A; (+) strand; PAM type: YTN; PAM sequence: CTG
tgaggctgggattgtgaata

SEQ ID NO: 106441 - DNA, 20 bp, Artificial Sequence
  Description of Artificial Sequence: Synthetic oligonucleotide
  Target: SCN9A; (+) strand; PAM type: YTN; PAM sequence: CTG
ggattgtgaataaatgattg

SEQ ID NO: 106442 - DNA, 20 bp, Artificial Sequence
  Description of Artificial Sequence: Synthetic oligonucleotide
  Target: SCN9A; (+) strand; PAM type: YTN; PAM sequence: TTG
tgaataaatgattgaccatc

SEQ ID NO: 106443 - DNA, 20 bp, Artificial Sequence
  Description of Artificial Sequence: Synthetic oligonucleotide
  Target: SCN9A; (+) strand; PAM type: YTN; PAM sequence: TTG
accatcactgtcttccatca

SEQ ID NO: 106444 - DNA, 20 bp, Artificial Sequence
  Description of Artificial Sequence: Synthetic oligonucleotide
  Target: SCN9A; (+) strand; PAM type: YTN; PAM sequence: CTG
tcttccatcaagtgtttgtc

SEQ ID NO: 106445 - DNA, 20 bp, Artificial Sequence
  Description of Artificial Sequence: Synthetic oligonucleotide
  Target: SCN9A; (+) strand; PAM type: YTN; PAM sequence: CTT
ccatcaagtgtttgtccacg

SEQ ID NO: 106446 - DNA, 20 bp, Artificial Sequence
  Description of Artificial Sequence: Synthetic oligonucleotide
  Target: SCN9A; (+) strand; PAM type: YTN; PAM sequence: TTC
catcaagtgtttgtccacgc

SEQ ID NO: 106447 - DNA, 20 bp, Artificial Sequence
  Description of Artificial Sequence: Synthetic oligonucleotide
  Target: SCN9A; (+) strand; PAM type: YTN; PAM sequence: TTT
gtccacgctgcttccaaaac

SEQ ID NO: 106448 - DNA, 20 bp, Artificial Sequence
  Description of Artificial Sequence: Synthetic oligonucleotide
  Target: SCN9A; (+) strand; PAM type: YTN; PAM sequence: TTG
tccacgctgcttccaaaacc

SEQ ID NO: 106449 - DNA, 20 bp, Artificial Sequence
  Description of Artificial Sequence: Synthetic oligonucleotide
  Target: SCN9A; (+) strand; PAM type: YTN; PAM sequence: CTG
cttccaaaaccactgatttt

SEQ ID NO: 106450 - DNA, 20 bp, Artificial Sequence
  Description of Artificial Sequence: Synthetic oligonucleotide
  Target: SCN9A; (+) strand; PAM type: YTN; PAM sequence: CTT
ccaaaaccactgattttatc

SEQ ID NO: 106451 - DNA, 20 bp, Artificial Sequence
  Description of Artificial Sequence: Synthetic oligonucleotide
  Target: SCN9A; (+) strand; PAM type: YTN; PAM sequence: TTC
caaaaccactgattttatct

SEQ ID NO: 106452 - DNA, 20 bp, Artificial Sequence
  Description of Artificial Sequence: Synthetic oligonucleotide
  Target: SCN9A; (+) strand; PAM type: YTN; PAM sequence: CTG
attttatctttttccttgag

SEQ ID NO: 106453 - DNA, 20 bp, Artificial Sequence
  Description of Artificial Sequence: Synthetic oligonucleotide
  Target: SCN9A; (+) strand; PAM type: YTN; PAM sequence: TTT
tatctttttccttgaggaaa

SEQ ID NO: 106454 - DNA, 20 bp, Artificial Sequence
  Description of Artificial Sequence: Synthetic oligonucleotide
  Target: SCN9A; (+) strand; PAM type: YTN; PAM sequence: TTT
atctttttccttgaggaaat

SEQ ID NO: 106455 - DNA, 20 bp, Artificial Sequence
  Description of Artificial Sequence: Synthetic oligonucleotide
  Target: SCN9A; (+) strand; PAM type: YTN; PAM sequence: TTA
tctttttccttgaggaaatt

SEQ ID NO: 106456 - DNA, 20 bp, Artificial Sequence
  Description of Artificial Sequence: Synthetic oligonucleotide
  Target: SCN9A; (+) strand; PAM type: YTN; PAM sequence: CTT
tttccttgaggaaattgtga

SEQ ID NO: 106457 - DNA, 20 bp, Artificial Sequence
  Description of Artificial Sequence: Synthetic oligonucleotide
  Target: SCN9A; (+) strand; PAM type: YTN; PAM sequence: TTT
ttccttgaggaaattgtgac

SEQ ID NO: 106458 - DNA, 20 bp, Artificial Sequence
  Description of Artificial Sequence: Synthetic oligonucleotide
  Target: SCN9A; (+) strand; PAM type: YTN; PAM sequence: TTT
tccttgaggaaattgtgacc

SEQ ID NO: 106459 - DNA, 20 bp, Artificial Sequence
  Description of Artificial Sequence: Synthetic oligonucleotide
  Target: SCN9A; (+) strand; PAM type: YTN; PAM sequence: TTT
ccttgaggaaattgtgacct

SEQ ID NO: 106460 - DNA, 20 bp, Artificial Sequence
  Description of Artificial Sequence: Synthetic oligonucleotide
  Target: SCN9A; (+) strand; PAM type: YTN; PAM sequence: TTC
cttgaggaaattgtgacctt

SEQ ID NO: 106461 - DNA, 20 bp, Artificial Sequence
  Description of Artificial Sequence: Synthetic oligonucleotide
  Target: SCN9A; (+) strand; PAM type: YTN; PAM sequence: CTT
gaggaaattgtgacctttgc

SEQ ID NO: 106462 - DNA, 20 bp, Artificial Sequence
  Description of Artificial Sequence: Synthetic oligonucleotide
  Target: SCN9A; (+) strand; PAM type: YTN; PAM sequence: TTG
aggaaattgtgacctttgct

SEQ ID NO: 106463 - DNA, 20 bp, Artificial Sequence
  Description of Artificial Sequence: Synthetic oligonucleotide
  Target: SCN9A; (+) strand; PAM type: YTN; PAM sequence: TTG
tgacctttgctcatttcagc

SEQ ID NO: 106464 - DNA, 20 bp, Artificial Sequence
  Description of Artificial Sequence: Synthetic oligonucleotide
  Target: SCN9A; (+) strand; PAM type: YTN; PAM sequence: CTT
tgctcatttcagcaagtgta

SEQ ID NO: 106465 - DNA, 20 bp, Artificial Sequence
  Description of Artificial Sequence: Synthetic oligonucleotide
  Target: SCN9A; (+) strand; PAM type: YTN; PAM sequence: TTT
gctcatttcagcaagtgtat

SEQ ID NO: 106466 - DNA, 20 bp, Artificial Sequence
  Description of Artificial Sequence: Synthetic oligonucleotide
  Target: SCN9A; (+) strand; PAM type: YTN; PAM sequence: TTG
ctcatttcagcaagtgtatg

SEQ ID NO: 106467 - DNA, 20 bp, Artificial Sequence
  Description of Artificial Sequence: Synthetic oligonucleotide
  Target: SCN9A; (+) strand; PAM type: YTN; PAM sequence: CTC
atttcagcaagtgtatggtt

SEQ ID NO: 106468 - DNA, 20 bp, Artificial Sequence
  Description of Artificial Sequence: Synthetic oligonucleotide
  Target: SCN9A; (+) strand; PAM type: YTN; PAM sequence: TTT
cagcaagtgtatggttagaa

SEQ ID NO: 106469 - DNA, 20 bp, Artificial Sequence
  Description of Artificial Sequence: Synthetic oligonucleotide
  Target: SCN9A; (+) strand; PAM type: YTN; PAM sequence: TTC
agcaagtgtatggttagaaa

SEQ ID NO: 106470 - DNA, 20 bp, Artificial Sequence
  Description of Artificial Sequence: Synthetic oligonucleotide
  Target: SCN9A; (+) strand; PAM type: YTN; PAM sequence: TTA
gaaatatagttttccttctt

SEQ ID NO: 106471 - DNA, 20 bp, Artificial Sequence
  Description of Artificial Sequence: Synthetic oligonucleotide
  Target: SCN9A; (+) strand; PAM type: YTN; PAM sequence: TTT
tccttcttagtattcagatc

SEQ ID NO: 106472 - DNA, 20 bp, Artificial Sequence
  Description of Artificial Sequence: Synthetic oligonucleotide
  Target: SCN9A; (+) strand; PAM type: YTN; PAM sequence: TTT
ccttcttagtattcagatct

SEQ ID NO: 106473 - DNA, 20 bp, Artificial Sequence
  Description of Artificial Sequence: Synthetic oligonucleotide
  Target: SCN9A; (+) strand; PAM type: YTN; PAM sequence: TTC
cttcttagtattcagatctt

SEQ ID NO: 106474 - DNA, 20 bp, Artificial Sequence
  Description of Artificial Sequence: Synthetic oligonucleotide
  Target: SCN9A; (+) strand; PAM type: YTN; PAM sequence: CTT
cttagtattcagatcttctg

SEQ ID NO: 106475 - DNA, 20 bp, Artificial Sequence
  Description of Artificial Sequence: Synthetic oligonucleotide
  Target: SCN9A; (+) strand; PAM type: YTN; PAM sequence: TTC
ttagtattcagatcttctgc

SEQ ID NO: 106476 - DNA, 20 bp, Artificial Sequence
  Description of Artificial Sequence: Synthetic oligonucleotide
  Target: SCN9A; (+) strand; PAM type: YTN; PAM sequence: CTT
agtattcagatcttctgctt

SEQ ID NO: 106477 - DNA, 20 bp, Artificial Sequence
  Description of Artificial Sequence: Synthetic oligonucleotide
  Target: SCN9A; (+) strand; PAM type: YTN; PAM sequence: TTA
gtattcagatcttctgcttg

SEQ ID NO: 106478 - DNA, 20 bp, Artificial Sequence
  Description of Artificial Sequence: Synthetic oligonucleotide
  Target: SCN9A; (+) strand; PAM type: YTN; PAM sequence: TTC
agatcttctgcttgtcttat

SEQ ID NO: 106479 - DNA, 20 bp, Artificial Sequence
  Description of Artificial Sequence: Synthetic oligonucleotide
  Target: SCN9A; (+) strand; PAM type: YTN; PAM sequence: CTT
ctgcttgtcttatctccctg

SEQ ID NO: 106480 - DNA, 20 bp, Artificial Sequence
  Description of Artificial Sequence: Synthetic oligonucleotide
  Target: SCN9A; (+) strand; PAM type: YTN; PAM sequence: TTC
tgcttgtcttatctccctgg

SEQ ID NO: 106481 - DNA, 20 bp, Artificial Sequence
  Description of Artificial Sequence: Synthetic oligonucleotide
  Target: SCN9A; (+) strand; PAM type: YTN; PAM sequence: CTG
cttgtcttatctccctggaa

SEQ ID NO: 106482 - DNA, 20 bp, Artificial Sequence
  Description of Artificial Sequence: Synthetic oligonucleotide
  Target: SCN9A; (+) strand; PAM type: YTN; PAM sequence: CTT
gtcttatctccctggaaatc

SEQ ID NO: 106483 - DNA, 20 bp, Artificial Sequence
  Description of Artificial Sequence: Synthetic oligonucleotide
  Target: SCN9A; (+) strand; PAM type: YTN; PAM sequence: TTG
tcttatctccctggaaatct

SEQ ID NO: 106484 - DNA, 20 bp, Artificial Sequence
  Description of Artificial Sequence: Synthetic oligonucleotide
  Target: SCN9A; (+) strand; PAM type: YTN; PAM sequence: CTT
atctccctggaaatctttgg

SEQ ID NO: 106485 - DNA, 20 bp, Artificial Sequence
  Description of Artificial Sequence: Synthetic oligonucleotide
  Target: SCN9A; (+) strand; PAM type: YTN; PAM sequence: TTA
tctccctggaaatctttggc

SEQ ID NO: 106486 - DNA, 20 bp, Artificial Sequence
  Description of Artificial Sequence: Synthetic oligonucleotide
  Target: SCN9A; (+) strand; PAM type: YTN; PAM sequence: CTC
cctggaaatctttggctttt

SEQ ID NO: 106487 - DNA, 20 bp, Artificial Sequence
  Description of Artificial Sequence: Synthetic oligonucleotide
  Target: SCN9A; (+) strand; PAM type: YTN; PAM sequence: CTG
gaaatctttggctttttgga

SEQ ID NO: 106488 - DNA, 20 bp, Artificial Sequence
  Description of Artificial Sequence: Synthetic oligonucleotide
  Target: SCN9A; (+) strand; PAM type: YTN; PAM sequence: CTT
tggctttttggaaaatgctt

SEQ ID NO: 106489 - DNA, 20 bp, Artificial Sequence
  Description of Artificial Sequence: Synthetic oligonucleotide
  Target: SCN9A; (+) strand; PAM type: YTN; PAM sequence: TTT
ggctttttggaaaatgcttt

SEQ ID NO: 106490 - DNA, 20 bp, Artificial Sequence
  Description of Artificial Sequence: Synthetic oligonucleotide
  Target: SCN9A; (+) strand; PAM type: YTN; PAM sequence: TTG
gctttttggaaaatgctttt

SEQ ID NO: 106491 - DNA, 20 bp, Artificial Sequence
  Description of Artificial Sequence: Synthetic oligonucleotide
  Target: SCN9A; (+) strand; PAM type: YTN; PAM sequence: CTT
tttggaaaatgcttttagaa

SEQ ID NO: 106492 - DNA, 20 bp, Artificial Sequence
  Description of Artificial Sequence: Synthetic oligonucleotide
  Target: SCN9A; (+) strand; PAM type: YTN; PAM sequence: TTT
ttggaaaatgcttttagaat

SEQ ID NO: 106493 - DNA, 20 bp, Artificial Sequence
  Description of Artificial Sequence: Synthetic oligonucleotide
  Target: SCN9A; (+) strand; PAM type: YTN; PAM sequence: TTT
tggaaaatgcttttagaata

SEQ ID NO: 106494 - DNA, 20 bp, Artificial Sequence
  Description of Artificial Sequence: Synthetic oligonucleotide
  Target: SCN9A; (+) strand; PAM type: YTN; PAM sequence: TTT
ggaaaatgcttttagaataa

SEQ ID NO: 106495 - DNA, 20 bp, Artificial Sequence
  Description of Artificial Sequence: Synthetic oligonucleotide
  Target: SCN9A; (+) strand; PAM type: YTN; PAM sequence: TTG
gaaaatgcttttagaataaa

SEQ ID NO: 106496 - DNA, 20 bp, Artificial Sequence
  Description of Artificial Sequence: Synthetic oligonucleotide
  Target: SCN9A; (+) strand; PAM type: YTN; PAM sequence: CTT
ttagaataaattcacgtaag

SEQ ID NO: 106497 - DNA, 20 bp, Artificial Sequence
  Description of Artificial Sequence: Synthetic oligonucleotide
  Target: SCN9A; (+) strand; PAM type: YTN; PAM sequence: TTT
tagaataaattcacgtaagg

SEQ ID NO: 106498 - DNA, 20 bp, Artificial Sequence
  Description of Artificial Sequence: Synthetic oligonucleotide
  Target: SCN9A; (+) strand; PAM type: YTN; PAM sequence: TTT
agaataaattcacgtaaggt

SEQ ID NO: 106499 - DNA, 20 bp, Artificial Sequence
  Description of Artificial Sequence: Synthetic oligonucleotide
  Target: SCN9A; (+) strand; PAM type: YTN; PAM sequence: TTA
gaataaattcacgtaaggtt

SEQ ID NO: 106500 - DNA, 20 bp, Artificial Sequence
  Description of Artificial Sequence: Synthetic oligonucleotide
  Target: SCN9A; (+) strand; PAM type: YTN; PAM sequence: TTC
acgtaaggtttgtttcacat

SEQ ID NO: 106501 - DNA, 20 bp, Artificial Sequence
  Description of Artificial Sequence: Synthetic oligonucleotide
  Target: SCN9A; (+) strand; PAM type: YTN; PAM sequence: TTT
gtttcacataatttattccc

SEQ ID NO: 106502 - DNA, 20 bp, Artificial Sequence
  Description of Artificial Sequence: Synthetic oligonucleotide
  Target: SCN9A; (+) strand; PAM type: YTN; PAM sequence: TTG
tttcacataatttattccct

SEQ ID NO: 106503 - DNA, 20 bp, Artificial Sequence
  Description of Artificial Sequence: Synthetic oligonucleotide
  Target: SCN9A; (+) strand; PAM type: YTN; PAM sequence: TTT
cacataatttattccctttt

SEQ ID NO: 106504 - DNA, 20 bp, Artificial Sequence
  Description of Artificial Sequence: Synthetic oligonucleotide
  Target: SCN9A; (+) strand; PAM type: YTN; PAM sequence: TTC
acataatttattcccttttt

SEQ ID NO: 106505 - DNA, 20 bp, Artificial Sequence
  Description of Artificial Sequence: Synthetic oligonucleotide
  Target: SCN9A; (+) strand; PAM type: YTN; PAM sequence: TTT
attccctttttaattctagt

SEQ ID NO: 106506 - DNA, 20 bp, Artificial Sequence
  Description of Artificial Sequence: Synthetic oligonucleotide
  Target: SCN9A; (+) strand; PAM type: YTN; PAM sequence: TTA
ttccctttttaattctagtc

SEQ ID NO: 106507 - DNA, 20 bp, Artificial Sequence
  Description of Artificial Sequence: Synthetic oligonucleotide
  Target: SCN9A; (+) strand; PAM type: YTN; PAM sequence: TTC
cctttttaattctagtcact

SEQ ID NO: 106508 - DNA, 20 bp, Artificial Sequence
  Description of Artificial Sequence: Synthetic oligonucleotide
  Target: SCN9A; (+) strand; PAM type: YTN; PAM sequence: CTT
tttaattctagtcactgcaa

SEQ ID NO: 106509 - DNA, 20 bp, Artificial Sequence
  Description of Artificial Sequence: Synthetic oligonucleotide
  Target: SCN9A; (+) strand; PAM type: YTN; PAM sequence: TTT
ttaattctagtcactgcaat

SEQ ID NO: 106510 - DNA, 20 bp, Artificial Sequence
  Description of Artificial Sequence: Synthetic oligonucleotide
  Target: SCN9A; (+) strand; PAM type: YTN; PAM sequence: TTT
taattctagtcactgcaatc

SEQ ID NO: 106511 - DNA, 20 bp, Artificial Sequence
  Description of Artificial Sequence: Synthetic oligonucleotide
  Target: SCN9A; (+) strand; PAM type: YTN; PAM sequence: TTT
aattctagtcactgcaatct

SEQ ID NO: 106512 - DNA, 20 bp, Artificial Sequence
  Description of Artificial Sequence: Synthetic oligonucleotide
  Target: SCN9A; (+) strand; PAM type: YTN; PAM sequence: TTA
attctagtcactgcaatctg

SEQ ID NO: 106513 - DNA, 20 bp, Artificial Sequence
  Description of Artificial Sequence: Synthetic oligonucleotide
  Target: SCN9A; (+) strand; PAM type: YTN; PAM sequence: TTC
tagtcactgcaatctggagg

SEQ ID NO: 106514 - DNA, 20 bp, Artificial Sequence
  Description of Artificial Sequence: Synthetic oligonucleotide
  Target: SCN9A; (+) strand; PAM type: YTN; PAM sequence: CTA
gtcactgcaatctggaggtt

SEQ ID NO: 106515 - DNA, 20 bp, Artificial Sequence
  Description of Artificial Sequence: Synthetic oligonucleotide
  Target: SCN9A; (+) strand; PAM type: YTN; PAM sequence: CTG
caatctggaggttgtttgca

SEQ ID NO: 106516 - DNA, 20 bp, Artificial Sequence
  Description of Artificial Sequence: Synthetic oligonucleotide
  Target: SCN9A; (+) strand; PAM type: YTN; PAM sequence: CTG
gaggttgtttgcatcagggt

SEQ ID NO: 106517 - DNA, 20 bp, Artificial Sequence
  Description of Artificial Sequence: Synthetic oligonucleotide
  Target: SCN9A; (+) strand; PAM type: YTN; PAM sequence: TTG
tttgcatcagggtcttcttc

SEQ ID NO: 106518 - DNA, 20 bp, Artificial Sequence
  Description of Artificial Sequence: Synthetic oligonucleotide
  Target: SCN9A; (+) strand; PAM type: YTN; PAM sequence: TTT
gcatcagggtcttcttcaat

SEQ ID NO: 106519 - DNA, 20 bp, Artificial Sequence
  Description of Artificial Sequence: Synthetic oligonucleotide
  Target: SCN9A; (+) strand; PAM type: YTN; PAM sequence: TTG
catcagggtcttcttcaatt

SEQ ID NO: 106520 - DNA, 20 bp, Artificial Sequence
  Description of Artificial Sequence: Synthetic oligonucleotide
  Target: SCN9A; (+) strand; PAM type: YTN; PAM sequence: CTT
cttcaattgctgtaagattg

SEQ ID NO: 106521 - DNA, 20 bp, Artificial Sequence
  Description of Artificial Sequence: Synthetic oligonucleotide
  Target: SCN9A; (+) strand; PAM type: YTN; PAM sequence: TTC
ttcaattgctgtaagattgt

SEQ ID NO: 106522 - DNA, 20 bp, Artificial Sequence
  Description of Artificial Sequence: Synthetic oligonucleotide
  Target: SCN9A; (+) strand; PAM type: YTN; PAM sequence: CTT
caattgctgtaagattgtct

SEQ ID NO: 106523 - DNA, 20 bp, Artificial Sequence
  Description of Artificial Sequence: Synthetic oligonucleotide
  Target: SCN9A; (+) strand; PAM type: YTN; PAM sequence: TTC
aattgctgtaagattgtctg

SEQ ID NO: 106524 - DNA, 20 bp, Artificial Sequence
  Description of Artificial Sequence: Synthetic oligonucleotide
  Target: SCN9A; (+) strand; PAM type: YTN; PAM sequence: TTG
ctgtaagattgtctgaacta

SEQ ID NO: 106525 - DNA, 20 bp, Artificial Sequence
  Description of Artificial Sequence: Synthetic oligonucleotide
  Target: SCN9A; (+) strand; PAM type: YTN; PAM sequence: CTG
taagattgtctgaactaaat

SEQ ID NO: 106526 - DNA, 20 bp, Artificial Sequence
  Description of Artificial Sequence: Synthetic oligonucleotide
  Target: SCN9A; (+) strand; PAM type: YTN; PAM sequence: TTG
tctgaactaaatgagctcaa

SEQ ID NO: 106527 - DNA, 20 bp, Artificial Sequence
  Description of Artificial Sequence: Synthetic oligonucleotide
  Target: SCN9A; (+) strand; PAM type: YTN; PAM sequence: CTG
aactaaatgagctcaataat

SEQ ID NO: 106528 - DNA, 20 bp, Artificial Sequence
  Description of Artificial Sequence: Synthetic oligonucleotide
  Target: SCN9A; (+) strand; PAM type: YTN; PAM sequence: CTA
aatgagctcaataataaggc

SEQ ID NO: 106529 - DNA, 20 bp, Artificial Sequence
  Description of Artificial Sequence: Synthetic oligonucleotide
  Target: SCN9A; (+) strand; PAM type: YTN; PAM sequence: CTC
aataataaggccagaaatag

SEQ ID NO: 106530 - DNA, 20 bp, Artificial Sequence
  Description of Artificial Sequence: Synthetic oligonucleotide
  Target: SCN9A; (+) strand; PAM type: YTN; PAM sequence: TTT
aggacctatatcagggtggg

SEQ ID NO: 106531 - DNA, 20 bp, Artificial Sequence
  Description of Artificial Sequence: Synthetic oligonucleotide
  Target: SCN9A; (+) strand; PAM type: YTN; PAM sequence: TTA
ggacctatatcagggtgggg

SEQ ID NO: 106532 - DNA, 20 bp, Artificial Sequence
  Description of Artificial Sequence: Synthetic oligonucleotide
  Target: SCN9A; (+) strand; PAM type: YTN; PAM sequence: CTA
tatcagggtggggagagggg

SEQ ID NO: 106533 - DNA, 20 bp, Artificial Sequence
  Description of Artificial Sequence: Synthetic oligonucleotide
  Target: SCN9A; (+) strand; PAM type: YTN; PAM sequence: CTT
ttccgaatataggccacaat

SEQ ID NO: 106534 - DNA, 20 bp, Artificial Sequence
  Description of Artificial Sequence: Synthetic oligonucleotide
  Target: SCN9A; (+) strand; PAM type: YTN; PAM sequence: TTT
tccgaatataggccacaata

SEQ ID NO: 106535 - DNA, 20 bp, Artificial Sequence
  Description of Artificial Sequence: Synthetic oligonucleotide
  Target: SCN9A; (+) strand; PAM type: YTN; PAM sequence: TTT
ccgaatataggccacaatac

SEQ ID NO: 106536 - DNA, 20 bp, Artificial Sequence
  Description of Artificial Sequence: Synthetic oligonucleotide
  Target: SCN9A; (+) strand; PAM type: YTN; PAM sequence: TTC
cgaatataggccacaataca

SEQ ID NO: 106537 - DNA, 20 bp, Artificial Sequence
  Description of Artificial Sequence: Synthetic oligonucleotide
  Target: SCN9A; (+) strand; PAM type: YTN; PAM sequence: TTT
ctgcaccttttcacacacgg

SEQ ID NO: 106538 - DNA, 20 bp, Artificial Sequence
  Description of Artificial Sequence: Synthetic oligonucleotide
  Target: SCN9A; (+) strand; PAM type: YTN; PAM sequence: TTC
tgcaccttttcacacacgga

SEQ ID NO: 106539 - DNA, 20 bp, Artificial Sequence
  Description of Artificial Sequence: Synthetic oligonucleotide
  Target: SCN9A; (+) strand; PAM type: YTN; PAM sequence: CTG
caccttttcacacacggata

SEQ ID NO: 106540 - DNA, 20 bp, Artificial Sequence
  Description of Artificial Sequence: Synthetic oligonucleotide
  Target: SCN9A; (+) strand; PAM type: YTN; PAM sequence: CTT
ttcacacacggataagacca

SEQ ID NO: 106541 - DNA, 20 bp, Artificial Sequence
  Description of Artificial Sequence: Synthetic oligonucleotide
  Target: SCN9A; (+) strand; PAM type: YTN; PAM sequence: TTT
tcacacacggataagaccac

SEQ ID NO: 106542 - DNA, 20 bp, Artificial Sequence
  Description of Artificial Sequence: Synthetic oligonucleotide
  Target: SCN9A; (+) strand; PAM type: YTN; PAM sequence: TTT
cacacacggataagaccaca

SEQ ID NO: 106543 - DNA, 20 bp, Artificial Sequence
  Description of Artificial Sequence: Synthetic oligonucleotide
  Target: SCN9A; (+) strand; PAM type: YTN; PAM sequence: TTC
acacacggataagaccacat

SEQ ID NO: 106544 - DNA, 20 bp, Artificial Sequence
  Description of Artificial Sequence: Synthetic oligonucleotide
  Target: SCN9A; (+) strand; PAM type: YTN; PAM sequence: CTC
ctcatcactgtatccctaga

SEQ ID NO: 106545 - DNA, 20 bp, Artificial Sequence
  Description of Artificial Sequence: Synthetic oligonucleotide
  Target: SCN9A; (+) strand; PAM type: YTN; PAM sequence: CTC
atcactgtatccctagacta

SEQ ID NO: 106546 - DNA, 20 bp, Artificial Sequence
  Description of Artificial Sequence: Synthetic oligonucleotide
  Target: SCN9A; (+) strand; PAM type: YTN; PAM sequence: CTG
tatccctagactagcccctg

SEQ ID NO: 106547 - DNA, 20 bp, Artificial Sequence
  Description of Artificial Sequence: Synthetic oligonucleotide
  Target: SCN9A; (+) strand; PAM type: YTN; PAM sequence: CTA
gactagcccctgcagactca

SEQ ID NO: 106548 - DNA, 20 bp, Artificial Sequence
  Description of Artificial Sequence: Synthetic oligonucleotide
  Target: SCN9A; (+) strand; PAM type: YTN; PAM sequence: CTA
gcccctgcagactcagcagc

SEQ ID NO: 106549 - DNA, 20 bp, Artificial Sequence
  Description of Artificial Sequence: Synthetic oligonucleotide
  Target: SCN9A; (+) strand; PAM type: YTN; PAM sequence: CTG
cagactcagcagcagagggt

SEQ ID NO: 106550 - DNA, 20 bp, Artificial Sequence
  Description of Artificial Sequence: Synthetic oligonucleotide
  Target: SCN9A; (+) strand; PAM type: YTN; PAM sequence: CTC
agcagcagagggtcagccat

SEQ ID NO: 106551 - DNA, 20 bp, Artificial Sequence
  Description of Artificial Sequence: Synthetic oligonucleotide
  Target: SCN9A; (+) strand; PAM type: YTN; PAM sequence: TTA
ccatggggagcagagagaat

SEQ ID NO: 106552 - DNA, 20 bp, Artificial Sequence
  Description of Artificial Sequence: Synthetic oligonucleotide
  Target: SCN9A; (+) strand; PAM type: YTN; PAM sequence: CTC
accattatcattacatcatt

SEQ ID NO: 106553 - DNA, 20 bp, Artificial Sequence
  Description of Artificial Sequence: Synthetic oligonucleotide
  Target: SCN9A; (+) strand; PAM type: YTN; PAM sequence: TTA
tcattacatcatttctaagt

SEQ ID NO: 106554 - DNA, 20 bp, Artificial Sequence
  Description of Artificial Sequence: Synthetic oligonucleotide
  Target: SCN9A; (+) strand; PAM type: YTN; PAM sequence: TTA
catcatttctaagttcattt

SEQ ID NO: 106555 - DNA, 20 bp, Artificial Sequence
  Description of Artificial Sequence: Synthetic oligonucleotide
  Target: SCN9A; (+) strand; PAM type: YTN; PAM sequence: TTT
ctaagttcatttctgtagca

SEQ ID NO: 106556 - DNA, 20 bp, Artificial Sequence
  Description of Artificial Sequence: Synthetic oligonucleotide
  Target: SCN9A; (+) strand; PAM type: YTN; PAM sequence: TTC
taagttcatttctgtagcag

SEQ ID NO: 106557 - DNA, 20 bp, Artificial Sequence
  Description of Artificial Sequence: Synthetic oligonucleotide
  Target: SCN9A; (+) strand; PAM type: YTN; PAM sequence: CTA
agttcatttctgtagcagta

SEQ ID NO: 106558 - DNA, 20 bp, Artificial Sequence
  Description of Artificial Sequence: Synthetic oligonucleotide
  Target: SCN9A; (+) strand; PAM type: YTN; PAM sequence: TTC
atttctgtagcagtagtgcc

SEQ ID NO: 106559 - DNA, 20 bp, Artificial Sequence
  Description of Artificial Sequence: Synthetic oligonucleotide
  Target: SCN9A; (+) strand; PAM type: YTN; PAM sequence: TTT
ctgtagcagtagtgccttaa

SEQ ID NO: 106560 - DNA, 20 bp, Artificial Sequence
  Description of Artificial Sequence: Synthetic oligonucleotide
  Target: SCN9A; (+) strand; PAM type: YTN; PAM sequence: TTC
tgtagcagtagtgccttaat

SEQ ID NO: 106561 - DNA, 20 bp, Artificial Sequence
  Description of Artificial Sequence: Synthetic oligonucleotide
  Target: SCN9A; (+) strand; PAM type: YTN; PAM sequence: CTG
tagcagtagtgccttaatca

SEQ ID NO: 106562 - DNA, 20 bp, Artificial Sequence
  Description of Artificial Sequence: Synthetic oligonucleotide
  Target: SCN9A; (+) strand; PAM type: YTN; PAM sequence: CTT
aatcaagttctcttttatga

SEQ ID NO: 106563 - DNA, 20 bp, Artificial Sequence
  Description of Artificial Sequence: Synthetic oligonucleotide
  Target: SCN9A; (+) strand; PAM type: YTN; PAM sequence: TTA
atcaagttctcttttatgaa

SEQ ID NO: 106564 - DNA, 20 bp, Artificial Sequence
  Description of Artificial Sequence: Synthetic oligonucleotide
  Target: SCN9A; (+) strand; PAM type: YTN; PAM sequence: TTC
tcttttatgaacccaaaaaa

SEQ ID NO: 106565 - DNA, 20 bp, Artificial Sequence
  Description of Artificial Sequence: Synthetic oligonucleotide
  Target: SCN9A; (+) strand; PAM type: YTN; PAM sequence: CTC
ttttatgaacccaaaaaact

SEQ ID NO: 106566 - DNA, 20 bp, Artificial Sequence
  Description of Artificial Sequence: Synthetic oligonucleotide
  Target: SCN9A; (+) strand; PAM type: YTN; PAM sequence: CTT
ttatgaacccaaaaaactct

SEQ ID NO: 106567 - DNA, 20 bp, Artificial Sequence
  Description of Artificial Sequence: Synthetic oligonucleotide
  Target: SCN9A; (+) strand; PAM type: YTN; PAM sequence: TTT
tatgaacccaaaaaactctc

SEQ ID NO: 106568 - DNA, 20 bp, Artificial Sequence
  Description of Artificial Sequence: Synthetic oligonucleotide
  Target: SCN9A; (+) strand; PAM type: YTN; PAM sequence: TTT
atgaacccaaaaaactctcc

SEQ ID NO: 106569 - DNA, 20 bp, Artificial Sequence
  Description of Artificial Sequence: Synthetic oligonucleotide
  Target: SCN9A; (+) strand; PAM type: YTN; PAM sequence: TTA
tgaacccaaaaaactctcct

SEQ ID NO: 106570 - DNA, 20 bp, Artificial Sequence
  Description of Artificial Sequence: Synthetic oligonucleotide
  Target: SCN9A; (+) strand; PAM type: YTN; PAM sequence: CTC
tcctagcattcatctatcat

SEQ ID NO: 106571 - DNA, 20 bp, Artificial Sequence
  Description of Artificial Sequence: Synthetic oligonucleotide
  Target: SCN9A; (+) strand; PAM type: YTN; PAM sequence: CTC
ctagcattcatctatcatta

SEQ ID NO: 106572 - DNA, 20 bp, Artificial Sequence
  Description of Artificial Sequence: Synthetic oligonucleotide
  Target: SCN9A; (+) strand; PAM type: YTN; PAM sequence: CTA
gcattcatctatcattactc

SEQ ID NO: 106573 - DNA, 20 bp, Artificial Sequence
  Description of Artificial Sequence: Synthetic oligonucleotide
  Target: SCN9A; (+) strand; PAM type: YTN; PAM sequence: TTC
atctatcattactctttatt

SEQ ID NO: 106574 - DNA, 20 bp, Artificial Sequence
  Description of Artificial Sequence: Synthetic oligonucleotide
  Target: SCN9A; (+) strand; PAM type: YTN; PAM sequence: CTA
tcattactctttattacctg

SEQ ID NO: 106575 - DNA, 20 bp, Artificial Sequence
  Description of Artificial Sequence: Synthetic oligonucleotide
  Target: SCN9A; (+) strand; PAM type: YTN; PAM sequence: TTA
ctctttattacctgtgagaa

SEQ ID NO: 106576 - DNA, 20 bp, Artificial Sequence
  Description of Artificial Sequence: Synthetic oligonucleotide
  Target: SCN9A; (+) strand; PAM type: YTN; PAM sequence: CTC
tttattacctgtgagaaaca

SEQ ID NO: 106577 - DNA, 20 bp, Artificial Sequence
  Description of Artificial Sequence: Synthetic oligonucleotide
  Target: SCN9A; (+) strand; PAM type: YTN; PAM sequence: CTT
tattacctgtgagaaacagg

SEQ ID NO: 106578 - DNA, 20 bp, Artificial Sequence
  Description of Artificial Sequence: Synthetic oligonucleotide
  Target: SCN9A; (+) strand; PAM type: YTN; PAM sequence: TTT
attacctgtgagaaacaggt

SEQ ID NO: 106579 - DNA, 20 bp, Artificial Sequence
  Description of Artificial Sequence: Synthetic oligonucleotide
  Target: SCN9A; (+) strand; PAM type: YTN; PAM sequence: TTA
ttacctgtgagaaacaggta

SEQ ID NO: 106580 - DNA, 20 bp, Artificial Sequence
  Description of Artificial Sequence: Synthetic oligonucleotide
  Target: SCN9A; (+) strand; PAM type: YTN; PAM sequence: TTA
cctgtgagaaacaggtagaa

SEQ ID NO: 106581 - DNA, 20 bp, Artificial Sequence
  Description of Artificial Sequence: Synthetic oligonucleotide
  Target: SCN9A; (+) strand; PAM type: YTN; PAM sequence: CTG
tgagaaacaggtagaacaaa

SEQ ID NO: 106582 - DNA, 20 bp, Artificial Sequence
  Description of Artificial Sequence: Synthetic oligonucleotide
  Target: SCN9A; (+) strand; PAM type: YTN; PAM sequence: TTG
tgactattttctattgtgct

SEQ ID NO: 106583 - DNA, 20 bp, Artificial Sequence
  Description of Artificial Sequence: Synthetic oligonucleotide
  Target: SCN9A; (+) strand; PAM type: YTN; PAM sequence: CTA
ttttctattgtgctaaagat

SEQ ID NO: 106584 - DNA, 20 bp, Artificial Sequence
  Description of Artificial Sequence: Synthetic oligonucleotide
  Target: SCN9A; (+) strand; PAM type: YTN; PAM sequence: TTT
tctattgtgctaaagatctt

SEQ ID NO: 106585 - DNA, 20 bp, Artificial Sequence
  Description of Artificial Sequence: Synthetic oligonucleotide
  Target: SCN9A; (+) strand; PAM type: YTN; PAM sequence: TTT
ctattgtgctaaagatcttt

SEQ ID NO: 106586 - DNA, 20 bp, Artificial Sequence
  Description of Artificial Sequence: Synthetic oligonucleotide
  Target: SCN9A; (+) strand; PAM type: YTN; PAM sequence: TTC
tattgtgctaaagatctttg

SEQ ID NO: 106587 - DNA, 20 bp, Artificial Sequence
  Description of Artificial Sequence: Synthetic oligonucleotide
  Target: SCN9A; (+) strand; PAM type: YTN; PAM sequence: CTA
ttgtgctaaagatctttgtt

SEQ ID NO: 106588 - DNA, 20 bp, Artificial Sequence
  Description of Artificial Sequence: Synthetic oligonucleotide
  Target: SCN9A; (+) strand; PAM type: YTN; PAM sequence: TTG
tgctaaagatctttgttcac

SEQ ID NO: 106589 - DNA, 20 bp, Artificial Sequence
  Description of Artificial Sequence: Synthetic oligonucleotide
  Target: SCN9A; (+) strand; PAM type: YTN; PAM sequence: CTA
aagatctttgttcactttac

SEQ ID NO: 106590 - DNA, 20 bp, Artificial Sequence
  Description of Artificial Sequence: Synthetic oligonucleotide
  Target: SCN9A; (+) strand; PAM type: YTN; PAM sequence: CTT
tgttcactttaccagaagat

SEQ ID NO: 106591 - DNA, 20 bp, Artificial Sequence
  Description of Artificial Sequence: Synthetic oligonucleotide
  Target: SCN9A; (+) strand; PAM type: YTN; PAM sequence: TTT
gttcactttaccagaagata

SEQ ID NO: 106592 - DNA, 20 bp, Artificial Sequence
  Description of Artificial Sequence: Synthetic oligonucleotide
  Target: SCN9A; (+) strand; PAM type: YTN; PAM sequence: TTG
ttcactttaccagaagataa

SEQ ID NO: 106593 - DNA, 20 bp, Artificial Sequence
  Description of Artificial Sequence: Synthetic oligonucleotide
  Target: SCN9A; (+) strand; PAM type: YTN; PAM sequence: TTC
actttaccagaagataaatg

SEQ ID NO: 106594 - DNA, 20 bp, Artificial Sequence
  Description of Artificial Sequence: Synthetic oligonucleotide
  Target: SCN9A; (+) strand; PAM type: YTN; PAM sequence: CTT
taccagaagataaatgtcac

SEQ ID NO: 106595 - DNA, 20 bp, Artificial Sequence
  Description of Artificial Sequence: Synthetic oligonucleotide
  Target: SCN9A; (+) strand; PAM type: YTN; PAM sequence: TTT
accagaagataaatgtcact

SEQ ID NO: 106596 - DNA, 20 bp, Artificial Sequence
  Description of Artificial Sequence: Synthetic oligonucleotide
  Target: SCN9A; (+) strand; PAM type: YTN; PAM sequence: TTA
ccagaagataaatgtcactt

SEQ ID NO: 106597 - DNA, 20 bp, Artificial Sequence
  Description of Artificial Sequence: Synthetic oligonucleotide
  Target: SCN9A; (+) strand; PAM type: YTN; PAM sequence: CTT
gttctaacaaatggaacaca

SEQ ID NO: 106598 - DNA, 20 bp, Artificial Sequence
  Description of Artificial Sequence: Synthetic oligonucleotide
  Target: SCN9A; (+) strand; PAM type: YTN; PAM sequence: TTG
ttctaacaaatggaacacat

SEQ ID NO: 106599 - DNA, 20 bp, Artificial Sequence
  Description of Artificial Sequence: Synthetic oligonucleotide
  Target: SCN9A; (+) strand; PAM type: YTN; PAM sequence: TTC
taacaaatggaacacataat

SEQ ID NO: 106600 - DNA, 20 bp, Artificial Sequence
  Description of Artificial Sequence: Synthetic oligonucleotide
  Target: SCN9A; (+) strand; PAM type: YTN; PAM sequence: CTA
acaaatggaacacataatac

SEQ ID NO: 106601 - DNA, 20 bp, Artificial Sequence
  Description of Artificial Sequence: Synthetic oligonucleotide
  Target: SCN9A; (+) strand; PAM type: YTN; PAM sequence: CTT
acaaagttcctgtaataaaa

SEQ ID NO: 106602 - DNA, 20 bp, Artificial Sequence
  Description of Artificial Sequence: Synthetic oligonucleotide
  Target: SCN9A; (+) strand; PAM type: YTN; PAM sequence: TTA
caaagttcctgtaataaaat

SEQ ID NO: 106603 - DNA, 20 bp, Artificial Sequence
  Description of Artificial Sequence: Synthetic oligonucleotide
  Target: SCN9A; (+) strand; PAM type: YTN; PAM sequence: TTC
ctgtaataaaatattctgtc

SEQ ID NO: 106604 - DNA, 20 bp, Artificial Sequence
  Description of Artificial Sequence: Synthetic oligonucleotide
  Target: SCN9A; (+) strand; PAM type: YTN; PAM sequence: CTG
taataaaatattctgtccaa

SEQ ID NO: 106605 - DNA, 20 bp, Artificial Sequence
  Description of Artificial Sequence: Synthetic oligonucleotide
  Target: SCN9A; (+) strand; PAM type: YTN; PAM sequence: TTC
tgtccaagaagcgtgctaga

SEQ ID NO: 106606 - DNA, 20 bp, Artificial Sequence
  Description of Artificial Sequence: Synthetic oligonucleotide
  Target: SCN9A; (+) strand; PAM type: YTN; PAM sequence: CTG
tccaagaagcgtgctagaat

SEQ ID NO: 106607 - DNA, 20 bp, Artificial Sequence
  Description of Artificial Sequence: Synthetic oligonucleotide
  Target: SCN9A; (+) strand; PAM type: YTN; PAM sequence: CTA
gaatactgcttaatgtgact

SEQ ID NO: 106608 - DNA, 20 bp, Artificial Sequence
  Description of Artificial Sequence: Synthetic oligonucleotide
  Target: SCN9A; (+) strand; PAM type: YTN; PAM sequence: CTG
cttaatgtgacttttaaagc

SEQ ID NO: 106609 - DNA, 20 bp, Artificial Sequence
  Description of Artificial Sequence: Synthetic oligonucleotide
  Target: SCN9A; (+) strand; PAM type: YTN; PAM sequence: CTT
aatgtgacttttaaagcaca

SEQ ID NO: 106610 - DNA, 20 bp, Artificial Sequence
  Description of Artificial Sequence: Synthetic oligonucleotide
  Target: SCN9A; (+) strand; PAM type: YTN; PAM sequence: TTA
atgtgacttttaaagcacag

SEQ ID NO: 106611 - DNA, 20 bp, Artificial Sequence
  Description of Artificial Sequence: Synthetic oligonucleotide
  Target: SCN9A; (+) strand; PAM type: YTN; PAM sequence: CTT
ttaaagcacagaaaaggacc

SEQ ID NO: 106612 - DNA, 20 bp, Artificial Sequence
  Description of Artificial Sequence: Synthetic oligonucleotide
  Target: SCN9A; (+) strand; PAM type: YTN; PAM sequence: TTT
taaagcacagaaaaggacct

SEQ ID NO: 106613 - DNA, 20 bp, Artificial Sequence
  Description of Artificial Sequence: Synthetic oligonucleotide
  Target: SCN9A; (+) strand; PAM type: YTN; PAM sequence: TTT
aaagcacagaaaaggacctg

SEQ ID NO: 106614 - DNA, 20 bp, Artificial Sequence
  Description of Artificial Sequence: Synthetic oligonucleotide
  Target: SCN9A; (+) strand; PAM type: YTN; PAM sequence: TTA
aagcacagaaaaggacctgc

SEQ ID NO: 106615 - DNA, 20 bp, Artificial Sequence
  Description of Artificial Sequence: Synthetic oligonucleotide
  Target: SCN9A; (+) strand; PAM type: YTN; PAM sequence: CTG
ccccttgaacctgattcaca

SEQ ID NO: 106616 - DNA, 20 bp, Artificial Sequence
  Description of Artificial Sequence: Synthetic oligonucleotide
  Target: SCN9A; (+) strand; PAM type: YTN; PAM sequence: CTT
gaacctgattcacatgcaat

SEQ ID NO: 106617 - DNA, 20 bp, Artificial Sequence
  Description of Artificial Sequence: Synthetic oligonucleotide
  Target: SCN9A; (+) strand; PAM type: YTN; PAM sequence: TTG
aacctgattcacatgcaata

SEQ ID NO: 106618 - DNA, 20 bp, Artificial Sequence
  Description of Artificial Sequence: Synthetic oligonucleotide
  Target: SCN9A; (+) strand; PAM type: YTN; PAM sequence: CTG
attcacatgcaataatggca

SEQ ID NO: 106619 - DNA, 20 bp, Artificial Sequence
  Description of Artificial Sequence: Synthetic oligonucleotide
  Target: SCN9A; (+) strand; PAM type: YTN; PAM sequence: TTC
acatgcaataatggcattat

SEQ ID NO: 106620 - DNA, 20 bp, Artificial Sequence
  Description of Artificial Sequence: Synthetic oligonucleotide
  Target: SCN9A; (+) strand; PAM type: YTN; PAM sequence: TTA
tgattggctggcttcattgc

SEQ ID NO: 106621 - DNA, 20 bp, Artificial Sequence
  Description of Artificial Sequence: Synthetic oligonucleotide
  Target: SCN9A; (+) strand; PAM type: YTN; PAM sequence: TTG
gctggcttcattgcctatta

SEQ ID NO: 106622 - DNA, 20 bp, Artificial Sequence
  Description of Artificial Sequence: Synthetic oligonucleotide
  Target: SCN9A; (+) strand; PAM type: YTN; PAM sequence: CTG
gcttcattgcctattatgtt

SEQ ID NO: 106623 - DNA, 20 bp, Artificial Sequence
  Description of Artificial Sequence: Synthetic oligonucleotide
  Target: SCN9A; (+) strand; PAM type: YTN; PAM sequence: CTT
cattgcctattatgtttgcc

SEQ ID NO: 106624 - DNA, 20 bp, Artificial Sequence
  Description of Artificial Sequence: Synthetic oligonucleotide
  Target: SCN9A; (+) strand; PAM type: YTN; PAM sequence: TTC
attgcctattatgtttgccc

SEQ ID NO: 106625 - DNA, 20 bp, Artificial Sequence
  Description of Artificial Sequence: Synthetic oligonucleotide
  Target: SCN9A; (+) strand; PAM type: YTN; PAM sequence: TTG
cctattatgtttgccctaga

SEQ ID NO: 106626 - DNA, 20 bp, Artificial Sequence
  Description of Artificial Sequence: Synthetic oligonucleotide
  Target: SCN9A; (+) strand; PAM type: YTN; PAM sequence: CTA
ttatgtttgccctagaagag

SEQ ID NO: 106627 - DNA, 20 bp, Artificial Sequence
  Description of Artificial Sequence: Synthetic oligonucleotide
  Target: SCN9A; (+) strand; PAM type: YTN; PAM sequence: TTA
tgtttgccctagaagagatt

SEQ ID NO: 106628 - DNA, 20 bp, Artificial Sequence
  Description of Artificial Sequence: Synthetic oligonucleotide
  Target: SCN9A; (+) strand; PAM type: YTN; PAM sequence: TTT
gccctagaagagattacaaa

SEQ ID NO: 106629 - DNA, 20 bp, Artificial Sequence
  Description of Artificial Sequence: Synthetic oligonucleotide
  Target: SCN9A; (+) strand; PAM type: YTN; PAM sequence: TTG
ccctagaagagattacaaaa

SEQ ID NO: 106630 - DNA, 20 bp, Artificial Sequence
  Description of Artificial Sequence: Synthetic oligonucleotide
  Target: SCN9A; (+) strand; PAM type: YTN; PAM sequence: CTA
gaagagattacaaaaaaggt

SEQ ID NO: 106631 - DNA, 20 bp, Artificial Sequence
  Description of Artificial Sequence: Synthetic oligonucleotide
  Target: SCN9A; (+) strand; PAM type: YTN; PAM sequence: TTA
caaaaaaggtcaggacaatt

SEQ ID NO: 106632 - DNA, 20 bp, Artificial Sequence
  Description of Artificial Sequence: Synthetic oligonucleotide
  Target: SCN9A; (+) strand; PAM type: YTN; PAM sequence: TTT
ctattctcttgaagcaaagt

SEQ ID NO: 106633 - DNA, 20 bp, Artificial Sequence
  Description of Artificial Sequence: Synthetic oligonucleotide
  Target: SCN9A; (+) strand; PAM type: YTN; PAM sequence: TTC
tattctcttgaagcaaagtt

SEQ ID NO: 106634 - DNA, 20 bp, Artificial Sequence
  Description of Artificial Sequence: Synthetic oligonucleotide
  Target: SCN9A; (+) strand; PAM type: YTN; PAM sequence: CTA
ttctcttgaagcaaagtttt

SEQ ID NO: 106635 - DNA, 20 bp, Artificial Sequence
  Description of Artificial Sequence: Synthetic oligonucleotide
  Target: SCN9A; (+) strand; PAM type: YTN; PAM sequence: TTC
tcttgaagcaaagttttatt

SEQ ID NO: 106636 - DNA, 20 bp, Artificial Sequence
  Description of Artificial Sequence: Synthetic oligonucleotide
  Target: SCN9A; (+) strand; PAM type: YTN; PAM sequence: CTC
ttgaagcaaagttttatttc

SEQ ID NO: 106637 - DNA, 20 bp, Artificial Sequence
  Description of Artificial Sequence: Synthetic oligonucleotide
  Target: SCN9A; (+) strand; PAM type: YTN; PAM sequence: CTT
gaagcaaagttttatttctg

SEQ ID NO: 106638 - DNA, 20 bp, Artificial Sequence
  Description of Artificial Sequence: Synthetic oligonucleotide
  Target: SCN9A; (+) strand; PAM type: YTN; PAM sequence: TTG
aagcaaagttttatttctga

SEQ ID NO: 106639 - DNA, 20 bp, Artificial Sequence
  Description of Artificial Sequence: Synthetic oligonucleotide
  Target: SCN9A; (+) strand; PAM type: YTN; PAM sequence: TTT
tatttctgagttaattattt

SEQ ID NO: 106640 - DNA, 20 bp, Artificial Sequence
  Description of Artificial Sequence: Synthetic oligonucleotide
  Target: SCN9A; (+) strand; PAM type: YTN; PAM sequence: TTT
atttctgagttaattatttt

SEQ ID NO: 106641 - DNA, 20 bp, Artificial Sequence
  Description of Artificial Sequence: Synthetic oligonucleotide
  Target: SCN9A; (+) strand; PAM type: YTN; PAM sequence: TTA
tttctgagttaattattttt

SEQ ID NO: 106642 - DNA, 20 bp, Artificial Sequence
  Description of Artificial Sequence: Synthetic oligonucleotide
  Target: SCN9A; (+) strand; PAM type: YTN; PAM sequence: TTT
ctgagttaattatttttttt

SEQ ID NO: 106643 - DNA, 20 bp, Artificial Sequence
  Description of Artificial Sequence: Synthetic oligonucleotide
  Target: SCN9A; (+) strand; PAM type: YTN; PAM sequence: TTC
tgagttaattattttttttt

SEQ ID NO: 106644 - DNA, 20 bp, Artificial Sequence
  Description of Artificial Sequence: Synthetic oligonucleotide
  Target: SCN9A; (+) strand; PAM type: YTN; PAM sequence: CTG
agttaattatttttttttct

SEQ ID NO: 106645 - DNA, 20 bp, Artificial Sequence
  Description of Artificial Sequence: Synthetic oligonucleotide
  Target: SCN9A; (+) strand; PAM type: YTN; PAM sequence: TTA
attatttttttttctcactg

SEQ ID NO: 106646 - DNA, 20 bp, Artificial Sequence
  Description of Artificial Sequence: Synthetic oligonucleotide
  Target: SCN9A; (+) strand; PAM type: YTN; PAM sequence: TTA
tttttttttctcactgaagt

SEQ ID NO: 106647 - DNA, 20 bp, Artificial Sequence
  Description of Artificial Sequence: Synthetic oligonucleotide
  Target: SCN9A; (+) strand; PAM type: YTN; PAM sequence: TTT
ttttttctcactgaagtaga

SEQ ID NO: 106648 - DNA, 20 bp, Artificial Sequence
  Description of Artificial Sequence: Synthetic oligonucleotide
  Target: SCN9A; (+) strand; PAM type: YTN; PAM sequence: TTT
tttttctcactgaagtagaa

SEQ ID NO: 106649 - DNA, 20 bp, Artificial Sequence
  Description of Artificial Sequence: Synthetic oligonucleotide
  Target: SCN9A; (+) strand; PAM type: YTN; PAM sequence: TTT
ttttctcactgaagtagaag

SEQ ID NO: 106650 - DNA, 20 bp, Artificial Sequence
  Description of Artificial Sequence: Synthetic oligonucleotide
  Target: SCN9A; (+) strand; PAM type: YTN; PAM sequence: TTT
tttctcactgaagtagaagt

SEQ ID NO: 106651 - DNA, 20 bp, Artificial Sequence
  Description of Artificial Sequence: Synthetic oligonucleotide
  Target: SCN9A; (+) strand; PAM type: YTN; PAM sequence: TTT
ttctcactgaagtagaagtg

SEQ ID NO: 106652 - DNA, 20 bp, Artificial Sequence
  Description of Artificial Sequence: Synthetic oligonucleotide
  Target: SCN9A; (+) strand; PAM type: YTN; PAM sequence: TTT
tctcactgaagtagaagtgc

SEQ ID NO: 106653 - DNA, 20 bp, Artificial Sequence
  Description of Artificial Sequence: Synthetic oligonucleotide
  Target: SCN9A; (+) strand; PAM type: YTN; PAM sequence: TTT
ctcactgaagtagaagtgca

SEQ ID NO: 106654 - DNA, 20 bp, Artificial Sequence
  Description of Artificial Sequence: Synthetic oligonucleotide
  Target: SCN9A; (+) strand; PAM type: YTN; PAM sequence: TTC
tcactgaagtagaagtgcag

SEQ ID NO: 106655 - DNA, 20 bp, Artificial Sequence
  Description of Artificial Sequence: Synthetic oligonucleotide
  Target: SCN9A; (+) strand; PAM type: YTN; PAM sequence: CTC
actgaagtagaagtgcaggt

SEQ ID NO: 106656 - DNA, 20 bp, Artificial Sequence
  Description of Artificial Sequence: Synthetic oligonucleotide
  Target: SCN9A; (+) strand; PAM type: YTN; PAM sequence: CTG
aagtagaagtgcaggtcaac

SEQ ID NO: 106657 - DNA, 20 bp, Artificial Sequence
  Description of Artificial Sequence: Synthetic oligonucleotide
  Target: SCN9A; (+) strand; PAM type: YTN; PAM sequence: CTC
cacattgtaaaaaaaaaaaa

SEQ ID NO: 106658 - DNA, 20 bp, Artificial Sequence
  Description of Artificial Sequence: Synthetic oligonucleotide
  Target: SCN9A; (+) strand; PAM type: YTN; PAM sequence: TTG
taaaaaaaaaaaatgttcac

SEQ ID NO: 106659 - DNA, 20 bp, Artificial Sequence
  Description of Artificial Sequence: Synthetic oligonucleotide
  Target: SCN9A; (+) strand; PAM type: YTN; PAM sequence: TTC
acagagggcaggaaacatgt

SEQ ID NO: 106660 - DNA, 20 bp, Artificial Sequence
  Description of Artificial Sequence: Synthetic oligonucleotide
  Target: SCN9A; (+) strand; PAM type: YTN; PAM sequence: TTG
taaattatatttaaacattg

SEQ ID NO: 106661 - DNA, 20 bp, Artificial Sequence
  Description of Artificial Sequence: Synthetic oligonucleotide
  Target: SCN9A; (+) strand; PAM type: YTN; PAM sequence: TTA
tatttaaacattgttttatc

SEQ ID NO: 106662 - DNA, 20 bp, Artificial Sequence
  Description of Artificial Sequence: Synthetic oligonucleotide
  Target: SCN9A; (+) strand; PAM type: YTN; PAM sequence: TTT
aaacattgttttatccagga

SEQ ID NO: 106663 - DNA, 20 bp, Artificial Sequence
  Description of Artificial Sequence: Synthetic oligonucleotide
  Target: SCN9A; (+) strand; PAM type: YTN; PAM sequence: TTA
aacattgttttatccaggaa

SEQ ID NO: 106664 - DNA, 20 bp, Artificial Sequence
  Description of Artificial Sequence: Synthetic oligonucleotide
  Target: SCN9A; (+) strand; PAM type: YTN; PAM sequence: TTG
ttttatccaggaaacaaaaa

SEQ ID NO: 106665 - DNA, 20 bp, Artificial Sequence
  Description of Artificial Sequence: Synthetic oligonucleotide
  Target: SCN9A; (+) strand; PAM type: YTN; PAM sequence: TTT
tatccaggaaacaaaaaagg

SEQ ID NO: 106666 - DNA, 20 bp, Artificial Sequence
  Description of Artificial Sequence: Synthetic oligonucleotide
  Target: SCN9A; (+) strand; PAM type: YTN; PAM sequence: TTT
atccaggaaacaaaaaagga

SEQ ID NO: 106667 - DNA, 20 bp, Artificial Sequence
  Description of Artificial Sequence: Synthetic oligonucleotide
  Target: SCN9A; (+) strand; PAM type: YTN; PAM sequence: TTA
tccaggaaacaaaaaaggaa

SEQ ID NO: 106668 - DNA, 20 bp, Artificial Sequence
  Description of Artificial Sequence: Synthetic oligonucleotide
  Target: SCN9A; (+) strand; PAM type: YTN; PAM sequence: TTG
aattggcatttgatgtaagt

SEQ ID NO: 106669 - DNA, 20 bp, Artificial Sequence
  Description of Artificial Sequence: Synthetic oligonucleotide
  Target: SCN9A; (+) strand; PAM type: YTN; PAM sequence: TTG
gcatttgatgtaagtctttt

SEQ ID NO: 106670 - DNA, 20 bp, Artificial Sequence
  Description of Artificial Sequence: Synthetic oligonucleotide
  Target: SCN9A; (+) strand; PAM type: YTN; PAM sequence: TTT
gatgtaagtcttttcatggc

SEQ ID NO: 106671 - DNA, 20 bp, Artificial Sequence
  Description of Artificial Sequence: Synthetic oligonucleotide
  Target: SCN9A; (+) strand; PAM type: YTN; PAM sequence: TTG
atgtaagtcttttcatggcc

SEQ ID NO: 106672 - DNA, 20 bp, Artificial Sequence
  Description of Artificial Sequence: Synthetic oligonucleotide
  Target: SCN9A; (+) strand; PAM type: YTN; PAM sequence: CTT
ttcatggcccaaatcatcta

SEQ ID NO: 106673 - DNA, 20 bp, Artificial Sequence
  Description of Artificial Sequence: Synthetic oligonucleotide
  Target: SCN9A; (+) strand; PAM type: YTN; PAM sequence: TTT
tcatggcccaaatcatctac

SEQ ID NO: 106674 - DNA, 20 bp, Artificial Sequence
  Description of Artificial Sequence: Synthetic oligonucleotide
  Target: SCN9A; (+) strand; PAM type: YTN; PAM sequence: TTT
catggcccaaatcatctacc

SEQ ID NO: 106675 - DNA, 20 bp, Artificial Sequence
  Description of Artificial Sequence: Synthetic oligonucleotide
  Target: SCN9A; (+) strand; PAM type: YTN; PAM sequence: TTC
atggcccaaatcatctacct

SEQ ID NO: 106676 - DNA, 20 bp, Artificial Sequence
  Description of Artificial Sequence: Synthetic oligonucleotide
  Target: SCN9A; (+) strand; PAM type: YTN; PAM sequence: CTA
cctcatgttttaaaaatcga

SEQ ID NO: 106677 - DNA, 20 bp, Artificial Sequence
  Description of Artificial Sequence: Synthetic oligonucleotide
  Target: SCN9A; (+) strand; PAM type: YTN; PAM sequence: CTC
atgttttaaaaatcgaagta

SEQ ID NO: 106678 - DNA, 20 bp, Artificial Sequence
  Description of Artificial Sequence: Synthetic oligonucleotide
  Target: SCN9A; (+) strand; PAM type: YTN; PAM sequence: TTT
taaaaatcgaagtaagacct

SEQ ID NO: 106679 - DNA, 20 bp, Artificial Sequence
  Description of Artificial Sequence: Synthetic oligonucleotide
  Target: SCN9A; (+) strand; PAM type: YTN; PAM sequence: TTT
aaaaatcgaagtaagaccta

SEQ ID NO: 106680 - DNA, 20 bp, Artificial Sequence
  Description of Artificial Sequence: Synthetic oligonucleotide
  Target: SCN9A; (+) strand; PAM type: YTN; PAM sequence: TTA
aaaatcgaagtaagacctaa

SEQ ID NO: 106681 - DNA, 20 bp, Artificial Sequence
  Description of Artificial Sequence: Synthetic oligonucleotide
  Target: SCN9A; (+) strand; PAM type: YTN; PAM sequence: CTA
actgaagagaaggtactcat

SEQ ID NO: 106682 - DNA, 20 bp, Artificial Sequence
  Description of Artificial Sequence: Synthetic oligonucleotide
  Target: SCN9A; (+) strand; PAM type: YTN; PAM sequence: CTG
aagagaaggtactcatccct

SEQ ID NO: 106683 - DNA, 20 bp, Artificial Sequence
  Description of Artificial Sequence: Synthetic oligonucleotide
  Target: SCN9A; (+) strand; PAM type: YTN; PAM sequence: CTC
atccctcattttggtcatac

SEQ ID NO: 106684 - DNA, 20 bp, Artificial Sequence
  Description of Artificial Sequence: Synthetic oligonucleotide
  Target: SCN9A; (+) strand; PAM type: YTN; PAM sequence: CTC
attttggtcatacctaaaac

SEQ ID NO: 106685 - DNA, 20 bp, Artificial Sequence
  Description of Artificial Sequence: Synthetic oligonucleotide
  Target: SCN9A; (+) strand; PAM type: YTN; PAM sequence: TTT
tggtcatacctaaaacaatt

SEQ ID NO: 106686 - DNA, 20 bp, Artificial Sequence
  Description of Artificial Sequence: Synthetic oligonucleotide
  Target: SCN9A; (+) strand; PAM type: YTN; PAM sequence: TTT
ggtcatacctaaaacaattt

SEQ ID NO: 106687 - DNA, 20 bp, Artificial Sequence
  Description of Artificial Sequence: Synthetic oligonucleotide
  Target: SCN9A; (+) strand; PAM type: YTN; PAM sequence: TTG
gtcatacctaaaacaatttc

SEQ ID NO: 106688 - DNA, 20 bp, Artificial Sequence
  Description of Artificial Sequence: Synthetic oligonucleotide
  Target: SCN9A; (+) strand; PAM type: YTN; PAM sequence: CTA
aaacaatttctctgagatgt

SEQ ID NO: 106689 - DNA, 20 bp, Artificial Sequence
  Description of Artificial Sequence: Synthetic oligonucleotide
  Target: SCN9A; (+) strand; PAM type: YTN; PAM sequence: TTT
ctctgagatgtaagtaaaga

SEQ ID NO: 106690 - DNA, 20 bp, Artificial Sequence
  Description of Artificial Sequence: Synthetic oligonucleotide
  Target: SCN9A; (+) strand; PAM type: YTN; PAM sequence: TTC
tctgagatgtaagtaaagac

SEQ ID NO: 106691 - DNA, 20 bp, Artificial Sequence
  Description of Artificial Sequence: Synthetic oligonucleotide
  Target: SCN9A; (+) strand; PAM type: YTN; PAM sequence: CTC
tgagatgtaagtaaagacag

SEQ ID NO: 106692 - DNA, 20 bp, Artificial Sequence
  Description of Artificial Sequence: Synthetic oligonucleotide
  Target: SCN9A; (+) strand; PAM type: YTN; PAM sequence: CTG
agatgtaagtaaagacagca

SEQ ID NO: 106693 - DNA, 20 bp, Artificial Sequence
  Description of Artificial Sequence: Synthetic oligonucleotide
  Target: SCN9A; (+) strand; PAM type: YTN; PAM sequence: CTA
aaattgtgtgtctcaataag

SEQ ID NO: 106694 - DNA, 20 bp, Artificial Sequence
  Description of Artificial Sequence: Synthetic oligonucleotide
  Target: SCN9A; (+) strand; PAM type: YTN; PAM sequence: TTG
tgtgtctcaataagtctgat

SEQ ID NO: 106695 - DNA, 20 bp, Artificial Sequence
  Description of Artificial Sequence: Synthetic oligonucleotide
  Target: SCN9A; (+) strand; PAM type: YTN; PAM sequence: CTC
aataagtctgatttaggaga

SEQ ID NO: 106696 - DNA, 20 bp, Artificial Sequence
  Description of Artificial Sequence: Synthetic oligonucleotide
  Target: SCN9A; (+) strand; PAM type: YTN; PAM sequence: CTG
atttaggagaaaattctgga

SEQ ID NO: 106697 - DNA, 20 bp, Artificial Sequence
  Description of Artificial Sequence: Synthetic oligonucleotide
  Target: SCN9A; (+) strand; PAM type: YTN; PAM sequence: TTT
aggagaaaattctggaggtc

SEQ ID NO: 106698 - DNA, 20 bp, Artificial Sequence
  Description of Artificial Sequence: Synthetic oligonucleotide
  Target: SCN9A; (+) strand; PAM type: YTN; PAM sequence: TTA
ggagaaaattctggaggtcg

SEQ ID NO: 106699 - DNA, 20 bp, Artificial Sequence
  Description of Artificial Sequence: Synthetic oligonucleotide
  Target: SCN9A; (+) strand; PAM type: YTN; PAM sequence: TTC
tggaggtcggaggtctggga

SEQ ID NO: 106700 - DNA, 20 bp, Artificial Sequence
  Description of Artificial Sequence: Synthetic oligonucleotide
  Target: SCN9A; (+) strand; PAM type: YTN; PAM sequence: CTG
gaggtcggaggtctgggaat

SEQ ID NO: 106701 - DNA, 20 bp, Artificial Sequence
  Description of Artificial Sequence: Synthetic oligonucleotide
  Target: SCN9A; (+) strand; PAM type: YTN; PAM sequence: CTG
ggaatcatagtgaacaattt

SEQ ID NO: 106702 - DNA, 20 bp, Artificial Sequence
  Description of Artificial Sequence: Synthetic oligonucleotide
  Target: SCN9A; (+) strand; PAM type: YTN; PAM sequence: TTT
tgataattgctaaaaatccc

SEQ ID NO: 106703 - DNA, 20 bp, Artificial Sequence
  Description of Artificial Sequence: Synthetic oligonucleotide
  Target: SCN9A; (+) strand; PAM type: YTN; PAM sequence: TTT
gataattgctaaaaatccct

SEQ ID NO: 106704 - DNA, 20 bp, Artificial Sequence
  Description of Artificial Sequence: Synthetic oligonucleotide
  Target: SCN9A; (+) strand; PAM type: YTN; PAM sequence: TTG
ataattgctaaaaatccctg

SEQ ID NO: 106705 - DNA, 20 bp, Artificial Sequence
  Description of Artificial Sequence: Synthetic oligonucleotide
  Target: SCN9A; (+) strand; PAM type: YTN; PAM sequence: TTG
ctaaaaatccctgaaatggt

SEQ ID NO: 106706 - DNA, 20 bp, Artificial Sequence
  Description of Artificial Sequence: Synthetic oligonucleotide
  Target: SCN9A; (+) strand; PAM type: YTN; PAM sequence: CTA
aaaatccctgaaatggttta

SEQ ID NO: 106707 - DNA, 20 bp, Artificial Sequence
  Description of Artificial Sequence: Synthetic oligonucleotide
  Target: SCN9A; (+) strand; PAM type: YTN; PAM sequence: CTG
aaatggtttaatagttgtca

SEQ ID NO: 106708 - DNA, 20 bp, Artificial Sequence
  Description of Artificial Sequence: Synthetic oligonucleotide
  Target: SCN9A; (+) strand; PAM type: YTN; PAM sequence: TTT
aatagttgtcaatgaaaaag

SEQ ID NO: 106709 - DNA, 20 bp, Artificial Sequence
  Description of Artificial Sequence: Synthetic oligonucleotide
  Target: SCN9A; (+) strand; PAM type: YTN; PAM sequence: TTA
atagttgtcaatgaaaaagt

SEQ ID NO: 106710 - DNA, 20 bp, Artificial Sequence
  Description of Artificial Sequence: Synthetic oligonucleotide
  Target: SCN9A; (+) strand; PAM type: YTN; PAM sequence: TTG
tcaatgaaaaagtatatttc

SEQ ID NO: 106711 - DNA, 20 bp, Artificial Sequence
  Description of Artificial Sequence: Synthetic oligonucleotide
  Target: SCN9A; (+) strand; PAM type: YTN; PAM sequence: TTT
cactatgaaatacatgtttg

SEQ ID NO: 106712 - DNA, 20 bp, Artificial Sequence
  Description of Artificial Sequence: Synthetic oligonucleotide
  Target: SCN9A; (+) strand; PAM type: YTN; PAM sequence: TTC
actatgaaatacatgtttgt

SEQ ID NO: 106713 - DNA, 20 bp, Artificial Sequence
  Description of Artificial Sequence: Synthetic oligonucleotide
  Target: SCN9A; (+) strand; PAM type: YTN; PAM sequence: CTA
tgaaatacatgtttgtgtat

SEQ ID NO: 106714 - DNA, 20 bp, Artificial Sequence
  Description of Artificial Sequence: Synthetic oligonucleotide
  Target: SCN9A; (+) strand; PAM type: YTN; PAM sequence: TTT
gtgtatatttgttttaatag

SEQ ID NO: 106715 - DNA, 20 bp, Artificial Sequence
  Description of Artificial Sequence: Synthetic oligonucleotide
  Target: SCN9A; (+) strand; PAM type: YTN; PAM sequence: TTG
tgtatatttgttttaatagg

SEQ ID NO: 106716 - DNA, 20 bp, Artificial Sequence
  Description of Artificial Sequence: Synthetic oligonucleotide
  Target: SCN9A; (+) strand; PAM type: YTN; PAM sequence: TTT
gttttaataggaatattggt

SEQ ID NO: 106717 - DNA, 20 bp, Artificial Sequence
  Description of Artificial Sequence: Synthetic oligonucleotide
  Target: SCN9A; (+) strand; PAM type: YTN; PAM sequence: TTG
ttttaataggaatattggtg

SEQ ID NO: 106718 - DNA, 20 bp, Artificial Sequence
  Description of Artificial Sequence: Synthetic oligonucleotide
  Target: SCN9A; (+) strand; PAM type: YTN; PAM sequence: TTT
taataggaatattggtgaag

SEQ ID NO: 106719 - DNA, 20 bp, Artificial Sequence
  Description of Artificial Sequence: Synthetic oligonucleotide
  Target: SCN9A; (+) strand; PAM type: YTN; PAM sequence: TTT
aataggaatattggtgaaga

SEQ ID NO: 106720 - DNA, 20 bp, Artificial Sequence
  Description of Artificial Sequence: Synthetic oligonucleotide
  Target: SCN9A; (+) strand; PAM type: YTN; PAM sequence: TTA
ataggaatattggtgaagat

SEQ ID NO: 106721 - DNA, 20 bp, Artificial Sequence
  Description of Artificial Sequence: Synthetic oligonucleotide
  Target: SCN9A; (+) strand; PAM type: YTN; PAM sequence: TTG
gtgaagatctgagggtccat

SEQ ID NO: 106722 - DNA, 20 bp, Artificial Sequence
  Description of Artificial Sequence: Synthetic oligonucleotide
  Target: SCN9A; (+) strand; PAM type: YTN; PAM sequence: CTG
agggtccattttactgcttt

SEQ ID NO: 106723 - DNA, 20 bp, Artificial Sequence
  Description of Artificial Sequence: Synthetic oligonucleotide
  Target: SCN9A; (+) strand; PAM type: YTN; PAM sequence: TTT
tactgctttagtctccttaa

SEQ ID NO: 106724 - DNA, 20 bp, Artificial Sequence
  Description of Artificial Sequence: Synthetic oligonucleotide
  Target: SCN9A; (+) strand; PAM type: YTN; PAM sequence: TTT
actgctttagtctccttaat

SEQ ID NO: 106725 - DNA, 20 bp, Artificial Sequence
  Description of Artificial Sequence: Synthetic oligonucleotide
  Target: SCN9A; (+) strand; PAM type: YTN; PAM sequence: TTA
ctgctttagtctccttaatc

SEQ ID NO: 106726 - DNA, 20 bp, Artificial Sequence
  Description of Artificial Sequence: Synthetic oligonucleotide
  Target: SCN9A; (+) strand; PAM type: YTN; PAM sequence: CTG
ctttagtctccttaatctgt

SEQ ID NO: 106727 - DNA, 20 bp, Artificial Sequence
  Description of Artificial Sequence: Synthetic oligonucleotide
  Target: SCN9A; (+) strand; PAM type: YTN; PAM sequence: CTT
tagtctccttaatctgttca

SEQ ID NO: 106728 - DNA, 20 bp, Artificial Sequence
  Description of Artificial Sequence: Synthetic oligonucleotide
  Target: SCN9A; (+) strand; PAM type: YTN; PAM sequence: TTT
agtctccttaatctgttcaa

SEQ ID NO: 106729 - DNA, 20 bp, Artificial Sequence
  Description of Artificial Sequence: Synthetic oligonucleotide
  Target: SCN9A; (+) strand; PAM type: YTN; PAM sequence: TTA
gtctccttaatctgttcaag

SEQ ID NO: 106730 - DNA, 20 bp, Artificial Sequence
  Description of Artificial Sequence: Synthetic oligonucleotide
  Target: SCN9A; (+) strand; PAM type: YTN; PAM sequence: CTC
cttaatctgttcaagcgtta

SEQ ID NO: 106731 - DNA, 20 bp, Artificial Sequence
  Description of Artificial Sequence: Synthetic oligonucleotide
  Target: SCN9A; (+) strand; PAM type: YTN; PAM sequence: CTT
aatctgttcaagcgttaaac

SEQ ID NO: 106732 - DNA, 20 bp, Artificial Sequence
  Description of Artificial Sequence: Synthetic oligonucleotide
  Target: SCN9A; (+) strand; PAM type: YTN; PAM sequence: TTA
atctgttcaagcgttaaacc

SEQ ID NO: 106733 - DNA, 20 bp, Artificial Sequence
  Description of Artificial Sequence: Synthetic oligonucleotide
  Target: SCN9A; (+) strand; PAM type: YTN; PAM sequence: CTG
ttcaagcgttaaaccatttt

SEQ ID NO: 106734 - DNA, 20 bp, Artificial Sequence
  Description of Artificial Sequence: Synthetic oligonucleotide
  Target: SCN9A; (+) strand; PAM type: YTN; PAM sequence: TTC
aagcgttaaaccattttaac

SEQ ID NO: 106735 - DNA, 20 bp, Artificial Sequence
  Description of Artificial Sequence: Synthetic oligonucleotide
  Target: SCN9A; (+) strand; PAM type: YTN; PAM sequence: TTA
aaccattttaacagggtgca

SEQ ID NO: 106736 - DNA, 20 bp, Artificial Sequence
  Description of Artificial Sequence: Synthetic oligonucleotide
  Target: SCN9A; (+) strand; PAM type: YTN; PAM sequence: TTT
taacagggtgcagtggctca

SEQ ID NO: 106737 - DNA, 20 bp, Artificial Sequence
  Description of Artificial Sequence: Synthetic oligonucleotide
  Target: SCN9A; (+) strand; PAM type: YTN; PAM sequence: TTT
aacagggtgcagtggctcat

SEQ ID NO: 106738 - DNA, 20 bp, Artificial Sequence
  Description of Artificial Sequence: Synthetic oligonucleotide
  Target: SCN9A; (+) strand; PAM type: YTN; PAM sequence: TTA
acagggtgcagtggctcatg

SEQ ID NO: 106739 - DNA, 20 bp, Artificial Sequence
  Description of Artificial Sequence: Synthetic oligonucleotide
  Target: SCN9A; (+) strand; PAM type: YTN; PAM sequence: CTC
atgcggttctcacttcgttg

SEQ ID NO: 106740 - DNA, 20 bp, Artificial Sequence
  Description of Artificial Sequence: Synthetic oligonucleotide
  Target: SCN9A; (+) strand; PAM type: YTN; PAM sequence: TTC
tcacttcgttgagaacagct

SEQ ID NO: 106741 - DNA, 20 bp, Artificial Sequence
  Description of Artificial Sequence: Synthetic oligonucleotide
  Target: SCN9A; (+) strand; PAM type: YTN; PAM sequence: CTC
acttcgttgagaacagctgc

SEQ ID NO: 106742 - DNA, 20 bp, Artificial Sequence
  Description of Artificial Sequence: Synthetic oligonucleotide
  Target: SCN9A; (+) strand; PAM type: YTN; PAM sequence: CTT
cgttgagaacagctgctgtg

SEQ ID NO: 106743 - DNA, 20 bp, Artificial Sequence
  Description of Artificial Sequence: Synthetic oligonucleotide
  Target: SCN9A; (+) strand; PAM type: YTN; PAM sequence: TTC
gttgagaacagctgctgtga

SEQ ID NO: 106744 - DNA, 20 bp, Artificial Sequence
  Description of Artificial Sequence: Synthetic oligonucleotide
  Target: SCN9A; (+) strand; PAM type: YTN; PAM sequence: TTG
agaacagctgctgtgacaac

SEQ ID NO: 106745 - DNA, 20 bp, Artificial Sequence
  Description of Artificial Sequence: Synthetic oligonucleotide
  Target: SCN9A; (+) strand; PAM type: YTN; PAM sequence: CTG
ctgtgacaactttctttcct

SEQ ID NO: 106746 - DNA, 20 bp, Artificial Sequence
  Description of Artificial Sequence: Synthetic oligonucleotide
  Target: SCN9A; (+) strand; PAM type: YTN; PAM sequence: CTG
tgacaactttctttccttca

SEQ ID NO: 106747 - DNA, 20 bp, Artificial Sequence
  Description of Artificial Sequence: Synthetic oligonucleotide
  Target: SCN9A; (+) strand; PAM type: YTN; PAM sequence: CTT
tctttccttcaaaaatcata

SEQ ID NO: 106748 - DNA, 20 bp, Artificial Sequence
  Description of Artificial Sequence: Synthetic oligonucleotide
  Target: SCN9A; (+) strand; PAM type: YTN; PAM sequence: TTT
ctttccttcaaaaatcataa

SEQ ID NO: 106749 - DNA, 20 bp, Artificial Sequence
  Description of Artificial Sequence: Synthetic oligonucleotide
  Target: SCN9A; (+) strand; PAM type: YTN; PAM sequence: TTC
tttccttcaaaaatcataag

SEQ ID NO: 106750 - DNA, 20 bp, Artificial Sequence
  Description of Artificial Sequence: Synthetic oligonucleotide
  Target: SCN9A; (+) strand; PAM type: YTN; PAM sequence: CTT
tccttcaaaaatcataagtc

SEQ ID NO: 106751 - DNA, 20 bp, Artificial Sequence
  Description of Artificial Sequence: Synthetic oligonucleotide
  Target: SCN9A; (+) strand; PAM type: YTN; PAM sequence: TTT
ccttcaaaaatcataagtct

SEQ ID NO: 106752 - DNA, 20 bp, Artificial Sequence
  Description of Artificial Sequence: Synthetic oligonucleotide
  Target: SCN9A; (+) strand; PAM type: YTN; PAM sequence: TTC
cttcaaaaatcataagtctc

SEQ ID NO: 106753 - DNA, 20 bp, Artificial Sequence
  Description of Artificial Sequence: Synthetic oligonucleotide
  Target: SCN9A; (+) strand; PAM type: YTN; PAM sequence: CTT
caaaaatcataagtctctaa

SEQ ID NO: 106754 - DNA, 20 bp, Artificial Sequence
  Description of Artificial Sequence: Synthetic oligonucleotide
  Target: SCN9A; (+) strand; PAM type: YTN; PAM sequence: TTC
aaaaatcataagtctctaat

SEQ ID NO: 106755 - DNA, 20 bp, Artificial Sequence
  Description of Artificial Sequence: Synthetic oligonucleotide
  Target: SCN9A; (+) strand; PAM type: YTN; PAM sequence: CTC
taatatttctataacctagt

SEQ ID NO: 106756 - DNA, 20 bp, Artificial Sequence
  Description of Artificial Sequence: Synthetic oligonucleotide
  Target: SCN9A; (+) strand; PAM type: YTN; PAM sequence: CTA
atatttctataacctagtgg

SEQ ID NO: 106757 - DNA, 20 bp, Artificial Sequence
  Description of Artificial Sequence: Synthetic oligonucleotide
  Target: SCN9A; (+) strand; PAM type: YTN; PAM sequence: TTT
ctataacctagtgggtatca

SEQ ID NO: 106758 - DNA, 20 bp, Artificial Sequence
  Description of Artificial Sequence: Synthetic oligonucleotide
  Target: SCN9A; (+) strand; PAM type: YTN; PAM sequence: TTC
tataacctagtgggtatcac

SEQ ID NO: 106759 - DNA, 20 bp, Artificial Sequence
  Description of Artificial Sequence: Synthetic oligonucleotide
  Target: SCN9A; (+) strand; PAM type: YTN; PAM sequence: CTA
taacctagtgggtatcacaa

SEQ ID NO: 106760 - DNA, 20 bp, Artificial Sequence
  Description of Artificial Sequence: Synthetic oligonucleotide
  Target: SCN9A; (+) strand; PAM type: YTN; PAM sequence: CTA
gtgggtatcacaaatcaaaa

SEQ ID NO: 106761 - DNA, 20 bp, Artificial Sequence
  Description of Artificial Sequence: Synthetic oligonucleotide
  Target: SCN9A; (+) strand; PAM type: YTN; PAM sequence: TTT
gtatcatctttgtattatca

SEQ ID NO: 106762 - DNA, 20 bp, Artificial Sequence
  Description of Artificial Sequence: Synthetic oligonucleotide
  Target: SCN9A; (+) strand; PAM type: YTN; PAM sequence: TTG
tatcatctttgtattatcat

SEQ ID NO: 106763 - DNA, 20 bp, Artificial Sequence
  Description of Artificial Sequence: Synthetic oligonucleotide
  Target: SCN9A; (+) strand; PAM type: YTN; PAM sequence: CTT
tgtattatcatgttaaacaa

SEQ ID NO: 106764 - DNA, 20 bp, Artificial Sequence
  Description of Artificial Sequence: Synthetic oligonucleotide
  Target: SCN9A; (+) strand; PAM type: YTN; PAM sequence: TTT
gtattatcatgttaaacaag

SEQ ID NO: 106765 - DNA, 20 bp, Artificial Sequence
  Description of Artificial Sequence: Synthetic oligonucleotide
  Target: SCN9A; (+) strand; PAM type: YTN; PAM sequence: TTG
tattatcatgttaaacaaga

SEQ ID NO: 106766 - DNA, 20 bp, Artificial Sequence
  Description of Artificial Sequence: Synthetic oligonucleotide
  Target: SCN9A; (+) strand; PAM type: YTN; PAM sequence: TTA
tcatgttaaacaagagaaga

SEQ ID NO: 106767 - DNA, 20 bp, Artificial Sequence
  Description of Artificial Sequence: Synthetic oligonucleotide
  Target: SCN9A; (+) strand; PAM type: YTN; PAM sequence: TTA
aacaagagaagaaatattaa

SEQ ID NO: 106768 - DNA, 20 bp, Artificial Sequence
  Description of Artificial Sequence: Synthetic oligonucleotide
  Target: SCN9A; (+) strand; PAM type: YTN; PAM sequence: TTA
ataaaatgtatacttgattc

SEQ ID NO: 106769 - DNA, 20 bp, Artificial Sequence
  Description of Artificial Sequence: Synthetic oligonucleotide
  Target: SCN9A; (+) strand; PAM type: YTN; PAM sequence: CTT
gattcaaagtctcattttga

SEQ ID NO: 106770 - DNA, 20 bp, Artificial Sequence
  Description of Artificial Sequence: Synthetic oligonucleotide
  Target: SCN9A; (+) strand; PAM type: YTN; PAM sequence: TTG
attcaaagtctcattttgat

SEQ ID NO: 106771 - DNA, 20 bp, Artificial Sequence
  Description of Artificial Sequence: Synthetic oligonucleotide
  Target: SCN9A; (+) strand; PAM type: YTN; PAM sequence: TTC
aaagtctcattttgattaat

SEQ ID NO: 106772 - DNA, 20 bp, Artificial Sequence
  Description of Artificial Sequence: Synthetic oligonucleotide
  Target: SCN9A; (+) strand; PAM type: YTN; PAM sequence: CTC
attttgattaatggtcttcg

SEQ ID NO: 106773 - DNA, 20 bp, Artificial Sequence
  Description of Artificial Sequence: Synthetic oligonucleotide
  Target: SCN9A; (+) strand; PAM type: YTN; PAM sequence: TTT
tgattaatggtcttcgcaag

SEQ ID NO: 106774 - DNA, 20 bp, Artificial Sequence
  Description of Artificial Sequence: Synthetic oligonucleotide
  Target: SCN9A; (+) strand; PAM type: YTN; PAM sequence: TTT
gattaatggtcttcgcaagt

SEQ ID NO: 106775 - DNA, 20 bp, Artificial Sequence
  Description of Artificial Sequence: Synthetic oligonucleotide
  Target: SCN9A; (+) strand; PAM type: YTN; PAM sequence: TTG
attaatggtcttcgcaagtt

SEQ ID NO: 106776 - DNA, 20 bp, Artificial Sequence
  Description of Artificial Sequence: Synthetic oligonucleotide
  Target: SCN9A; (+) strand; PAM type: YTN; PAM sequence: TTA
atggtcttcgcaagtttcct

SEQ ID NO: 106777 - DNA, 20 bp, Artificial Sequence
  Description of Artificial Sequence: Synthetic oligonucleotide
  Target: SCN9A; (+) strand; PAM type: YTN; PAM sequence: CTT
cgcaagtttcctgatataga

SEQ ID NO: 106778 - DNA, 20 bp, Artificial Sequence
  Description of Artificial Sequence: Synthetic oligonucleotide
  Target: SCN9A; (+) strand; PAM type: YTN; PAM sequence: TTC
gcaagtttcctgatatagac

SEQ ID NO: 106779 - DNA, 20 bp, Artificial Sequence
  Description of Artificial Sequence: Synthetic oligonucleotide
  Target: SCN9A; (+) strand; PAM type: YTN; PAM sequence: TTT
cctgatatagacccgagctg

SEQ ID NO: 106780 - DNA, 20 bp, Artificial Sequence
  Description of Artificial Sequence: Synthetic oligonucleotide
  Target: SCN9A; (+) strand; PAM type: YTN; PAM sequence: TTC
ctgatatagacccgagctga

SEQ ID NO: 106781 - DNA, 20 bp, Artificial Sequence
  Description of Artificial Sequence: Synthetic oligonucleotide
  Target: SCN9A; (+) strand; PAM type: YTN; PAM sequence: CTG
atatagacccgagctgacta

SEQ ID NO: 106782 - DNA, 20 bp, Artificial Sequence
  Description of Artificial Sequence: Synthetic oligonucleotide
  Target: SCN9A; (+) strand; PAM type: YTN; PAM sequence: CTG
actaaaacttatttttccaa

SEQ ID NO: 106783 - DNA, 20 bp, Artificial Sequence
  Description of Artificial Sequence: Synthetic oligonucleotide
  Target: SCN9A; (+) strand; PAM type: YTN; PAM sequence: CTA
aaacttatttttccaaatgt

SEQ ID NO: 106784 - DNA, 20 bp, Artificial Sequence
  Description of Artificial Sequence: Synthetic oligonucleotide
  Target: SCN9A; (+) strand; PAM type: YTN; PAM sequence: CTT
atttttccaaatgttttcct

SEQ ID NO: 106785 - DNA, 20 bp, Artificial Sequence
  Description of Artificial Sequence: Synthetic oligonucleotide
  Target: SCN9A; (+) strand; PAM type: YTN; PAM sequence: TTA
tttttccaaatgttttccta

SEQ ID NO: 106786 - DNA, 20 bp, Artificial Sequence
  Description of Artificial Sequence: Synthetic oligonucleotide
  Target: SCN9A; (+) strand; PAM type: YTN; PAM sequence: TTT
ttccaaatgttttcctaaac

SEQ ID NO: 106787 - DNA, 20 bp, Artificial Sequence
  Description of Artificial Sequence: Synthetic oligonucleotide
  Target: SCN9A; (+) strand; PAM type: YTN; PAM sequence: TTT
tccaaatgttttcctaaacc

SEQ ID NO: 106788 - DNA, 20 bp, Artificial Sequence
  Description of Artificial Sequence: Synthetic oligonucleotide
  Target: SCN9A; (+) strand; PAM type: YTN; PAM sequence: TTT
ccaaatgttttcctaaacct

SEQ ID NO: 106789 - DNA, 20 bp, Artificial Sequence
  Description of Artificial Sequence: Synthetic oligonucleotide
  Target: SCN9A; (+) strand; PAM type: YTN; PAM sequence: TTC
caaatgttttcctaaaccta

SEQ ID NO: 106790 - DNA, 20 bp, Artificial Sequence
  Description of Artificial Sequence: Synthetic oligonucleotide
  Target: SCN9A; (+) strand; PAM type: YTN; PAM sequence: TTT
tcctaaacctatggtcctta

SEQ ID NO: 106791 - DNA, 20 bp, Artificial Sequence
  Description of Artificial Sequence: Synthetic oligonucleotide
  Target: SCN9A; (+) strand; PAM type: YTN; PAM sequence: TTT
cctaaacctatggtccttaa

SEQ ID NO: 106792 - DNA, 20 bp, Artificial Sequence
  Description of Artificial Sequence: Synthetic oligonucleotide
  Target: SCN9A; (+) strand; PAM type: YTN; PAM sequence: TTC
ctaaacctatggtccttaac

SEQ ID NO: 106793 - DNA, 20 bp, Artificial Sequence
  Description of Artificial Sequence: Synthetic oligonucleotide
  Target: SCN9A; (+) strand; PAM type: YTN; PAM sequence: CTA
aacctatggtccttaaccat

SEQ ID NO: 106794 - DNA, 20 bp, Artificial Sequence
  Description of Artificial Sequence: Synthetic oligonucleotide
  Target: SCN9A; (+) strand; PAM type: YTN; PAM sequence: CTA
tggtccttaaccatttcaat

SEQ ID NO: 106795 - DNA, 20 bp, Artificial Sequence
  Description of Artificial Sequence: Synthetic oligonucleotide
  Target: SCN9A; (+) strand; PAM type: YTN; PAM sequence: CTT
aaccatttcaattaactggc

SEQ ID NO: 106796 - DNA, 20 bp, Artificial Sequence
  Description of Artificial Sequence: Synthetic oligonucleotide
  Target: SCN9A; (+) strand; PAM type: YTN; PAM sequence: TTA
accatttcaattaactggca

SEQ ID NO: 106797 - DNA, 20 bp, Artificial Sequence
  Description of Artificial Sequence: Synthetic oligonucleotide
  Target: SCN9A; (+) strand; PAM type: YTN; PAM sequence: TTT
caattaactggcaataaaat

SEQ ID NO: 106798 - DNA, 20 bp, Artificial Sequence
  Description of Artificial Sequence: Synthetic oligonucleotide
  Target: SCN9A; (+) strand; PAM type: YTN; PAM sequence: TTC
aattaactggcaataaaatg

SEQ ID NO: 106799 - DNA, 20 bp, Artificial Sequence
  Description of Artificial Sequence: Synthetic oligonucleotide
  Target: SCN9A; (+) strand; PAM type: YTN; PAM sequence: TTA
actggcaataaaatgatcaa

SEQ ID NO: 106800 - DNA, 20 bp, Artificial Sequence
  Description of Artificial Sequence: Synthetic oligonucleotide
  Target: SCN9A; (+) strand; PAM type: YTN; PAM sequence: CTG
gcaataaaatgatcaaaaga

SEQ ID NO: 106801 - DNA, 20 bp, Artificial Sequence
  Description of Artificial Sequence: Synthetic oligonucleotide
  Target: SCN9A; (+) strand; PAM type: YTN; PAM sequence: TTA
gagaaatataaaaaaagaga

SEQ ID NO: 106802 - DNA, 20 bp, Artificial Sequence
  Description of Artificial Sequence: Synthetic oligonucleotide
  Target: SCN9A; (+) strand; PAM type: YTN; PAM sequence: TTT
agcatataactctaatgtgg

SEQ ID NO: 106803 - DNA, 20 bp, Artificial Sequence
  Description of Artificial Sequence: Synthetic oligonucleotide
  Target: SCN9A; (+) strand; PAM type: YTN; PAM sequence: TTA
gcatataactctaatgtgga

SEQ ID NO: 106804 - DNA, 20 bp, Artificial Sequence
  Description of Artificial Sequence: Synthetic oligonucleotide
  Target: SCN9A; (+) strand; PAM type: YTN; PAM sequence: CTC
taatgtggaaggctatatca

SEQ ID NO: 106805 - DNA, 20 bp, Artificial Sequence
  Description of Artificial Sequence: Synthetic oligonucleotide
  Target: SCN9A; (+) strand; PAM type: YTN; PAM sequence: CTA
atgtggaaggctatatcagg

SEQ ID NO: 106806 - DNA, 20 bp, Artificial Sequence
  Description of Artificial Sequence: Synthetic oligonucleotide
  Target: SCN9A; (+) strand; PAM type: YTN; PAM sequence: CTA
tatcaggaatatattttttt

SEQ ID NO: 106807 - DNA, 20 bp, Artificial Sequence
  Description of Artificial Sequence: Synthetic oligonucleotide
  Target: SCN9A; (+) strand; PAM type: YTN; PAM sequence: TTT
ttttccttaaattttaattc

SEQ ID NO: 106808 - DNA, 20 bp, Artificial Sequence
  Description of Artificial Sequence: Synthetic oligonucleotide
  Target: SCN9A; (+) strand; PAM type: YTN; PAM sequence: TTT
tttccttaaattttaattct

SEQ ID NO: 106809 - DNA, 20 bp, Artificial Sequence
  Description of Artificial Sequence: Synthetic oligonucleotide
  Target: SCN9A; (+) strand; PAM type: YTN; PAM sequence: TTT
ttccttaaattttaattcta

SEQ ID NO: 106810 - DNA, 20 bp, Artificial Sequence
  Description of Artificial Sequence: Synthetic oligonucleotide
  Target: SCN9A; (+) strand; PAM type: YTN; PAM sequence: TTT
tccttaaattttaattctat

SEQ ID NO: 106811 - DNA, 20 bp, Artificial Sequence
  Description of Artificial Sequence: Synthetic oligonucleotide
  Target: SCN9A; (+) strand; PAM type: YTN; PAM sequence: TTT
ccttaaattttaattctatg

SEQ ID NO: 106812 - DNA, 20 bp, Artificial Sequence
  Description of Artificial Sequence: Synthetic oligonucleotide
  Target: SCN9A; (+) strand; PAM type: YTN; PAM sequence: TTC
cttaaattttaattctatga

SEQ ID NO: 106813 - DNA, 20 bp, Artificial Sequence
  Description of Artificial Sequence: Synthetic oligonucleotide
  Target: SCN9A; (+) strand; PAM type: YTN; PAM sequence: CTT
aaattttaattctatgatat

SEQ ID NO: 106814 - DNA, 20 bp, Artificial Sequence
  Description of Artificial Sequence: Synthetic oligonucleotide
  Target: SCN9A; (+) strand; PAM type: YTN; PAM sequence: TTA
aattttaattctatgatatt

SEQ ID NO: 106815 - DNA, 20 bp, Artificial Sequence
  Description of Artificial Sequence: Synthetic oligonucleotide
  Target: SCN9A; (+) strand; PAM type: YTN; PAM sequence: TTT
taattctatgatattggtag

SEQ ID NO: 106816 - DNA, 20 bp, Artificial Sequence
  Description of Artificial Sequence: Synthetic oligonucleotide
  Target: SCN9A; (+) strand; PAM type: YTN; PAM sequence: TTT
aattctatgatattggtagt

SEQ ID NO: 106817 - DNA, 20 bp, Artificial Sequence
  Description of Artificial Sequence: Synthetic oligonucleotide
  Target: SCN9A; (+) strand; PAM type: YTN; PAM sequence: TTA
attctatgatattggtagtt

SEQ ID NO: 106818 - DNA, 20 bp, Artificial Sequence
  Description of Artificial Sequence: Synthetic oligonucleotide
  Target: SCN9A; (+) strand; PAM type: YTN; PAM sequence: TTC
tatgatattggtagttcctc

SEQ ID NO: 106819 - DNA, 20 bp, Artificial Sequence
  Description of Artificial Sequence: Synthetic oligonucleotide
  Target: SCN9A; (+) strand; PAM type: YTN; PAM sequence: CTA
tgatattggtagttcctcca

SEQ ID NO: 106820 - DNA, 20 bp, Artificial Sequence
  Description of Artificial Sequence: Synthetic oligonucleotide
  Target: SCN9A; (+) strand; PAM type: YTN; PAM sequence: TTG
gtagttcctccattagtcaa

SEQ ID NO: 106821 - DNA, 20 bp, Artificial Sequence
  Description of Artificial Sequence: Synthetic oligonucleotide
  Target: SCN9A; (+) strand; PAM type: YTN; PAM sequence: TTC
ctccattagtcaagagttgg

SEQ ID NO: 106822 - DNA, 20 bp, Artificial Sequence
  Description of Artificial Sequence: Synthetic oligonucleotide
  Target: SCN9A; (+) strand; PAM type: YTN; PAM sequence: CTC
cattagtcaagagttggtta

SEQ ID NO: 106823 - DNA, 20 bp, Artificial Sequence
  Description of Artificial Sequence: Synthetic oligonucleotide
  Target: SCN9A; (+) strand; PAM type: YTN; PAM sequence: TTA
gtcaagagttggttatcaac

SEQ ID NO: 106824 - DNA, 20 bp, Artificial Sequence
  Description of Artificial Sequence: Synthetic oligonucleotide
  Target: SCN9A; (+) strand; PAM type: YTN; PAM sequence: TTG
gttatcaactttatgaattt

SEQ ID NO: 106825 - DNA, 20 bp, Artificial Sequence
  Description of Artificial Sequence: Synthetic oligonucleotide
  Target: SCN9A; (+) strand; PAM type: YTN; PAM sequence: TTA
tcaactttatgaattttctt

SEQ ID NO: 106826 - DNA, 20 bp, Artificial Sequence
  Description of Artificial Sequence: Synthetic oligonucleotide
  Target: SCN9A; (+) strand; PAM type: YTN; PAM sequence: CTT
tatgaattttcttctgtata

SEQ ID NO: 106827 - DNA, 20 bp, Artificial Sequence
  Description of Artificial Sequence: Synthetic oligonucleotide
  Target: SCN9A; (+) strand; PAM type: YTN; PAM sequence: TTT
atgaattttcttctgtatac

SEQ ID NO: 106828 - DNA, 20 bp, Artificial Sequence
  Description of Artificial Sequence: Synthetic oligonucleotide
  Target: SCN9A; (+) strand; PAM type: YTN; PAM sequence: TTA
tgaattttcttctgtatact

SEQ ID NO: 106829 - DNA, 20 bp, Artificial Sequence
  Description of Artificial Sequence: Synthetic oligonucleotide
  Target: SCN9A; (+) strand; PAM type: YTN; PAM sequence: TTT
tcttctgtatactttctttg

SEQ ID NO: 106830 - DNA, 20 bp, Artificial Sequence
  Description of Artificial Sequence: Synthetic oligonucleotide
  Target: SCN9A; (+) strand; PAM type: YTN; PAM sequence: TTT
cttctgtatactttctttgc

SEQ ID NO: 106831 - DNA, 20 bp, Artificial Sequence
  Description of Artificial Sequence: Synthetic oligonucleotide
  Target: SCN9A; (+) strand; PAM type: YTN; PAM sequence: TTC
ttctgtatactttctttgcc

SEQ ID NO: 106832 - DNA, 20 bp, Artificial Sequence
  Description of Artificial Sequence: Synthetic oligonucleotide
  Target: SCN9A; (+) strand; PAM type: YTN; PAM sequence: CTT
ctgtatactttctttgccaa

SEQ ID NO: 106833 - DNA, 20 bp, Artificial Sequence
  Description of Artificial Sequence: Synthetic oligonucleotide
  Target: SCN9A; (+) strand; PAM type: YTN; PAM sequence: TTC
tgtatactttctttgccaag

SEQ ID NO: 106834 - DNA, 20 bp, Artificial Sequence
  Description of Artificial Sequence: Synthetic oligonucleotide
  Target: SCN9A; (+) strand; PAM type: YTN; PAM sequence: CTG
tatactttctttgccaagaa

SEQ ID NO: 106835 - DNA, 20 bp, Artificial Sequence
  Description of Artificial Sequence: Synthetic oligonucleotide
  Target: SCN9A; (+) strand; PAM type: YTN; PAM sequence: CTT
tctttgccaagaattaataa

SEQ ID NO: 106836 - DNA, 20 bp, Artificial Sequence
  Description of Artificial Sequence: Synthetic oligonucleotide
  Target: SCN9A; (+) strand; PAM type: YTN; PAM sequence: TTT
ctttgccaagaattaataat

SEQ ID NO: 106837 - DNA, 20 bp, Artificial Sequence
  Description of Artificial Sequence: Synthetic oligonucleotide
  Target: SCN9A; (+) strand; PAM type: YTN; PAM sequence: TTC
tttgccaagaattaataatt

SEQ ID NO: 106838 - DNA, 20 bp, Artificial Sequence
  Description of Artificial Sequence: Synthetic oligonucleotide
  Target: SCN9A; (+) strand; PAM type: YTN; PAM sequence: CTT
tgccaagaattaataattaa

SEQ ID NO: 106839 - DNA, 20 bp, Artificial Sequence
  Description of Artificial Sequence: Synthetic oligonucleotide
  Target: SCN9A; (+) strand; PAM type: YTN; PAM sequence: TTT
gccaagaattaataattaaa

SEQ ID NO: 106840 - DNA, 20 bp, Artificial Sequence
  Description of Artificial Sequence: Synthetic oligonucleotide
  Target: SCN9A; (+) strand; PAM type: YTN; PAM sequence: TTG
ccaagaattaataattaaag

SEQ ID NO: 106841 - DNA, 20 bp, Artificial Sequence
  Description of Artificial Sequence: Synthetic oligonucleotide
  Target: SCN9A; (+) strand; PAM type: YTN; PAM sequence: TTA
ataattaaagaataataata

SEQ ID NO: 106842 - DNA, 20 bp, Artificial Sequence
  Description of Artificial Sequence: Synthetic oligonucleotide
  Target: SCN9A; (+) strand; PAM type: YTN; PAM sequence: TTA
aagaataataatatgagtta

SEQ ID NO: 106843 - DNA, 20 bp, Artificial Sequence
  Description of Artificial Sequence: Synthetic oligonucleotide
  Target: SCN9A; (+) strand; PAM type: YTN; PAM sequence: TTA
gttaacactaattctacacg

SEQ ID NO: 106844 - DNA, 20 bp, Artificial Sequence
  Description of Artificial Sequence: Synthetic oligonucleotide
  Target: SCN9A; (+) strand; PAM type: YTN; PAM sequence: TTA
acactaattctacacgaatg

SEQ ID NO: 106845 - DNA, 20 bp, Artificial Sequence
  Description of Artificial Sequence: Synthetic oligonucleotide
  Target: SCN9A; (+) strand; PAM type: YTN; PAM sequence: CTA
attctacacgaatgaaacac

SEQ ID NO: 106846 - DNA, 20 bp, Artificial Sequence
  Description of Artificial Sequence: Synthetic oligonucleotide
  Target: SCN9A; (+) strand; PAM type: YTN; PAM sequence: TTC
tacacgaatgaaacactcac

SEQ ID NO: 106847 - DNA, 20 bp, Artificial Sequence
  Description of Artificial Sequence: Synthetic oligonucleotide
  Target: SCN9A; (+) strand; PAM type: YTN; PAM sequence: CTA
cacgaatgaaacactcacca

SEQ ID NO: 106848 - DNA, 20 bp, Artificial Sequence
  Description of Artificial Sequence: Synthetic oligonucleotide
  Target: SCN9A; (+) strand; PAM type: YTN; PAM sequence: CTC
accaatatatcccctctgtt

SEQ ID NO: 106849 - DNA, 20 bp, Artificial Sequence
  Description of Artificial Sequence: Synthetic oligonucleotide
  Target: SCN9A; (+) strand; PAM type: YTN; PAM sequence: CTC
tgttttttactataaatcta

SEQ ID NO: 106850 - DNA, 20 bp, Artificial Sequence
  Description of Artificial Sequence: Synthetic oligonucleotide
  Target: SCN9A; (+) strand; PAM type: YTN; PAM sequence: CTG
ttttttactataaatctata

SEQ ID NO: 106851 - DNA, 20 bp, Artificial Sequence
  Description of Artificial Sequence: Synthetic oligonucleotide
  Target: SCN9A; (+) strand; PAM type: YTN; PAM sequence: TTT
tttactataaatctatattg

SEQ ID NO: 106852 - DNA, 20 bp, Artificial Sequence
  Description of Artificial Sequence: Synthetic oligonucleotide
  Target: SCN9A; (+) strand; PAM type: YTN; PAM sequence: TTT
ttactataaatctatattgc

SEQ ID NO: 106853 - DNA, 20 bp, Artificial Sequence
  Description of Artificial Sequence: Synthetic oligonucleotide
  Target: SCN9A; (+) strand; PAM type: YTN; PAM sequence: TTT
tactataaatctatattgcc

SEQ ID NO: 106854 - DNA, 20 bp, Artificial Sequence
  Description of Artificial Sequence: Synthetic oligonucleotide
  Target: SCN9A; (+) strand; PAM type: YTN; PAM sequence: TTT
actataaatctatattgcct

SEQ ID NO: 106855 - DNA, 20 bp, Artificial Sequence
  Description of Artificial Sequence: Synthetic oligonucleotide
  Target: SCN9A; (+) strand; PAM type: YTN; PAM sequence: TTA
ctataaatctatattgcctt

SEQ ID NO: 106856 - DNA, 20 bp, Artificial Sequence
  Description of Artificial Sequence: Synthetic oligonucleotide
  Target: SCN9A; (+) strand; PAM type: YTN; PAM sequence: CTA
taaatctatattgcctttca

SEQ ID NO: 106857 - DNA, 20 bp, Artificial Sequence
  Description of Artificial Sequence: Synthetic oligonucleotide
  Target: SCN9A; (+) strand; PAM type: YTN; PAM sequence: CTA
tattgcctttcaaaggaaaa

SEQ ID NO: 106858 - DNA, 20 bp, Artificial Sequence
  Description of Artificial Sequence: Synthetic oligonucleotide
  Target: SCN9A; (+) strand; PAM type: YTN; PAM sequence: TTG
cctttcaaaggaaaacataa

SEQ ID NO: 106859 - DNA, 20 bp, Artificial Sequence
  Description of Artificial Sequence: Synthetic oligonucleotide
  Target: SCN9A; (+) strand; PAM type: YTN; PAM sequence: CTT
tcaaaggaaaacataactct

SEQ ID NO: 106860 - DNA, 20 bp, Artificial Sequence
  Description of Artificial Sequence: Synthetic oligonucleotide
  Target: SCN9A; (+) strand; PAM type: YTN; PAM sequence: TTT
caaaggaaaacataactctc

SEQ ID NO: 106861 - DNA, 20 bp, Artificial Sequence
  Description of Artificial Sequence: Synthetic oligonucleotide
  Target: SCN9A; (+) strand; PAM type: YTN; PAM sequence: TTC
aaaggaaaacataactctca

SEQ ID NO: 106862 - DNA, 20 bp, Artificial Sequence
  Description of Artificial Sequence: Synthetic oligonucleotide
  Target: SCN9A; (+) strand; PAM type: YTN; PAM sequence: CTC
tcacaccagtgtccatgatc

SEQ ID NO: 106863 - DNA, 20 bp, Artificial Sequence
  Description of Artificial Sequence: Synthetic oligonucleotide
  Target: SCN9A; (+) strand; PAM type: YTN; PAM sequence: CTC
acaccagtgtccatgatcaa

SEQ ID NO: 106864 - DNA, 20 bp, Artificial Sequence
  Description of Artificial Sequence: Synthetic oligonucleotide
  Target: SCN9A; (+) strand; PAM type: YTN; PAM sequence: TTA
tattatccattgttcaaagg

SEQ ID NO: 106865 - DNA, 20 bp, Artificial Sequence
  Description of Artificial Sequence: Synthetic oligonucleotide
  Target: SCN9A; (+) strand; PAM type: YTN; PAM sequence: TTA
tccattgttcaaaggcccac

SEQ ID NO: 106866 - DNA, 20 bp, Artificial Sequence
  Description of Artificial Sequence: Synthetic oligonucleotide
  Target: SCN9A; (+) strand; PAM type: YTN; PAM sequence: TTG
ttcaaaggcccacttcaaaa

SEQ ID NO: 106867 - DNA, 20 bp, Artificial Sequence
  Description of Artificial Sequence: Synthetic oligonucleotide
  Target: SCN9A; (+) strand; PAM type: YTN; PAM sequence: TTC
aaaggcccacttcaaaaacc

SEQ ID NO: 106868 - DNA, 20 bp, Artificial Sequence
  Description of Artificial Sequence: Synthetic oligonucleotide
  Target: SCN9A; (+) strand; PAM type: YTN; PAM sequence: CTT
caaaaacctcccttaagtct

SEQ ID NO: 106869 - DNA, 20 bp, Artificial Sequence
  Description of Artificial Sequence: Synthetic oligonucleotide
  Target: SCN9A; (+) strand; PAM type: YTN; PAM sequence: TTC
aaaaacctcccttaagtctc

SEQ ID NO: 106870 - DNA, 20 bp, Artificial Sequence
  Description of Artificial Sequence: Synthetic oligonucleotide
  Target: SCN9A; (+) strand; PAM type: YTN; PAM sequence: CTC
ccttaagtctcaatctagaa

SEQ ID NO: 106871 - DNA, 20 bp, Artificial Sequence
  Description of Artificial Sequence: Synthetic oligonucleotide
  Target: SCN9A; (+) strand; PAM type: YTN; PAM sequence: CTT
aagtctcaatctagaactct

SEQ ID NO: 106872 - DNA, 20 bp, Artificial Sequence
  Description of Artificial Sequence: Synthetic oligonucleotide
  Target: SCN9A; (+) strand; PAM type: YTN; PAM sequence: TTA
agtctcaatctagaactctt

SEQ ID NO: 106873 - DNA, 20 bp, Artificial Sequence
  Description of Artificial Sequence: Synthetic oligonucleotide
  Target: SCN9A; (+) strand; PAM type: YTN; PAM sequence: CTC
aatctagaactctttcttta

SEQ ID NO: 106874 - DNA, 20 bp, Artificial Sequence
  Description of Artificial Sequence: Synthetic oligonucleotide
  Target: SCN9A; (+) strand; PAM type: YTN; PAM sequence: CTA
gaactctttctttaagtgtc

SEQ ID NO: 106875 - DNA, 20 bp, Artificial Sequence
  Description of Artificial Sequence: Synthetic oligonucleotide
  Target: SCN9A; (+) strand; PAM type: YTN; PAM sequence: CTC
tttctttaagtgtcagaagc

SEQ ID NO: 106876 - DNA, 20 bp, Artificial Sequence
  Description of Artificial Sequence: Synthetic oligonucleotide
  Target: SCN9A; (+) strand; PAM type: YTN; PAM sequence: CTT
tctttaagtgtcagaagcat

SEQ ID NO: 106877 - DNA, 20 bp, Artificial Sequence
  Description of Artificial Sequence: Synthetic oligonucleotide
  Target: SCN9A; (+) strand; PAM type: YTN; PAM sequence: TTT
ctttaagtgtcagaagcatt

SEQ ID NO: 106878 - DNA, 20 bp, Artificial Sequence
  Description of Artificial Sequence: Synthetic oligonucleotide
  Target: SCN9A; (+) strand; PAM type: YTN; PAM sequence: TTC
tttaagtgtcagaagcattt

SEQ ID NO: 106879 - DNA, 20 bp, Artificial Sequence
  Description of Artificial Sequence: Synthetic oligonucleotide
  Target: SCN9A; (+) strand; PAM type: YTN; PAM sequence: CTT
taagtgtcagaagcatttta

SEQ ID NO: 106880 - DNA, 20 bp, Artificial Sequence
  Description of Artificial Sequence: Synthetic oligonucleotide
  Target: SCN9A; (+) strand; PAM type: YTN; PAM sequence: TTT
aagtgtcagaagcattttat

SEQ ID NO: 106881 - DNA, 20 bp, Artificial Sequence
  Description of Artificial Sequence: Synthetic oligonucleotide
  Target: SCN9A; (+) strand; PAM type: YTN; PAM sequence: TTA
agtgtcagaagcattttatt

SEQ ID NO: 106882 - DNA, 20 bp, Artificial Sequence
  Description of Artificial Sequence: Synthetic oligonucleotide
  Target: SCN9A; (+) strand; PAM type: YTN; PAM sequence: TTT
tatttaaccttattggtaga

SEQ ID NO: 106883 - DNA, 20 bp, Artificial Sequence
  Description of Artificial Sequence: Synthetic oligonucleotide
  Target: SCN9A; (+) strand; PAM type: YTN; PAM sequence: TTT
atttaaccttattggtagaa

SEQ ID NO: 106884 - DNA, 20 bp, Artificial Sequence
  Description of Artificial Sequence: Synthetic oligonucleotide
  Target: SCN9A; (+) strand; PAM type: YTN; PAM sequence: TTA
tttaaccttattggtagaac

SEQ ID NO: 106885 - DNA, 20 bp, Artificial Sequence
  Description of Artificial Sequence: Synthetic oligonucleotide
  Target: SCN9A; (+) strand; PAM type: YTN; PAM sequence: TTT
aaccttattggtagaactca

SEQ ID NO: 106886 - DNA, 20 bp, Artificial Sequence
  Description of Artificial Sequence: Synthetic oligonucleotide
  Target: SCN9A; (+) strand; PAM type: YTN; PAM sequence: TTA
accttattggtagaactcat

SEQ ID NO: 106887 - DNA, 20 bp, Artificial Sequence
  Description of Artificial Sequence: Synthetic oligonucleotide
  Target: SCN9A; (+) strand; PAM type: YTN; PAM sequence: CTT
attggtagaactcatcactt

SEQ ID NO: 106888 - DNA, 20 bp, Artificial Sequence
  Description of Artificial Sequence: Synthetic oligonucleotide
  Target: SCN9A; (+) strand; PAM type: YTN; PAM sequence: TTA
ttggtagaactcatcacttc

SEQ ID NO: 106889 - DNA, 20 bp, Artificial Sequence
  Description of Artificial Sequence: Synthetic oligonucleotide
  Target: SCN9A; (+) strand; PAM type: YTN; PAM sequence: TTG
gtagaactcatcacttcttc

SEQ ID NO: 106890 - DNA, 20 bp, Artificial Sequence
  Description of Artificial Sequence: Synthetic oligonucleotide
  Target: SCN9A; (+) strand; PAM type: YTN; PAM sequence: CTC
atcacttcttccttgtctga

SEQ ID NO: 106891 - DNA, 20 bp, Artificial Sequence
  Description of Artificial Sequence: Synthetic oligonucleotide
  Target: SCN9A; (+) strand; PAM type: YTN; PAM sequence: CTT
cttccttgtctgataacttt

SEQ ID NO: 106892 - DNA, 20 bp, Artificial Sequence
  Description of Artificial Sequence: Synthetic oligonucleotide
  Target: SCN9A; (+) strand; PAM type: YTN; PAM sequence: TTC
ttccttgtctgataactttt

SEQ ID NO: 106893 - DNA, 20 bp, Artificial Sequence
  Description of Artificial Sequence: Synthetic oligonucleotide
  Target: SCN9A; (+) strand; PAM type: YTN; PAM sequence: CTT
ccttgtctgataacttttgt

SEQ ID NO: 106894 - DNA, 20 bp, Artificial Sequence
  Description of Artificial Sequence: Synthetic oligonucleotide
  Target: SCN9A; (+) strand; PAM type: YTN; PAM sequence: TTC
cttgtctgataacttttgtg

SEQ ID NO: 106895 - DNA, 20 bp, Artificial Sequence
  Description of Artificial Sequence: Synthetic oligonucleotide
  Target: SCN9A; (+) strand; PAM type: YTN; PAM sequence: CTT
gtctgataacttttgtgttc

SEQ ID NO: 106896 - DNA, 20 bp, Artificial Sequence
  Description of Artificial Sequence: Synthetic oligonucleotide
  Target: SCN9A; (+) strand; PAM type: YTN; PAM sequence: TTG
tctgataacttttgtgttcc

SEQ ID NO: 106897 - DNA, 20 bp, Artificial Sequence
  Description of Artificial Sequence: Synthetic oligonucleotide
  Target: SCN9A; (+) strand; PAM type: YTN; PAM sequence: CTG
ataacttttgtgttccactt

SEQ ID NO: 106898 - DNA, 20 bp, Artificial Sequence
  Description of Artificial Sequence: Synthetic oligonucleotide
  Target: SCN9A; (+) strand; PAM type: YTN; PAM sequence: CTT
ttgtgttccacttttctgtg

SEQ ID NO: 106899 - DNA, 20 bp, Artificial Sequence
  Description of Artificial Sequence: Synthetic oligonucleotide
  Target: SCN9A; (+) strand; PAM type: YTN; PAM sequence: TTT
tgtgttccacttttctgtgc

SEQ ID NO: 106900 - DNA, 20 bp, Artificial Sequence
  Description of Artificial Sequence: Synthetic oligonucleotide
  Target: SCN9A; (+) strand; PAM type: YTN; PAM sequence: TTT
gtgttccacttttctgtgcc

SEQ ID NO: 106901 - DNA, 20 bp, Artificial Sequence
  Description of Artificial Sequence: Synthetic oligonucleotide
  Target: SCN9A; (+) strand; PAM type: YTN; PAM sequence: TTG
tgttccacttttctgtgccc

SEQ ID NO: 106902 - DNA, 20 bp, Artificial Sequence
  Description of Artificial Sequence: Synthetic oligonucleotide
  Target: SCN9A; (+) strand; PAM type: YTN; PAM sequence: TTC
cacttttctgtgccctaata

SEQ ID NO: 106903 - DNA, 20 bp, Artificial Sequence
  Description of Artificial Sequence: Synthetic oligonucleotide
  Target: SCN9A; (+) strand; PAM type: YTN; PAM sequence: CTT
ttctgtgccctaataagcat

SEQ ID NO: 106904 - DNA, 20 bp, Artificial Sequence
  Description of Artificial Sequence: Synthetic oligonucleotide
  Target: SCN9A; (+) strand; PAM type: YTN; PAM sequence: TTT
tctgtgccctaataagcatc

SEQ ID NO: 106905 - DNA, 20 bp, Artificial Sequence
  Description of Artificial Sequence: Synthetic oligonucleotide
  Target: SCN9A; (+) strand; PAM type: YTN; PAM sequence: TTT
ctgtgccctaataagcatct

SEQ ID NO: 106906 - DNA, 20 bp, Artificial Sequence
  Description of Artificial Sequence: Synthetic oligonucleotide
  Target: SCN9A; (+) strand; PAM type: YTN; PAM sequence: TTC
tgtgccctaataagcatctt

SEQ ID NO: 106907 - DNA, 20 bp, Artificial Sequence
  Description of Artificial Sequence: Synthetic oligonucleotide
  Target: SCN9A; (+) strand; PAM type: YTN; PAM sequence: CTG
tgccctaataagcatcttaa

SEQ ID NO: 106908 - DNA, 20 bp, Artificial Sequence
  Description of Artificial Sequence: Synthetic oligonucleotide
  Target: SCN9A; (+) strand; PAM type: YTN; PAM sequence: CTA
ataagcatcttaaaaacaag

SEQ ID NO: 106909 - DNA, 20 bp, Artificial Sequence
  Description of Artificial Sequence: Synthetic oligonucleotide
  Target: SCN9A; (+) strand; PAM type: YTN; PAM sequence: CTT
aaaaacaaggattagaccat

SEQ ID NO: 106910 - DNA, 20 bp, Artificial Sequence
  Description of Artificial Sequence: Synthetic oligonucleotide
  Target: SCN9A; (+) strand; PAM type: YTN; PAM sequence: TTA
aaaacaaggattagaccatg

SEQ ID NO: 106911 - DNA, 20 bp, Artificial Sequence
  Description of Artificial Sequence: Synthetic oligonucleotide
  Target: SCN9A; (+) strand; PAM type: YTN; PAM sequence: TTA
gaccatgggtaattggtttt

SEQ ID NO: 106912 - DNA, 20 bp, Artificial Sequence
  Description of Artificial Sequence: Synthetic oligonucleotide
  Target: SCN9A; (+) strand; PAM type: YTN; PAM sequence: TTG
gttttggtcttccaccctaa

SEQ ID NO: 106913 - DNA, 20 bp, Artificial Sequence
  Description of Artificial Sequence: Synthetic oligonucleotide
  Target: SCN9A; (+) strand; PAM type: YTN; PAM sequence: TTT
tggtcttccaccctaaataa

SEQ ID NO: 106914 - DNA, 20 bp, Artificial Sequence
  Description of Artificial Sequence: Synthetic oligonucleotide
  Target: SCN9A; (+) strand; PAM type: YTN; PAM sequence: TTT
ggtcttccaccctaaataat

SEQ ID NO: 106915 - DNA, 20 bp, Artificial Sequence
  Description of Artificial Sequence: Synthetic oligonucleotide
  Target: SCN9A; (+) strand; PAM type: YTN; PAM sequence: TTG
gtcttccaccctaaataata

SEQ ID NO: 106916 - DNA, 20 bp, Artificial Sequence
  Description of Artificial Sequence: Synthetic oligonucleotide
  Target: SCN9A; (+) strand; PAM type: YTN; PAM sequence: CTT
ccaccctaaataatacctaa

SEQ ID NO: 106917 - DNA, 20 bp, Artificial Sequence
  Description of Artificial Sequence: Synthetic oligonucleotide
  Target: SCN9A; (+) strand; PAM type: YTN; PAM sequence: TTC
caccctaaataatacctaaa

SEQ ID NO: 106918 - DNA, 20 bp, Artificial Sequence
  Description of Artificial Sequence: Synthetic oligonucleotide
  Target: SCN9A; (+) strand; PAM type: YTN; PAM sequence: CTA
aataatacctaaacaatgcc

SEQ ID NO: 106919 - DNA, 20 bp, Artificial Sequence
  Description of Artificial Sequence: Synthetic oligonucleotide
  Target: SCN9A; (+) strand; PAM type: YTN; PAM sequence: CTA
aacaatgccttcctatctaa

SEQ ID NO: 106920 - DNA, 20 bp, Artificial Sequence
  Description of Artificial Sequence: Synthetic oligonucleotide
  Target: SCN9A; (+) strand; PAM type: YTN; PAM sequence: CTT
cctatctaaacaatacctaa

SEQ ID NO: 106921 - DNA, 20 bp, Artificial Sequence
  Description of Artificial Sequence: Synthetic oligonucleotide
  Target: SCN9A; (+) strand; PAM type: YTN; PAM sequence: TTC
ctatctaaacaatacctaaa

SEQ ID NO: 106922 - DNA, 20 bp, Artificial Sequence
  Description of Artificial Sequence: Synthetic oligonucleotide
  Target: SCN9A; (+) strand; PAM type: YTN; PAM sequence: CTA
tctaaacaatacctaaatac

SEQ ID NO: 106923 - DNA, 20 bp, Artificial Sequence
  Description of Artificial Sequence: Synthetic oligonucleotide
  Target: SCN9A; (+) strand; PAM type: YTN; PAM sequence: CTA
aacaatacctaaataccttt

SEQ ID NO: 106924 - DNA, 20 bp, Artificial Sequence
  Description of Artificial Sequence: Synthetic oligonucleotide
  Target: SCN9A; (+) strand; PAM type: YTN; PAM sequence: CTA
aatacctttcttttcacaga

SEQ ID NO: 106925 - DNA, 20 bp, Artificial Sequence
  Description of Artificial Sequence: Synthetic oligonucleotide
  Target: SCN9A; (+) strand; PAM type: YTN; PAM sequence: CTT
tcttttcacagagaagatac

SEQ ID NO: 106926 - DNA, 20 bp, Artificial Sequence
  Description of Artificial Sequence: Synthetic oligonucleotide
  Target: SCN9A; (+) strand; PAM type: YTN; PAM sequence: TTT
cttttcacagagaagatact

SEQ ID NO: 106927 - DNA, 20 bp, Artificial Sequence
  Description of Artificial Sequence: Synthetic oligonucleotide
  Target: SCN9A; (+) strand; PAM type: YTN; PAM sequence: TTC
ttttcacagagaagatacta

SEQ ID NO: 106928 - DNA, 20 bp, Artificial Sequence
  Description of Artificial Sequence: Synthetic oligonucleotide
  Target: SCN9A; (+) strand; PAM type: YTN; PAM sequence: CTT
ttcacagagaagatactaaa

SEQ ID NO: 106929 - DNA, 20 bp, Artificial Sequence
  Description of Artificial Sequence: Synthetic oligonucleotide
  Target: SCN9A; (+) strand; PAM type: YTN; PAM sequence: TTT
tcacagagaagatactaaaa

SEQ ID NO: 106930 - DNA, 20 bp, Artificial Sequence
  Description of Artificial Sequence: Synthetic oligonucleotide
  Target: SCN9A; (+) strand; PAM type: YTN; PAM sequence: TTT
cacagagaagatactaaaaa

SEQ ID NO: 106931 - DNA, 20 bp, Artificial Sequence
  Description of Artificial Sequence: Synthetic oligonucleotide
  Target: SCN9A; (+) strand; PAM type: YTN; PAM sequence: TTC
acagagaagatactaaaaaa

SEQ ID NO: 106932 - DNA, 20 bp, Artificial Sequence
  Description of Artificial Sequence: Synthetic oligonucleotide
  Target: SCN9A; (+) strand; PAM type: YTN; PAM sequence: CTA
aaaaatattgagtggaaaat

SEQ ID NO: 106933 - DNA, 20 bp, Artificial Sequence
  Description of Artificial Sequence: Synthetic oligonucleotide
  Target: SCN9A; (+) strand; PAM type: YTN; PAM sequence: TTG
agtggaaaatgtggtgagag

SEQ ID NO: 106934 - DNA, 20 bp, Artificial Sequence
  Description of Artificial Sequence: Synthetic oligonucleotide
  Target: SCN9A; (+) strand; PAM type: YTN; PAM sequence: CTT
tccctttgaatttgcctgaa

SEQ ID NO: 106935 - DNA, 20 bp, Artificial Sequence
  Description of Artificial Sequence: Synthetic oligonucleotide
  Target: SCN9A; (+) strand; PAM type: YTN; PAM sequence: TTT
ccctttgaatttgcctgaat

SEQ ID NO: 106936 - DNA, 20 bp, Artificial Sequence
  Description of Artificial Sequence: Synthetic oligonucleotide
  Target: SCN9A; (+) strand; PAM type: YTN; PAM sequence: TTC
cctttgaatttgcctgaata

SEQ ID NO: 106937 - DNA, 20 bp, Artificial Sequence
  Description of Artificial Sequence: Synthetic oligonucleotide
  Target: SCN9A; (+) strand; PAM type: YTN; PAM sequence: CTT
tgaatttgcctgaataaata

SEQ ID NO: 106938 - DNA, 20 bp, Artificial Sequence
  Description of Artificial Sequence: Synthetic oligonucleotide
  Target: SCN9A; (+) strand; PAM type: YTN; PAM sequence: TTT
gaatttgcctgaataaataa

SEQ ID NO: 106939 - DNA, 20 bp, Artificial Sequence
  Description of Artificial Sequence: Synthetic oligonucleotide
  Target: SCN9A; (+) strand; PAM type: YTN; PAM sequence: TTG
aatttgcctgaataaataat

SEQ ID NO: 106940 - DNA, 20 bp, Artificial Sequence
  Description of Artificial Sequence: Synthetic oligonucleotide
  Target: SCN9A; (+) strand; PAM type: YTN; PAM sequence: TTT
gcctgaataaataataaaca

SEQ ID NO: 106941 - DNA, 20 bp, Artificial Sequence
  Description of Artificial Sequence: Synthetic oligonucleotide
  Target: SCN9A; (+) strand; PAM type: YTN; PAM sequence: TTG
cctgaataaataataaacat

SEQ ID NO: 106942 - DNA, 20 bp, Artificial Sequence
  Description of Artificial Sequence: Synthetic oligonucleotide
  Target: SCN9A; (+) strand; PAM type: YTN; PAM sequence: CTG
aataaataataaacatttaa

SEQ ID NO: 106943 - DNA, 20 bp, Artificial Sequence
  Description of Artificial Sequence: Synthetic oligonucleotide
  Target: SCN9A; (+) strand; PAM type: YTN; PAM sequence: TTT
aaattatttgtgattattgg

SEQ ID NO: 106944 - DNA, 20 bp, Artificial Sequence
  Description of Artificial Sequence: Synthetic oligonucleotide
  Target: SCN9A; (+) strand; PAM type: YTN; PAM sequence: TTA
aattatttgtgattattggc

SEQ ID NO: 106945 - DNA, 20 bp, Artificial Sequence
  Description of Artificial Sequence: Synthetic oligonucleotide
  Target: SCN9A; (+) strand; PAM type: YTN; PAM sequence: TTA
tttgtgattattggctttga

SEQ ID NO: 106946 - DNA, 20 bp, Artificial Sequence
  Description of Artificial Sequence: Synthetic oligonucleotide
  Target: SCN9A; (+) strand; PAM type: YTN; PAM sequence: TTT
gtgattattggctttgatgt

SEQ ID NO: 106947 - DNA, 20 bp, Artificial Sequence
  Description of Artificial Sequence: Synthetic oligonucleotide
  Target: SCN9A; (+) strand; PAM type: YTN; PAM sequence: TTG
tgattattggctttgatgtg

SEQ ID NO: 106948 - DNA, 20 bp, Artificial Sequence
  Description of Artificial Sequence: Synthetic oligonucleotide
  Target: SCN9A; (+) strand; PAM type: YTN; PAM sequence: TTA
ttggctttgatgtggcatgt

SEQ ID NO: 106949 - DNA, 20 bp, Artificial Sequence
  Description of Artificial Sequence: Synthetic oligonucleotide
  Target: SCN9A; (+) strand; PAM type: YTN; PAM sequence: TTG
gctttgatgtggcatgtttt

SEQ ID NO: 106950 - DNA, 20 bp, Artificial Sequence
  Description of Artificial Sequence: Synthetic oligonucleotide
  Target: SCN9A; (+) strand; PAM type: YTN; PAM sequence: CTT
tgatgtggcatgttttcaca

SEQ ID NO: 106951 - DNA, 20 bp, Artificial Sequence
  Description of Artificial Sequence: Synthetic oligonucleotide
  Target: SCN9A; (+) strand; PAM type: YTN; PAM sequence: TTT
gatgtggcatgttttcacaa

SEQ ID NO: 106952 - DNA, 20 bp, Artificial Sequence
  Description of Artificial Sequence: Synthetic oligonucleotide
  Target: SCN9A; (+) strand; PAM type: YTN; PAM sequence: TTG
atgtggcatgttttcacaag

SEQ ID NO: 106953 - DNA, 20 bp, Artificial Sequence
  Description of Artificial Sequence: Synthetic oligonucleotide
  Target: SCN9A; (+) strand; PAM type: YTN; PAM sequence: TTT
tcacaagttatacctttccc

SEQ ID NO: 106954 - DNA, 20 bp, Artificial Sequence
  Description of Artificial Sequence: Synthetic oligonucleotide
  Target: SCN9A; (+) strand; PAM type: YTN; PAM sequence: TTT
cacaagttatacctttccca

SEQ ID NO: 106955 - DNA, 20 bp, Artificial Sequence
  Description of Artificial Sequence: Synthetic oligonucleotide
  Target: SCN9A; (+) strand; PAM type: YTN; PAM sequence: TTC
acaagttatacctttcccaa

SEQ ID NO: 106956 - DNA, 20 bp, Artificial Sequence
  Description of Artificial Sequence: Synthetic oligonucleotide
  Target: SCN9A; (+) strand; PAM type: YTN; PAM sequence: TTA
tacctttcccaatttcacga

SEQ ID NO: 106957 - DNA, 20 bp, Artificial Sequence
  Description of Artificial Sequence: Synthetic oligonucleotide
  Target: SCN9A; (+) strand; PAM type: YTN; PAM sequence: CTT
tcccaatttcacgattttat

SEQ ID NO: 106958 - DNA, 20 bp, Artificial Sequence
  Description of Artificial Sequence: Synthetic oligonucleotide
  Target: SCN9A; (+) strand; PAM type: YTN; PAM sequence: TTT
cccaatttcacgattttatg

SEQ ID NO: 106959 - DNA, 20 bp, Artificial Sequence
  Description of Artificial Sequence: Synthetic oligonucleotide
  Target: SCN9A; (+) strand; PAM type: YTN; PAM sequence: TTC
ccaatttcacgattttatgt

SEQ ID NO: 106960 - DNA, 20 bp, Artificial Sequence
  Description of Artificial Sequence: Synthetic oligonucleotide
  Target: SCN9A; (+) strand; PAM type: YTN; PAM sequence: TTT
cacgattttatgtcaaaatt

SEQ ID NO: 106961 - DNA, 20 bp, Artificial Sequence
  Description of Artificial Sequence: Synthetic oligonucleotide
  Target: SCN9A; (+) strand; PAM type: YTN; PAM sequence: TTC
acgattttatgtcaaaattt

SEQ ID NO: 106962 - DNA, 20 bp, Artificial Sequence
  Description of Artificial Sequence: Synthetic oligonucleotide
  Target: SCN9A; (+) strand; PAM type: YTN; PAM sequence: TTT
tatgtcaaaattttgtaaga

SEQ ID NO: 106963 - DNA, 20 bp, Artificial Sequence
  Description of Artificial Sequence: Synthetic oligonucleotide
  Target: SCN9A; (+) strand; PAM type: YTN; PAM sequence: TTT
atgtcaaaattttgtaagaa

SEQ ID NO: 106964 - DNA, 20 bp, Artificial Sequence
  Description of Artificial Sequence: Synthetic oligonucleotide
  Target: SCN9A; (+) strand; PAM type: YTN; PAM sequence: TTA
tgtcaaaattttgtaagaag

SEQ ID NO: 106965 - DNA, 20 bp, Artificial Sequence
  Description of Artificial Sequence: Synthetic oligonucleotide
  Target: SCN9A; (+) strand; PAM type: YTN; PAM sequence: TTT
tgtaagaagaaatgcacagc

SEQ ID NO: 106966 - DNA, 20 bp, Artificial Sequence
  Description of Artificial Sequence: Synthetic oligonucleotide
  Target: SCN9A; (+) strand; PAM type: YTN; PAM sequence: TTT
gtaagaagaaatgcacagct

SEQ ID NO: 106967 - DNA, 20 bp, Artificial Sequence
  Description of Artificial Sequence: Synthetic oligonucleotide
  Target: SCN9A; (+) strand; PAM type: YTN; PAM sequence: TTG
taagaagaaatgcacagctg

SEQ ID NO: 106968 - DNA, 20 bp, Artificial Sequence
  Description of Artificial Sequence: Synthetic oligonucleotide
  Target: SCN9A; (+) strand; PAM type: YTN; PAM sequence: CTG
ggcgcagtagctcacgcctg

SEQ ID NO: 106969 - DNA, 20 bp, Artificial Sequence
  Description of Artificial Sequence: Synthetic oligonucleotide
  Target: SCN9A; (+) strand; PAM type: YTN; PAM sequence: CTC
acgcctgtaattctagcact

SEQ ID NO: 106970 - DNA, 20 bp, Artificial Sequence
  Description of Artificial Sequence: Synthetic oligonucleotide
  Target: SCN9A; (+) strand; PAM type: YTN; PAM sequence: CTG
taattctagcactttgggag

SEQ ID NO: 106971 - DNA, 20 bp, Artificial Sequence
  Description of Artificial Sequence: Synthetic oligonucleotide
  Target: SCN9A; (+) strand; PAM type: YTN; PAM sequence: TTC
tagcactttgggaggcgacg

SEQ ID NO: 106972 - DNA, 20 bp, Artificial Sequence
  Description of Artificial Sequence: Synthetic oligonucleotide
  Target: SCN9A; (+) strand; PAM type: YTN; PAM sequence: CTA
gcactttgggaggcgacgga

SEQ ID NO: 106973 - DNA, 20 bp, Artificial Sequence
  Description of Artificial Sequence: Synthetic oligonucleotide
  Target: SCN9A; (+) strand; PAM type: YTN; PAM sequence: CTT
tgggaggcgacggaggctgg

SEQ ID NO: 106974 - DNA, 20 bp, Artificial Sequence
  Description of Artificial Sequence: Synthetic oligonucleotide
  Target: SCN9A; (+) strand; PAM type: YTN; PAM sequence: TTT
gggaggcgacggaggctgga

SEQ ID NO: 106975 - DNA, 20 bp, Artificial Sequence
  Description of Artificial Sequence: Synthetic oligonucleotide
  Target: SCN9A; (+) strand; PAM type: YTN; PAM sequence: TTG
ggaggcgacggaggctggat

SEQ ID NO: 106976 - DNA, 20 bp, Artificial Sequence
  Description of Artificial Sequence: Synthetic oligonucleotide
  Target: SCN9A; (+) strand; PAM type: YTN; PAM sequence: CTG
gatcacctgaggtcaggagt

SEQ ID NO: 106977 - DNA, 20 bp, Artificial Sequence
  Description of Artificial Sequence: Synthetic oligonucleotide
  Target: SCN9A; (+) strand; PAM type: YTN; PAM sequence: CTG
aggtcaggagttcgagacca

SEQ ID NO: 106978 - DNA, 20 bp, Artificial Sequence
  Description of Artificial Sequence: Synthetic oligonucleotide
  Target: SCN9A; (+) strand; PAM type: YTN; PAM sequence: TTC
gagaccagcctggccaacat

SEQ ID NO: 106979 - DNA, 20 bp, Artificial Sequence
  Description of Artificial Sequence: Synthetic oligonucleotide
  Target: SCN9A; (+) strand; PAM type: YTN; PAM sequence: CTG
gccaacatgacgaaaacctg

SEQ ID NO: 106980 - DNA, 20 bp, Artificial Sequence
  Description of Artificial Sequence: Synthetic oligonucleotide
  Target: SCN9A; (+) strand; PAM type: YTN; PAM sequence: CTG
tctctactaaaaatacaaaa

SEQ ID NO: 106981 - DNA, 20 bp, Artificial Sequence
  Description of Artificial Sequence: Synthetic oligonucleotide
  Target: SCN9A; (+) strand; PAM type: YTN; PAM sequence: CTC
tactaaaaatacaaaaatta

SEQ ID NO: 106982 - DNA, 20 bp, Artificial Sequence
  Description of Artificial Sequence: Synthetic oligonucleotide
  Target: SCN9A; (+) strand; PAM type: YTN; PAM sequence: CTA
ctaaaaatacaaaaattagc

SEQ ID NO: 106983 - DNA, 20 bp, Artificial Sequence
  Description of Artificial Sequence: Synthetic oligonucleotide
  Target: SCN9A; (+) strand; PAM type: YTN; PAM sequence: CTA
aaaatacaaaaattagctgg

SEQ ID NO: 106984 - DNA, 20 bp, Artificial Sequence
  Description of Artificial Sequence: Synthetic oligonucleotide
  Target: SCN9A; (+) strand; PAM type: YTN; PAM sequence: TTA
gctggcacggtagcatgcac

SEQ ID NO: 106985 - DNA, 20 bp, Artificial Sequence
  Description of Artificial Sequence: Synthetic oligonucleotide
  Target: SCN9A; (+) strand; PAM type: YTN; PAM sequence: CTG
gcacggtagcatgcacctgt

SEQ ID NO: 106986 - DNA, 20 bp, Artificial Sequence
  Description of Artificial Sequence: Synthetic oligonucleotide
  Target: SCN9A; (+) strand; PAM type: YTN; PAM sequence: CTG
taatctcagctactcaggag

SEQ ID NO: 106987 - DNA, 20 bp, Artificial Sequence
  Description of Artificial Sequence: Synthetic oligonucleotide
  Target: SCN9A; (+) strand; PAM type: YTN; PAM sequence: CTC
agctactcaggaggctgagg

SEQ ID NO: 106988 - DNA, 20 bp, Artificial Sequence
  Description of Artificial Sequence: Synthetic oligonucleotide
  Target: SCN9A; (+) strand; PAM type: YTN; PAM sequence: CTA
ctcaggaggctgaggcagaa

SEQ ID NO: 106989 - DNA, 20 bp, Artificial Sequence
  Description of Artificial Sequence: Synthetic oligonucleotide
  Target: SCN9A; (+) strand; PAM type: YTN; PAM sequence: CTC
aggaggctgaggcagaagaa

SEQ ID NO: 106990 - DNA, 20 bp, Artificial Sequence
  Description of Artificial Sequence: Synthetic oligonucleotide
  Target: SCN9A; (+) strand; PAM type: YTN; PAM sequence: CTG
aggcagaagaattgcttgaa

SEQ ID NO: 106991 - DNA, 20 bp, Artificial Sequence
  Description of Artificial Sequence: Synthetic oligonucleotide
  Target: SCN9A; (+) strand; PAM type: YTN; PAM sequence: TTG
cttgaacctgggaggtggag

SEQ ID NO: 106992 - DNA, 20 bp, Artificial Sequence
  Description of Artificial Sequence: Synthetic oligonucleotide
  Target: SCN9A; (+) strand; PAM type: YTN; PAM sequence: CTT
gaacctgggaggtggaggtt

SEQ ID NO: 106993 - DNA, 20 bp, Artificial Sequence
  Description of Artificial Sequence: Synthetic oligonucleotide
  Target: SCN9A; (+) strand; PAM type: YTN; PAM sequence: TTG
aacctgggaggtggaggttg

SEQ ID NO: 106994 - DNA, 20 bp, Artificial Sequence
  Description of Artificial Sequence: Synthetic oligonucleotide
  Target: SCN9A; (+) strand; PAM type: YTN; PAM sequence: CTG
ggaggtggaggttggggtga

SEQ ID NO: 106995 - DNA, 20 bp, Artificial Sequence
  Description of Artificial Sequence: Synthetic oligonucleotide
  Target: SCN9A; (+) strand; PAM type: YTN; PAM sequence: TTG
gggtgagccgagatcacatc

SEQ ID NO: 106996 - DNA, 20 bp, Artificial Sequence
  Description of Artificial Sequence: Synthetic oligonucleotide
  Target: SCN9A; (+) strand; PAM type: YTN; PAM sequence: TTG
cactccagcctgggcaacaa

SEQ ID NO: 106997 - DNA, 20 bp, Artificial Sequence
  Description of Artificial Sequence: Synthetic oligonucleotide
  Target: SCN9A; (+) strand; PAM type: YTN; PAM sequence: CTC
cagcctgggcaacaaagcga

SEQ ID NO: 106998 - DNA, 20 bp, Artificial Sequence
  Description of Artificial Sequence: Synthetic oligonucleotide
  Target: SCN9A; (+) strand; PAM type: YTN; PAM sequence: CTG
ggcaacaaagcgagattcca

SEQ ID NO: 106999 - DNA, 20 bp, Artificial Sequence
  Description of Artificial Sequence: Synthetic oligonucleotide
  Target: SCN9A; (+) strand; PAM type: YTN; PAM sequence: TTC
catctcaaaaaaaaaaaaaa

SEQ ID NO: 107000 - DNA, 20 bp, Artificial Sequence
  Description of Artificial Sequence: Synthetic oligonucleotide
  Target: SCN9A; (+) strand; PAM type: YTN; PAM sequence: CTC
aaaaaaaaaaaaaatacaca

SEQ ID NO: 107001 - DNA, 20 bp, Artificial Sequence
  Description of Artificial Sequence: Synthetic oligonucleotide
  Target: SCN9A; (+) strand; PAM type: YTN; PAM sequence: CTG
ctataggagcttataaatac

SEQ ID NO: 107002 - DNA, 20 bp, Artificial Sequence
  Description of Artificial Sequence: Synthetic oligonucleotide
  Target: SCN9A; (+) strand; PAM type: YTN; PAM sequence: CTA
taggagcttataaatacaaa

SEQ ID NO: 107003 - DNA, 20 bp, Artificial Sequence
  Description of Artificial Sequence: Synthetic oligonucleotide
  Target: SCN9A; (+) strand; PAM type: YTN; PAM sequence: CTT
ataaatacaaaacagagaag

SEQ ID NO: 107004 - DNA, 20 bp, Artificial Sequence
  Description of Artificial Sequence: Synthetic oligonucleotide
  Target: SCN9A; (+) strand; PAM type: YTN; PAM sequence: TTA
taaatacaaaacagagaaga

SEQ ID NO: 107005 - DNA, 20 bp, Artificial Sequence
  Description of Artificial Sequence: Synthetic oligonucleotide
  Target: SCN9A; (+) strand; PAM type: YTN; PAM sequence: TTT
cattccatattggaaggaat

SEQ ID NO: 107006 - DNA, 20 bp, Artificial Sequence
  Description of Artificial Sequence: Synthetic oligonucleotide
  Target: SCN9A; (+) strand; PAM type: YTN; PAM sequence: TTC
attccatattggaaggaatt

SEQ ID NO: 107007 - DNA, 20 bp, Artificial Sequence
  Description of Artificial Sequence: Synthetic oligonucleotide
  Target: SCN9A; (+) strand; PAM type: YTN; PAM sequence: TTC
catattggaaggaatttgta

SEQ ID NO: 107008 - DNA, 20 bp, Artificial Sequence
  Description of Artificial Sequence: Synthetic oligonucleotide
  Target: SCN9A; (+) strand; PAM type: YTN; PAM sequence: TTG
gaaggaatttgtaaggctat

SEQ ID NO: 107009 - DNA, 20 bp, Artificial Sequence
  Description of Artificial Sequence: Synthetic oligonucleotide
  Target: SCN9A; (+) strand; PAM type: YTN; PAM sequence: TTT
gtaaggctatataaaactag

SEQ ID NO: 107010 - DNA, 20 bp, Artificial Sequence
  Description of Artificial Sequence: Synthetic oligonucleotide
  Target: SCN9A; (+) strand; PAM type: YTN; PAM sequence: TTG
taaggctatataaaactagg

SEQ ID NO: 107011 - DNA, 20 bp, Artificial Sequence
  Description of Artificial Sequence: Synthetic oligonucleotide
  Target: SCN9A; (+) strand; PAM type: YTN; PAM sequence: CTA
tataaaactaggaagcttat

SEQ ID NO: 107012 - DNA, 20 bp, Artificial Sequence
  Description of Artificial Sequence: Synthetic oligonucleotide
  Target: SCN9A; (+) strand; PAM type: YTN; PAM sequence: CTA
ggaagcttatttattactac

SEQ ID NO: 107013 - DNA, 20 bp, Artificial Sequence
  Description of Artificial Sequence: Synthetic oligonucleotide
  Target: SCN9A; (+) strand; PAM type: YTN; PAM sequence: CTT
atttattactacaacttgag

SEQ ID NO: 107014 - DNA, 20 bp, Artificial Sequence
  Description of Artificial Sequence: Synthetic oligonucleotide
  Target: SCN9A; (+) strand; PAM type: YTN; PAM sequence: TTA
tttattactacaacttgagg

SEQ ID NO: 107015 - DNA, 20 bp, Artificial Sequence
  Description of Artificial Sequence: Synthetic oligonucleotide
  Target: SCN9A; (+) strand; PAM type: YTN; PAM sequence: TTT
attactacaacttgagggtg

SEQ ID NO: 107016 - DNA, 20 bp, Artificial Sequence
  Description of Artificial Sequence: Synthetic oligonucleotide
  Target: SCN9A; (+) strand; PAM type: YTN; PAM sequence: TTA
ttactacaacttgagggtga

SEQ ID NO: 107017 - DNA, 20 bp, Artificial Sequence
  Description of Artificial Sequence: Synthetic oligonucleotide
  Target: SCN9A; (+) strand; PAM type: YTN; PAM sequence: TTA
ctacaacttgagggtgatca

SEQ ID NO: 107018 - DNA, 20 bp, Artificial Sequence
  Description of Artificial Sequence: Synthetic oligonucleotide
  Target: SCN9A; (+) strand; PAM type: YTN; PAM sequence: CTA
caacttgagggtgatcaaca

SEQ ID NO: 107019 - DNA, 20 bp, Artificial Sequence
  Description of Artificial Sequence: Synthetic oligonucleotide
  Target: SCN9A; (+) strand; PAM type: YTN; PAM sequence: CTT
gagggtgatcaacaattata

SEQ ID NO: 107020 - DNA, 20 bp, Artificial Sequence
  Description of Artificial Sequence: Synthetic oligonucleotide
  Target: SCN9A; (+) strand; PAM type: YTN; PAM sequence: TTG
agggtgatcaacaattatag

SEQ ID NO: 107021 - DNA, 20 bp, Artificial Sequence
  Description of Artificial Sequence: Synthetic oligonucleotide
  Target: SCN9A; (+) strand; PAM type: YTN; PAM sequence: TTA
tagaatggtaatccaggatg

SEQ ID NO: 107022 - DNA, 20 bp, Artificial Sequence
  Description of Artificial Sequence: Synthetic oligonucleotide
  Target: SCN9A; (+) strand; PAM type: YTN; PAM sequence: TTT
tttgtgcagtaaaaatctag

SEQ ID NO: 107023 - DNA, 20 bp, Artificial Sequence
  Description of Artificial Sequence: Synthetic oligonucleotide
  Target: SCN9A; (+) strand; PAM type: YTN; PAM sequence: TTT
ttgtgcagtaaaaatctaga

SEQ ID NO: 107024 - DNA, 20 bp, Artificial Sequence
  Description of Artificial Sequence: Synthetic oligonucleotide
  Target: SCN9A; (+) strand; PAM type: YTN; PAM sequence: TTT
tgtgcagtaaaaatctagaa

SEQ ID NO: 107025 - DNA, 20 bp, Artificial Sequence
  Description of Artificial Sequence: Synthetic oligonucleotide
  Target: SCN9A; (+) strand; PAM type: YTN; PAM sequence: TTT
gtgcagtaaaaatctagaat

SEQ ID NO: 107026 - DNA, 20 bp, Artificial Sequence
  Description of Artificial Sequence: Synthetic oligonucleotide
  Target: SCN9A; (+) strand; PAM type: YTN; PAM sequence: TTG
tgcagtaaaaatctagaatt

SEQ ID NO: 107027 - DNA, 20 bp, Artificial Sequence
  Description of Artificial Sequence: Synthetic oligonucleotide
  Target: SCN9A; (+) strand; PAM type: YTN; PAM sequence: CTA
gaatttgtgctgcataaatg

SEQ ID NO: 107028 - DNA, 20 bp, Artificial Sequence
  Description of Artificial Sequence: Synthetic oligonucleotide
  Target: SCN9A; (+) strand; PAM type: YTN; PAM sequence: TTT
gtgctgcataaatgcctttg

SEQ ID NO: 107029 - DNA, 20 bp, Artificial Sequence
  Description of Artificial Sequence: Synthetic oligonucleotide
  Target: SCN9A; (+) strand; PAM type: YTN; PAM sequence: TTG
tgctgcataaatgcctttgt

SEQ ID NO: 107030 - DNA, 20 bp, Artificial Sequence
  Description of Artificial Sequence: Synthetic oligonucleotide
  Target: SCN9A; (+) strand; PAM type: YTN; PAM sequence: CTG
cataaatgcctttgtgtatg

SEQ ID NO: 107031 - DNA, 20 bp, Artificial Sequence
  Description of Artificial Sequence: Synthetic oligonucleotide
  Target: SCN9A; (+) strand; PAM type: YTN; PAM sequence: CTT
tgtgtatgtctggcacagta

SEQ ID NO: 107032 - DNA, 20 bp, Artificial Sequence
  Description of Artificial Sequence: Synthetic oligonucleotide
  Target: SCN9A; (+) strand; PAM type: YTN; PAM sequence: TTT
gtgtatgtctggcacagtat

SEQ ID NO: 107033 - DNA, 20 bp, Artificial Sequence
  Description of Artificial Sequence: Synthetic oligonucleotide
  Target: SCN9A; (+) strand; PAM type: YTN; PAM sequence: TTG
tgtatgtctggcacagtatc

SEQ ID NO: 107034 - DNA, 20 bp, Artificial Sequence
  Description of Artificial Sequence: Synthetic oligonucleotide
  Target: SCN9A; (+) strand; PAM type: YTN; PAM sequence: CTG
gcacagtatcatttagtgtg

SEQ ID NO: 107035 - DNA, 20 bp, Artificial Sequence
  Description of Artificial Sequence: Synthetic oligonucleotide
  Target: SCN9A; (+) strand; PAM type: YTN; PAM sequence: TTT
agtgtgtgactggatgaatg

SEQ ID NO: 107036 - DNA, 20 bp, Artificial Sequence
  Description of Artificial Sequence: Synthetic oligonucleotide
  Target: SCN9A; (+) strand; PAM type: YTN; PAM sequence: TTA
gtgtgtgactggatgaatgt

SEQ ID NO: 107037 - DNA, 20 bp, Artificial Sequence
  Description of Artificial Sequence: Synthetic oligonucleotide
  Target: SCN9A; (+) strand; PAM type: YTN; PAM sequence: CTG
gatgaatgtaagtttctgtc

SEQ ID NO: 107038 - DNA, 20 bp, Artificial Sequence
  Description of Artificial Sequence: Synthetic oligonucleotide
  Target: SCN9A; (+) strand; PAM type: YTN; PAM sequence: TTT
ctgtcctgacttctgaatcc

SEQ ID NO: 107039 - DNA, 20 bp, Artificial Sequence
  Description of Artificial Sequence: Synthetic oligonucleotide
  Target: SCN9A; (+) strand; PAM type: YTN; PAM sequence: TTC
tgtcctgacttctgaatcct

SEQ ID NO: 107040 - DNA, 20 bp, Artificial Sequence
  Description of Artificial Sequence: Synthetic oligonucleotide
  Target: SCN9A; (+) strand; PAM type: YTN; PAM sequence: CTG
tcctgacttctgaatcctct

SEQ ID NO: 107041 - DNA, 20 bp, Artificial Sequence
  Description of Artificial Sequence: Synthetic oligonucleotide
  Target: SCN9A; (+) strand; PAM type: YTN; PAM sequence: CTG
acttctgaatcctcttttta

SEQ ID NO: 107042 - DNA, 20 bp, Artificial Sequence
  Description of Artificial Sequence: Synthetic oligonucleotide
  Target: SCN9A; (+) strand; PAM type: YTN; PAM sequence: CTT
ctgaatcctctttttatggt

SEQ ID NO: 107043 - DNA, 20 bp, Artificial Sequence
  Description of Artificial Sequence: Synthetic oligonucleotide
  Target: SCN9A; (+) strand; PAM type: YTN; PAM sequence: TTC
tgaatcctctttttatggtg

SEQ ID NO: 107044 - DNA, 20 bp, Artificial Sequence
  Description of Artificial Sequence: Synthetic oligonucleotide
  Target: SCN9A; (+) strand; PAM type: YTN; PAM sequence: CTG
aatcctctttttatggtggt

SEQ ID NO: 107045 - DNA, 20 bp, Artificial Sequence
  Description of Artificial Sequence: Synthetic oligonucleotide
  Target: SCN9A; (+) strand; PAM type: YTN; PAM sequence: CTC
tttttatggtggttacaagg

SEQ ID NO: 107046 - DNA, 20 bp, Artificial Sequence
  Description of Artificial Sequence: Synthetic oligonucleotide
  Target: SCN9A; (+) strand; PAM type: YTN; PAM sequence: CTT
tttatggtggttacaaggac

SEQ ID NO: 107047 - DNA, 20 bp, Artificial Sequence
  Description of Artificial Sequence: Synthetic oligonucleotide
  Target: SCN9A; (+) strand; PAM type: YTN; PAM sequence: TTT
ttatggtggttacaaggaca

SEQ ID NO: 107048 - DNA, 20 bp, Artificial Sequence
  Description of Artificial Sequence: Synthetic oligonucleotide
  Target: SCN9A; (+) strand; PAM type: YTN; PAM sequence: TTT
tatggtggttacaaggacaa

SEQ ID NO: 107049 - DNA, 20 bp, Artificial Sequence
  Description of Artificial Sequence: Synthetic oligonucleotide
  Target: SCN9A; (+) strand; PAM type: YTN; PAM sequence: TTT
atggtggttacaaggacaac

SEQ ID NO: 107050 - DNA, 20 bp, Artificial Sequence
  Description of Artificial Sequence: Synthetic oligonucleotide
  Target: SCN9A; (+) strand; PAM type: YTN; PAM sequence: TTA
tggtggttacaaggacaaca

SEQ ID NO: 107051 - DNA, 20 bp, Artificial Sequence
  Description of Artificial Sequence: Synthetic oligonucleotide
  Target: SCN9A; (+) strand; PAM type: YTN; PAM sequence: TTA
caaggacaacaatattttag

SEQ ID NO: 107052 - DNA, 20 bp, Artificial Sequence
  Description of Artificial Sequence: Synthetic oligonucleotide
  Target: SCN9A; (+) strand; PAM type: YTN; PAM sequence: TTT
tagtaatttttttcaactca

SEQ ID NO: 107053 - DNA, 20 bp, Artificial Sequence
  Description of Artificial Sequence: Synthetic oligonucleotide
  Target: SCN9A; (+) strand; PAM type: YTN; PAM sequence: TTT
agtaatttttttcaactcag

SEQ ID NO: 107054 - DNA, 20 bp, Artificial Sequence
  Description of Artificial Sequence: Synthetic oligonucleotide
  Target: SCN9A; (+) strand; PAM type: YTN; PAM sequence: TTA
gtaatttttttcaactcagt

SEQ ID NO: 107055 - DNA, 20 bp, Artificial Sequence
  Description of Artificial Sequence: Synthetic oligonucleotide
  Target: SCN9A; (+) strand; PAM type: YTN; PAM sequence: TTT
ttttcaactcagtgggaagt

SEQ ID NO: 107056 - DNA, 20 bp, Artificial Sequence
  Description of Artificial Sequence: Synthetic oligonucleotide
  Target: SCN9A; (+) strand; PAM type: YTN; PAM sequence: TTT
tttcaactcagtgggaagtg

SEQ ID NO: 107057 - DNA, 20 bp, Artificial Sequence
  Description of Artificial Sequence: Synthetic oligonucleotide
  Target: SCN9A; (+) strand; PAM type: YTN; PAM sequence: TTT
ttcaactcagtgggaagtga

SEQ ID NO: 107058 - DNA, 20 bp, Artificial Sequence
  Description of Artificial Sequence: Synthetic oligonucleotide
  Target: SCN9A; (+) strand; PAM type: YTN; PAM sequence: TTT
tcaactcagtgggaagtgaa

SEQ ID NO: 107059 - DNA, 20 bp, Artificial Sequence
  Description of Artificial Sequence: Synthetic oligonucleotide
  Target: SCN9A; (+) strand; PAM type: YTN; PAM sequence: TTT
caactcagtgggaagtgaag

SEQ ID NO: 107060 - DNA, 20 bp, Artificial Sequence
  Description of Artificial Sequence: Synthetic oligonucleotide
  Target: SCN9A; (+) strand; PAM type: YTN; PAM sequence: TTC
aactcagtgggaagtgaagg

SEQ ID NO: 107061 - DNA, 20 bp, Artificial Sequence
  Description of Artificial Sequence: Synthetic oligonucleotide
  Target: SCN9A; (+) strand; PAM type: YTN; PAM sequence: CTC
agtgggaagtgaaggcactt

SEQ ID NO: 107062 - DNA, 20 bp, Artificial Sequence
  Description of Artificial Sequence: Synthetic oligonucleotide
  Target: SCN9A; (+) strand; PAM type: YTN; PAM sequence: CTT
accatatggctgttaccata

SEQ ID NO: 107063 - DNA, 20 bp, Artificial Sequence
  Description of Artificial Sequence: Synthetic oligonucleotide
  Target: SCN9A; (+) strand; PAM type: YTN; PAM sequence: TTA
ccatatggctgttaccatat

SEQ ID NO: 107064 - DNA, 20 bp, Artificial Sequence
  Description of Artificial Sequence: Synthetic oligonucleotide
  Target: SCN9A; (+) strand; PAM type: YTN; PAM sequence: CTG
ttaccatatcccaccttctg

SEQ ID NO: 107065 - DNA, 20 bp, Artificial Sequence
  Description of Artificial Sequence: Synthetic oligonucleotide
  Target: SCN9A; (+) strand; PAM type: YTN; PAM sequence: TTA
ccatatcccaccttctggat

SEQ ID NO: 107066 - DNA, 20 bp, Artificial Sequence
  Description of Artificial Sequence: Synthetic oligonucleotide
  Target: SCN9A; (+) strand; PAM type: YTN; PAM sequence: CTT
ctggatacctgatgagagat

SEQ ID NO: 107067 - DNA, 20 bp, Artificial Sequence
  Description of Artificial Sequence: Synthetic oligonucleotide
  Target: SCN9A; (+) strand; PAM type: YTN; PAM sequence: TTC
tggatacctgatgagagatt

SEQ ID NO: 107068 - DNA, 20 bp, Artificial Sequence
  Description of Artificial Sequence: Synthetic oligonucleotide
  Target: SCN9A; (+) strand; PAM type: YTN; PAM sequence: CTG
gatacctgatgagagatttg

SEQ ID NO: 107069 - DNA, 20 bp, Artificial Sequence
  Description of Artificial Sequence: Synthetic oligonucleotide
  Target: SCN9A; (+) strand; PAM type: YTN; PAM sequence: CTG
atgagagatttgatgtcaag

SEQ ID NO: 107070 - DNA, 20 bp, Artificial Sequence
  Description of Artificial Sequence: Synthetic oligonucleotide
  Target: SCN9A; (+) strand; PAM type: YTN; PAM sequence: TTT
gatgtcaagctgaccaactg

SEQ ID NO: 107071 - DNA, 20 bp, Artificial Sequence
  Description of Artificial Sequence: Synthetic oligonucleotide
  Target: SCN9A; (+) strand; PAM type: YTN; PAM sequence: TTG
atgtcaagctgaccaactgt

SEQ ID NO: 107072 - DNA, 20 bp, Artificial Sequence
  Description of Artificial Sequence: Synthetic oligonucleotide
  Target: SCN9A; (+) strand; PAM type: YTN; PAM sequence: CTG
accaactgtgacaagtcaac

SEQ ID NO: 107073 - DNA, 20 bp, Artificial Sequence
  Description of Artificial Sequence: Synthetic oligonucleotide
  Target: SCN9A; (+) strand; PAM type: YTN; PAM sequence: CTG
tgacaagtcaacgtggcaga

SEQ ID NO: 107074 - DNA, 20 bp, Artificial Sequence
  Description of Artificial Sequence: Synthetic oligonucleotide
  Target: SCN9A; (+) strand; PAM type: YTN; PAM sequence: TTT
gagaattgagatgagtggct

SEQ ID NO: 107075 - DNA, 20 bp, Artificial Sequence
  Description of Artificial Sequence: Synthetic oligonucleotide
  Target: SCN9A; (+) strand; PAM type: YTN; PAM sequence: TTG
agaattgagatgagtggctc

SEQ ID NO: 107076 - DNA, 20 bp, Artificial Sequence
  Description of Artificial Sequence: Synthetic oligonucleotide
  Target: SCN9A; (+) strand; PAM type: YTN; PAM sequence: TTG
agatgagtggctcatagaag

SEQ ID NO: 107077 - DNA, 20 bp, Artificial Sequence
  Description of Artificial Sequence: Synthetic oligonucleotide
  Target: SCN9A; (+) strand; PAM type: YTN; PAM sequence: CTC
atagaagagcattttatccc

SEQ ID NO: 107078 - DNA, 20 bp, Artificial Sequence
  Description of Artificial Sequence: Synthetic oligonucleotide
  Target: SCN9A; (+) strand; PAM type: YTN; PAM sequence: TTT
tatcccaattttctcctgct

SEQ ID NO: 107079 - DNA, 20 bp, Artificial Sequence
  Description of Artificial Sequence: Synthetic oligonucleotide
  Target: SCN9A; (+) strand; PAM type: YTN; PAM sequence: TTT
atcccaattttctcctgctt

SEQ ID NO: 107080 - DNA, 20 bp, Artificial Sequence
  Description of Artificial Sequence: Synthetic oligonucleotide
  Target: SCN9A; (+) strand; PAM type: YTN; PAM sequence: TTA
tcccaattttctcctgcttg

SEQ ID NO: 107081 - DNA, 20 bp, Artificial Sequence
  Description of Artificial Sequence: Synthetic oligonucleotide
  Target: SCN9A; (+) strand; PAM type: YTN; PAM sequence: TTT
tctcctgcttgtaagcttga

SEQ ID NO: 107082 - DNA, 20 bp, Artificial Sequence
  Description of Artificial Sequence: Synthetic oligonucleotide
  Target: SCN9A; (+) strand; PAM type: YTN; PAM sequence: TTT
ctcctgcttgtaagcttgaa

SEQ ID NO: 107083 - DNA, 20 bp, Artificial Sequence
  Description of Artificial Sequence: Synthetic oligonucleotide
  Target: SCN9A; (+) strand; PAM type: YTN; PAM sequence: TTC
tcctgcttgtaagcttgaaa

SEQ ID NO: 107084 - DNA, 20 bp, Artificial Sequence
  Description of Artificial Sequence: Synthetic oligonucleotide
  Target: SCN9A; (+) strand; PAM type: YTN; PAM sequence: CTC
ctgcttgtaagcttgaaagt

SEQ ID NO: 107085 - DNA, 20 bp, Artificial Sequence
  Description of Artificial Sequence: Synthetic oligonucleotide
  Target: SCN9A; (+) strand; PAM type: YTN; PAM sequence: CTG
cttgtaagcttgaaagtttt

SEQ ID NO: 107086 - DNA, 20 bp, Artificial Sequence
  Description of Artificial Sequence: Synthetic oligonucleotide
  Target: SCN9A; (+) strand; PAM type: YTN; PAM sequence: CTT
gtaagcttgaaagttttcac

SEQ ID NO: 107087 - DNA, 20 bp, Artificial Sequence
  Description of Artificial Sequence: Synthetic oligonucleotide
  Target: SCN9A; (+) strand; PAM type: YTN; PAM sequence: TTG
taagcttgaaagttttcact

SEQ ID NO: 107088 - DNA, 20 bp, Artificial Sequence
  Description of Artificial Sequence: Synthetic oligonucleotide
  Target: SCN9A; (+) strand; PAM type: YTN; PAM sequence: CTT
gaaagttttcactaatcagt

SEQ ID NO: 107089 - DNA, 20 bp, Artificial Sequence
  Description of Artificial Sequence: Synthetic oligonucleotide
  Target: SCN9A; (+) strand; PAM type: YTN; PAM sequence: TTG
aaagttttcactaatcagta

SEQ ID NO: 107090 - DNA, 20 bp, Artificial Sequence
  Description of Artificial Sequence: Synthetic oligonucleotide
  Target: SCN9A; (+) strand; PAM type: YTN; PAM sequence: TTT
tcactaatcagtataaggaa

SEQ ID NO: 107091 - DNA, 20 bp, Artificial Sequence
  Description of Artificial Sequence: Synthetic oligonucleotide
  Target: SCN9A; (+) strand; PAM type: YTN; PAM sequence: TTT
cactaatcagtataaggaag

SEQ ID NO: 107092 - DNA, 20 bp, Artificial Sequence
  Description of Artificial Sequence: Synthetic oligonucleotide
  Target: SCN9A; (+) strand; PAM type: YTN; PAM sequence: TTC
actaatcagtataaggaaga

SEQ ID NO: 107093 - DNA, 20 bp, Artificial Sequence
  Description of Artificial Sequence: Synthetic oligonucleotide
  Target: SCN9A; (+) strand; PAM type: YTN; PAM sequence: CTA
atcagtataaggaagaaaaa

SEQ ID NO: 107094 - DNA, 20 bp, Artificial Sequence
  Description of Artificial Sequence: Synthetic oligonucleotide
  Target: SCN9A; (+) strand; PAM type: YTN; PAM sequence: CTA
attcaaaaagtaggcagatt

SEQ ID NO: 107095 - DNA, 20 bp, Artificial Sequence
  Description of Artificial Sequence: Synthetic oligonucleotide
  Target: SCN9A; (+) strand; PAM type: YTN; PAM sequence: TTC
aaaaagtaggcagattgcta

SEQ ID NO: 107096 - DNA, 20 bp, Artificial Sequence
  Description of Artificial Sequence: Synthetic oligonucleotide
  Target: SCN9A; (+) strand; PAM type: YTN; PAM sequence: TTG
ctatgtccacgcgatgctat

SEQ ID NO: 107097 - DNA, 20 bp, Artificial Sequence
  Description of Artificial Sequence: Synthetic oligonucleotide
  Target: SCN9A; (+) strand; PAM type: YTN; PAM sequence: CTA
tgtccacgcgatgctatagg

SEQ ID NO: 107098 - DNA, 20 bp, Artificial Sequence
  Description of Artificial Sequence: Synthetic oligonucleotide
  Target: SCN9A; (+) strand; PAM type: YTN; PAM sequence: CTA
taggccagtggctggaaaac

SEQ ID NO: 107099 - DNA, 20 bp, Artificial Sequence
  Description of Artificial Sequence: Synthetic oligonucleotide
  Target: SCN9A; (+) strand; PAM type: YTN; PAM sequence: CTG
gaaaactttttcgtaaaggg

SEQ ID NO: 107100 - DNA, 20 bp, Artificial Sequence
  Description of Artificial Sequence: Synthetic oligonucleotide
  Target: SCN9A; (+) strand; PAM type: YTN; PAM sequence: CTT
tttcgtaaagggccaaatga

SEQ ID NO: 107101 - DNA, 20 bp, Artificial Sequence
  Description of Artificial Sequence: Synthetic oligonucleotide
  Target: SCN9A; (+) strand; PAM type: YTN; PAM sequence: TTT
ttcgtaaagggccaaatgat

SEQ ID NO: 107102 - DNA, 20 bp, Artificial Sequence
  Description of Artificial Sequence: Synthetic oligonucleotide
  Target: SCN9A; (+) strand; PAM type: YTN; PAM sequence: TTT
tcgtaaagggccaaatgata

SEQ ID NO: 107103 - DNA, 20 bp, Artificial Sequence
  Description of Artificial Sequence: Synthetic oligonucleotide
  Target: SCN9A; (+) strand; PAM type: YTN; PAM sequence: TTT
cgtaaagggccaaatgataa

SEQ ID NO: 107104 - DNA, 20 bp, Artificial Sequence
  Description of Artificial Sequence: Synthetic oligonucleotide
  Target: SCN9A; (+) strand; PAM type: YTN; PAM sequence: TTC
gtaaagggccaaatgataaa

SEQ ID NO: 107105 - DNA, 20 bp, Artificial Sequence
  Description of Artificial Sequence: Synthetic oligonucleotide
  Target: SCN9A; (+) strand; PAM type: YTN; PAM sequence: TTT
tagactttattgggcatacg

SEQ ID NO: 107106 - DNA, 20 bp, Artificial Sequence
  Description of Artificial Sequence: Synthetic oligonucleotide
  Target: SCN9A; (+) strand; PAM type: YTN; PAM sequence: TTT
agactttattgggcatacga

SEQ ID NO: 107107 - DNA, 20 bp, Artificial Sequence
  Description of Artificial Sequence: Synthetic oligonucleotide
  Target: SCN9A; (+) strand; PAM type: YTN; PAM sequence: TTA
gactttattgggcatacgat

SEQ ID NO: 107108 - DNA, 20 bp, Artificial Sequence
  Description of Artificial Sequence: Synthetic oligonucleotide
  Target: SCN9A; (+) strand; PAM type: YTN; PAM sequence: CTT
tattgggcatacgatttcta

SEQ ID NO: 107109 - DNA, 20 bp, Artificial Sequence
  Description of Artificial Sequence: Synthetic oligonucleotide
  Target: SCN9A; (+) strand; PAM type: YTN; PAM sequence: TTT
attgggcatacgatttctat

SEQ ID NO: 107110 - DNA, 20 bp, Artificial Sequence
  Description of Artificial Sequence: Synthetic oligonucleotide
  Target: SCN9A; (+) strand; PAM type: YTN; PAM sequence: TTA
ttgggcatacgatttctatg

SEQ ID NO: 107111 - DNA, 20 bp, Artificial Sequence
  Description of Artificial Sequence: Synthetic oligonucleotide
  Target: SCN9A; (+) strand; PAM type: YTN; PAM sequence: TTG
ggcatacgatttctatggca

SEQ ID NO: 107112 - DNA, 20 bp, Artificial Sequence
  Description of Artificial Sequence: Synthetic oligonucleotide
  Target: SCN9A; (+) strand; PAM type: YTN; PAM sequence: TTT
ctatggcagctattcacctc

SEQ ID NO: 107113 - DNA, 20 bp, Artificial Sequence
  Description of Artificial Sequence: Synthetic oligonucleotide
  Target: SCN9A; (+) strand; PAM type: YTN; PAM sequence: TTC
tatggcagctattcacctct

SEQ ID NO: 107114 - DNA, 20 bp, Artificial Sequence
  Description of Artificial Sequence: Synthetic oligonucleotide
  Target: SCN9A; (+) strand; PAM type: YTN; PAM sequence: CTA
tggcagctattcacctctgc

SEQ ID NO: 107115 - DNA, 20 bp, Artificial Sequence
  Description of Artificial Sequence: Synthetic oligonucleotide
  Target: SCN9A; (+) strand; PAM type: YTN; PAM sequence: CTA
ttcacctctgccactgtaat

SEQ ID NO: 107116 - DNA, 20 bp, Artificial Sequence
  Description of Artificial Sequence: Synthetic oligonucleotide
  Target: SCN9A; (+) strand; PAM type: YTN; PAM sequence: TTC
acctctgccactgtaatgta

SEQ ID NO: 107117 - DNA, 20 bp, Artificial Sequence
  Description of Artificial Sequence: Synthetic oligonucleotide
  Target: SCN9A; (+) strand; PAM type: YTN; PAM sequence: CTC
tgccactgtaatgtaaaagc

SEQ ID NO: 107118 - DNA, 20 bp, Artificial Sequence
  Description of Artificial Sequence: Synthetic oligonucleotide
  Target: SCN9A; (+) strand; PAM type: YTN; PAM sequence: CTG
ccactgtaatgtaaaagcag

SEQ ID NO: 107119 - DNA, 20 bp, Artificial Sequence
  Description of Artificial Sequence: Synthetic oligonucleotide
  Target: SCN9A; (+) strand; PAM type: YTN; PAM sequence: CTG
taatgtaaaagcagtcatag

SEQ ID NO: 107120 - DNA, 20 bp, Artificial Sequence
  Description of Artificial Sequence: Synthetic oligonucleotide
  Target: SCN9A; (+) strand; PAM type: YTN; PAM sequence: TTG
acattcctatgtttgaataa

SEQ ID NO: 107121 - DNA, 20 bp, Artificial Sequence
  Description of Artificial Sequence: Synthetic oligonucleotide
  Target: SCN9A; (+) strand; PAM type: YTN; PAM sequence: TTC
ctatgtttgaataaagttta

SEQ ID NO: 107122 - DNA, 20 bp, Artificial Sequence
  Description of Artificial Sequence: Synthetic oligonucleotide
  Target: SCN9A; (+) strand; PAM type: YTN; PAM sequence: CTA
tgtttgaataaagtttatga

SEQ ID NO: 107123 - DNA, 20 bp, Artificial Sequence
  Description of Artificial Sequence: Synthetic oligonucleotide
  Target: SCN9A; (+) strand; PAM type: YTN; PAM sequence: TTT
gaataaagtttatgaacact

SEQ ID NO: 107124 - DNA, 20 bp, Artificial Sequence
  Description of Artificial Sequence: Synthetic oligonucleotide
  Target: SCN9A; (+) strand; PAM type: YTN; PAM sequence: TTG
aataaagtttatgaacacta

SEQ ID NO: 107125 - DNA, 20 bp, Artificial Sequence
  Description of Artificial Sequence: Synthetic oligonucleotide
  Target: SCN9A; (+) strand; PAM type: YTN; PAM sequence: TTT
atgaacactaaaatttgcat

SEQ ID NO: 107126 - DNA, 20 bp, Artificial Sequence
  Description of Artificial Sequence: Synthetic oligonucleotide
  Target: SCN9A; (+) strand; PAM type: YTN; PAM sequence: TTA
tgaacactaaaatttgcatt

SEQ ID NO: 107127 - DNA, 20 bp, Artificial Sequence
  Description of Artificial Sequence: Synthetic oligonucleotide
  Target: SCN9A; (+) strand; PAM type: YTN; PAM sequence: CTA
aaatttgcatttcatataat

SEQ ID NO: 107128 - DNA, 20 bp, Artificial Sequence
  Description of Artificial Sequence: Synthetic oligonucleotide
  Target: SCN9A; (+) strand; PAM type: YTN; PAM sequence: TTT
gcatttcatataatgtgcat

SEQ ID NO: 107129 - DNA, 20 bp, Artificial Sequence
  Description of Artificial Sequence: Synthetic oligonucleotide
  Target: SCN9A; (+) strand; PAM type: YTN; PAM sequence: TTG
catttcatataatgtgcatg

SEQ ID NO: 107130 - DNA, 20 bp, Artificial Sequence
  Description of Artificial Sequence: Synthetic oligonucleotide
  Target: SCN9A; (+) strand; PAM type: YTN; PAM sequence: TTT
catataatgtgcatgtgtca

SEQ ID NO: 107131 - DNA, 20 bp, Artificial Sequence
  Description of Artificial Sequence: Synthetic oligonucleotide
  Target: SCN9A; (+) strand; PAM type: YTN; PAM sequence: TTC
atataatgtgcatgtgtcat

SEQ ID NO: 107132 - DNA, 20 bp, Artificial Sequence
  Description of Artificial Sequence: Synthetic oligonucleotide
  Target: SCN9A; (+) strand; PAM type: YTN; PAM sequence: TTT
attcttcttttgattatttt

SEQ ID NO: 107133 - DNA, 20 bp, Artificial Sequence
  Description of Artificial Sequence: Synthetic oligonucleotide
  Target: SCN9A; (+) strand; PAM type: YTN; PAM sequence: TTA
ttcttcttttgattatttta

SEQ ID NO: 107134 - DNA, 20 bp, Artificial Sequence
  Description of Artificial Sequence: Synthetic oligonucleotide
  Target: SCN9A; (+) strand; PAM type: YTN; PAM sequence: TTC
ttcttttgattattttaacc

SEQ ID NO: 107135 - DNA, 20 bp, Artificial Sequence
  Description of Artificial Sequence: Synthetic oligonucleotide
  Target: SCN9A; (+) strand; PAM type: YTN; PAM sequence: CTT
cttttgattattttaaccac

SEQ ID NO: 107136 - DNA, 20 bp, Artificial Sequence
  Description of Artificial Sequence: Synthetic oligonucleotide
  Target: SCN9A; (+) strand; PAM type: YTN; PAM sequence: TTC
ttttgattattttaaccact

SEQ ID NO: 107137 - DNA, 20 bp, Artificial Sequence
  Description of Artificial Sequence: Synthetic oligonucleotide
  Target: SCN9A; (+) strand; PAM type: YTN; PAM sequence: CTT
ttgattattttaaccactta

SEQ ID NO: 107138 - DNA, 20 bp, Artificial Sequence
  Description of Artificial Sequence: Synthetic oligonucleotide
  Target: SCN9A; (+) strand; PAM type: YTN; PAM sequence: TTT
tgattattttaaccacttaa

SEQ ID NO: 107139 - DNA, 20 bp, Artificial Sequence
  Description of Artificial Sequence: Synthetic oligonucleotide
  Target: SCN9A; (+) strand; PAM type: YTN; PAM sequence: TTT
gattattttaaccacttaaa

SEQ ID NO: 107140 - DNA, 20 bp, Artificial Sequence
  Description of Artificial Sequence: Synthetic oligonucleotide
  Target: SCN9A; (+) strand; PAM type: YTN; PAM sequence: TTG
attattttaaccacttaaaa

SEQ ID NO: 107141 - DNA, 20 bp, Artificial Sequence
  Description of Artificial Sequence: Synthetic oligonucleotide
  Target: SCN9A; (+) strand; PAM type: YTN; PAM sequence: TTA
ttttaaccacttaaaaatgt

SEQ ID NO: 107142 - DNA, 20 bp, Artificial Sequence
  Description of Artificial Sequence: Synthetic oligonucleotide
  Target: SCN9A; (+) strand; PAM type: YTN; PAM sequence: TTT
taaccacttaaaaatgtaaa

SEQ ID NO: 107143 - DNA, 20 bp, Artificial Sequence
  Description of Artificial Sequence: Synthetic oligonucleotide
  Target: SCN9A; (+) strand; PAM type: YTN; PAM sequence: TTT
aaccacttaaaaatgtaaaa

SEQ ID NO: 107144 - DNA, 20 bp, Artificial Sequence
  Description of Artificial Sequence: Synthetic oligonucleotide
  Target: SCN9A; (+) strand; PAM type: YTN; PAM sequence: TTA
accacttaaaaatgtaaaaa

SEQ ID NO: 107145 - DNA, 20 bp, Artificial Sequence
  Description of Artificial Sequence: Synthetic oligonucleotide
  Target: SCN9A; (+) strand; PAM type: YTN; PAM sequence: CTT
aaaaatgtaaaaatcattct

SEQ ID NO: 107146 - DNA, 20 bp, Artificial Sequence
  Description of Artificial Sequence: Synthetic oligonucleotide
  Target: SCN9A; (+) strand; PAM type: YTN; PAM sequence: TTA
aaaatgtaaaaatcattctt

SEQ ID NO: 107147 - DNA, 20 bp, Artificial Sequence
  Description of Artificial Sequence: Synthetic oligonucleotide
  Target: SCN9A; (+) strand; PAM type: YTN; PAM sequence: TTC
ttagctcccagggccacaca

SEQ ID NO: 107148 - DNA, 20 bp, Artificial Sequence
  Description of Artificial Sequence: Synthetic oligonucleotide
  Target: SCN9A; (+) strand; PAM type: YTN; PAM sequence: CTT
agctcccagggccacacaat

SEQ ID NO: 107149 - DNA, 20 bp, Artificial Sequence
  Description of Artificial Sequence: Synthetic oligonucleotide
  Target: SCN9A; (+) strand; PAM type: YTN; PAM sequence: TTA
gctcccagggccacacaata

SEQ ID NO: 107150 - DNA, 20 bp, Artificial Sequence
  Description of Artificial Sequence: Synthetic oligonucleotide
  Target: SCN9A; (+) strand; PAM type: YTN; PAM sequence: CTC
ccagggccacacaataacag

SEQ ID NO: 107151 - DNA, 20 bp, Artificial Sequence
  Description of Artificial Sequence: Synthetic oligonucleotide
  Target: SCN9A; (+) strand; PAM type: YTN; PAM sequence: TTG
gactggctttggtctgtggg

SEQ ID NO: 107152 - DNA, 20 bp, Artificial Sequence
  Description of Artificial Sequence: Synthetic oligonucleotide
  Target: SCN9A; (+) strand; PAM type: YTN; PAM sequence: CTG
gctttggtctgtggggcata

SEQ ID NO: 107153 - DNA, 20 bp, Artificial Sequence
  Description of Artificial Sequence: Synthetic oligonucleotide
  Target: SCN9A; (+) strand; PAM type: YTN; PAM sequence: CTT
tggtctgtggggcataggtg

SEQ ID NO: 107154 - DNA, 20 bp, Artificial Sequence
  Description of Artificial Sequence: Synthetic oligonucleotide
  Target: SCN9A; (+) strand; PAM type: YTN; PAM sequence: TTT
ggtctgtggggcataggtgc

SEQ ID NO: 107155 - DNA, 20 bp, Artificial Sequence
  Description of Artificial Sequence: Synthetic oligonucleotide
  Target: SCN9A; (+) strand; PAM type: YTN; PAM sequence: TTG
gtctgtggggcataggtgct

SEQ ID NO: 107156 - DNA, 20 bp, Artificial Sequence
  Description of Artificial Sequence: Synthetic oligonucleotide
  Target: SCN9A; (+) strand; PAM type: YTN; PAM sequence: CTG
tggggcataggtgctgatcc

SEQ ID NO: 107157 - DNA, 20 bp, Artificial Sequence
  Description of Artificial Sequence: Synthetic oligonucleotide
  Target: SCN9A; (+) strand; PAM type: YTN; PAM sequence: CTG
atccttgctatagaggctag

SEQ ID NO: 107158 - DNA, 20 bp, Artificial Sequence
  Description of Artificial Sequence: Synthetic oligonucleotide
  Target: SCN9A; (+) strand; PAM type: YTN; PAM sequence: CTT
gctatagaggctagtcttac

SEQ ID NO: 107159 - DNA, 20 bp, Artificial Sequence
  Description of Artificial Sequence: Synthetic oligonucleotide
  Target: SCN9A; (+) strand; PAM type: YTN; PAM sequence: TTG
ctatagaggctagtcttaca

SEQ ID NO: 107160 - DNA, 20 bp, Artificial Sequence
  Description of Artificial Sequence: Synthetic oligonucleotide
  Target: SCN9A; (+) strand; PAM type: YTN; PAM sequence: CTA
tagaggctagtcttacacat

SEQ ID NO: 107161 - DNA, 20 bp, Artificial Sequence
  Description of Artificial Sequence: Synthetic oligonucleotide
  Target: SCN9A; (+) strand; PAM type: YTN; PAM sequence: CTA
gtcttacacatggctataag

SEQ ID NO: 107162 - DNA, 20 bp, Artificial Sequence
  Description of Artificial Sequence: Synthetic oligonucleotide
  Target: SCN9A; (+) strand; PAM type: YTN; PAM sequence: CTT
acacatggctataaggtgcg

SEQ ID NO: 107163 - DNA, 20 bp, Artificial Sequence
  Description of Artificial Sequence: Synthetic oligonucleotide
  Target: SCN9A; (+) strand; PAM type: YTN; PAM sequence: TTA
cacatggctataaggtgcgg

SEQ ID NO: 107164 - DNA, 20 bp, Artificial Sequence
  Description of Artificial Sequence: Synthetic oligonucleotide
  Target: SCN9A; (+) strand; PAM type: YTN; PAM sequence: CTA
taaggtgcgggaccagtcct

SEQ ID NO: 107165 - DNA, 20 bp, Artificial Sequence
  Description of Artificial Sequence: Synthetic oligonucleotide
  Target: SCN9A; (+) strand; PAM type: YTN; PAM sequence: CTT
tcatttgccttggtccatta

SEQ ID NO: 107166 - DNA, 20 bp, Artificial Sequence
  Description of Artificial Sequence: Synthetic oligonucleotide
  Target: SCN9A; (+) strand; PAM type: YTN; PAM sequence: TTT
catttgccttggtccattat

SEQ ID NO: 107167 - DNA, 20 bp, Artificial Sequence
  Description of Artificial Sequence: Synthetic oligonucleotide
  Target: SCN9A; (+) strand; PAM type: YTN; PAM sequence: TTC
atttgccttggtccattatt

SEQ ID NO: 107168 - DNA, 20 bp, Artificial Sequence
  Description of Artificial Sequence: Synthetic oligonucleotide
  Target: SCN9A; (+) strand; PAM type: YTN; PAM sequence: TTT
gccttggtccattattaact

SEQ ID NO: 107169 - DNA, 20 bp, Artificial Sequence
  Description of Artificial Sequence: Synthetic oligonucleotide
  Target: SCN9A; (+) strand; PAM type: YTN; PAM sequence: TTG
ccttggtccattattaactt

SEQ ID NO: 107170 - DNA, 20 bp, Artificial Sequence
  Description of Artificial Sequence: Synthetic oligonucleotide
  Target: SCN9A; (+) strand; PAM type: YTN; PAM sequence: CTT
ggtccattattaacttcatt

SEQ ID NO: 107171 - DNA, 20 bp, Artificial Sequence
  Description of Artificial Sequence: Synthetic oligonucleotide
  Target: SCN9A; (+) strand; PAM type: YTN; PAM sequence: TTG
gtccattattaacttcattt

SEQ ID NO: 107172 - DNA, 20 bp, Artificial Sequence
  Description of Artificial Sequence: Synthetic oligonucleotide
  Target: SCN9A; (+) strand; PAM type: YTN; PAM sequence: TTA
ttaacttcatttttgttatt

SEQ ID NO: 107173 - DNA, 20 bp, Artificial Sequence
  Description of Artificial Sequence: Synthetic oligonucleotide
  Target: SCN9A; (+) strand; PAM type: YTN; PAM sequence: TTA
acttcatttttgttattatt

SEQ ID NO: 107174 - DNA, 20 bp, Artificial Sequence
  Description of Artificial Sequence: Synthetic oligonucleotide
  Target: SCN9A; (+) strand; PAM type: YTN; PAM sequence: CTT
catttttgttattattaact

SEQ ID NO: 107175 - DNA, 20 bp, Artificial Sequence
  Description of Artificial Sequence: Synthetic oligonucleotide
  Target: SCN9A; (+) strand; PAM type: YTN; PAM sequence: TTC
atttttgttattattaactt

SEQ ID NO: 107176 - DNA, 20 bp, Artificial Sequence
  Description of Artificial Sequence: Synthetic oligonucleotide
  Target: SCN9A; (+) strand; PAM type: YTN; PAM sequence: TTT
ttgttattattaacttaatt

SEQ ID NO: 107177 - DNA, 20 bp, Artificial Sequence
  Description of Artificial Sequence: Synthetic oligonucleotide
  Target: SCN9A; (+) strand; PAM type: YTN; PAM sequence: TTT
tgttattattaacttaatta

SEQ ID NO: 107178 - DNA, 20 bp, Artificial Sequence
  Description of Artificial Sequence: Synthetic oligonucleotide
  Target: SCN9A; (+) strand; PAM type: YTN; PAM sequence: TTT
gttattattaacttaattat

SEQ ID NO: 107179 - DNA, 20 bp, Artificial Sequence
  Description of Artificial Sequence: Synthetic oligonucleotide
  Target: SCN9A; (+) strand; PAM type: YTN; PAM sequence: TTG
ttattattaacttaattata

SEQ ID NO: 107180 - DNA, 20 bp, Artificial Sequence
  Description of Artificial Sequence: Synthetic oligonucleotide
  Target: SCN9A; (+) strand; PAM type: YTN; PAM sequence: TTA
ttattaacttaattatattt

SEQ ID NO: 107181 - DNA, 20 bp, Artificial Sequence
  Description of Artificial Sequence: Synthetic oligonucleotide
  Target: SCN9A; (+) strand; PAM type: YTN; PAM sequence: TTA
ttaacttaattatattttat

SEQ ID NO: 107182 - DNA, 20 bp, Artificial Sequence
  Description of Artificial Sequence: Synthetic oligonucleotide
  Target: SCN9A; (+) strand; PAM type: YTN; PAM sequence: TTA
acttaattatattttattta

SEQ ID NO: 107183 - DNA, 20 bp, Artificial Sequence
  Description of Artificial Sequence: Synthetic oligonucleotide
  Target: SCN9A; (+) strand; PAM type: YTN; PAM sequence: CTT
aattatattttatttactag

SEQ ID NO: 107184 - DNA, 20 bp, Artificial Sequence
  Description of Artificial Sequence: Synthetic oligonucleotide
  Target: SCN9A; (+) strand; PAM type: YTN; PAM sequence: TTA
attatattttatttactagt

SEQ ID NO: 107185 - DNA, 20 bp, Artificial Sequence
  Description of Artificial Sequence: Synthetic oligonucleotide
  Target: SCN9A; (+) strand; PAM type: YTN; PAM sequence: TTA
tattttatttactagtatag

SEQ ID NO: 107186 - DNA, 20 bp, Artificial Sequence
  Description of Artificial Sequence: Synthetic oligonucleotide
  Target: SCN9A; (+) strand; PAM type: YTN; PAM sequence: TTT
tatttactagtatagcttca

SEQ ID NO: 107187 - DNA, 20 bp, Artificial Sequence
  Description of Artificial Sequence: Synthetic oligonucleotide
  Target: SCN9A; (+) strand; PAM type: YTN; PAM sequence: TTT
atttactagtatagcttcaa

SEQ ID NO: 107188 - DNA, 20 bp, Artificial Sequence
  Description of Artificial Sequence: Synthetic oligonucleotide
  Target: SCN9A; (+) strand; PAM type: YTN; PAM sequence: TTA
tttactagtatagcttcaag

SEQ ID NO: 107189 - DNA, 20 bp, Artificial Sequence
  Description of Artificial Sequence: Synthetic oligonucleotide
  Target: SCN9A; (+) strand; PAM type: YTN; PAM sequence: TTT
actagtatagcttcaagaga

SEQ ID NO: 107190 - DNA, 20 bp, Artificial Sequence
  Description of Artificial Sequence: Synthetic oligonucleotide
  Target: SCN9A; (+) strand; PAM type: YTN; PAM sequence: TTA
ctagtatagcttcaagagag

SEQ ID NO: 107191 - DNA, 20 bp, Artificial Sequence
  Description of Artificial Sequence: Synthetic oligonucleotide
  Target: SCN9A; (+) strand; PAM type: YTN; PAM sequence: CTA
gtatagcttcaagagagcat

SEQ ID NO: 107192 - DNA, 20 bp, Artificial Sequence
  Description of Artificial Sequence: Synthetic oligonucleotide
  Target: SCN9A; (+) strand; PAM type: YTN; PAM sequence: CTT
caagagagcatatgccatca

SEQ ID NO: 107193 - DNA, 20 bp, Artificial Sequence
  Description of Artificial Sequence: Synthetic oligonucleotide
  Target: SCN9A; (+) strand; PAM type: YTN; PAM sequence: TTC
aagagagcatatgccatcac

SEQ ID NO: 107194 - DNA, 20 bp, Artificial Sequence
  Description of Artificial Sequence: Synthetic oligonucleotide
  Target: SCN9A; (+) strand; PAM type: YTN; PAM sequence: CTT
tcaaaattagagaaaaagat

SEQ ID NO: 107195 - DNA, 20 bp, Artificial Sequence
  Description of Artificial Sequence: Synthetic oligonucleotide
  Target: SCN9A; (+) strand; PAM type: YTN; PAM sequence: TTT
caaaattagagaaaaagata

SEQ ID NO: 107196 - DNA, 20 bp, Artificial Sequence
  Description of Artificial Sequence: Synthetic oligonucleotide
  Target: SCN9A; (+) strand; PAM type: YTN; PAM sequence: TTC
aaaattagagaaaaagatag

SEQ ID NO: 107197 - DNA, 20 bp, Artificial Sequence
  Description of Artificial Sequence: Synthetic oligonucleotide
  Target: SCN9A; (+) strand; PAM type: YTN; PAM sequence: TTA
gagaaaaagatagaaacctt

SEQ ID NO: 107198 - DNA, 20 bp, Artificial Sequence
  Description of Artificial Sequence: Synthetic oligonucleotide
  Target: SCN9A; (+) strand; PAM type: YTN; PAM sequence: CTT
tgccttaaaatgaataggca

SEQ ID NO: 107199 - DNA, 20 bp, Artificial Sequence
  Description of Artificial Sequence: Synthetic oligonucleotide
  Target: SCN9A; (+) strand; PAM type: YTN; PAM sequence: TTT
gccttaaaatgaataggcag

SEQ ID NO: 107200 - DNA, 20 bp, Artificial Sequence
  Description of Artificial Sequence: Synthetic oligonucleotide
  Target: SCN9A; (+) strand; PAM type: YTN; PAM sequence: TTG
ccttaaaatgaataggcagt

SEQ ID NO: 107201 - DNA, 20 bp, Artificial Sequence
  Description of Artificial Sequence: Synthetic oligonucleotide
  Target: SCN9A; (+) strand; PAM type: YTN; PAM sequence: CTT
aaaatgaataggcagtgatt

SEQ ID NO: 107202 - DNA, 20 bp, Artificial Sequence
  Description of Artificial Sequence: Synthetic oligonucleotide
  Target: SCN9A; (+) strand; PAM type: YTN; PAM sequence: TTA
aaatgaataggcagtgattt

SEQ ID NO: 107203 - DNA, 20 bp, Artificial Sequence
  Description of Artificial Sequence: Synthetic oligonucleotide
  Target: SCN9A; (+) strand; PAM type: YTN; PAM sequence: TTT
tgaaaaatataaatatgggt

SEQ ID NO: 107204 - DNA, 20 bp, Artificial Sequence
  Description of Artificial Sequence: Synthetic oligonucleotide
  Target: SCN9A; (+) strand; PAM type: YTN; PAM sequence: TTT
gaaaaatataaatatgggtt

SEQ ID NO: 107205 - DNA, 20 bp, Artificial Sequence
  Description of Artificial Sequence: Synthetic oligonucleotide
  Target: SCN9A; (+) strand; PAM type: YTN; PAM sequence: TTG
aaaaatataaatatgggtta

SEQ ID NO: 107206 - DNA, 20 bp, Artificial Sequence
  Description of Artificial Sequence: Synthetic oligonucleotide
  Target: SCN9A; (+) strand; PAM type: YTN; PAM sequence: TTA
tttggctaggaaaactaata

SEQ ID NO: 107207 - DNA, 20 bp, Artificial Sequence
  Description of Artificial Sequence: Synthetic oligonucleotide
  Target: SCN9A; (+) strand; PAM type: YTN; PAM sequence: TTT
ggctaggaaaactaatacaa

SEQ ID NO: 107208 - DNA, 20 bp, Artificial Sequence
  Description of Artificial Sequence: Synthetic oligonucleotide
  Target: SCN9A; (+) strand; PAM type: YTN; PAM sequence: TTG
gctaggaaaactaatacaaa

SEQ ID NO: 107209 - DNA, 20 bp, Artificial Sequence
  Description of Artificial Sequence: Synthetic oligonucleotide
  Target: SCN9A; (+) strand; PAM type: YTN; PAM sequence: CTA
ggaaaactaatacaaaattt

SEQ ID NO: 107210 - DNA, 20 bp, Artificial Sequence
  Description of Artificial Sequence: Synthetic oligonucleotide
  Target: SCN9A; (+) strand; PAM type: YTN; PAM sequence: CTA
atacaaaatttcgttctctt

SEQ ID NO: 107211 - DNA, 20 bp, Artificial Sequence
  Description of Artificial Sequence: Synthetic oligonucleotide
  Target: SCN9A; (+) strand; PAM type: YTN; PAM sequence: TTT
cgttctctttcctgttcttt

SEQ ID NO: 107212 - DNA, 20 bp, Artificial Sequence
  Description of Artificial Sequence: Synthetic oligonucleotide
  Target: SCN9A; (+) strand; PAM type: YTN; PAM sequence: TTC
gttctctttcctgttctttc

SEQ ID NO: 107213 - DNA, 20 bp, Artificial Sequence
  Description of Artificial Sequence: Synthetic oligonucleotide
  Target: SCN9A; (+) strand; PAM type: YTN; PAM sequence: TTC
tctttcctgttctttcttgt

SEQ ID NO: 107214 - DNA, 20 bp, Artificial Sequence
  Description of Artificial Sequence: Synthetic oligonucleotide
  Target: SCN9A; (+) strand; PAM type: YTN; PAM sequence: CTC
tttcctgttctttcttgtat

SEQ ID NO: 107215 - DNA, 20 bp, Artificial Sequence
  Description of Artificial Sequence: Synthetic oligonucleotide
  Target: SCN9A; (+) strand; PAM type: YTN; PAM sequence: CTT
tcctgttctttcttgtatta

SEQ ID NO: 107216 - DNA, 20 bp, Artificial Sequence
  Description of Artificial Sequence: Synthetic oligonucleotide
  Target: SCN9A; (+) strand; PAM type: YTN; PAM sequence: TTT
cctgttctttcttgtattaa

SEQ ID NO: 107217 - DNA, 20 bp, Artificial Sequence
  Description of Artificial Sequence: Synthetic oligonucleotide
  Target: SCN9A; (+) strand; PAM type: YTN; PAM sequence: TTC
ctgttctttcttgtattaaa

SEQ ID NO: 107218 - DNA, 20 bp, Artificial Sequence
  Description of Artificial Sequence: Synthetic oligonucleotide
  Target: SCN9A; (+) strand; PAM type: YTN; PAM sequence: CTG
ttctttcttgtattaaaatt

SEQ ID NO: 107219 - DNA, 20 bp, Artificial Sequence
  Description of Artificial Sequence: Synthetic oligonucleotide
  Target: SCN9A; (+) strand; PAM type: YTN; PAM sequence: TTC
tttcttgtattaaaattatc

SEQ ID NO: 107220 - DNA, 20 bp, Artificial Sequence
  Description of Artificial Sequence: Synthetic oligonucleotide
  Target: SCN9A; (+) strand; PAM type: YTN; PAM sequence: CTT
tcttgtattaaaattatcac

SEQ ID NO: 107221 - DNA, 20 bp, Artificial Sequence
  Description of Artificial Sequence: Synthetic oligonucleotide
  Target: SCN9A; (+) strand; PAM type: YTN; PAM sequence: TTT
cttgtattaaaattatcact

SEQ ID NO: 107222 - DNA, 20 bp, Artificial Sequence
  Description of Artificial Sequence: Synthetic oligonucleotide
  Target: SCN9A; (+) strand; PAM type: YTN; PAM sequence: TTC
ttgtattaaaattatcacta

SEQ ID NO: 107223 - DNA, 20 bp, Artificial Sequence
  Description of Artificial Sequence: Synthetic oligonucleotide
  Target: SCN9A; (+) strand; PAM type: YTN; PAM sequence: CTT
gtattaaaattatcactatt

SEQ ID NO: 107224 - DNA, 20 bp, Artificial Sequence
  Description of Artificial Sequence: Synthetic oligonucleotide
  Target: SCN9A; (+) strand; PAM type: YTN; PAM sequence: TTG
tattaaaattatcactattc

SEQ ID NO: 107225 - DNA, 20 bp, Artificial Sequence
  Description of Artificial Sequence: Synthetic oligonucleotide
  Target: SCN9A; (+) strand; PAM type: YTN; PAM sequence: TTA
aaattatcactattcttttg

SEQ ID NO: 107226 - DNA, 20 bp, Artificial Sequence
  Description of Artificial Sequence: Synthetic oligonucleotide
  Target: SCN9A; (+) strand; PAM type: YTN; PAM sequence: TTA
tcactattcttttgcaatta

SEQ ID NO: 107227 - DNA, 20 bp, Artificial Sequence
  Description of Artificial Sequence: Synthetic oligonucleotide
  Target: SCN9A; (+) strand; PAM type: YTN; PAM sequence: CTA
ttcttttgcaattaataatt

SEQ ID NO: 107228 - DNA, 20 bp, Artificial Sequence
  Description of Artificial Sequence: Synthetic oligonucleotide
  Target: SCN9A; (+) strand; PAM type: YTN; PAM sequence: TTC
ttttgcaattaataattgta

SEQ ID NO: 107229 - DNA, 20 bp, Artificial Sequence
  Description of Artificial Sequence: Synthetic oligonucleotide
  Target: SCN9A; (+) strand; PAM type: YTN; PAM sequence: CTT
ttgcaattaataattgtaga

SEQ ID NO: 107230 - DNA, 20 bp, Artificial Sequence
  Description of Artificial Sequence: Synthetic oligonucleotide
  Target: SCN9A; (+) strand; PAM type: YTN; PAM sequence: TTT
tgcaattaataattgtagat

SEQ ID NO: 107231 - DNA, 20 bp, Artificial Sequence
  Description of Artificial Sequence: Synthetic oligonucleotide
  Target: SCN9A; (+) strand; PAM type: YTN; PAM sequence: TTT
gcaattaataattgtagata

SEQ ID NO: 107232 - DNA, 20 bp, Artificial Sequence
  Description of Artificial Sequence: Synthetic oligonucleotide
  Target: SCN9A; (+) strand; PAM type: YTN; PAM sequence: TTG
caattaataattgtagatat

SEQ ID NO: 107233 - DNA, 20 bp, Artificial Sequence
  Description of Artificial Sequence: Synthetic oligonucleotide
  Target: SCN9A; (+) strand; PAM type: YTN; PAM sequence: TTA
ataattgtagatataattaa

SEQ ID NO: 107234 - DNA, 20 bp, Artificial Sequence
  Description of Artificial Sequence: Synthetic oligonucleotide
  Target: SCN9A; (+) strand; PAM type: YTN; PAM sequence: TTG
tagatataattaattataaa

SEQ ID NO: 107235 - DNA, 20 bp, Artificial Sequence
  Description of Artificial Sequence: Synthetic oligonucleotide
  Target: SCN9A; (+) strand; PAM type: YTN; PAM sequence: TTA
attataaaattataaaaata

SEQ ID NO: 107236 - DNA, 20 bp, Artificial Sequence
  Description of Artificial Sequence: Synthetic oligonucleotide
  Target: SCN9A; (+) strand; PAM type: YTN; PAM sequence: TTA
taaaattataaaaataatag

SEQ ID NO: 107237 - DNA, 20 bp, Artificial Sequence
  Description of Artificial Sequence: Synthetic oligonucleotide
  Target: SCN9A; (+) strand; PAM type: YTN; PAM sequence: TTA
taaaaataatagatcacatc

SEQ ID NO: 107238 - DNA, 20 bp, Artificial Sequence
  Description of Artificial Sequence: Synthetic oligonucleotide
  Target: SCN9A; (+) strand; PAM type: YTN; PAM sequence: TTT
ccacagagaaattaaaatgc

SEQ ID NO: 107239 - DNA, 20 bp, Artificial Sequence
  Description of Artificial Sequence: Synthetic oligonucleotide
  Target: SCN9A; (+) strand; PAM type: YTN; PAM sequence: TTC
cacagagaaattaaaatgca

SEQ ID NO: 107240 - DNA, 20 bp, Artificial Sequence
  Description of Artificial Sequence: Synthetic oligonucleotide
  Target: SCN9A; (+) strand; PAM type: YTN; PAM sequence: TTA
aaatgcatgaacatctggtt

SEQ ID NO: 107241 - DNA, 20 bp, Artificial Sequence
  Description of Artificial Sequence: Synthetic oligonucleotide
  Target: SCN9A; (+) strand; PAM type: YTN; PAM sequence: CTG
gttacataccaccaggtttc

SEQ ID NO: 107242 - DNA, 20 bp, Artificial Sequence
  Description of Artificial Sequence: Synthetic oligonucleotide
  Target: SCN9A; (+) strand; PAM type: YTN; PAM sequence: TTA
cataccaccaggtttccaat

SEQ ID NO: 107243 - DNA, 20 bp, Artificial Sequence
  Description of Artificial Sequence: Synthetic oligonucleotide
  Target: SCN9A; (+) strand; PAM type: YTN; PAM sequence: TTT
ccaatgaccatgaccatcat

SEQ ID NO: 107244 - DNA, 20 bp, Artificial Sequence
  Description of Artificial Sequence: Synthetic oligonucleotide
  Target: SCN9A; (+) strand; PAM type: YTN; PAM sequence: TTC
caatgaccatgaccatcatg

SEQ ID NO: 107245 - DNA, 20 bp, Artificial Sequence
  Description of Artificial Sequence: Synthetic oligonucleotide
  Target: SCN9A; (+) strand; PAM type: YTN; PAM sequence: CTT
gaccagcgacctccatacag

SEQ ID NO: 107246 - DNA, 20 bp, Artificial Sequence
  Description of Artificial Sequence: Synthetic oligonucleotide
  Target: SCN9A; (+) strand; PAM type: YTN; PAM sequence: TTG
accagcgacctccatacagt

SEQ ID NO: 107247 - DNA, 20 bp, Artificial Sequence
  Description of Artificial Sequence: Synthetic oligonucleotide
  Target: SCN9A; (+) strand; PAM type: YTN; PAM sequence: CTC
catacagtcccacatggtct

SEQ ID NO: 107248 - DNA, 20 bp, Artificial Sequence
  Description of Artificial Sequence: Synthetic oligonucleotide
  Target: SCN9A; (+) strand; PAM type: YTN; PAM sequence: CTC
tatccactctccacacagca

SEQ ID NO: 107249 - DNA, 20 bp, Artificial Sequence
  Description of Artificial Sequence: Synthetic oligonucleotide
  Target: SCN9A; (+) strand; PAM type: YTN; PAM sequence: CTA
tccactctccacacagcacg

SEQ ID NO: 107250 - DNA, 20 bp, Artificial Sequence
  Description of Artificial Sequence: Synthetic oligonucleotide
  Target: SCN9A; (+) strand; PAM type: YTN; PAM sequence: CTC
tccacacagcacgcggaaca

SEQ ID NO: 107251 - DNA, 20 bp, Artificial Sequence
  Description of Artificial Sequence: Synthetic oligonucleotide
  Target: SCN9A; (+) strand; PAM type: YTN; PAM sequence: CTC
cacacagcacgcggaacaca

SEQ ID NO: 107252 - DNA, 20 bp, Artificial Sequence
  Description of Artificial Sequence: Synthetic oligonucleotide
  Target: SCN9A; (+) strand; PAM type: YTN; PAM sequence: TTC
atgtgccaccgtgggagcgt

SEQ ID NO: 107253 - DNA, 20 bp, Artificial Sequence
  Description of Artificial Sequence: Synthetic oligonucleotide
  Target: SCN9A; (+) strand; PAM type: YTN; PAM sequence: TTG
atcttgcagacacattcttt

SEQ ID NO: 107254 - DNA, 20 bp, Artificial Sequence
  Description of Artificial Sequence: Synthetic oligonucleotide
  Target: SCN9A; (+) strand; PAM type: YTN; PAM sequence: CTT
gcagacacattctttgtagc

SEQ ID NO: 107255 - DNA, 20 bp, Artificial Sequence
  Description of Artificial Sequence: Synthetic oligonucleotide
  Target: SCN9A; (+) strand; PAM type: YTN; PAM sequence: TTG
cagacacattctttgtagct

SEQ ID NO: 107256 - DNA, 20 bp, Artificial Sequence
  Description of Artificial Sequence: Synthetic oligonucleotide
  Target: SCN9A; (+) strand; PAM type: YTN; PAM sequence: TTC
tttgtagctcttaccaaaga

SEQ ID NO: 107257 - DNA, 20 bp, Artificial Sequence
  Description of Artificial Sequence: Synthetic oligonucleotide
  Target: SCN9A; (+) strand; PAM type: YTN; PAM sequence: CTT
tgtagctcttaccaaagagc

SEQ ID NO: 107258 - DNA, 20 bp, Artificial Sequence
  Description of Artificial Sequence: Synthetic oligonucleotide
  Target: SCN9A; (+) strand; PAM type: YTN; PAM sequence: TTT
gtagctcttaccaaagagct

SEQ ID NO: 107259 - DNA, 20 bp, Artificial Sequence
  Description of Artificial Sequence: Synthetic oligonucleotide
  Target: SCN9A; (+) strand; PAM type: YTN; PAM sequence: TTG
tagctcttaccaaagagctg

SEQ ID NO: 107260 - DNA, 20 bp, Artificial Sequence
  Description of Artificial Sequence: Synthetic oligonucleotide
  Target: SCN9A; (+) strand; PAM type: YTN; PAM sequence: CTC
ttaccaaagagctgcatgcc

SEQ ID NO: 107261 - DNA, 20 bp, Artificial Sequence
  Description of Artificial Sequence: Synthetic oligonucleotide
  Target: SCN9A; (+) strand; PAM type: YTN; PAM sequence: CTT
accaaagagctgcatgccga

SEQ ID NO: 107262 - DNA, 20 bp, Artificial Sequence
  Description of Artificial Sequence: Synthetic oligonucleotide
  Target: SCN9A; (+) strand; PAM type: YTN; PAM sequence: TTA
ccaaagagctgcatgccgac

SEQ ID NO: 107263 - DNA, 20 bp, Artificial Sequence
  Description of Artificial Sequence: Synthetic oligonucleotide
  Target: SCN9A; (+) strand; PAM type: YTN; PAM sequence: CTG
catgccgaccacagcaaaaa

SEQ ID NO: 107264 - DNA, 20 bp, Artificial Sequence
  Description of Artificial Sequence: Synthetic oligonucleotide
  Target: SCN9A; (+) strand; PAM type: YTN; PAM sequence: CTA
aggtgaggttacctagagcc

SEQ ID NO: 107265 - DNA, 20 bp, Artificial Sequence
  Description of Artificial Sequence: Synthetic oligonucleotide
  Target: SCN9A; (+) strand; PAM type: YTN; PAM sequence: TTA
cctagagcccctactgagtt

SEQ ID NO: 107266 - DNA, 20 bp, Artificial Sequence
  Description of Artificial Sequence: Synthetic oligonucleotide
  Target: SCN9A; (+) strand; PAM type: YTN; PAM sequence: CTA
gagcccctactgagttacca

SEQ ID NO: 107267 - DNA, 20 bp, Artificial Sequence
  Description of Artificial Sequence: Synthetic oligonucleotide
  Target: SCN9A; (+) strand; PAM type: YTN; PAM sequence: CTA
ctgagttaccaatgatctta

SEQ ID NO: 107268 - DNA, 20 bp, Artificial Sequence
  Description of Artificial Sequence: Synthetic oligonucleotide
  Target: SCN9A; (+) strand; PAM type: YTN; PAM sequence: CTG
agttaccaatgatcttaatc

SEQ ID NO: 107269 - DNA, 20 bp, Artificial Sequence
  Description of Artificial Sequence: Synthetic oligonucleotide
  Target: SCN9A; (+) strand; PAM type: YTN; PAM sequence: TTA
ccaatgatcttaatcagcat

SEQ ID NO: 107270 - DNA, 20 bp, Artificial Sequence
  Description of Artificial Sequence: Synthetic oligonucleotide
  Target: SCN9A; (+) strand; PAM type: YTN; PAM sequence: CTT
aatcagcatgttcaatgttg

SEQ ID NO: 107271 - DNA, 20 bp, Artificial Sequence
  Description of Artificial Sequence: Synthetic oligonucleotide
  Target: SCN9A; (+) strand; PAM type: YTN; PAM sequence: TTA
atcagcatgttcaatgttgg

SEQ ID NO: 107272 - DNA, 20 bp, Artificial Sequence
  Description of Artificial Sequence: Synthetic oligonucleotide
  Target: SCN9A; (+) strand; PAM type: YTN; PAM sequence: TTC
aatgttggccaggattttgc

SEQ ID NO: 107273 - DNA, 20 bp, Artificial Sequence
  Description of Artificial Sequence: Synthetic oligonucleotide
  Target: SCN9A; (+) strand; PAM type: YTN; PAM sequence: TTG
gccaggattttgccaacttg

SEQ ID NO: 107274 - DNA, 20 bp, Artificial Sequence
  Description of Artificial Sequence: Synthetic oligonucleotide
  Target: SCN9A; (+) strand; PAM type: YTN; PAM sequence: TTT
tgccaacttgaagactcgga

SEQ ID NO: 107275 - DNA, 20 bp, Artificial Sequence
  Description of Artificial Sequence: Synthetic oligonucleotide
  Target: SCN9A; (+) strand; PAM type: YTN; PAM sequence: TTT
gccaacttgaagactcggag

SEQ ID NO: 107276 - DNA, 20 bp, Artificial Sequence
  Description of Artificial Sequence: Synthetic oligonucleotide
  Target: SCN9A; (+) strand; PAM type: YTN; PAM sequence: TTG
ccaacttgaagactcggagc

SEQ ID NO: 107277 - DNA, 20 bp, Artificial Sequence
  Description of Artificial Sequence: Synthetic oligonucleotide
  Target: SCN9A; (+) strand; PAM type: YTN; PAM sequence: CTT
gaagactcggagctaaaagc

SEQ ID NO: 107278 - DNA, 20 bp, Artificial Sequence
  Description of Artificial Sequence: Synthetic oligonucleotide
  Target: SCN9A; (+) strand; PAM type: YTN; PAM sequence: TTG
aagactcggagctaaaagca

SEQ ID NO: 107279 - DNA, 20 bp, Artificial Sequence
  Description of Artificial Sequence: Synthetic oligonucleotide
  Target: SCN9A; (+) strand; PAM type: YTN; PAM sequence: CTC
ggagctaaaagcaaatataa

SEQ ID NO: 107280 - DNA, 20 bp, Artificial Sequence
  Description of Artificial Sequence: Synthetic oligonucleotide
  Target: SCN9A; (+) strand; PAM type: YTN; PAM sequence: CTA
aaagcaaatataaagtttaa

SEQ ID NO: 107281 - DNA, 20 bp, Artificial Sequence
  Description of Artificial Sequence: Synthetic oligonucleotide
  Target: SCN9A; (+) strand; PAM type: YTN; PAM sequence: TTT
aatgttaatcactatgaaaa

SEQ ID NO: 107282 - DNA, 20 bp, Artificial Sequence
  Description of Artificial Sequence: Synthetic oligonucleotide
  Target: SCN9A; (+) strand; PAM type: YTN; PAM sequence: TTA
atgttaatcactatgaaaat

SEQ ID NO: 107283 - DNA, 20 bp, Artificial Sequence
  Description of Artificial Sequence: Synthetic oligonucleotide
  Target: SCN9A; (+) strand; PAM type: YTN; PAM sequence: TTA
atcactatgaaaatcttttc

SEQ ID NO: 107284 - DNA, 20 bp, Artificial Sequence
  Description of Artificial Sequence: Synthetic oligonucleotide
  Target: SCN9A; (+) strand; PAM type: YTN; PAM sequence: CTA
tgaaaatcttttcaatgttt

SEQ ID NO: 107285 - DNA, 20 bp, Artificial Sequence
  Description of Artificial Sequence: Synthetic oligonucleotide
  Target: SCN9A; (+) strand; PAM type: YTN; PAM sequence: CTT
ttcaatgtttccaatcttga

SEQ ID NO: 107286 - DNA, 20 bp, Artificial Sequence
  Description of Artificial Sequence: Synthetic oligonucleotide
  Target: SCN9A; (+) strand; PAM type: YTN; PAM sequence: TTT
tcaatgtttccaatcttgat

SEQ ID NO: 107287 - DNA, 20 bp, Artificial Sequence
  Description of Artificial Sequence: Synthetic oligonucleotide
  Target: SCN9A; (+) strand; PAM type: YTN; PAM sequence: TTT
caatgtttccaatcttgatt

SEQ ID NO: 107288 - DNA, 20 bp, Artificial Sequence
  Description of Artificial Sequence: Synthetic oligonucleotide
  Target: SCN9A; (+) strand; PAM type: YTN; PAM sequence: TTC
aatgtttccaatcttgattt

SEQ ID NO: 107289 - DNA, 20 bp, Artificial Sequence
  Description of Artificial Sequence: Synthetic oligonucleotide
  Target: SCN9A; (+) strand; PAM type: YTN; PAM sequence: TTT
ccaatcttgatttttgttca

SEQ ID NO: 107290 - DNA, 20 bp, Artificial Sequence
  Description of Artificial Sequence: Synthetic oligonucleotide
  Target: SCN9A; (+) strand; PAM type: YTN; PAM sequence: TTC
caatcttgatttttgttcaa

SEQ ID NO: 107291 - DNA, 20 bp, Artificial Sequence
  Description of Artificial Sequence: Synthetic oligonucleotide
  Target: SCN9A; (+) strand; PAM type: YTN; PAM sequence: CTT
gatttttgttcaaagggtaa

SEQ ID NO: 107292 - DNA, 20 bp, Artificial Sequence
  Description of Artificial Sequence: Synthetic oligonucleotide
  Target: SCN9A; (+) strand; PAM type: YTN; PAM sequence: TTG
atttttgttcaaagggtaaa

SEQ ID NO: 107293 - DNA, 20 bp, Artificial Sequence
  Description of Artificial Sequence: Synthetic oligonucleotide
  Target: SCN9A; (+) strand; PAM type: YTN; PAM sequence: TTT
ttgttcaaagggtaaagcag

SEQ ID NO: 107294 - DNA, 20 bp, Artificial Sequence
  Description of Artificial Sequence: Synthetic oligonucleotide
  Target: SCN9A; (+) strand; PAM type: YTN; PAM sequence: TTT
tgttcaaagggtaaagcaga

SEQ ID NO: 107295 - DNA, 20 bp, Artificial Sequence
  Description of Artificial Sequence: Synthetic oligonucleotide
  Target: SCN9A; (+) strand; PAM type: YTN; PAM sequence: TTT
gttcaaagggtaaagcagac

SEQ ID NO: 107296 - DNA, 20 bp, Artificial Sequence
  Description of Artificial Sequence: Synthetic oligonucleotide
  Target: SCN9A; (+) strand; PAM type: YTN; PAM sequence: TTG
ttcaaagggtaaagcagact

SEQ ID NO: 107297 - DNA, 20 bp, Artificial Sequence
  Description of Artificial Sequence: Synthetic oligonucleotide
  Target: SCN9A; (+) strand; PAM type: YTN; PAM sequence: TTC
aaagggtaaagcagacttta

SEQ ID NO: 107298 - DNA, 20 bp, Artificial Sequence
  Description of Artificial Sequence: Synthetic oligonucleotide
  Target: SCN9A; (+) strand; PAM type: YTN; PAM sequence: CTT
taagtcctataatattgtca

SEQ ID NO: 107299 - DNA, 20 bp, Artificial Sequence
  Description of Artificial Sequence: Synthetic oligonucleotide
  Target: SCN9A; (+) strand; PAM type: YTN; PAM sequence: TTT
aagtcctataatattgtcat

SEQ ID NO: 107300 - DNA, 20 bp, Artificial Sequence
  Description of Artificial Sequence: Synthetic oligonucleotide
  Target: SCN9A; (+) strand; PAM type: YTN; PAM sequence: TTA
agtcctataatattgtcatt

SEQ ID NO: 107301 - DNA, 20 bp, Artificial Sequence
  Description of Artificial Sequence: Synthetic oligonucleotide
  Target: SCN9A; (+) strand; PAM type: YTN; PAM sequence: CTA
taatattgtcattattatcc

SEQ ID NO: 107302 - DNA, 20 bp, Artificial Sequence
  Description of Artificial Sequence: Synthetic oligonucleotide
  Target: SCN9A; (+) strand; PAM type: YTN; PAM sequence: TTG
tcattattatccagctaaaa

SEQ ID NO: 107303 - DNA, 20 bp, Artificial Sequence
  Description of Artificial Sequence: Synthetic oligonucleotide
  Target: SCN9A; (+) strand; PAM type: YTN; PAM sequence: TTA
ttatccagctaaaatattct

SEQ ID NO: 107304 - DNA, 20 bp, Artificial Sequence
  Description of Artificial Sequence: Synthetic oligonucleotide
  Target: SCN9A; (+) strand; PAM type: YTN; PAM sequence: TTA
tccagctaaaatattcttat

SEQ ID NO: 107305 - DNA, 20 bp, Artificial Sequence
  Description of Artificial Sequence: Synthetic oligonucleotide
  Target: SCN9A; (+) strand; PAM type: YTN; PAM sequence: CTA
aaatattcttatttttcatt

SEQ ID NO: 107306 - DNA, 20 bp, Artificial Sequence
  Description of Artificial Sequence: Synthetic oligonucleotide
  Target: SCN9A; (+) strand; PAM type: YTN; PAM sequence: TTC
ttatttttcattttcatcaa

SEQ ID NO: 107307 - DNA, 20 bp, Artificial Sequence
  Description of Artificial Sequence: Synthetic oligonucleotide
  Target: SCN9A; (+) strand; PAM type: YTN; PAM sequence: CTT
atttttcattttcatcaatt

SEQ ID NO: 107308 - DNA, 20 bp, Artificial Sequence
  Description of Artificial Sequence: Synthetic oligonucleotide
  Target: SCN9A; (+) strand; PAM type: YTN; PAM sequence: TTA
tttttcattttcatcaattt

SEQ ID NO: 107309 - DNA, 20 bp, Artificial Sequence
  Description of Artificial Sequence: Synthetic oligonucleotide
  Target: SCN9A; (+) strand; PAM type: YTN; PAM sequence: TTT
ttcattttcatcaattttca

SEQ ID NO: 107310 - DNA, 20 bp, Artificial Sequence
  Description of Artificial Sequence: Synthetic oligonucleotide
  Target: SCN9A; (+) strand; PAM type: YTN; PAM sequence: TTT
tcattttcatcaattttcaa

SEQ ID NO: 107311 - DNA, 20 bp, Artificial Sequence
  Description of Artificial Sequence: Synthetic oligonucleotide
  Target: SCN9A; (+) strand; PAM type: YTN; PAM sequence: TTT
cattttcatcaattttcaat

SEQ ID NO: 107312 - DNA, 20 bp, Artificial Sequence
  Description of Artificial Sequence: Synthetic oligonucleotide
  Target: SCN9A; (+) strand; PAM type: YTN; PAM sequence: TTC
attttcatcaattttcaata

SEQ ID NO: 107313 - DNA, 20 bp, Artificial Sequence
  Description of Artificial Sequence: Synthetic oligonucleotide
  Target: SCN9A; (+) strand; PAM type: YTN; PAM sequence: TTT
tcatcaattttcaatatctc

SEQ ID NO: 107314 - DNA, 20 bp, Artificial Sequence
  Description of Artificial Sequence: Synthetic oligonucleotide
  Target: SCN9A; (+) strand; PAM type: YTN; PAM sequence: TTT
catcaattttcaatatctct

SEQ ID NO: 107315 - DNA, 20 bp, Artificial Sequence
  Description of Artificial Sequence: Synthetic oligonucleotide
  Target: SCN9A; (+) strand; PAM type: YTN; PAM sequence: TTC
atcaattttcaatatctctg

SEQ ID NO: 107316 - DNA, 20 bp, Artificial Sequence
  Description of Artificial Sequence: Synthetic oligonucleotide
  Target: SCN9A; (+) strand; PAM type: YTN; PAM sequence: TTT
tcaatatctctgttattttg

SEQ ID NO: 107317 - DNA, 20 bp, Artificial Sequence
  Description of Artificial Sequence: Synthetic oligonucleotide
  Target: SCN9A; (+) strand; PAM type: YTN; PAM sequence: TTT
caatatctctgttattttgt

SEQ ID NO: 107318 - DNA, 20 bp, Artificial Sequence
  Description of Artificial Sequence: Synthetic oligonucleotide
  Target: SCN9A; (+) strand; PAM type: YTN; PAM sequence: TTC
aatatctctgttattttgtt

SEQ ID NO: 107319 - DNA, 20 bp, Artificial Sequence
  Description of Artificial Sequence: Synthetic oligonucleotide
  Target: SCN9A; (+) strand; PAM type: YTN; PAM sequence: CTC
tgttattttgttccacttgc

SEQ ID NO: 107320 - DNA, 20 bp, Artificial Sequence
  Description of Artificial Sequence: Synthetic oligonucleotide
  Target: SCN9A; (+) strand; PAM type: YTN; PAM sequence: CTG
ttattttgttccacttgcca

SEQ ID NO: 107321 - DNA, 20 bp, Artificial Sequence
  Description of Artificial Sequence: Synthetic oligonucleotide
  Target: SCN9A; (+) strand; PAM type: YTN; PAM sequence: TTA
ttttgttccacttgccacaa

SEQ ID NO: 107322 - DNA, 20 bp, Artificial Sequence
  Description of Artificial Sequence: Synthetic oligonucleotide
  Target: SCN9A; (+) strand; PAM type: YTN; PAM sequence: TTT
tgttccacttgccacaaaaa

SEQ ID NO: 107323 - DNA, 20 bp, Artificial Sequence
  Description of Artificial Sequence: Synthetic oligonucleotide
  Target: SCN9A; (+) strand; PAM type: YTN; PAM sequence: TTT
gttccacttgccacaaaaaa

SEQ ID NO: 107324 - DNA, 20 bp, Artificial Sequence
  Description of Artificial Sequence: Synthetic oligonucleotide
  Target: SCN9A; (+) strand; PAM type: YTN; PAM sequence: TTG
ttccacttgccacaaaaaat

SEQ ID NO: 107325 - DNA, 20 bp, Artificial Sequence
  Description of Artificial Sequence: Synthetic oligonucleotide
  Target: SCN9A; (+) strand; PAM type: YTN; PAM sequence: TTC
cacttgccacaaaaaattac

SEQ ID NO: 107326 - DNA, 20 bp, Artificial Sequence
  Description of Artificial Sequence: Synthetic oligonucleotide
  Target: SCN9A; (+) strand; PAM type: YTN; PAM sequence: CTT
gccacaaaaaattacaacac

SEQ ID NO: 107327 - DNA, 20 bp, Artificial Sequence
  Description of Artificial Sequence: Synthetic oligonucleotide
  Target: SCN9A; (+) strand; PAM type: YTN; PAM sequence: TTG
ccacaaaaaattacaacaca

SEQ ID NO: 107328 - DNA, 20 bp, Artificial Sequence
  Description of Artificial Sequence: Synthetic oligonucleotide
  Target: SCN9A; (+) strand; PAM type: YTN; PAM sequence: TTA
caacacatattatgaagaaa

SEQ ID NO: 107329 - DNA, 20 bp, Artificial Sequence
  Description of Artificial Sequence: Synthetic oligonucleotide
  Target: SCN9A; (+) strand; PAM type: YTN; PAM sequence: TTA
tgaagaaactatgtactttt

SEQ ID NO: 107330 - DNA, 20 bp, Artificial Sequence
  Description of Artificial Sequence: Synthetic oligonucleotide
  Target: SCN9A; (+) strand; PAM type: YTN; PAM sequence: CTA
tgtacttttagttcaggatt

SEQ ID NO: 107331 - DNA, 20 bp, Artificial Sequence
  Description of Artificial Sequence: Synthetic oligonucleotide
  Target: SCN9A; (+) strand; PAM type: YTN; PAM sequence: CTT
ttagttcaggattgctatag

SEQ ID NO: 107332 - DNA, 20 bp, Artificial Sequence
  Description of Artificial Sequence: Synthetic oligonucleotide
  Target: SCN9A; (+) strand; PAM type: YTN; PAM sequence: TTT
tagttcaggattgctataga

SEQ ID NO: 107333 - DNA, 20 bp, Artificial Sequence
  Description of Artificial Sequence: Synthetic oligonucleotide
  Target: SCN9A; (+) strand; PAM type: YTN; PAM sequence: TTT
agttcaggattgctatagaa

SEQ ID NO: 107334 - DNA, 20 bp, Artificial Sequence
  Description of Artificial Sequence: Synthetic oligonucleotide
  Target: SCN9A; (+) strand; PAM type: YTN; PAM sequence: TTA
gttcaggattgctatagaaa

SEQ ID NO: 107335 - DNA, 20 bp, Artificial Sequence
  Description of Artificial Sequence: Synthetic oligonucleotide
  Target: SCN9A; (+) strand; PAM type: YTN; PAM sequence: TTC
aggattgctatagaaacctc

SEQ ID NO: 107336 - DNA, 20 bp, Artificial Sequence
  Description of Artificial Sequence: Synthetic oligonucleotide
  Target: SCN9A; (+) strand; PAM type: YTN; PAM sequence: TTG
ctatagaaacctcttatcat

SEQ ID NO: 107337 - DNA, 20 bp, Artificial Sequence
  Description of Artificial Sequence: Synthetic oligonucleotide
  Target: SCN9A; (+) strand; PAM type: YTN; PAM sequence: CTA
tagaaacctcttatcataat

SEQ ID NO: 107338 - DNA, 20 bp, Artificial Sequence
  Description of Artificial Sequence: Synthetic oligonucleotide
  Target: SCN9A; (+) strand; PAM type: YTN; PAM sequence: CTC
ttatcataatttgtgatatt

SEQ ID NO: 107339 - DNA, 20 bp, Artificial Sequence
  Description of Artificial Sequence: Synthetic oligonucleotide
  Target: SCN9A; (+) strand; PAM type: YTN; PAM sequence: CTT
atcataatttgtgatatttt

SEQ ID NO: 107340 - DNA, 20 bp, Artificial Sequence
  Description of Artificial Sequence: Synthetic oligonucleotide
  Target: SCN9A; (+) strand; PAM type: YTN; PAM sequence: TTA
tcataatttgtgatattttt

SEQ ID NO: 107341 - DNA, 20 bp, Artificial Sequence
  Description of Artificial Sequence: Synthetic oligonucleotide
  Target: SCN9A; (+) strand; PAM type: YTN; PAM sequence: TTT
gtgatatttttcttttagaa

SEQ ID NO: 107342 - DNA, 20 bp, Artificial Sequence
  Description of Artificial Sequence: Synthetic oligonucleotide
  Target: SCN9A; (+) strand; PAM type: YTN; PAM sequence: TTG
tgatatttttcttttagaat

SEQ ID NO: 107343 - DNA, 20 bp, Artificial Sequence
  Description of Artificial Sequence: Synthetic oligonucleotide
  Target: SCN9A; (+) strand; PAM type: YTN; PAM sequence: TTT
ttcttttagaattgataatt

SEQ ID NO: 107344 - DNA, 20 bp, Artificial Sequence
  Description of Artificial Sequence: Synthetic oligonucleotide
  Target: SCN9A; (+) strand; PAM type: YTN; PAM sequence: TTT
tcttttagaattgataattt

SEQ ID NO: 107345 - DNA, 20 bp, Artificial Sequence
  Description of Artificial Sequence: Synthetic oligonucleotide
  Target: SCN9A; (+) strand; PAM type: YTN; PAM sequence: TTT
cttttagaattgataattta

SEQ ID NO: 107346 - DNA, 20 bp, Artificial Sequence
  Description of Artificial Sequence: Synthetic oligonucleotide
  Target: SCN9A; (+) strand; PAM type: YTN; PAM sequence: TTC
ttttagaattgataatttat

SEQ ID NO: 107347 - DNA, 20 bp, Artificial Sequence
  Description of Artificial Sequence: Synthetic oligonucleotide
  Target: SCN9A; (+) strand; PAM type: YTN; PAM sequence: CTT
ttagaattgataatttatcc

SEQ ID NO: 107348 - DNA, 20 bp, Artificial Sequence
  Description of Artificial Sequence: Synthetic oligonucleotide
  Target: SCN9A; (+) strand; PAM type: YTN; PAM sequence: TTT
tagaattgataatttatcct

SEQ ID NO: 107349 - DNA, 20 bp, Artificial Sequence
  Description of Artificial Sequence: Synthetic oligonucleotide
  Target: SCN9A; (+) strand; PAM type: YTN; PAM sequence: TTT
agaattgataatttatcctt

SEQ ID NO: 107350 - DNA, 20 bp, Artificial Sequence
  Description of Artificial Sequence: Synthetic oligonucleotide
  Target: SCN9A; (+) strand; PAM type: YTN; PAM sequence: TTA
gaattgataatttatcctta

SEQ ID NO: 107351 - DNA, 20 bp, Artificial Sequence
  Description of Artificial Sequence: Synthetic oligonucleotide
  Target: SCN9A; (+) strand; PAM type: YTN; PAM sequence: TTG
ataatttatccttaattcta

SEQ ID NO: 107352 - DNA, 20 bp, Artificial Sequence
  Description of Artificial Sequence: Synthetic oligonucleotide
  Target: SCN9A; (+) strand; PAM type: YTN; PAM sequence: TTT
atccttaattctactttcta

SEQ ID NO: 107353 - DNA, 20 bp, Artificial Sequence
  Description of Artificial Sequence: Synthetic oligonucleotide
  Target: SCN9A; (+) strand; PAM type: YTN; PAM sequence: TTA
tccttaattctactttctaa

SEQ ID NO: 107354 - DNA, 20 bp, Artificial Sequence
  Description of Artificial Sequence: Synthetic oligonucleotide
  Target: SCN9A; (+) strand; PAM type: YTN; PAM sequence: CTT
aattctactttctaatactt

SEQ ID NO: 107355 - DNA, 20 bp, Artificial Sequence
  Description of Artificial Sequence: Synthetic oligonucleotide
  Target: SCN9A; (+) strand; PAM type: YTN; PAM sequence: TTA
attctactttctaatacttt

SEQ ID NO: 107356 - DNA, 20 bp, Artificial Sequence
  Description of Artificial Sequence: Synthetic oligonucleotide
  Target: SCN9A; (+) strand; PAM type: YTN; PAM sequence: TTC
tactttctaatactttcata

SEQ ID NO: 107357 - DNA, 20 bp, Artificial Sequence
  Description of Artificial Sequence: Synthetic oligonucleotide
  Target: SCN9A; (+) strand; PAM type: YTN; PAM sequence: CTA
ctttctaatactttcataca

SEQ ID NO: 107358 - DNA, 20 bp, Artificial Sequence
  Description of Artificial Sequence: Synthetic oligonucleotide
  Target: SCN9A; (+) strand; PAM type: YTN; PAM sequence: CTT
tctaatactttcatacattt

SEQ ID NO: 107359 - DNA, 20 bp, Artificial Sequence
  Description of Artificial Sequence: Synthetic oligonucleotide
  Target: SCN9A; (+) strand; PAM type: YTN; PAM sequence: TTT
ctaatactttcatacatttt

SEQ ID NO: 107360 - DNA, 20 bp, Artificial Sequence
  Description of Artificial Sequence: Synthetic oligonucleotide
  Target: SCN9A; (+) strand; PAM type: YTN; PAM sequence: TTC
taatactttcatacattttc

SEQ ID NO: 107361 - DNA, 20 bp, Artificial Sequence
  Description of Artificial Sequence: Synthetic oligonucleotide
  Target: SCN9A; (+) strand; PAM type: YTN; PAM sequence: CTA
atactttcatacattttctc

SEQ ID NO: 107362 - DNA, 20 bp, Artificial Sequence
  Description of Artificial Sequence: Synthetic oligonucleotide
  Target: SCN9A; (+) strand; PAM type: YTN; PAM sequence: CTT
tcatacattttctcatgccg

SEQ ID NO: 107363 - DNA, 20 bp, Artificial Sequence
  Description of Artificial Sequence: Synthetic oligonucleotide
  Target: SCN9A; (+) strand; PAM type: YTN; PAM sequence: TTT
catacattttctcatgccga

SEQ ID NO: 107364 - DNA, 20 bp, Artificial Sequence
  Description of Artificial Sequence: Synthetic oligonucleotide
  Target: SCN9A; (+) strand; PAM type: YTN; PAM sequence: TTC
atacattttctcatgccgac

SEQ ID NO: 107365 - DNA, 20 bp, Artificial Sequence
  Description of Artificial Sequence: Synthetic oligonucleotide
  Target: SCN9A; (+) strand; PAM type: YTN; PAM sequence: TTT
tctcatgccgacacttagat

SEQ ID NO: 107366 - DNA, 20 bp, Artificial Sequence
  Description of Artificial Sequence: Synthetic oligonucleotide
  Target: SCN9A; (+) strand; PAM type: YTN; PAM sequence: TTT
ctcatgccgacacttagata

SEQ ID NO: 107367 - DNA, 20 bp, Artificial Sequence
  Description of Artificial Sequence: Synthetic oligonucleotide
  Target: SCN9A; (+) strand; PAM type: YTN; PAM sequence: TTC
tcatgccgacacttagataa

SEQ ID NO: 107368 - DNA, 20 bp, Artificial Sequence
  Description of Artificial Sequence: Synthetic oligonucleotide
  Target: SCN9A; (+) strand; PAM type: YTN; PAM sequence: CTC
atgccgacacttagataaaa

SEQ ID NO: 107369 - DNA, 20 bp, Artificial Sequence
  Description of Artificial Sequence: Synthetic oligonucleotide
  Target: SCN9A; (+) strand; PAM type: YTN; PAM sequence: CTT
agataaaatctagcatatta

SEQ ID NO: 107370 - DNA, 20 bp, Artificial Sequence
  Description of Artificial Sequence: Synthetic oligonucleotide
  Target: SCN9A; (+) strand; PAM type: YTN; PAM sequence: TTA
gataaaatctagcatattag

SEQ ID NO: 107371 - DNA, 20 bp, Artificial Sequence
  Description of Artificial Sequence: Synthetic oligonucleotide
  Target: SCN9A; (+) strand; PAM type: YTN; PAM sequence: CTA
gcatattagaggaatgtgct

SEQ ID NO: 107372 - DNA, 20 bp, Artificial Sequence
  Description of Artificial Sequence: Synthetic oligonucleotide
  Target: SCN9A; (+) strand; PAM type: YTN; PAM sequence: TTA
gaggaatgtgctttaaaaag

SEQ ID NO: 107373 - DNA, 20 bp, Artificial Sequence
  Description of Artificial Sequence: Synthetic oligonucleotide
  Target: SCN9A; (+) strand; PAM type: YTN; PAM sequence: CTT
taaaaagtctttatttgttt

SEQ ID NO: 107374 - DNA, 20 bp, Artificial Sequence
  Description of Artificial Sequence: Synthetic oligonucleotide
  Target: SCN9A; (+) strand; PAM type: YTN; PAM sequence: TTT
aaaaagtctttatttgtttt

SEQ ID NO: 107375 - DNA, 20 bp, Artificial Sequence
  Description of Artificial Sequence: Synthetic oligonucleotide
  Target: SCN9A; (+) strand; PAM type: YTN; PAM sequence: TTA
aaaagtctttatttgttttt

SEQ ID NO: 107376 - DNA, 20 bp, Artificial Sequence
  Description of Artificial Sequence: Synthetic oligonucleotide
  Target: SCN9A; (+) strand; PAM type: YTN; PAM sequence: CTT
tatttgtttttatattgtta

SEQ ID NO: 107377 - DNA, 20 bp, Artificial Sequence
  Description of Artificial Sequence: Synthetic oligonucleotide
  Target: SCN9A; (+) strand; PAM type: YTN; PAM sequence: TTT
atttgtttttatattgttaa

SEQ ID NO: 107378 - DNA, 20 bp, Artificial Sequence
  Description of Artificial Sequence: Synthetic oligonucleotide
  Target: SCN9A; (+) strand; PAM type: YTN; PAM sequence: TTA
tttgtttttatattgttaag

SEQ ID NO: 107379 - DNA, 20 bp, Artificial Sequence
  Description of Artificial Sequence: Synthetic oligonucleotide
  Target: SCN9A; (+) strand; PAM type: YTN; PAM sequence: TTT
gtttttatattgttaagatc

SEQ ID NO: 107380 - DNA, 20 bp, Artificial Sequence
  Description of Artificial Sequence: Synthetic oligonucleotide
  Target: SCN9A; (+) strand; PAM type: YTN; PAM sequence: TTG
tttttatattgttaagatca

SEQ ID NO: 107381 - DNA, 20 bp, Artificial Sequence
  Description of Artificial Sequence: Synthetic oligonucleotide
  Target: SCN9A; (+) strand; PAM type: YTN; PAM sequence: TTT
ttatattgttaagatcagac

SEQ ID NO: 107382 - DNA, 20 bp, Artificial Sequence
  Description of Artificial Sequence: Synthetic oligonucleotide
  Target: SCN9A; (+) strand; PAM type: YTN; PAM sequence: TTT
tatattgttaagatcagaca

SEQ ID NO: 107383 - DNA, 20 bp, Artificial Sequence
  Description of Artificial Sequence: Synthetic oligonucleotide
  Target: SCN9A; (+) strand; PAM type: YTN; PAM sequence: TTT
atattgttaagatcagacaa

SEQ ID NO: 107384 - DNA, 20 bp, Artificial Sequence
  Description of Artificial Sequence: Synthetic oligonucleotide
  Target: SCN9A; (+) strand; PAM type: YTN; PAM sequence: TTA
tattgttaagatcagacaac

SEQ ID NO: 107385 - DNA, 20 bp, Artificial Sequence
  Description of Artificial Sequence: Synthetic oligonucleotide
  Target: SCN9A; (+) strand; PAM type: YTN; PAM sequence: TTG
ttaagatcagacaacaattg

SEQ ID NO: 107386 - DNA, 20 bp, Artificial Sequence
  Description of Artificial Sequence: Synthetic oligonucleotide
  Target: SCN9A; (+) strand; PAM type: YTN; PAM sequence: TTA
agatcagacaacaattgttt

SEQ ID NO: 107387 - DNA, 20 bp, Artificial Sequence
  Description of Artificial Sequence: Synthetic oligonucleotide
  Target: SCN9A; (+) strand; PAM type: YTN; PAM sequence: TTG
ttttgggggataacaatttg

SEQ ID NO: 107388 - DNA, 20 bp, Artificial Sequence
  Description of Artificial Sequence: Synthetic oligonucleotide
  Target: SCN9A; (+) strand; PAM type: YTN; PAM sequence: TTT
tgggggataacaatttgatc

SEQ ID NO: 107389 - DNA, 20 bp, Artificial Sequence
  Description of Artificial Sequence: Synthetic oligonucleotide
  Target: SCN9A; (+) strand; PAM type: YTN; PAM sequence: TTT
gggggataacaatttgatct

SEQ ID NO: 107390 - DNA, 20 bp, Artificial Sequence
  Description of Artificial Sequence: Synthetic oligonucleotide
  Target: SCN9A; (+) strand; PAM type: YTN; PAM sequence: TTG
ggggataacaatttgatctt

SEQ ID NO: 107391 - DNA, 20 bp, Artificial Sequence
  Description of Artificial Sequence: Synthetic oligonucleotide
  Target: SCN9A; (+) strand; PAM type: YTN; PAM sequence: TTT
gatctttaattaccaaattc

SEQ ID NO: 107392 - DNA, 20 bp, Artificial Sequence
  Description of Artificial Sequence: Synthetic oligonucleotide
  Target: SCN9A; (+) strand; PAM type: YTN; PAM sequence: TTG
atctttaattaccaaattca

SEQ ID NO: 107393 - DNA, 20 bp, Artificial Sequence
  Description of Artificial Sequence: Synthetic oligonucleotide
  Target: SCN9A; (+) strand; PAM type: YTN; PAM sequence: CTT
taattaccaaattcataaag

SEQ ID NO: 107394 - DNA, 20 bp, Artificial Sequence
  Description of Artificial Sequence: Synthetic oligonucleotide
  Target: SCN9A; (+) strand; PAM type: YTN; PAM sequence: TTT
aattaccaaattcataaagt

SEQ ID NO: 107395 - DNA, 20 bp, Artificial Sequence
  Description of Artificial Sequence: Synthetic oligonucleotide
  Target: SCN9A; (+) strand; PAM type: YTN; PAM sequence: TTA
attaccaaattcataaagtt

SEQ ID NO: 107396 - DNA, 20 bp, Artificial Sequence
  Description of Artificial Sequence: Synthetic oligonucleotide
  Target: SCN9A; (+) strand; PAM type: YTN; PAM sequence: TTA
ccaaattcataaagttatga

SEQ ID NO: 107397 - DNA, 20 bp, Artificial Sequence
  Description of Artificial Sequence: Synthetic oligonucleotide
  Target: SCN9A; (+) strand; PAM type: YTN; PAM sequence: TTC
ataaagttatgaacatataa

SEQ ID NO: 107398 - DNA, 20 bp, Artificial Sequence
  Description of Artificial Sequence: Synthetic oligonucleotide
  Target: SCN9A; (+) strand; PAM type: YTN; PAM sequence: TTA
tgaacatataatcattgaaa

SEQ ID NO: 107399 - DNA, 20 bp, Artificial Sequence
  Description of Artificial Sequence: Synthetic oligonucleotide
  Target: SCN9A; (+) strand; PAM type: YTN; PAM sequence: TTG
aaattctgtaagccacaagc

SEQ ID NO: 107400 - DNA, 20 bp, Artificial Sequence
  Description of Artificial Sequence: Synthetic oligonucleotide
  Target: SCN9A; (+) strand; PAM type: YTN; PAM sequence: TTC
tgtaagccacaagcttctta

SEQ ID NO: 107401 - DNA, 20 bp, Artificial Sequence
  Description of Artificial Sequence: Synthetic oligonucleotide
  Target: SCN9A; (+) strand; PAM type: YTN; PAM sequence: CTG
taagccacaagcttcttact

SEQ ID NO: 107402 - DNA, 20 bp, Artificial Sequence
  Description of Artificial Sequence: Synthetic oligonucleotide
  Target: SCN9A; (+) strand; PAM type: YTN; PAM sequence: CTT
cttactctgaaataaattat

SEQ ID NO: 107403 - DNA, 20 bp, Artificial Sequence
  Description of Artificial Sequence: Synthetic oligonucleotide
  Target: SCN9A; (+) strand; PAM type: YTN; PAM sequence: TTC
ttactctgaaataaattatt

SEQ ID NO: 107404 - DNA, 20 bp, Artificial Sequence
  Description of Artificial Sequence: Synthetic oligonucleotide
  Target: SCN9A; (+) strand; PAM type: YTN; PAM sequence: CTT
actctgaaataaattattgt

SEQ ID NO: 107405 - DNA, 20 bp, Artificial Sequence
  Description of Artificial Sequence: Synthetic oligonucleotide
  Target: SCN9A; (+) strand; PAM type: YTN; PAM sequence: TTA
ctctgaaataaattattgta

SEQ ID NO: 107406 - DNA, 20 bp, Artificial Sequence
  Description of Artificial Sequence: Synthetic oligonucleotide
  Target: SCN9A; (+) strand; PAM type: YTN; PAM sequence: CTC
tgaaataaattattgtacta

SEQ ID NO: 107407 - DNA, 20 bp, Artificial Sequence
  Description of Artificial Sequence: Synthetic oligonucleotide
  Target: SCN9A; (+) strand; PAM type: YTN; PAM sequence: CTG
aaataaattattgtactata

SEQ ID NO: 107408 - DNA, 20 bp, Artificial Sequence
  Description of Artificial Sequence: Synthetic oligonucleotide
  Target: SCN9A; (+) strand; PAM type: YTN; PAM sequence: TTA
ttgtactatattaatagaaa

SEQ ID NO: 107409 - DNA, 20 bp, Artificial Sequence
  Description of Artificial Sequence: Synthetic oligonucleotide
  Target: SCN9A; (+) strand; PAM type: YTN; PAM sequence: TTG
tactatattaatagaaaata

SEQ ID NO: 107410 - DNA, 20 bp, Artificial Sequence
  Description of Artificial Sequence: Synthetic oligonucleotide
  Target: SCN9A; (+) strand; PAM type: YTN; PAM sequence: CTA
tattaatagaaaatatttat

SEQ ID NO: 107411 - DNA, 20 bp, Artificial Sequence
  Description of Artificial Sequence: Synthetic oligonucleotide
  Target: SCN9A; (+) strand; PAM type: YTN; PAM sequence: TTA
atagaaaatatttatattat

SEQ ID NO: 107412 - DNA, 20 bp, Artificial Sequence
  Description of Artificial Sequence: Synthetic oligonucleotide
  Target: SCN9A; (+) strand; PAM type: YTN; PAM sequence: TTT
atattatattagcgtgtact

SEQ ID NO: 107413 - DNA, 20 bp, Artificial Sequence
  Description of Artificial Sequence: Synthetic oligonucleotide
  Target: SCN9A; (+) strand; PAM type: YTN; PAM sequence: TTA
tattatattagcgtgtactt

SEQ ID NO: 107414 - DNA, 20 bp, Artificial Sequence
  Description of Artificial Sequence: Synthetic oligonucleotide
  Target: SCN9A; (+) strand; PAM type: YTN; PAM sequence: TTA
tattagcgtgtacttcaaat

SEQ ID NO: 107415 - DNA, 20 bp, Artificial Sequence
  Description of Artificial Sequence: Synthetic oligonucleotide
  Target: SCN9A; (+) strand; PAM type: YTN; PAM sequence: TTA
gcgtgtacttcaaattagaa

SEQ ID NO: 107416 - DNA, 20 bp, Artificial Sequence
  Description of Artificial Sequence: Synthetic oligonucleotide
  Target: SCN9A; (+) strand; PAM type: YTN; PAM sequence: CTT
caaattagaattgagcatgt

SEQ ID NO: 107417 - DNA, 20 bp, Artificial Sequence
  Description of Artificial Sequence: Synthetic oligonucleotide
  Target: SCN9A; (+) strand; PAM type: YTN; PAM sequence: TTC
aaattagaattgagcatgtc

SEQ ID NO: 107418 - DNA, 20 bp, Artificial Sequence
  Description of Artificial Sequence: Synthetic oligonucleotide
  Target: SCN9A; (+) strand; PAM type: YTN; PAM sequence: TTA
gaattgagcatgtcttcaaa

SEQ ID NO: 107419 - DNA, 20 bp, Artificial Sequence
  Description of Artificial Sequence: Synthetic oligonucleotide
  Target: SCN9A; (+) strand; PAM type: YTN; PAM sequence: TTG
agcatgtcttcaaaaattgt

SEQ ID NO: 107420 - DNA, 20 bp, Artificial Sequence
  Description of Artificial Sequence: Synthetic oligonucleotide
  Target: SCN9A; (+) strand; PAM type: YTN; PAM sequence: CTT
caaaaattgtaaaaatattc

SEQ ID NO: 107421 - DNA, 20 bp, Artificial Sequence
  Description of Artificial Sequence: Synthetic oligonucleotide
  Target: SCN9A; (+) strand; PAM type: YTN; PAM sequence: TTC
aaaaattgtaaaaatattca

SEQ ID NO: 107422 - DNA, 20 bp, Artificial Sequence
  Description of Artificial Sequence: Synthetic oligonucleotide
  Target: SCN9A; (+) strand; PAM type: YTN; PAM sequence: TTG
taaaaatattcatgtggttt

SEQ ID NO: 107423 - DNA, 20 bp, Artificial Sequence
  Description of Artificial Sequence: Synthetic oligonucleotide
  Target: SCN9A; (+) strand; PAM type: YTN; PAM sequence: TTC
atgtggttttagttctttaa

SEQ ID NO: 107424 - DNA, 20 bp, Artificial Sequence
  Description of Artificial Sequence: Synthetic oligonucleotide
  Target: SCN9A; (+) strand; PAM type: YTN; PAM sequence: TTT
tagttctttaagtgcatttg

SEQ ID NO: 107425 - DNA, 20 bp, Artificial Sequence
  Description of Artificial Sequence: Synthetic oligonucleotide
  Target: SCN9A; (+) strand; PAM type: YTN; PAM sequence: TTT
agttctttaagtgcatttgt

SEQ ID NO: 107426 - DNA, 20 bp, Artificial Sequence
  Description of Artificial Sequence: Synthetic oligonucleotide
  Target: SCN9A; (+) strand; PAM type: YTN; PAM sequence: TTA
gttctttaagtgcatttgtc

SEQ ID NO: 107427 - DNA, 20 bp, Artificial Sequence
  Description of Artificial Sequence: Synthetic oligonucleotide
  Target: SCN9A; (+) strand; PAM type: YTN; PAM sequence: TTC
tttaagtgcatttgtcaatg

SEQ ID NO: 107428 - DNA, 20 bp, Artificial Sequence
  Description of Artificial Sequence: Synthetic oligonucleotide
  Target: SCN9A; (+) strand; PAM type: YTN; PAM sequence: CTT
taagtgcatttgtcaatgaa

SEQ ID NO: 107429 - DNA, 20 bp, Artificial Sequence
  Description of Artificial Sequence: Synthetic oligonucleotide
  Target: SCN9A; (+) strand; PAM type: YTN; PAM sequence: TTT
aagtgcatttgtcaatgaat

SEQ ID NO: 107430 - DNA, 20 bp, Artificial Sequence
  Description of Artificial Sequence: Synthetic oligonucleotide
  Target: SCN9A; (+) strand; PAM type: YTN; PAM sequence: TTA
agtgcatttgtcaatgaatg

SEQ ID NO: 107431 - DNA, 20 bp, Artificial Sequence
  Description of Artificial Sequence: Synthetic oligonucleotide
  Target: SCN9A; (+) strand; PAM type: YTN; PAM sequence: TTT
gtcaatgaatggattttatt

SEQ ID NO: 107432 - DNA, 20 bp, Artificial Sequence
  Description of Artificial Sequence: Synthetic oligonucleotide
  Target: SCN9A; (+) strand; PAM type: YTN; PAM sequence: TTG
tcaatgaatggattttattt

SEQ ID NO: 107433 - DNA, 20 bp, Artificial Sequence
  Description of Artificial Sequence: Synthetic oligonucleotide
  Target: SCN9A; (+) strand; PAM type: YTN; PAM sequence: TTT
tattttactagatatcaaga

SEQ ID NO: 107434 - DNA, 20 bp, Artificial Sequence
  Description of Artificial Sequence: Synthetic oligonucleotide
  Target: SCN9A; (+) strand; PAM type: YTN; PAM sequence: TTT
attttactagatatcaagat

SEQ ID NO: 107435 - DNA, 20 bp, Artificial Sequence
  Description of Artificial Sequence: Synthetic oligonucleotide
  Target: SCN9A; (+) strand; PAM type: YTN; PAM sequence: TTA
ttttactagatatcaagata

SEQ ID NO: 107436 - DNA, 20 bp, Artificial Sequence
  Description of Artificial Sequence: Synthetic oligonucleotide
  Target: SCN9A; (+) strand; PAM type: YTN; PAM sequence: TTT
tactagatatcaagatataa

SEQ ID NO: 107437 - DNA, 20 bp, Artificial Sequence
  Description of Artificial Sequence: Synthetic oligonucleotide
  Target: SCN9A; (+) strand; PAM type: YTN; PAM sequence: TTT
actagatatcaagatataat

SEQ ID NO: 107438 - DNA, 20 bp, Artificial Sequence
  Description of Artificial Sequence: Synthetic oligonucleotide
  Target: SCN9A; (+) strand; PAM type: YTN; PAM sequence: TTA
ctagatatcaagatataatc

SEQ ID NO: 107439 - DNA, 20 bp, Artificial Sequence
  Description of Artificial Sequence: Synthetic oligonucleotide
  Target: SCN9A; (+) strand; PAM type: YTN; PAM sequence: CTA
gatatcaagatataatcttg

SEQ ID NO: 107440 - DNA, 20 bp, Artificial Sequence
  Description of Artificial Sequence: Synthetic oligonucleotide
  Target: SCN9A; (+) strand; PAM type: YTN; PAM sequence: CTT
gccttttgattcaaattccc

SEQ ID NO: 107441 - DNA, 20 bp, Artificial Sequence
  Description of Artificial Sequence: Synthetic oligonucleotide
  Target: SCN9A; (+) strand; PAM type: YTN; PAM sequence: TTG
ccttttgattcaaattccca

SEQ ID NO: 107442 - DNA, 20 bp, Artificial Sequence
  Description of Artificial Sequence: Synthetic oligonucleotide
  Target: SCN9A; (+) strand; PAM type: YTN; PAM sequence: CTT
ttgattcaaattcccaaaag

SEQ ID NO: 107443 - DNA, 20 bp, Artificial Sequence
  Description of Artificial Sequence: Synthetic oligonucleotide
  Target: SCN9A; (+) strand; PAM type: YTN; PAM sequence: TTT
tgattcaaattcccaaaagt

SEQ ID NO: 107444 - DNA, 20 bp, Artificial Sequence
  Description of Artificial Sequence: Synthetic oligonucleotide
  Target: SCN9A; (+) strand; PAM type: YTN; PAM sequence: TTT
gattcaaattcccaaaagtt

SEQ ID NO: 107445 - DNA, 20 bp, Artificial Sequence
  Description of Artificial Sequence: Synthetic oligonucleotide
  Target: SCN9A; (+) strand; PAM type: YTN; PAM sequence: TTG
attcaaattcccaaaagttt

SEQ ID NO: 107446 - DNA, 20 bp, Artificial Sequence
  Description of Artificial Sequence: Synthetic oligonucleotide
  Target: SCN9A; (+) strand; PAM type: YTN; PAM sequence: TTC
aaattcccaaaagtttttaa

SEQ ID NO: 107447 - DNA, 20 bp, Artificial Sequence
  Description of Artificial Sequence: Synthetic oligonucleotide
  Target: SCN9A; (+) strand; PAM type: YTN; PAM sequence: TTC
ccaaaagtttttaaaaataa

SEQ ID NO: 107448 - DNA, 20 bp, Artificial Sequence
  Description of Artificial Sequence: Synthetic oligonucleotide
  Target: SCN9A; (+) strand; PAM type: YTN; PAM sequence: TTT
ttaaaaataatgcaaaacca

SEQ ID NO: 107449 - DNA, 20 bp, Artificial Sequence
  Description of Artificial Sequence: Synthetic oligonucleotide
  Target: SCN9A; (+) strand; PAM type: YTN; PAM sequence: TTT
taaaaataatgcaaaaccaa

SEQ ID NO: 107450 - DNA, 20 bp, Artificial Sequence
  Description of Artificial Sequence: Synthetic oligonucleotide
  Target: SCN9A; (+) strand; PAM type: YTN; PAM sequence: TTT
aaaaataatgcaaaaccaaa

SEQ ID NO: 107451 - DNA, 20 bp, Artificial Sequence
  Description of Artificial Sequence: Synthetic oligonucleotide
  Target: SCN9A; (+) strand; PAM type: YTN; PAM sequence: TTA
aaaataatgcaaaaccaaag

SEQ ID NO: 107452 - DNA, 20 bp, Artificial Sequence
  Description of Artificial Sequence: Synthetic oligonucleotide
  Target: SCN9A; (+) strand; PAM type: YTN; PAM sequence: CTT
tattatagaatataatggca

SEQ ID NO: 107453 - DNA, 20 bp, Artificial Sequence
  Description of Artificial Sequence: Synthetic oligonucleotide
  Target: SCN9A; (+) strand; PAM type: YTN; PAM sequence: TTT
attatagaatataatggcaa

SEQ ID NO: 107454 - DNA, 20 bp, Artificial Sequence
  Description of Artificial Sequence: Synthetic oligonucleotide
  Target: SCN9A; (+) strand; PAM type: YTN; PAM sequence: TTA
ttatagaatataatggcaac

SEQ ID NO: 107455 - DNA, 20 bp, Artificial Sequence
  Description of Artificial Sequence: Synthetic oligonucleotide
  Target: SCN9A; (+) strand; PAM type: YTN; PAM sequence: TTA
tagaatataatggcaacctt

SEQ ID NO: 107456 - DNA, 20 bp, Artificial Sequence
  Description of Artificial Sequence: Synthetic oligonucleotide
  Target: SCN9A; (+) strand; PAM type: YTN; PAM sequence: CTT
agtttatgtttaccagtctg

SEQ ID NO: 107457 - DNA, 20 bp, Artificial Sequence
  Description of Artificial Sequence: Synthetic oligonucleotide
  Target: SCN9A; (+) strand; PAM type: YTN; PAM sequence: TTA
gtttatgtttaccagtctga

SEQ ID NO: 107458 - DNA, 20 bp, Artificial Sequence
  Description of Artificial Sequence: Synthetic oligonucleotide
  Target: SCN9A; (+) strand; PAM type: YTN; PAM sequence: TTT
atgtttaccagtctgaatga

SEQ ID NO: 107459 - DNA, 20 bp, Artificial Sequence
  Description of Artificial Sequence: Synthetic oligonucleotide
  Target: SCN9A; (+) strand; PAM type: YTN; PAM sequence: TTA
tgtttaccagtctgaatgat

SEQ ID NO: 107460 - DNA, 20 bp, Artificial Sequence
  Description of Artificial Sequence: Synthetic oligonucleotide
  Target: SCN9A; (+) strand; PAM type: YTN; PAM sequence: TTT
accagtctgaatgatcgcag

SEQ ID NO: 107461 - DNA, 20 bp, Artificial Sequence
  Description of Artificial Sequence: Synthetic oligonucleotide
  Target: SCN9A; (+) strand; PAM type: YTN; PAM sequence: TTA
ccagtctgaatgatcgcaga

SEQ ID NO: 107462 - DNA, 20 bp, Artificial Sequence
  Description of Artificial Sequence: Synthetic oligonucleotide
  Target: SCN9A; (+) strand; PAM type: YTN; PAM sequence: CTG
aatgatcgcagaactgacaa

SEQ ID NO: 107463 - DNA, 20 bp, Artificial Sequence
  Description of Artificial Sequence: Synthetic oligonucleotide
  Target: SCN9A; (+) strand; PAM type: YTN; PAM sequence: CTG
acaatccttccacatctgct

SEQ ID NO: 107464 - DNA, 20 bp, Artificial Sequence
  Description of Artificial Sequence: Synthetic oligonucleotide
  Target: SCN9A; (+) strand; PAM type: YTN; PAM sequence: CTT
ccacatctgctagaaagagc

SEQ ID NO: 107465 - DNA, 20 bp, Artificial Sequence
  Description of Artificial Sequence: Synthetic oligonucleotide
  Target: SCN9A; (+) strand; PAM type: YTN; PAM sequence: TTC
cacatctgctagaaagagct

SEQ ID NO: 107466 - DNA, 20 bp, Artificial Sequence
  Description of Artificial Sequence: Synthetic oligonucleotide
  Target: SCN9A; (+) strand; PAM type: YTN; PAM sequence: CTG
ctagaaagagctccactaaa

SEQ ID NO: 107467 - DNA, 20 bp, Artificial Sequence
  Description of Artificial Sequence: Synthetic oligonucleotide
  Target: SCN9A; (+) strand; PAM type: YTN; PAM sequence: CTA
gaaagagctccactaaactt

SEQ ID NO: 107468 - DNA, 20 bp, Artificial Sequence
  Description of Artificial Sequence: Synthetic oligonucleotide
  Target: SCN9A; (+) strand; PAM type: YTN; PAM sequence: CTC
cactaaacttaaagtcacaa

SEQ ID NO: 107469 - DNA, 20 bp, Artificial Sequence
  Description of Artificial Sequence: Synthetic oligonucleotide
  Target: SCN9A; (+) strand; PAM type: YTN; PAM sequence: CTA
aacttaaagtcacaataagg

SEQ ID NO: 107470 - DNA, 20 bp, Artificial Sequence
  Description of Artificial Sequence: Synthetic oligonucleotide
  Target: SCN9A; (+) strand; PAM type: YTN; PAM sequence: CTT
aaagtcacaataaggctgtc

SEQ ID NO: 107471 - DNA, 20 bp, Artificial Sequence
  Description of Artificial Sequence: Synthetic oligonucleotide
  Target: SCN9A; (+) strand; PAM type: YTN; PAM sequence: TTA
aagtcacaataaggctgtca

SEQ ID NO: 107472 - DNA, 20 bp, Artificial Sequence
  Description of Artificial Sequence: Synthetic oligonucleotide
  Target: SCN9A; (+) strand; PAM type: YTN; PAM sequence: CTG
tcaaaaatattccagcctac

SEQ ID NO: 107473 - DNA, 20 bp, Artificial Sequence
  Description of Artificial Sequence: Synthetic oligonucleotide
  Target: SCN9A; (+) strand; PAM type: YTN; PAM sequence: TTC
cagcctacttggaaatactc

SEQ ID NO: 107474 - DNA, 20 bp, Artificial Sequence
  Description of Artificial Sequence: Synthetic oligonucleotide
  Target: SCN9A; (+) strand; PAM type: YTN; PAM sequence: CTA
cttggaaatactcatatgga

SEQ ID NO: 107475 - DNA, 20 bp, Artificial Sequence
  Description of Artificial Sequence: Synthetic oligonucleotide
  Target: SCN9A; (+) strand; PAM type: YTN; PAM sequence: CTT
ggaaatactcatatggatcc

SEQ ID NO: 107476 - DNA, 20 bp, Artificial Sequence
  Description of Artificial Sequence: Synthetic oligonucleotide
  Target: SCN9A; (+) strand; PAM type: YTN; PAM sequence: TTG
gaaatactcatatggatcca

SEQ ID NO: 107477 - DNA, 20 bp, Artificial Sequence
  Description of Artificial Sequence: Synthetic oligonucleotide
  Target: SCN9A; (+) strand; PAM type: YTN; PAM sequence: CTC
atatggatccatggcaatca

SEQ ID NO: 107478 - DNA, 20 bp, Artificial Sequence
  Description of Artificial Sequence: Synthetic oligonucleotide
  Target: SCN9A; (+) strand; PAM type: YTN; PAM sequence: TTT
taataccatttcagctgcaa

SEQ ID NO: 107479 - DNA, 20 bp, Artificial Sequence
  Description of Artificial Sequence: Synthetic oligonucleotide
  Target: SCN9A; (+) strand; PAM type: YTN; PAM sequence: TTT
aataccatttcagctgcaaa

SEQ ID NO: 107480 - DNA, 20 bp, Artificial Sequence
  Description of Artificial Sequence: Synthetic oligonucleotide
  Target: SCN9A; (+) strand; PAM type: YTN; PAM sequence: TTA
ataccatttcagctgcaaag

SEQ ID NO: 107481 - DNA, 20 bp, Artificial Sequence
  Description of Artificial Sequence: Synthetic oligonucleotide
  Target: SCN9A; (+) strand; PAM type: YTN; PAM sequence: TTT
cagctgcaaagattccagta

SEQ ID NO: 107482 - DNA, 20 bp, Artificial Sequence
  Description of Artificial Sequence: Synthetic oligonucleotide
  Target: SCN9A; (+) strand; PAM type: YTN; PAM sequence: TTC
agctgcaaagattccagtaa

SEQ ID NO: 107483 - DNA, 20 bp, Artificial Sequence
  Description of Artificial Sequence: Synthetic oligonucleotide
  Target: SCN9A; (+) strand; PAM type: YTN; PAM sequence: CTG
caaagattccagtaaagacc

SEQ ID NO: 107484 - DNA, 20 bp, Artificial Sequence
  Description of Artificial Sequence: Synthetic oligonucleotide
  Target: SCN9A; (+) strand; PAM type: YTN; PAM sequence: TTC
cagtaaagacctaagtgaga

SEQ ID NO: 107485 - DNA, 20 bp, Artificial Sequence
  Description of Artificial Sequence: Synthetic oligonucleotide
  Target: SCN9A; (+) strand; PAM type: YTN; PAM sequence: CTA
agtgagaaaaataatgtttt

SEQ ID NO: 107486 - DNA, 20 bp, Artificial Sequence
  Description of Artificial Sequence: Synthetic oligonucleotide
  Target: SCN9A; (+) strand; PAM type: YTN; PAM sequence: TTT
ttctgttaatattagaaaac

SEQ ID NO: 107487 - DNA, 20 bp, Artificial Sequence
  Description of Artificial Sequence: Synthetic oligonucleotide
  Target: SCN9A; (+) strand; PAM type: YTN; PAM sequence: TTT
tctgttaatattagaaaaca

SEQ ID NO: 107488 - DNA, 20 bp, Artificial Sequence
  Description of Artificial Sequence: Synthetic oligonucleotide
  Target: SCN9A; (+) strand; PAM type: YTN; PAM sequence: TTT
ctgttaatattagaaaacag

SEQ ID NO: 107489 - DNA, 20 bp, Artificial Sequence
  Description of Artificial Sequence: Synthetic oligonucleotide
  Target: SCN9A; (+) strand; PAM type: YTN; PAM sequence: TTC
tgttaatattagaaaacagg

SEQ ID NO: 107490 - DNA, 20 bp, Artificial Sequence
  Description of Artificial Sequence: Synthetic oligonucleotide
  Target: SCN9A; (+) strand; PAM type: YTN; PAM sequence: CTG
ttaatattagaaaacaggaa

SEQ ID NO: 107491 - DNA, 20 bp, Artificial Sequence
  Description of Artificial Sequence: Synthetic oligonucleotide
  Target: SCN9A; (+) strand; PAM type: YTN; PAM sequence: TTA
atattagaaaacaggaaatc

SEQ ID NO: 107492 - DNA, 20 bp, Artificial Sequence
  Description of Artificial Sequence: Synthetic oligonucleotide
  Target: SCN9A; (+) strand; PAM type: YTN; PAM sequence: TTA
gaaaacaggaaatcaacaca

SEQ ID NO: 107493 - DNA, 20 bp, Artificial Sequence
  Description of Artificial Sequence: Synthetic oligonucleotide
  Target: SCN9A; (+) strand; PAM type: YTN; PAM sequence: CTG
tttgcttagcatttactgtg

SEQ ID NO: 107494 - DNA, 20 bp, Artificial Sequence
  Description of Artificial Sequence: Synthetic oligonucleotide
  Target: SCN9A; (+) strand; PAM type: YTN; PAM sequence: TTT
gcttagcatttactgtgttc

SEQ ID NO: 107495 - DNA, 20 bp, Artificial Sequence
  Description of Artificial Sequence: Synthetic oligonucleotide
  Target: SCN9A; (+) strand; PAM type: YTN; PAM sequence: TTG
cttagcatttactgtgttcc

SEQ ID NO: 107496 - DNA, 20 bp, Artificial Sequence
  Description of Artificial Sequence: Synthetic oligonucleotide
  Target: SCN9A; (+) strand; PAM type: YTN; PAM sequence: CTT
agcatttactgtgttccaga

SEQ ID NO: 107497 - DNA, 20 bp, Artificial Sequence
  Description of Artificial Sequence: Synthetic oligonucleotide
  Target: SCN9A; (+) strand; PAM type: YTN; PAM sequence: TTA
gcatttactgtgttccagac

SEQ ID NO: 107498 - DNA, 20 bp, Artificial Sequence
  Description of Artificial Sequence: Synthetic oligonucleotide
  Target: SCN9A; (+) strand; PAM type: YTN; PAM sequence: TTT
actgtgttccagacagtttg

SEQ ID NO: 107499 - DNA, 20 bp, Artificial Sequence
  Description of Artificial Sequence: Synthetic oligonucleotide
  Target: SCN9A; (+) strand; PAM type: YTN; PAM sequence: TTA
ctgtgttccagacagtttgc

SEQ ID NO: 107500 - DNA, 20 bp, Artificial Sequence
  Description of Artificial Sequence: Synthetic oligonucleotide
  Target: SCN9A; (+) strand; PAM type: YTN; PAM sequence: CTG
tgttccagacagtttgctaa

SEQ ID NO: 107501 - DNA, 20 bp, Artificial Sequence
  Description of Artificial Sequence: Synthetic oligonucleotide
  Target: SCN9A; (+) strand; PAM type: YTN; PAM sequence: TTC
cagacagtttgctaaatact

SEQ ID NO: 107502 - DNA, 20 bp, Artificial Sequence
  Description of Artificial Sequence: Synthetic oligonucleotide
  Target: SCN9A; (+) strand; PAM type: YTN; PAM sequence: TTT
gctaaatactttataaatgg

SEQ ID NO: 107503 - DNA, 20 bp, Artificial Sequence
  Description of Artificial Sequence: Synthetic oligonucleotide
  Target: SCN9A; (+) strand; PAM type: YTN; PAM sequence: TTG
ctaaatactttataaatgga

SEQ ID NO: 107504 - DNA, 20 bp, Artificial Sequence
  Description of Artificial Sequence: Synthetic oligonucleotide
  Target: SCN9A; (+) strand; PAM type: YTN; PAM sequence: CTA
aatactttataaatggatat

SEQ ID NO: 107505 - DNA, 20 bp, Artificial Sequence
  Description of Artificial Sequence: Synthetic oligonucleotide
  Target: SCN9A; (+) strand; PAM type: YTN; PAM sequence: CTT
tataaatggatattcttatc

SEQ ID NO: 107506 - DNA, 20 bp, Artificial Sequence
  Description of Artificial Sequence: Synthetic oligonucleotide
  Target: SCN9A; (+) strand; PAM type: YTN; PAM sequence: TTT
ataaatggatattcttatct

SEQ ID NO: 107507 - DNA, 20 bp, Artificial Sequence
  Description of Artificial Sequence: Synthetic oligonucleotide
  Target: SCN9A; (+) strand; PAM type: YTN; PAM sequence: TTA
taaatggatattcttatcta

SEQ ID NO: 107508 - DNA, 20 bp, Artificial Sequence
  Description of Artificial Sequence: Synthetic oligonucleotide
  Target: SCN9A; (+) strand; PAM type: YTN; PAM sequence: TTC
ttatctaacttagtcctgta

SEQ ID NO: 107509 - DNA, 20 bp, Artificial Sequence
  Description of Artificial Sequence: Synthetic oligonucleotide
  Target: SCN9A; (+) strand; PAM type: YTN; PAM sequence: CTT
atctaacttagtcctgtaaa

SEQ ID NO: 107510 - DNA, 20 bp, Artificial Sequence
  Description of Artificial Sequence: Synthetic oligonucleotide
  Target: SCN9A; (+) strand; PAM type: YTN; PAM sequence: TTA
tctaacttagtcctgtaaat

SEQ ID NO: 107511 - DNA, 20 bp, Artificial Sequence
  Description of Artificial Sequence: Synthetic oligonucleotide
  Target: SCN9A; (+) strand; PAM type: YTN; PAM sequence: CTA
acttagtcctgtaaattagg

SEQ ID NO: 107512 - DNA, 20 bp, Artificial Sequence
  Description of Artificial Sequence: Synthetic oligonucleotide
  Target: SCN9A; (+) strand; PAM type: YTN; PAM sequence: CTT
agtcctgtaaattaggtatt

SEQ ID NO: 107513 - DNA, 20 bp, Artificial Sequence
  Description of Artificial Sequence: Synthetic oligonucleotide
  Target: SCN9A; (+) strand; PAM type: YTN; PAM sequence: TTA
gtcctgtaaattaggtattg

SEQ ID NO: 107514 - DNA, 20 bp, Artificial Sequence
  Description of Artificial Sequence: Synthetic oligonucleotide
  Target: SCN9A; (+) strand; PAM type: YTN; PAM sequence: CTG
taaattaggtattgctcttc

SEQ ID NO: 107515 - DNA, 20 bp, Artificial Sequence
  Description of Artificial Sequence: Synthetic oligonucleotide
  Target: SCN9A; (+) strand; PAM type: YTN; PAM sequence: TTA
ggtattgctcttccctggct

SEQ ID NO: 107516 - DNA, 20 bp, Artificial Sequence
  Description of Artificial Sequence: Synthetic oligonucleotide
  Target: SCN9A; (+) strand; PAM type: YTN; PAM sequence: TTG
ctcttccctggctcccatat

SEQ ID NO: 107517 - DNA, 20 bp, Artificial Sequence
  Description of Artificial Sequence: Synthetic oligonucleotide
  Target: SCN9A; (+) strand; PAM type: YTN; PAM sequence: CTC
ttccctggctcccatatcag

SEQ ID NO: 107518 - DNA, 20 bp, Artificial Sequence
  Description of Artificial Sequence: Synthetic oligonucleotide
  Target: SCN9A; (+) strand; PAM type: YTN; PAM sequence: CTT
ccctggctcccatatcagca

SEQ ID NO: 107519 - DNA, 20 bp, Artificial Sequence
  Description of Artificial Sequence: Synthetic oligonucleotide
  Target: SCN9A; (+) strand; PAM type: YTN; PAM sequence: TTC
cctggctcccatatcagcat

SEQ ID NO: 107520 - DNA, 20 bp, Artificial Sequence
  Description of Artificial Sequence: Synthetic oligonucleotide
  Target: SCN9A; (+) strand; PAM type: YTN; PAM sequence: CTG
gctcccatatcagcatcaaa

SEQ ID NO: 107521 - DNA, 20 bp, Artificial Sequence
  Description of Artificial Sequence: Synthetic oligonucleotide
  Target: SCN9A; (+) strand; PAM type: YTN; PAM sequence: CTC
ccatatcagcatcaaaaggt

SEQ ID NO: 107522 - DNA, 20 bp, Artificial Sequence
  Description of Artificial Sequence: Synthetic oligonucleotide
  Target: SCN9A; (+) strand; PAM type: YTN; PAM sequence: TTG
aaaagctctaactgtcctgt

SEQ ID NO: 107523 - DNA, 20 bp, Artificial Sequence
  Description of Artificial Sequence: Synthetic oligonucleotide
  Target: SCN9A; (+) strand; PAM type: YTN; PAM sequence: CTC
taactgtcctgtcagtgctc

SEQ ID NO: 107524 - DNA, 20 bp, Artificial Sequence
  Description of Artificial Sequence: Synthetic oligonucleotide
  Target: SCN9A; (+) strand; PAM type: YTN; PAM sequence: CTA
actgtcctgtcagtgctcat

SEQ ID NO: 107525 - DNA, 20 bp, Artificial Sequence
  Description of Artificial Sequence: Synthetic oligonucleotide
  Target: SCN9A; (+) strand; PAM type: YTN; PAM sequence: CTG
tcctgtcagtgctcatcatt

SEQ ID NO: 107526 - DNA, 20 bp, Artificial Sequence
  Description of Artificial Sequence: Synthetic oligonucleotide
  Target: SCN9A; (+) strand; PAM type: YTN; PAM sequence: CTG
tcagtgctcatcatttttag

SEQ ID NO: 107527 - DNA, 20 bp, Artificial Sequence
  Description of Artificial Sequence: Synthetic oligonucleotide
  Target: SCN9A; (+) strand; PAM type: YTN; PAM sequence: CTC
atcatttttagacagcattt

SEQ ID NO: 107528 - DNA, 20 bp, Artificial Sequence
  Description of Artificial Sequence: Synthetic oligonucleotide
  Target: SCN9A; (+) strand; PAM type: YTN; PAM sequence: TTT
ttagacagcattttagaata

SEQ ID NO: 107529 - DNA, 20 bp, Artificial Sequence
  Description of Artificial Sequence: Synthetic oligonucleotide
  Target: SCN9A; (+) strand; PAM type: YTN; PAM sequence: TTT
tagacagcattttagaatag

SEQ ID NO: 107530 - DNA, 20 bp, Artificial Sequence
  Description of Artificial Sequence: Synthetic oligonucleotide
  Target: SCN9A; (+) strand; PAM type: YTN; PAM sequence: TTT
agacagcattttagaatagc

SEQ ID NO: 107531 - DNA, 20 bp, Artificial Sequence
  Description of Artificial Sequence: Synthetic oligonucleotide
  Target: SCN9A; (+) strand; PAM type: YTN; PAM sequence: TTA
gacagcattttagaatagca

SEQ ID NO: 107532 - DNA, 20 bp, Artificial Sequence
  Description of Artificial Sequence: Synthetic oligonucleotide
  Target: SCN9A; (+) strand; PAM type: YTN; PAM sequence: TTT
tagaatagcatattaaaatt

SEQ ID NO: 107533 - DNA, 20 bp, Artificial Sequence
  Description of Artificial Sequence: Synthetic oligonucleotide
  Target: SCN9A; (+) strand; PAM type: YTN; PAM sequence: TTT
agaatagcatattaaaattt

SEQ ID NO: 107534 - DNA, 20 bp, Artificial Sequence
  Description of Artificial Sequence: Synthetic oligonucleotide
  Target: SCN9A; (+) strand; PAM type: YTN; PAM sequence: TTA
gaatagcatattaaaatttc

SEQ ID NO: 107535 - DNA, 20 bp, Artificial Sequence
  Description of Artificial Sequence: Synthetic oligonucleotide
  Target: SCN9A; (+) strand; PAM type: YTN; PAM sequence: TTA
aaatttcagaagagtaaaac

SEQ ID NO: 107536 - DNA, 20 bp, Artificial Sequence
  Description of Artificial Sequence: Synthetic oligonucleotide
  Target: SCN9A; (+) strand; PAM type: YTN; PAM sequence: TTT
cagaagagtaaaacatttgg

SEQ ID NO: 107537 - DNA, 20 bp, Artificial Sequence
  Description of Artificial Sequence: Synthetic oligonucleotide
  Target: SCN9A; (+) strand; PAM type: YTN; PAM sequence: TTC
agaagagtaaaacatttggt

SEQ ID NO: 107538 - DNA, 20 bp, Artificial Sequence
  Description of Artificial Sequence: Synthetic oligonucleotide
  Target: SCN9A; (+) strand; PAM type: YTN; PAM sequence: TTT
ggtaattgacacagtcacta

SEQ ID NO: 107539 - DNA, 20 bp, Artificial Sequence
  Description of Artificial Sequence: Synthetic oligonucleotide
  Target: SCN9A; (+) strand; PAM type: YTN; PAM sequence: TTG
gtaattgacacagtcactat

SEQ ID NO: 107540 - DNA, 20 bp, Artificial Sequence
  Description of Artificial Sequence: Synthetic oligonucleotide
  Target: SCN9A; (+) strand; PAM type: YTN; PAM sequence: TTG
acacagtcactattttcaaa

SEQ ID NO: 107541 - DNA, 20 bp, Artificial Sequence
  Description of Artificial Sequence: Synthetic oligonucleotide
  Target: SCN9A; (+) strand; PAM type: YTN; PAM sequence: CTA
ttttcaaagaatttatgtgg

SEQ ID NO: 107542 - DNA, 20 bp, Artificial Sequence
  Description of Artificial Sequence: Synthetic oligonucleotide
  Target: SCN9A; (+) strand; PAM type: YTN; PAM sequence: TTT
tcaaagaatttatgtgggtc

SEQ ID NO: 107543 - DNA, 20 bp, Artificial Sequence
  Description of Artificial Sequence: Synthetic oligonucleotide
  Target: SCN9A; (+) strand; PAM type: YTN; PAM sequence: TTT
caaagaatttatgtgggtca

SEQ ID NO: 107544 - DNA, 20 bp, Artificial Sequence
  Description of Artificial Sequence: Synthetic oligonucleotide
  Target: SCN9A; (+) strand; PAM type: YTN; PAM sequence: TTC
aaagaatttatgtgggtcaa

SEQ ID NO: 107545 - DNA, 20 bp, Artificial Sequence
  Description of Artificial Sequence: Synthetic oligonucleotide
  Target: SCN9A; (+) strand; PAM type: YTN; PAM sequence: TTT
atgtgggtcaaaaagttgtt

SEQ ID NO: 107546 - DNA, 20 bp, Artificial Sequence
  Description of Artificial Sequence: Synthetic oligonucleotide
  Target: SCN9A; (+) strand; PAM type: YTN; PAM sequence: TTA
tgtgggtcaaaaagttgttc

SEQ ID NO: 107547 - DNA, 20 bp, Artificial Sequence
  Description of Artificial Sequence: Synthetic oligonucleotide
  Target: SCN9A; (+) strand; PAM type: YTN; PAM sequence: TTG
ttctggaagaagataaaaag

SEQ ID NO: 107548 - DNA, 20 bp, Artificial Sequence
  Description of Artificial Sequence: Synthetic oligonucleotide
  Target: SCN9A; (+) strand; PAM type: YTN; PAM sequence: TTC
tggaagaagataaaaagaaa

SEQ ID NO: 107549 - DNA, 20 bp, Artificial Sequence
  Description of Artificial Sequence: Synthetic oligonucleotide
  Target: SCN9A; (+) strand; PAM type: YTN; PAM sequence: CTG
gaagaagataaaaagaaaac

SEQ ID NO: 107550 - DNA, 20 bp, Artificial Sequence
  Description of Artificial Sequence: Synthetic oligonucleotide
  Target: SCN9A; (+) strand; PAM type: YTN; PAM sequence: TTG
atactgaaattttgagccag

SEQ ID NO: 107551 - DNA, 20 bp, Artificial Sequence
  Description of Artificial Sequence: Synthetic oligonucleotide
  Target: SCN9A; (+) strand; PAM type: YTN; PAM sequence: CTG
aaattttgagccagtctttt

SEQ ID NO: 107552 - DNA, 20 bp, Artificial Sequence
  Description of Artificial Sequence: Synthetic oligonucleotide
  Target: SCN9A; (+) strand; PAM type: YTN; PAM sequence: TTT
tgagccagtctttttttttc

SEQ ID NO: 107553 - DNA, 20 bp, Artificial Sequence
  Description of Artificial Sequence: Synthetic oligonucleotide
  Target: SCN9A; (+) strand; PAM type: YTN; PAM sequence: TTT
gagccagtctttttttttct

SEQ ID NO: 107554 - DNA, 20 bp, Artificial Sequence
  Description of Artificial Sequence: Synthetic oligonucleotide
  Target: SCN9A; (+) strand; PAM type: YTN; PAM sequence: TTG
agccagtctttttttttctg

SEQ ID NO: 107555 - DNA, 20 bp, Artificial Sequence
  Description of Artificial Sequence: Synthetic oligonucleotide
  Target: SCN9A; (+) strand; PAM type: YTN; PAM sequence: CTT
tttttttctgatctgactac

SEQ ID NO: 107556 - DNA, 20 bp, Artificial Sequence
  Description of Artificial Sequence: Synthetic oligonucleotide
  Target: SCN9A; (+) strand; PAM type: YTN; PAM sequence: TTT
ttttttctgatctgactact

SEQ ID NO: 107557 - DNA, 20 bp, Artificial Sequence
  Description of Artificial Sequence: Synthetic oligonucleotide
  Target: SCN9A; (+) strand; PAM type: YTN; PAM sequence: TTT
tttttctgatctgactactg

SEQ ID NO: 107558 - DNA, 20 bp, Artificial Sequence
  Description of Artificial Sequence: Synthetic oligonucleotide
  Target: SCN9A; (+) strand; PAM type: YTN; PAM sequence: TTT
ttttctgatctgactactgt

SEQ ID NO: 107559 - DNA, 20 bp, Artificial Sequence
  Description of Artificial Sequence: Synthetic oligonucleotide
  Target: SCN9A; (+) strand; PAM type: YTN; PAM sequence: TTT
tttctgatctgactactgtt

SEQ ID NO: 107560 - DNA, 20 bp, Artificial Sequence
  Description of Artificial Sequence: Synthetic oligonucleotide
  Target: SCN9A; (+) strand; PAM type: YTN; PAM sequence: TTT
ttctgatctgactactgtta

SEQ ID NO: 107561 - DNA, 20 bp, Artificial Sequence
  Description of Artificial Sequence: Synthetic oligonucleotide
  Target: SCN9A; (+) strand; PAM type: YTN; PAM sequence: TTT
tctgatctgactactgttag

SEQ ID NO: 107562 - DNA, 20 bp, Artificial Sequence
  Description of Artificial Sequence: Synthetic oligonucleotide
  Target: SCN9A; (+) strand; PAM type: YTN; PAM sequence: TTT
ctgatctgactactgttaga

SEQ ID NO: 107563 - DNA, 20 bp, Artificial Sequence
  Description of Artificial Sequence: Synthetic oligonucleotide
  Target: SCN9A; (+) strand; PAM type: YTN; PAM sequence: TTC
tgatctgactactgttagag

SEQ ID NO: 107564 - DNA, 20 bp, Artificial Sequence
  Description of Artificial Sequence: Synthetic oligonucleotide
  Target: SCN9A; (+) strand; PAM type: YTN; PAM sequence: CTG
atctgactactgttagagta

SEQ ID NO: 107565 - DNA, 20 bp, Artificial Sequence
  Description of Artificial Sequence: Synthetic oligonucleotide
  Target: SCN9A; (+) strand; PAM type: YTN; PAM sequence: CTG
actactgttagagtaataaa

SEQ ID NO: 107566 - DNA, 20 bp, Artificial Sequence
  Description of Artificial Sequence: Synthetic oligonucleotide
  Target: SCN9A; (+) strand; PAM type: YTN; PAM sequence: CTA
ctgttagagtaataaagaac

SEQ ID NO: 107567 - DNA, 20 bp, Artificial Sequence
  Description of Artificial Sequence: Synthetic oligonucleotide
  Target: SCN9A; (+) strand; PAM type: YTN; PAM sequence: CTG
ttagagtaataaagaacatg

SEQ ID NO: 107568 - DNA, 20 bp, Artificial Sequence
  Description of Artificial Sequence: Synthetic oligonucleotide
  Target: SCN9A; (+) strand; PAM type: YTN; PAM sequence: TTA
gagtaataaagaacatgttg

SEQ ID NO: 107569 - DNA, 20 bp, Artificial Sequence
  Description of Artificial Sequence: Synthetic oligonucleotide
  Target: SCN9A; (+) strand; PAM type: YTN; PAM sequence: TTG
actcactctttaaagattta

SEQ ID NO: 107570 - DNA, 20 bp, Artificial Sequence
  Description of Artificial Sequence: Synthetic oligonucleotide
  Target: SCN9A; (+) strand; PAM type: YTN; PAM sequence: CTC
actctttaaagatttatcag

SEQ ID NO: 107571 - DNA, 20 bp, Artificial Sequence
  Description of Artificial Sequence: Synthetic oligonucleotide
  Target: SCN9A; (+) strand; PAM type: YTN; PAM sequence: CTC
tttaaagatttatcagcaga

SEQ ID NO: 107572 - DNA, 20 bp, Artificial Sequence
  Description of Artificial Sequence: Synthetic oligonucleotide
  Target: SCN9A; (+) strand; PAM type: YTN; PAM sequence: CTT
taaagatttatcagcagaag

SEQ ID NO: 107573 - DNA, 20 bp, Artificial Sequence
  Description of Artificial Sequence: Synthetic oligonucleotide
  Target: SCN9A; (+) strand; PAM type: YTN; PAM sequence: TTT
aaagatttatcagcagaaga

SEQ ID NO: 107574 - DNA, 20 bp, Artificial Sequence
  Description of Artificial Sequence: Synthetic oligonucleotide
  Target: SCN9A; (+) strand; PAM type: YTN; PAM sequence: TTA
aagatttatcagcagaagag

SEQ ID NO: 107575 - DNA, 20 bp, Artificial Sequence
  Description of Artificial Sequence: Synthetic oligonucleotide
  Target: SCN9A; (+) strand; PAM type: YTN; PAM sequence: TTT
atcagcagaagagaaaaaag

SEQ ID NO: 107576 - DNA, 20 bp, Artificial Sequence
  Description of Artificial Sequence: Synthetic oligonucleotide
  Target: SCN9A; (+) strand; PAM type: YTN; PAM sequence: TTA
tcagcagaagagaaaaaagt

SEQ ID NO: 107577 - DNA, 20 bp, Artificial Sequence
  Description of Artificial Sequence: Synthetic oligonucleotide
  Target: SCN9A; (+) strand; PAM type: YTN; PAM sequence: TTT
aattgacaatgtggcagcta

SEQ ID NO: 107578 - DNA, 20 bp, Artificial Sequence
  Description of Artificial Sequence: Synthetic oligonucleotide
  Target: SCN9A; (+) strand; PAM type: YTN; PAM sequence: TTA
attgacaatgtggcagctaa

SEQ ID NO: 107579 - DNA, 20 bp, Artificial Sequence
  Description of Artificial Sequence: Synthetic oligonucleotide
  Target: SCN9A; (+) strand; PAM type: YTN; PAM sequence: TTG
acaatgtggcagctaaagta

SEQ ID NO: 107580 - DNA, 20 bp, Artificial Sequence
  Description of Artificial Sequence: Synthetic oligonucleotide
  Target: SCN9A; (+) strand; PAM type: YTN; PAM sequence: CTA
aagtaatacttctaaagctt

SEQ ID NO: 107581 - DNA, 20 bp, Artificial Sequence
  Description of Artificial Sequence: Synthetic oligonucleotide
  Target: SCN9A; (+) strand; PAM type: YTN; PAM sequence: CTT
ctaaagctttgacacaaaag

SEQ ID NO: 107582 - DNA, 20 bp, Artificial Sequence
  Description of Artificial Sequence: Synthetic oligonucleotide
  Target: SCN9A; (+) strand; PAM type: YTN; PAM sequence: TTC
taaagctttgacacaaaagt

SEQ ID NO: 107583 - DNA, 20 bp, Artificial Sequence
  Description of Artificial Sequence: Synthetic oligonucleotide
  Target: SCN9A; (+) strand; PAM type: YTN; PAM sequence: CTA
aagctttgacacaaaagtgc

SEQ ID NO: 107584 - DNA, 20 bp, Artificial Sequence
  Description of Artificial Sequence: Synthetic oligonucleotide
  Target: SCN9A; (+) strand; PAM type: YTN; PAM sequence: CTT
tgacacaaaagtgcattgca

SEQ ID NO: 107585 - DNA, 20 bp, Artificial Sequence
  Description of Artificial Sequence: Synthetic oligonucleotide
  Target: SCN9A; (+) strand; PAM type: YTN; PAM sequence: TTT
gacacaaaagtgcattgcaa

SEQ ID NO: 107586 - DNA, 20 bp, Artificial Sequence
  Description of Artificial Sequence: Synthetic oligonucleotide
  Target: SCN9A; (+) strand; PAM type: YTN; PAM sequence: TTG
acacaaaagtgcattgcaaa

SEQ ID NO: 107587 - DNA, 20 bp, Artificial Sequence
  Description of Artificial Sequence: Synthetic oligonucleotide
  Target: SCN9A; (+) strand; PAM type: YTN; PAM sequence: TTG
caaaatatcattaattcatg

SEQ ID NO: 107588 - DNA, 20 bp, Artificial Sequence
  Description of Artificial Sequence: Synthetic oligonucleotide
  Target: SCN9A; (+) strand; PAM type: YTN; PAM sequence: TTA
attcatgatactggtatcaa

SEQ ID NO: 107589 - DNA, 20 bp, Artificial Sequence
  Description of Artificial Sequence: Synthetic oligonucleotide
  Target: SCN9A; (+) strand; PAM type: YTN; PAM sequence: TTC
atgatactggtatcaaagga

SEQ ID NO: 107590 - DNA, 20 bp, Artificial Sequence
  Description of Artificial Sequence: Synthetic oligonucleotide
  Target: SCN9A; (+) strand; PAM type: YTN; PAM sequence: CTG
gtatcaaaggactcacttaa

SEQ ID NO: 107591 - DNA, 20 bp, Artificial Sequence
  Description of Artificial Sequence: Synthetic oligonucleotide
  Target: SCN9A; (+) strand; PAM type: YTN; PAM sequence: CTC
acttaaaaaggcaacaccga

SEQ ID NO: 107592 - DNA, 20 bp, Artificial Sequence
  Description of Artificial Sequence: Synthetic oligonucleotide
  Target: SCN9A; (+) strand; PAM type: YTN; PAM sequence: CTT
aaaaaggcaacaccgaaatg

SEQ ID NO: 107593 - DNA, 20 bp, Artificial Sequence
  Description of Artificial Sequence: Synthetic oligonucleotide
  Target: SCN9A; (+) strand; PAM type: YTN; PAM sequence: TTA
aaaaggcaacaccgaaatga

SEQ ID NO: 107594 - DNA, 20 bp, Artificial Sequence
  Description of Artificial Sequence: Synthetic oligonucleotide
  Target: SCN9A; (+) strand; PAM type: YTN; PAM sequence: CTT
tgggtacactttgactcaag

SEQ ID NO: 107595 - DNA, 20 bp, Artificial Sequence
  Description of Artificial Sequence: Synthetic oligonucleotide
  Target: SCN9A; (+) strand; PAM type: YTN; PAM sequence: TTT
gggtacactttgactcaagg

SEQ ID NO: 107596 - DNA, 20 bp, Artificial Sequence
  Description of Artificial Sequence: Synthetic oligonucleotide
  Target: SCN9A; (+) strand; PAM type: YTN; PAM sequence: TTG
ggtacactttgactcaagga

SEQ ID NO: 107597 - DNA, 20 bp, Artificial Sequence
  Description of Artificial Sequence: Synthetic oligonucleotide
  Target: SCN9A; (+) strand; PAM type: YTN; PAM sequence: CTT
tgactcaaggaatctgacca

SEQ ID NO: 107598 - DNA, 20 bp, Artificial Sequence
  Description of Artificial Sequence: Synthetic oligonucleotide
  Target: SCN9A; (+) strand; PAM type: YTN; PAM sequence: TTT
gactcaaggaatctgaccaa

SEQ ID NO: 107599 - DNA, 20 bp, Artificial Sequence
  Description of Artificial Sequence: Synthetic oligonucleotide
  Target: SCN9A; (+) strand; PAM type: YTN; PAM sequence: TTG
actcaaggaatctgaccaaa

SEQ ID NO: 107600 - DNA, 20 bp, Artificial Sequence
  Description of Artificial Sequence: Synthetic oligonucleotide
  Target: SCN9A; (+) strand; PAM type: YTN; PAM sequence: CTC
aaggaatctgaccaaagaag

SEQ ID NO: 107601 - DNA, 20 bp, Artificial Sequence
  Description of Artificial Sequence: Synthetic oligonucleotide
  Target: SCN9A; (+) strand; PAM type: YTN; PAM sequence: CTG
accaaagaagattctaaggg

SEQ ID NO: 107602 - DNA, 20 bp, Artificial Sequence
  Description of Artificial Sequence: Synthetic oligonucleotide
  Target: SCN9A; (+) strand; PAM type: YTN; PAM sequence: TTC
taagggaaatgtttaggtct

SEQ ID NO: 107603 - DNA, 20 bp, Artificial Sequence
  Description of Artificial Sequence: Synthetic oligonucleotide
  Target: SCN9A; (+) strand; PAM type: YTN; PAM sequence: CTA
agggaaatgtttaggtctat

SEQ ID NO: 107604 - DNA, 20 bp, Artificial Sequence
  Description of Artificial Sequence: Synthetic oligonucleotide
  Target: SCN9A; (+) strand; PAM type: YTN; PAM sequence: TTT
aggtctataactgcaggagt

SEQ ID NO: 107605 - DNA, 20 bp, Artificial Sequence
  Description of Artificial Sequence: Synthetic oligonucleotide
  Target: SCN9A; (+) strand; PAM type: YTN; PAM sequence: TTA
ggtctataactgcaggagtc

SEQ ID NO: 107606 - DNA, 20 bp, Artificial Sequence
  Description of Artificial Sequence: Synthetic oligonucleotide
  Target: SCN9A; (+) strand; PAM type: YTN; PAM sequence: CTA
taactgcaggagtcaatttt

SEQ ID NO: 107607 - DNA, 20 bp, Artificial Sequence
  Description of Artificial Sequence: Synthetic oligonucleotide
  Target: SCN9A; (+) strand; PAM type: YTN; PAM sequence: CTG
caggagtcaattttcaaata

SEQ ID NO: 107608 - DNA, 20 bp, Artificial Sequence
  Description of Artificial Sequence: Synthetic oligonucleotide
  Target: SCN9A; (+) strand; PAM type: YTN; PAM sequence: TTT
tcaaataatgcaggatcaag

SEQ ID NO: 107609 - DNA, 20 bp, Artificial Sequence
  Description of Artificial Sequence: Synthetic oligonucleotide
  Target: SCN9A; (+) strand; PAM type: YTN; PAM sequence: TTT
caaataatgcaggatcaaga

SEQ ID NO: 107610 - DNA, 20 bp, Artificial Sequence
  Description of Artificial Sequence: Synthetic oligonucleotide
  Target: SCN9A; (+) strand; PAM type: YTN; PAM sequence: TTC
aaataatgcaggatcaagaa

SEQ ID NO: 107611 - DNA, 20 bp, Artificial Sequence
  Description of Artificial Sequence: Synthetic oligonucleotide
  Target: SCN9A; (+) strand; PAM type: YTN; PAM sequence: TTG
gcagggagcagctggacttg

SEQ ID NO: 107612 - DNA, 20 bp, Artificial Sequence
  Description of Artificial Sequence: Synthetic oligonucleotide
  Target: SCN9A; (+) strand; PAM type: YTN; PAM sequence: CTG
gacttgaggttgtggtaata

SEQ ID NO: 107613 - DNA, 20 bp, Artificial Sequence
  Description of Artificial Sequence: Synthetic oligonucleotide
  Target: SCN9A; (+) strand; PAM type: YTN; PAM sequence: CTT
gaggttgtggtaatagctgt

SEQ ID NO: 107614 - DNA, 20 bp, Artificial Sequence
  Description of Artificial Sequence: Synthetic oligonucleotide
  Target: SCN9A; (+) strand; PAM type: YTN; PAM sequence: TTG
aggttgtggtaatagctgtg

SEQ ID NO: 107615 - DNA, 20 bp, Artificial Sequence
  Description of Artificial Sequence: Synthetic oligonucleotide
  Target: SCN9A; (+) strand; PAM type: YTN; PAM sequence: TTG
tggtaatagctgtgaccagg

SEQ ID NO: 107616 - DNA, 20 bp, Artificial Sequence
  Description of Artificial Sequence: Synthetic oligonucleotide
  Target: SCN9A; (+) strand; PAM type: YTN; PAM sequence: CTG
tgaccaggtaaatcctttct

SEQ ID NO: 107617 - DNA, 20 bp, Artificial Sequence
  Description of Artificial Sequence: Synthetic oligonucleotide
  Target: SCN9A; (+) strand; PAM type: YTN; PAM sequence: CTT
tctgagttcacagggatgca

SEQ ID NO: 107618 - DNA, 20 bp, Artificial Sequence
  Description of Artificial Sequence: Synthetic oligonucleotide
  Target: SCN9A; (+) strand; PAM type: YTN; PAM sequence: TTT
ctgagttcacagggatgcag

SEQ ID NO: 107619 - DNA, 20 bp, Artificial Sequence
  Description of Artificial Sequence: Synthetic oligonucleotide
  Target: SCN9A; (+) strand; PAM type: YTN; PAM sequence: TTC
tgagttcacagggatgcagt

SEQ ID NO: 107620 - DNA, 20 bp, Artificial Sequence
  Description of Artificial Sequence: Synthetic oligonucleotide
  Target: SCN9A; (+) strand; PAM type: YTN; PAM sequence: CTG
agttcacagggatgcagtcg

SEQ ID NO: 107621 - DNA, 20 bp, Artificial Sequence
  Description of Artificial Sequence: Synthetic oligonucleotide
  Target: SCN9A; (+) strand; PAM type: YTN; PAM sequence: TTC
acagggatgcagtcgtctca

SEQ ID NO: 107622 - DNA, 20 bp, Artificial Sequence
  Description of Artificial Sequence: Synthetic oligonucleotide
  Target: SCN9A; (+) strand; PAM type: YTN; PAM sequence: CTC
agtgagaaggtacttatttg

SEQ ID NO: 107623 - DNA, 20 bp, Artificial Sequence
  Description of Artificial Sequence: Synthetic oligonucleotide
  Target: SCN9A; (+) strand; PAM type: YTN; PAM sequence: CTT
atttgcaagatccggatctc

SEQ ID NO: 107624 - DNA, 20 bp, Artificial Sequence
  Description of Artificial Sequence: Synthetic oligonucleotide
  Target: SCN9A; (+) strand; PAM type: YTN; PAM sequence: TTA
tttgcaagatccggatctcc

SEQ ID NO: 107625 - DNA, 20 bp, Artificial Sequence
  Description of Artificial Sequence: Synthetic oligonucleotide
  Target: SCN9A; (+) strand; PAM type: YTN; PAM sequence: TTT
gcaagatccggatctccacc

SEQ ID NO: 107626 - DNA, 20 bp, Artificial Sequence
  Description of Artificial Sequence: Synthetic oligonucleotide
  Target: SCN9A; (+) strand; PAM type: YTN; PAM sequence: TTG
caagatccggatctccacca

SEQ ID NO: 107627 - DNA, 20 bp, Artificial Sequence
  Description of Artificial Sequence: Synthetic oligonucleotide
  Target: SCN9A; (+) strand; PAM type: YTN; PAM sequence: CTC
caccaacaattagaaactag

SEQ ID NO: 107628 - DNA, 20 bp, Artificial Sequence
  Description of Artificial Sequence: Synthetic oligonucleotide
  Target: SCN9A; (+) strand; PAM type: YTN; PAM sequence: TTA
gaaactagatattcctgcct

SEQ ID NO: 107629 - DNA, 20 bp, Artificial Sequence
  Description of Artificial Sequence: Synthetic oligonucleotide
  Target: SCN9A; (+) strand; PAM type: YTN; PAM sequence: CTA
gatattcctgcctttttcca

SEQ ID NO: 107630 - DNA, 20 bp, Artificial Sequence
  Description of Artificial Sequence: Synthetic oligonucleotide
  Target: SCN9A; (+) strand; PAM type: YTN; PAM sequence: TTC
ctgcctttttccaaagataa

SEQ ID NO: 107631 - DNA, 20 bp, Artificial Sequence
  Description of Artificial Sequence: Synthetic oligonucleotide
  Target: SCN9A; (+) strand; PAM type: YTN; PAM sequence: CTG
cctttttccaaagataaata

SEQ ID NO: 107632 - DNA, 20 bp, Artificial Sequence
  Description of Artificial Sequence: Synthetic oligonucleotide
  Target: SCN9A; (+) strand; PAM type: YTN; PAM sequence: CTT
tttccaaagataaatagaag

SEQ ID NO: 107633 - DNA, 20 bp, Artificial Sequence
  Description of Artificial Sequence: Synthetic oligonucleotide
  Target: SCN9A; (+) strand; PAM type: YTN; PAM sequence: TTT
ttccaaagataaatagaagg

SEQ ID NO: 107634 - DNA, 20 bp, Artificial Sequence
  Description of Artificial Sequence: Synthetic oligonucleotide
  Target: SCN9A; (+) strand; PAM type: YTN; PAM sequence: TTT
tccaaagataaatagaaggg

SEQ ID NO: 107635 - DNA, 20 bp, Artificial Sequence
  Description of Artificial Sequence: Synthetic oligonucleotide
  Target: SCN9A; (+) strand; PAM type: YTN; PAM sequence: TTT
ccaaagataaatagaaggga

SEQ ID NO: 107636 - DNA, 20 bp, Artificial Sequence
  Description of Artificial Sequence: Synthetic oligonucleotide
  Target: SCN9A; (+) strand; PAM type: YTN; PAM sequence: TTC
caaagataaatagaagggaa

SEQ ID NO: 107637 - DNA, 20 bp, Artificial Sequence
  Description of Artificial Sequence: Synthetic oligonucleotide
  Target: SCN9A; (+) strand; PAM type: YTN; PAM sequence: CTA
actcagcgagcacatgggga

SEQ ID NO: 107638 - DNA, 20 bp, Artificial Sequence
  Description of Artificial Sequence: Synthetic oligonucleotide
  Target: SCN9A; (+) strand; PAM type: YTN; PAM sequence: CTC
agcgagcacatggggaaaaa

SEQ ID NO: 107639 - DNA, 20 bp, Artificial Sequence
  Description of Artificial Sequence: Synthetic oligonucleotide
  Target: SCN9A; (+) strand; PAM type: YTN; PAM sequence: TTG
ggaatatttgtagacaattt

SEQ ID NO: 107640 - DNA, 20 bp, Artificial Sequence
  Description of Artificial Sequence: Synthetic oligonucleotide
  Target: SCN9A; (+) strand; PAM type: YTN; PAM sequence: TTT
gtagacaatttagaagaaaa

SEQ ID NO: 107641 - DNA, 20 bp, Artificial Sequence
  Description of Artificial Sequence: Synthetic oligonucleotide
  Target: SCN9A; (+) strand; PAM type: YTN; PAM sequence: TTG
tagacaatttagaagaaaag

SEQ ID NO: 107642 - DNA, 20 bp, Artificial Sequence
  Description of Artificial Sequence: Synthetic oligonucleotide
  Target: SCN9A; (+) strand; PAM type: YTN; PAM sequence: TTT
agaagaaaagacagactcag

SEQ ID NO: 107643 - DNA, 20 bp, Artificial Sequence
  Description of Artificial Sequence: Synthetic oligonucleotide
  Target: SCN9A; (+) strand; PAM type: YTN; PAM sequence: TTA
gaagaaaagacagactcaga

SEQ ID NO: 107644 - DNA, 20 bp, Artificial Sequence
  Description of Artificial Sequence: Synthetic oligonucleotide
  Target: SCN9A; (+) strand; PAM type: YTN; PAM sequence: CTC
agaaaagaacttctggtctt

SEQ ID NO: 107645 - DNA, 20 bp, Artificial Sequence
  Description of Artificial Sequence: Synthetic oligonucleotide
  Target: SCN9A; (+) strand; PAM type: YTN; PAM sequence: CTT
ctggtcttcaaatgtcaatt

SEQ ID NO: 107646 - DNA, 20 bp, Artificial Sequence
  Description of Artificial Sequence: Synthetic oligonucleotide
  Target: SCN9A; (+) strand; PAM type: YTN; PAM sequence: TTC
tggtcttcaaatgtcaattt

SEQ ID NO: 107647 - DNA, 20 bp, Artificial Sequence
  Description of Artificial Sequence: Synthetic oligonucleotide
  Target: SCN9A; (+) strand; PAM type: YTN; PAM sequence: CTG
gtcttcaaatgtcaatttgt

SEQ ID NO: 107648 - DNA, 20 bp, Artificial Sequence
  Description of Artificial Sequence: Synthetic oligonucleotide
  Target: SCN9A; (+) strand; PAM type: YTN; PAM sequence: CTT
caaatgtcaatttgtttggg

SEQ ID NO: 107649 - DNA, 20 bp, Artificial Sequence
  Description of Artificial Sequence: Synthetic oligonucleotide
  Target: SCN9A; (+) strand; PAM type: YTN; PAM sequence: TTC
aaatgtcaatttgtttggga

SEQ ID NO: 107650 - DNA, 20 bp, Artificial Sequence
  Description of Artificial Sequence: Synthetic oligonucleotide
  Target: SCN9A; (+) strand; PAM type: YTN; PAM sequence: TTT
gtttgggaccacagcaaaag

SEQ ID NO: 107651 - DNA, 20 bp, Artificial Sequence
  Description of Artificial Sequence: Synthetic oligonucleotide
  Target: SCN9A; (+) strand; PAM type: YTN; PAM sequence: TTG
tttgggaccacagcaaaagc

SEQ ID NO: 107652 - DNA, 20 bp, Artificial Sequence
  Description of Artificial Sequence: Synthetic oligonucleotide
  Target: SCN9A; (+) strand; PAM type: YTN; PAM sequence: TTT
gggaccacagcaaaagcaaa

SEQ ID NO: 107653 - DNA, 20 bp, Artificial Sequence
  Description of Artificial Sequence: Synthetic oligonucleotide
  Target: SCN9A; (+) strand; PAM type: YTN; PAM sequence: TTG
ggaccacagcaaaagcaaaa

SEQ ID NO: 107654 - DNA, 20 bp, Artificial Sequence
  Description of Artificial Sequence: Synthetic oligonucleotide
  Target: SCN9A; (+) strand; PAM type: YTN; PAM sequence: TTA
tcttatatagacattgacaa

SEQ ID NO: 107655 - DNA, 20 bp, Artificial Sequence
  Description of Artificial Sequence: Synthetic oligonucleotide
  Target: SCN9A; (+) strand; PAM type: YTN; PAM sequence: CTT
atatagacattgacaaagat

SEQ ID NO: 107656 - DNA, 20 bp, Artificial Sequence
  Description of Artificial Sequence: Synthetic oligonucleotide
  Target: SCN9A; (+) strand; PAM type: YTN; PAM sequence: TTA
tatagacattgacaaagata

SEQ ID NO: 107657 - DNA, 20 bp, Artificial Sequence
  Description of Artificial Sequence: Synthetic oligonucleotide
  Target: SCN9A; (+) strand; PAM type: YTN; PAM sequence: TTG
acaaagatacccaaagttat

SEQ ID NO: 107658 - DNA, 20 bp, Artificial Sequence
  Description of Artificial Sequence: Synthetic oligonucleotide
  Target: SCN9A; (+) strand; PAM type: YTN; PAM sequence: TTA
ttcatggtttatgaagagtc

SEQ ID NO: 107659 - DNA, 20 bp, Artificial Sequence
  Description of Artificial Sequence: Synthetic oligonucleotide
  Target: SCN9A; (+) strand; PAM type: YTN; PAM sequence: TTC
atggtttatgaagagtcata

SEQ ID NO: 107660 - DNA, 20 bp, Artificial Sequence
  Description of Artificial Sequence: Synthetic oligonucleotide
  Target: SCN9A; (+) strand; PAM type: YTN; PAM sequence: TTT
atgaagagtcataagctgag

SEQ ID NO: 107661 - DNA, 20 bp, Artificial Sequence
  Description of Artificial Sequence: Synthetic oligonucleotide
  Target: SCN9A; (+) strand; PAM type: YTN; PAM sequence: TTA
tgaagagtcataagctgaga

SEQ ID NO: 107662 - DNA, 20 bp, Artificial Sequence
  Description of Artificial Sequence: Synthetic oligonucleotide
  Target: SCN9A; (+) strand; PAM type: YTN; PAM sequence: CTG
agattctctggccctaaaaa

SEQ ID NO: 107663 - DNA, 20 bp, Artificial Sequence
  Description of Artificial Sequence: Synthetic oligonucleotide
  Target: SCN9A; (+) strand; PAM type: YTN; PAM sequence: TTC
tctggccctaaaaatgaact

SEQ ID NO: 107664 - DNA, 20 bp, Artificial Sequence
  Description of Artificial Sequence: Synthetic oligonucleotide
  Target: SCN9A; (+) strand; PAM type: YTN; PAM sequence: CTC
tggccctaaaaatgaactgg

SEQ ID NO: 107665 - DNA, 20 bp, Artificial Sequence
  Description of Artificial Sequence: Synthetic oligonucleotide
  Target: SCN9A; (+) strand; PAM type: YTN; PAM sequence: CTG
gccctaaaaatgaactggtg

SEQ ID NO: 107666 - DNA, 20 bp, Artificial Sequence
  Description of Artificial Sequence: Synthetic oligonucleotide
  Target: SCN9A; (+) strand; PAM type: YTN; PAM sequence: CTA
aaaatgaactggtgcctgcc

SEQ ID NO: 107667 - DNA, 20 bp, Artificial Sequence
  Description of Artificial Sequence: Synthetic oligonucleotide
  Target: SCN9A; (+) strand; PAM type: YTN; PAM sequence: CTG
gtgcctgcctcacatccata

SEQ ID NO: 107668 - DNA, 20 bp, Artificial Sequence
  Description of Artificial Sequence: Synthetic oligonucleotide
  Target: SCN9A; (+) strand; PAM type: YTN; PAM sequence: CTG
cctcacatccatagtcaaaa

SEQ ID NO: 107669 - DNA, 20 bp, Artificial Sequence
  Description of Artificial Sequence: Synthetic oligonucleotide
  Target: SCN9A; (+) strand; PAM type: YTN; PAM sequence: CTC
acatccatagtcaaaaactg

SEQ ID NO: 107670 - DNA, 20 bp, Artificial Sequence
  Description of Artificial Sequence: Synthetic oligonucleotide
  Target: SCN9A; (+) strand; PAM type: YTN; PAM sequence: CTG
gcattttgtttaccctgagt

SEQ ID NO: 107671 - DNA, 20 bp, Artificial Sequence
  Description of Artificial Sequence: Synthetic oligonucleotide
  Target: SCN9A; (+) strand; PAM type: YTN; PAM sequence: TTT
tgtttaccctgagttagtgt

SEQ ID NO: 107672 - DNA, 20 bp, Artificial Sequence
  Description of Artificial Sequence: Synthetic oligonucleotide
  Target: SCN9A; (+) strand; PAM type: YTN; PAM sequence: TTT
gtttaccctgagttagtgtg

SEQ ID NO: 107673 - DNA, 20 bp, Artificial Sequence
  Description of Artificial Sequence: Synthetic oligonucleotide
  Target: SCN9A; (+) strand; PAM type: YTN; PAM sequence: TTG
tttaccctgagttagtgtga

SEQ ID NO: 107674 - DNA, 20 bp, Artificial Sequence
  Description of Artificial Sequence: Synthetic oligonucleotide
  Target: SCN9A; (+) strand; PAM type: YTN; PAM sequence: TTT
accctgagttagtgtgacca

SEQ ID NO: 107675 - DNA, 20 bp, Artificial Sequence
  Description of Artificial Sequence: Synthetic oligonucleotide
  Target: SCN9A; (+) strand; PAM type: YTN; PAM sequence: TTA
ccctgagttagtgtgaccag

SEQ ID NO: 107676 - DNA, 20 bp, Artificial Sequence
  Description of Artificial Sequence: Synthetic oligonucleotide
  Target: SCN9A; (+) strand; PAM type: YTN; PAM sequence: CTG
agttagtgtgaccagcactg

SEQ ID NO: 107677 - DNA, 20 bp, Artificial Sequence
  Description of Artificial Sequence: Synthetic oligonucleotide
  Target: SCN9A; (+) strand; PAM type: YTN; PAM sequence: TTA
gtgtgaccagcactgtacat

SEQ ID NO: 107678 - DNA, 20 bp, Artificial Sequence
  Description of Artificial Sequence: Synthetic oligonucleotide
  Target: SCN9A; (+) strand; PAM type: YTN; PAM sequence: CTG
tacattttagagatcactct

SEQ ID NO: 107679 - DNA, 20 bp, Artificial Sequence
  Description of Artificial Sequence: Synthetic oligonucleotide
  Target: SCN9A; (+) strand; PAM type: YTN; PAM sequence: TTT
tagagatcactctggcatca

SEQ ID NO: 107680 - DNA, 20 bp, Artificial Sequence
  Description of Artificial Sequence: Synthetic oligonucleotide
  Target: SCN9A; (+) strand; PAM type: YTN; PAM sequence: TTT
agagatcactctggcatcaa

SEQ ID NO: 107681 - DNA, 20 bp, Artificial Sequence
  Description of Artificial Sequence: Synthetic oligonucleotide
  Target: SCN9A; (+) strand; PAM type: YTN; PAM sequence: TTA
gagatcactctggcatcaat

SEQ ID NO: 107682 - DNA, 20 bp, Artificial Sequence
  Description of Artificial Sequence: Synthetic oligonucleotide
  Target: SCN9A; (+) strand; PAM type: YTN; PAM sequence: CTC
tggcatcaattttactaatt

SEQ ID NO: 107683 - DNA, 20 bp, Artificial Sequence
  Description of Artificial Sequence: Synthetic oligonucleotide
  Target: SCN9A; (+) strand; PAM type: YTN; PAM sequence: CTG
gcatcaattttactaattgg

SEQ ID NO: 107684 - DNA, 20 bp, Artificial Sequence
  Description of Artificial Sequence: Synthetic oligonucleotide
  Target: SCN9A; (+) strand; PAM type: YTN; PAM sequence: TTT
tactaattggatcttatatc

SEQ ID NO: 107685 - DNA, 20 bp, Artificial Sequence
  Description of Artificial Sequence: Synthetic oligonucleotide
  Target: SCN9A; (+) strand; PAM type: YTN; PAM sequence: TTT
actaattggatcttatatct

SEQ ID NO: 107686 - DNA, 20 bp, Artificial Sequence
  Description of Artificial Sequence: Synthetic oligonucleotide
  Target: SCN9A; (+) strand; PAM type: YTN; PAM sequence: TTA
ctaattggatcttatatctt

SEQ ID NO: 107687 - DNA, 20 bp, Artificial Sequence
  Description of Artificial Sequence: Synthetic oligonucleotide
  Target: SCN9A; (+) strand; PAM type: YTN; PAM sequence: CTA
attggatcttatatcttcca

SEQ ID NO: 107688 - DNA, 20 bp, Artificial Sequence
  Description of Artificial Sequence: Synthetic oligonucleotide
  Target: SCN9A; (+) strand; PAM type: YTN; PAM sequence: TTG
gatcttatatcttccagaag

SEQ ID NO: 107689 - DNA, 20 bp, Artificial Sequence
  Description of Artificial Sequence: Synthetic oligonucleotide
  Target: SCN9A; (+) strand; PAM type: YTN; PAM sequence: CTT
atatcttccagaagtctgtt

SEQ ID NO: 107690 - DNA, 20 bp, Artificial Sequence
  Description of Artificial Sequence: Synthetic oligonucleotide
  Target: SCN9A; (+) strand; PAM type: YTN; PAM sequence: TTA
tatcttccagaagtctgttg

SEQ ID NO: 107691 - DNA, 20 bp, Artificial Sequence
  Description of Artificial Sequence: Synthetic oligonucleotide
  Target: SCN9A; (+) strand; PAM type: YTN; PAM sequence: CTT
ccagaagtctgttgatcacc

SEQ ID NO: 107692 - DNA, 20 bp, Artificial Sequence
  Description of Artificial Sequence: Synthetic oligonucleotide
  Target: SCN9A; (+) strand; PAM type: YTN; PAM sequence: TTC
cagaagtctgttgatcacct

SEQ ID NO: 107693 - DNA, 20 bp, Artificial Sequence
  Description of Artificial Sequence: Synthetic oligonucleotide
  Target: SCN9A; (+) strand; PAM type: YTN; PAM sequence: CTG
ttgatcaccttcttgcctat

SEQ ID NO: 107694 - DNA, 20 bp, Artificial Sequence
  Description of Artificial Sequence: Synthetic oligonucleotide
  Target: SCN9A; (+) strand; PAM type: YTN; PAM sequence: TTG
atcaccttcttgcctatcct

SEQ ID NO: 107695 - DNA, 20 bp, Artificial Sequence
  Description of Artificial Sequence: Synthetic oligonucleotide
  Target: SCN9A; (+) strand; PAM type: YTN; PAM sequence: CTT
cttgcctatccttgagtctt

SEQ ID NO: 107696 - DNA, 20 bp, Artificial Sequence
  Description of Artificial Sequence: Synthetic oligonucleotide
  Target: SCN9A; (+) strand; PAM type: YTN; PAM sequence: TTC
ttgcctatccttgagtcttc

SEQ ID NO: 107697 - DNA, 20 bp, Artificial Sequence
  Description of Artificial Sequence: Synthetic oligonucleotide
  Target: SCN9A; (+) strand; PAM type: YTN; PAM sequence: CTT
gcctatccttgagtcttcta

SEQ ID NO: 107698 - DNA, 20 bp, Artificial Sequence
  Description of Artificial Sequence: Synthetic oligonucleotide
  Target: SCN9A; (+) strand; PAM type: YTN; PAM sequence: TTG
cctatccttgagtcttctat

SEQ ID NO: 107699 - DNA, 20 bp, Artificial Sequence
  Description of Artificial Sequence: Synthetic oligonucleotide
  Target: SCN9A; (+) strand; PAM type: YTN; PAM sequence: CTA
tccttgagtcttctatgtcc

SEQ ID NO: 107700 - DNA, 20 bp, Artificial Sequence
  Description of Artificial Sequence: Synthetic oligonucleotide
  Target: SCN9A; (+) strand; PAM type: YTN; PAM sequence: CTT
gagtcttctatgtccagttc

SEQ ID NO: 107701 - DNA, 20 bp, Artificial Sequence
  Description of Artificial Sequence: Synthetic oligonucleotide
  Target: SCN9A; (+) strand; PAM type: YTN; PAM sequence: TTG
agtcttctatgtccagttca

SEQ ID NO: 107702 - DNA, 20 bp, Artificial Sequence
  Description of Artificial Sequence: Synthetic oligonucleotide
  Target: SCN9A; (+) strand; PAM type: YTN; PAM sequence: CTT
ctatgtccagttcaaccatt

SEQ ID NO: 107703 - DNA, 20 bp, Artificial Sequence
  Description of Artificial Sequence: Synthetic oligonucleotide
  Target: SCN9A; (+) strand; PAM type: YTN; PAM sequence: TTC
tatgtccagttcaaccattt

SEQ ID NO: 107704 - DNA, 20 bp, Artificial Sequence
  Description of Artificial Sequence: Synthetic oligonucleotide
  Target: SCN9A; (+) strand; PAM type: YTN; PAM sequence: CTA
tgtccagttcaaccattttg

SEQ ID NO: 107705 - DNA, 20 bp, Artificial Sequence
  Description of Artificial Sequence: Synthetic oligonucleotide
  Target: SCN9A; (+) strand; PAM type: YTN; PAM sequence: TTC
aaccattttggtttctcaaa

SEQ ID NO: 107706 - DNA, 20 bp, Artificial Sequence
  Description of Artificial Sequence: Synthetic oligonucleotide
  Target: SCN9A; (+) strand; PAM type: YTN; PAM sequence: TTT
tggtttctcaaaatagttgt

SEQ ID NO: 107707 - DNA, 20 bp, Artificial Sequence
  Description of Artificial Sequence: Synthetic oligonucleotide
  Target: SCN9A; (+) strand; PAM type: YTN; PAM sequence: TTT
ggtttctcaaaatagttgtt

SEQ ID NO: 107708 - DNA, 20 bp, Artificial Sequence
  Description of Artificial Sequence: Synthetic oligonucleotide
  Target: SCN9A; (+) strand; PAM type: YTN; PAM sequence: TTG
gtttctcaaaatagttgttt

SEQ ID NO: 107709 - DNA, 20 bp, Artificial Sequence
  Description of Artificial Sequence: Synthetic oligonucleotide
  Target: SCN9A; (+) strand; PAM type: YTN; PAM sequence: TTT
ctcaaaatagttgtttttaa

SEQ ID NO: 107710 - DNA, 20 bp, Artificial Sequence
  Description of Artificial Sequence: Synthetic oligonucleotide
  Target: SCN9A; (+) strand; PAM type: YTN; PAM sequence: TTC
tcaaaatagttgtttttaaa

SEQ ID NO: 107711 - DNA, 20 bp, Artificial Sequence
  Description of Artificial Sequence: Synthetic oligonucleotide
  Target: SCN9A; (+) strand; PAM type: YTN; PAM sequence: CTC
aaaatagttgtttttaaagc

SEQ ID NO: 107712 - DNA, 20 bp, Artificial Sequence
  Description of Artificial Sequence: Synthetic oligonucleotide
  Target: SCN9A; (+) strand; PAM type: YTN; PAM sequence: TTG
tttttaaagcttgtttcatt

SEQ ID NO: 107713 - DNA, 20 bp, Artificial Sequence
  Description of Artificial Sequence: Synthetic oligonucleotide
  Target: SCN9A; (+) strand; PAM type: YTN; PAM sequence: TTT
ttaaagcttgtttcattaag

SEQ ID NO: 107714 - DNA, 20 bp, Artificial Sequence
  Description of Artificial Sequence: Synthetic oligonucleotide
  Target: SCN9A; (+) strand; PAM type: YTN; PAM sequence: TTT
taaagcttgtttcattaagt

SEQ ID NO: 107715 - DNA, 20 bp, Artificial Sequence
  Description of Artificial Sequence: Synthetic oligonucleotide
  Target: SCN9A; (+) strand; PAM type: YTN; PAM sequence: TTT
aaagcttgtttcattaagtc

SEQ ID NO: 107716 - DNA, 20 bp, Artificial Sequence
  Description of Artificial Sequence: Synthetic oligonucleotide
  Target: SCN9A; (+) strand; PAM type: YTN; PAM sequence: TTA
aagcttgtttcattaagtct

SEQ ID NO: 107717 - DNA, 20 bp, Artificial Sequence
  Description of Artificial Sequence: Synthetic oligonucleotide
  Target: SCN9A; (+) strand; PAM type: YTN; PAM sequence: CTT
gtttcattaagtctttgaag

SEQ ID NO: 107718 - DNA, 20 bp, Artificial Sequence
  Description of Artificial Sequence: Synthetic oligonucleotide
  Target: SCN9A; (+) strand; PAM type: YTN; PAM sequence: TTG
tttcattaagtctttgaagt

SEQ ID NO: 107719 - DNA, 20 bp, Artificial Sequence
  Description of Artificial Sequence: Synthetic oligonucleotide
  Target: SCN9A; (+) strand; PAM type: YTN; PAM sequence: TTT
cattaagtctttgaagtttt

SEQ ID NO: 107720 - DNA, 20 bp, Artificial Sequence
  Description of Artificial Sequence: Synthetic oligonucleotide
  Target: SCN9A; (+) strand; PAM type: YTN; PAM sequence: TTC
attaagtctttgaagttttg

SEQ ID NO: 107721 - DNA, 20 bp, Artificial Sequence
  Description of Artificial Sequence: Synthetic oligonucleotide
  Target: SCN9A; (+) strand; PAM type: YTN; PAM sequence: TTA
agtctttgaagttttgatga

SEQ ID NO: 107722 - DNA, 20 bp, Artificial Sequence
  Description of Artificial Sequence: Synthetic oligonucleotide
  Target: SCN9A; (+) strand; PAM type: YTN; PAM sequence: CTT
tgaagttttgatgacaatga

SEQ ID NO: 107723 - DNA, 20 bp, Artificial Sequence
  Description of Artificial Sequence: Synthetic oligonucleotide
  Target: SCN9A; (+) strand; PAM type: YTN; PAM sequence: TTT
gaagttttgatgacaatgat

SEQ ID NO: 107724 - DNA, 20 bp, Artificial Sequence
  Description of Artificial Sequence: Synthetic oligonucleotide
  Target: SCN9A; (+) strand; PAM type: YTN; PAM sequence: TTG
aagttttgatgacaatgatg

SEQ ID NO: 107725 - DNA, 20 bp, Artificial Sequence
  Description of Artificial Sequence: Synthetic oligonucleotide
  Target: SCN9A; (+) strand; PAM type: YTN; PAM sequence: TTT
tgatgacaatgatgttgatg

SEQ ID NO: 107726 - DNA, 20 bp, Artificial Sequence
  Description of Artificial Sequence: Synthetic oligonucleotide
  Target: SCN9A; (+) strand; PAM type: YTN; PAM sequence: TTT
gatgacaatgatgttgatga

SEQ ID NO: 107727 - DNA, 20 bp, Artificial Sequence
  Description of Artificial Sequence: Synthetic oligonucleotide
  Target: SCN9A; (+) strand; PAM type: YTN; PAM sequence: TTG
atgacaatgatgttgatgat

SEQ ID NO: 107728 - DNA, 20 bp, Artificial Sequence
  Description of Artificial Sequence: Synthetic oligonucleotide
  Target: SCN9A; (+) strand; PAM type: YTN; PAM sequence: TTG
atgatgatgatagctttaat

SEQ ID NO: 107729 - DNA, 20 bp, Artificial Sequence
  Description of Artificial Sequence: Synthetic oligonucleotide
  Target: SCN9A; (+) strand; PAM type: YTN; PAM sequence: CTT
taatttattgtgtatttact

SEQ ID NO: 107730 - DNA, 20 bp, Artificial Sequence
  Description of Artificial Sequence: Synthetic oligonucleotide
  Target: SCN9A; (+) strand; PAM type: YTN; PAM sequence: TTT
aatttattgtgtatttacta

SEQ ID NO: 107731 - DNA, 20 bp, Artificial Sequence
  Description of Artificial Sequence: Synthetic oligonucleotide
  Target: SCN9A; (+) strand; PAM type: YTN; PAM sequence: TTA
atttattgtgtatttactat

SEQ ID NO: 107732 - DNA, 20 bp, Artificial Sequence
  Description of Artificial Sequence: Synthetic oligonucleotide
  Target: SCN9A; (+) strand; PAM type: YTN; PAM sequence: TTT
attgtgtatttactatatgc

SEQ ID NO: 107733 - DNA, 20 bp, Artificial Sequence
  Description of Artificial Sequence: Synthetic oligonucleotide
  Target: SCN9A; (+) strand; PAM type: YTN; PAM sequence: TTA
ttgtgtatttactatatgcc

SEQ ID NO: 107734 - DNA, 20 bp, Artificial Sequence
  Description of Artificial Sequence: Synthetic oligonucleotide
  Target: SCN9A; (+) strand; PAM type: YTN; PAM sequence: TTG
tgtatttactatatgccagg

SEQ ID NO: 107735 - DNA, 20 bp, Artificial Sequence
  Description of Artificial Sequence: Synthetic oligonucleotide
  Target: SCN9A; (+) strand; PAM type: YTN; PAM sequence: TTT
actatatgccaggctaataa

SEQ ID NO: 107736 - DNA, 20 bp, Artificial Sequence
  Description of Artificial Sequence: Synthetic oligonucleotide
  Target: SCN9A; (+) strand; PAM type: YTN; PAM sequence: TTA
ctatatgccaggctaataag

SEQ ID NO: 107737 - DNA, 20 bp, Artificial Sequence
  Description of Artificial Sequence: Synthetic oligonucleotide
  Target: SCN9A; (+) strand; PAM type: YTN; PAM sequence: CTA
tatgccaggctaataagcag

SEQ ID NO: 107738 - DNA, 20 bp, Artificial Sequence
  Description of Artificial Sequence: Synthetic oligonucleotide
  Target: SCN9A; (+) strand; PAM type: YTN; PAM sequence: CTA
ataagcagaaagcatttaat

SEQ ID NO: 107739 - DNA, 20 bp, Artificial Sequence
  Description of Artificial Sequence: Synthetic oligonucleotide
  Target: SCN9A; (+) strand; PAM type: YTN; PAM sequence: TTT
aatcctcccaagaatatgat

SEQ ID NO: 107740 - DNA, 20 bp, Artificial Sequence
  Description of Artificial Sequence: Synthetic oligonucleotide
  Target: SCN9A; (+) strand; PAM type: YTN; PAM sequence: TTA
atcctcccaagaatatgata

SEQ ID NO: 107741 - DNA, 20 bp, Artificial Sequence
  Description of Artificial Sequence: Synthetic oligonucleotide
  Target: SCN9A; (+) strand; PAM type: YTN; PAM sequence: CTC
ccaagaatatgataaatgaa

SEQ ID NO: 107742 - DNA, 20 bp, Artificial Sequence
  Description of Artificial Sequence: Synthetic oligonucleotide
  Target: SCN9A; (+) strand; PAM type: YTN; PAM sequence: TTA
caattatattataaataatt

SEQ ID NO: 107743 - DNA, 20 bp, Artificial Sequence
  Description of Artificial Sequence: Synthetic oligonucleotide
  Target: SCN9A; (+) strand; PAM type: YTN; PAM sequence: TTA
tattataaataattatttta

SEQ ID NO: 107744 - DNA, 20 bp, Artificial Sequence
  Description of Artificial Sequence: Synthetic oligonucleotide
  Target: SCN9A; (+) strand; PAM type: YTN; PAM sequence: TTA
taaataattattttataatg

SEQ ID NO: 107745 - DNA, 20 bp, Artificial Sequence
  Description of Artificial Sequence: Synthetic oligonucleotide
  Target: SCN9A; (+) strand; PAM type: YTN; PAM sequence: TTA
ttttataatgaagtattatt

SEQ ID NO: 107746 - DNA, 20 bp, Artificial Sequence
  Description of Artificial Sequence: Synthetic oligonucleotide
  Target: SCN9A; (+) strand; PAM type: YTN; PAM sequence: TTT
tataatgaagtattatttta

SEQ ID NO: 107747 - DNA, 20 bp, Artificial Sequence
  Description of Artificial Sequence: Synthetic oligonucleotide
  Target: SCN9A; (+) strand; PAM type: YTN; PAM sequence: TTT
ataatgaagtattattttat

SEQ ID NO: 107748 - DNA, 20 bp, Artificial Sequence
  Description of Artificial Sequence: Synthetic oligonucleotide
  Target: SCN9A; (+) strand; PAM type: YTN; PAM sequence: TTA
taatgaagtattattttata

SEQ ID NO: 107749 - DNA, 20 bp, Artificial Sequence
  Description of Artificial Sequence: Synthetic oligonucleotide
  Target: SCN9A; (+) strand; PAM type: YTN; PAM sequence: TTA
ttttataaatgataaaatta

SEQ ID NO: 107750 - DNA, 20 bp, Artificial Sequence
  Description of Artificial Sequence: Synthetic oligonucleotide
  Target: SCN9A; (+) strand; PAM type: YTN; PAM sequence: TTT
tataaatgataaaattaaat

SEQ ID NO: 107751 - DNA, 20 bp, Artificial Sequence
  Description of Artificial Sequence: Synthetic oligonucleotide
  Target: SCN9A; (+) strand; PAM type: YTN; PAM sequence: TTT
ataaatgataaaattaaata

SEQ ID NO: 107752 - DNA, 20 bp, Artificial Sequence
  Description of Artificial Sequence: Synthetic oligonucleotide
  Target: SCN9A; (+) strand; PAM type: YTN; PAM sequence: TTA
taaatgataaaattaaatac

SEQ ID NO: 107753 - DNA, 20 bp, Artificial Sequence
  Description of Artificial Sequence: Synthetic oligonucleotide
  Target: SCN9A; (+) strand; PAM type: YTN; PAM sequence: TTA
aatactacagagttaaaata

SEQ ID NO: 107754 - DNA, 20 bp, Artificial Sequence
  Description of Artificial Sequence: Synthetic oligonucleotide
  Target: SCN9A; (+) strand; PAM type: YTN; PAM sequence: CTA
cagagttaaaatatttgtcc

SEQ ID NO: 107755 - DNA, 20 bp, Artificial Sequence
  Description of Artificial Sequence: Synthetic oligonucleotide
  Target: SCN9A; (+) strand; PAM type: YTN; PAM sequence: TTA
aaatatttgtccaagggcat

SEQ ID NO: 107756 - DNA, 20 bp, Artificial Sequence
  Description of Artificial Sequence: Synthetic oligonucleotide
  Target: SCN9A; (+) strand; PAM type: YTN; PAM sequence: TTT
gtccaagggcatatcactca

SEQ ID NO: 107757 - DNA, 20 bp, Artificial Sequence
  Description of Artificial Sequence: Synthetic oligonucleotide
  Target: SCN9A; (+) strand; PAM type: YTN; PAM sequence: TTG
tccaagggcatatcactcat

SEQ ID NO: 107758 - DNA, 20 bp, Artificial Sequence
  Description of Artificial Sequence: Synthetic oligonucleotide
  Target: SCN9A; (+) strand; PAM type: YTN; PAM sequence: CTC
atataatgcagaatcagcat

SEQ ID NO: 107759 - DNA, 20 bp, Artificial Sequence
  Description of Artificial Sequence: Synthetic oligonucleotide
  Target: SCN9A; (+) strand; PAM type: YTN; PAM sequence: TTC
aaacccaggactttgggact

SEQ ID NO: 107760 - DNA, 20 bp, Artificial Sequence
  Description of Artificial Sequence: Synthetic oligonucleotide
  Target: SCN9A; (+) strand; PAM type: YTN; PAM sequence: CTT
tgggactctgaggacccaaa

SEQ ID NO: 107761 - DNA, 20 bp, Artificial Sequence
  Description of Artificial Sequence: Synthetic oligonucleotide
  Target: SCN9A; (+) strand; PAM type: YTN; PAM sequence: TTT
gggactctgaggacccaaac

SEQ ID NO: 107762 - DNA, 20 bp, Artificial Sequence
  Description of Artificial Sequence: Synthetic oligonucleotide
  Target: SCN9A; (+) strand; PAM type: YTN; PAM sequence: TTG
ggactctgaggacccaaaca

SEQ ID NO: 107763 - DNA, 20 bp, Artificial Sequence
  Description of Artificial Sequence: Synthetic oligonucleotide
  Target: SCN9A; (+) strand; PAM type: YTN; PAM sequence: CTC
tgaggacccaaacacttcac

SEQ ID NO: 107764 - DNA, 20 bp, Artificial Sequence
  Description of Artificial Sequence: Synthetic oligonucleotide
  Target: SCN9A; (+) strand; PAM type: YTN; PAM sequence: CTG
aggacccaaacacttcacta

SEQ ID NO: 107765 - DNA, 20 bp, Artificial Sequence
  Description of Artificial Sequence: Synthetic oligonucleotide
  Target: SCN9A; (+) strand; PAM type: YTN; PAM sequence: CTT
cactactattatgtcaaagc

SEQ ID NO: 107766 - DNA, 20 bp, Artificial Sequence
  Description of Artificial Sequence: Synthetic oligonucleotide
  Target: SCN9A; (+) strand; PAM type: YTN; PAM sequence: TTC
actactattatgtcaaagca

SEQ ID NO: 107767 - DNA, 20 bp, Artificial Sequence
  Description of Artificial Sequence: Synthetic oligonucleotide
  Target: SCN9A; (+) strand; PAM type: YTN; PAM sequence: CTA
ctattatgtcaaagcaatac

SEQ ID NO: 107768 - DNA, 20 bp, Artificial Sequence
  Description of Artificial Sequence: Synthetic oligonucleotide
  Target: SCN9A; (+) strand; PAM type: YTN; PAM sequence: CTA
ttatgtcaaagcaatacatc

SEQ ID NO: 107769 - DNA, 20 bp, Artificial Sequence
  Description of Artificial Sequence: Synthetic oligonucleotide
  Target: SCN9A; (+) strand; PAM type: YTN; PAM sequence: TTA
tgtcaaagcaatacatccat

SEQ ID NO: 107770 - DNA, 20 bp, Artificial Sequence
  Description of Artificial Sequence: Synthetic oligonucleotide
  Target: SCN9A; (+) strand; PAM type: YTN; PAM sequence: TTT
tctgaaaatatgtgaggtgt

SEQ ID NO: 107771 - DNA, 20 bp, Artificial Sequence
  Description of Artificial Sequence: Synthetic oligonucleotide
  Target: SCN9A; (+) strand; PAM type: YTN; PAM sequence: TTT
ctgaaaatatgtgaggtgtg

SEQ ID NO: 107772 - DNA, 20 bp, Artificial Sequence
  Description of Artificial Sequence: Synthetic oligonucleotide
  Target: SCN9A; (+) strand; PAM type: YTN; PAM sequence: TTC
tgaaaatatgtgaggtgtgt

SEQ ID NO: 107773 - DNA, 20 bp, Artificial Sequence
  Description of Artificial Sequence: Synthetic oligonucleotide
  Target: SCN9A; (+) strand; PAM type: YTN; PAM sequence: CTG
aaaatatgtgaggtgtgtac

SEQ ID NO: 107774 - DNA, 20 bp, Artificial Sequence
  Description of Artificial Sequence: Synthetic oligonucleotide
  Target: SCN9A; (+) strand; PAM type: YTN; PAM sequence: CTT
acaagaaagcagcaatgtaa

SEQ ID NO: 107775 - DNA, 20 bp, Artificial Sequence
  Description of Artificial Sequence: Synthetic oligonucleotide
  Target: SCN9A; (+) strand; PAM type: YTN; PAM sequence: TTA
caagaaagcagcaatgtaat

SEQ ID NO: 107776 - DNA, 20 bp, Artificial Sequence
  Description of Artificial Sequence: Synthetic oligonucleotide
  Target: SCN9A; (+) strand; PAM type: YTN; PAM sequence: TTA
ggaaggtgtgagaaagaacc

SEQ ID NO: 107777 - DNA, 20 bp, Artificial Sequence
  Description of Artificial Sequence: Synthetic oligonucleotide
  Target: SCN9A; (+) strand; PAM type: YTN; PAM sequence: TTA
agtgttgctcccaagaaata

SEQ ID NO: 107778 - DNA, 20 bp, Artificial Sequence
  Description of Artificial Sequence: Synthetic oligonucleotide
  Target: SCN9A; (+) strand; PAM type: YTN; PAM sequence: TTG
ctcccaagaaatatgctggc

SEQ ID NO: 107779 - DNA, 20 bp, Artificial Sequence
  Description of Artificial Sequence: Synthetic oligonucleotide
  Target: SCN9A; (+) strand; PAM type: YTN; PAM sequence: CTC
ccaagaaatatgctggcaga

SEQ ID NO: 107780 - DNA, 20 bp, Artificial Sequence
  Description of Artificial Sequence: Synthetic oligonucleotide
  Target: SCN9A; (+) strand; PAM type: YTN; PAM sequence: CTG
gcagaaaaaatcattatcaa

SEQ ID NO: 107781 - DNA, 20 bp, Artificial Sequence
  Description of Artificial Sequence: Synthetic oligonucleotide
  Target: SCN9A; (+) strand; PAM type: YTN; PAM sequence: TTA
tcaactcccaagatggtaac

SEQ ID NO: 107782 - DNA, 20 bp, Artificial Sequence
  Description of Artificial Sequence: Synthetic oligonucleotide
  Target: SCN9A; (+) strand; PAM type: YTN; PAM sequence: CTC
ccaagatggtaaccttttat

SEQ ID NO: 107783 - DNA, 20 bp, Artificial Sequence
  Description of Artificial Sequence: Synthetic oligonucleotide
  Target: SCN9A; (+) strand; PAM type: YTN; PAM sequence: CTT
ttatagaaatagtattgtta

SEQ ID NO: 107784 - DNA, 20 bp, Artificial Sequence
  Description of Artificial Sequence: Synthetic oligonucleotide
  Target: SCN9A; (+) strand; PAM type: YTN; PAM sequence: TTT
tatagaaatagtattgttat

SEQ ID NO: 107785 - DNA, 20 bp, Artificial Sequence
  Description of Artificial Sequence: Synthetic oligonucleotide
  Target: SCN9A; (+) strand; PAM type: YTN; PAM sequence: TTT
atagaaatagtattgttatt

SEQ ID NO: 107786 - DNA, 20 bp, Artificial Sequence
  Description of Artificial Sequence: Synthetic oligonucleotide
  Target: SCN9A; (+) strand; PAM type: YTN; PAM sequence: TTA
tagaaatagtattgttattt

SEQ ID NO: 107787 - DNA, 20 bp, Artificial Sequence
  Description of Artificial Sequence: Synthetic oligonucleotide
  Target: SCN9A; (+) strand; PAM type: YTN; PAM sequence: TTG
ttatttgtagacctcaacag

SEQ ID NO: 107788 - DNA, 20 bp, Artificial Sequence
  Description of Artificial Sequence: Synthetic oligonucleotide
  Target: SCN9A; (+) strand; PAM type: YTN; PAM sequence: TTA
tttgtagacctcaacagtac

SEQ ID NO: 107789 - DNA, 20 bp, Artificial Sequence
  Description of Artificial Sequence: Synthetic oligonucleotide
  Target: SCN9A; (+) strand; PAM type: YTN; PAM sequence: TTT
gtagacctcaacagtactgc

SEQ ID NO: 107790 - DNA, 20 bp, Artificial Sequence
  Description of Artificial Sequence: Synthetic oligonucleotide
  Target: SCN9A; (+) strand; PAM type: YTN; PAM sequence: TTG
tagacctcaacagtactgca

SEQ ID NO: 107791 - DNA, 20 bp, Artificial Sequence
  Description of Artificial Sequence: Synthetic oligonucleotide
  Target: SCN9A; (+) strand; PAM type: YTN; PAM sequence: CTC
aacagtactgcacaattatt

SEQ ID NO: 107792 - DNA, 20 bp, Artificial Sequence
  Description of Artificial Sequence: Synthetic oligonucleotide
  Target: SCN9A; (+) strand; PAM type: YTN; PAM sequence: CTG
cacaattattttaaaagaca

SEQ ID NO: 107793 - DNA, 20 bp, Artificial Sequence
  Description of Artificial Sequence: Synthetic oligonucleotide
  Target: SCN9A; (+) strand; PAM type: YTN; PAM sequence: TTA
ttttaaaagacataaccaga

SEQ ID NO: 107794 - DNA, 20 bp, Artificial Sequence
  Description of Artificial Sequence: Synthetic oligonucleotide
  Target: SCN9A; (+) strand; PAM type: YTN; PAM sequence: TTT
taaaagacataaccagaaac

SEQ ID NO: 107795 - DNA, 20 bp, Artificial Sequence
  Description of Artificial Sequence: Synthetic oligonucleotide
  Target: SCN9A; (+) strand; PAM type: YTN; PAM sequence: TTT
aaaagacataaccagaaact

SEQ ID NO: 107796 - DNA, 20 bp, Artificial Sequence
  Description of Artificial Sequence: Synthetic oligonucleotide
  Target: SCN9A; (+) strand; PAM type: YTN; PAM sequence: TTA
aaagacataaccagaaactt

SEQ ID NO: 107797 - DNA, 20 bp, Artificial Sequence
  Description of Artificial Sequence: Synthetic oligonucleotide
  Target: SCN9A; (+) strand; PAM type: YTN; PAM sequence: CTT
gactctacacatccattcat

SEQ ID NO: 107798 - DNA, 20 bp, Artificial Sequence
  Description of Artificial Sequence: Synthetic oligonucleotide
  Target: SCN9A; (+) strand; PAM type: YTN; PAM sequence: TTG
actctacacatccattcata

SEQ ID NO: 107799 - DNA, 20 bp, Artificial Sequence
  Description of Artificial Sequence: Synthetic oligonucleotide
  Target: SCN9A; (+) strand; PAM type: YTN; PAM sequence: CTC
tacacatccattcatatgga

SEQ ID NO: 107800 - DNA, 20 bp, Artificial Sequence
  Description of Artificial Sequence: Synthetic oligonucleotide
  Target: SCN9A; (+) strand; PAM type: YTN; PAM sequence: CTA
cacatccattcatatggaaa

SEQ ID NO: 107801 - DNA, 20 bp, Artificial Sequence
  Description of Artificial Sequence: Synthetic oligonucleotide
  Target: SCN9A; (+) strand; PAM type: YTN; PAM sequence: TTC
atatggaaagttctggatat

SEQ ID NO: 107802 - DNA, 20 bp, Artificial Sequence
  Description of Artificial Sequence: Synthetic oligonucleotide
  Target: SCN9A; (+) strand; PAM type: YTN; PAM sequence: TTC
tggatatgcataattctgag

SEQ ID NO: 107803 - DNA, 20 bp, Artificial Sequence
  Description of Artificial Sequence: Synthetic oligonucleotide
  Target: SCN9A; (+) strand; PAM type: YTN; PAM sequence: CTG
gatatgcataattctgaggc

SEQ ID NO: 107804 - DNA, 20 bp, Artificial Sequence
  Description of Artificial Sequence: Synthetic oligonucleotide
  Target: SCN9A; (+) strand; PAM type: YTN; PAM sequence: TTC
tgaggctgcagattcatctg

SEQ ID NO: 107805 - DNA, 20 bp, Artificial Sequence
  Description of Artificial Sequence: Synthetic oligonucleotide
  Target: SCN9A; (+) strand; PAM type: YTN; PAM sequence: CTG
aggctgcagattcatctgac

SEQ ID NO: 107806 - DNA, 20 bp, Artificial Sequence
  Description of Artificial Sequence: Synthetic oligonucleotide
  Target: SCN9A; (+) strand; PAM type: YTN; PAM sequence: CTG
cagattcatctgacataaaa

SEQ ID NO: 107807 - DNA, 20 bp, Artificial Sequence
  Description of Artificial Sequence: Synthetic oligonucleotide
  Target: SCN9A; (+) strand; PAM type: YTN; PAM sequence: TTC
atctgacataaaaaatatga

SEQ ID NO: 107808 - DNA, 20 bp, Artificial Sequence
  Description of Artificial Sequence: Synthetic oligonucleotide
  Target: SCN9A; (+) strand; PAM type: YTN; PAM sequence: CTG
acataaaaaatatgaaatga

SEQ ID NO: 107809 - DNA, 20 bp, Artificial Sequence
  Description of Artificial Sequence: Synthetic oligonucleotide
  Target: SCN9A; (+) strand; PAM type: YTN; PAM sequence: CTA
aaaagagaaactatgagtac

SEQ ID NO: 107810 - DNA, 20 bp, Artificial Sequence
  Description of Artificial Sequence: Synthetic oligonucleotide
  Target: SCN9A; (+) strand; PAM type: YTN; PAM sequence: CTA
tgagtacataacacacaata

SEQ ID NO: 107811 - DNA, 20 bp, Artificial Sequence
  Description of Artificial Sequence: Synthetic oligonucleotide
  Target: SCN9A; (+) strand; PAM type: YTN; PAM sequence: CTT
accaaatttcctatagcaag

SEQ ID NO: 107812 - DNA, 20 bp, Artificial Sequence
  Description of Artificial Sequence: Synthetic oligonucleotide
  Target: SCN9A; (+) strand; PAM type: YTN; PAM sequence: TTA
ccaaatttcctatagcaagt

SEQ ID NO: 107813 - DNA, 20 bp, Artificial Sequence
  Description of Artificial Sequence: Synthetic oligonucleotide
  Target: SCN9A; (+) strand; PAM type: YTN; PAM sequence: TTT
cctatagcaagtacattttt

SEQ ID NO: 107814 - DNA, 20 bp, Artificial Sequence
  Description of Artificial Sequence: Synthetic oligonucleotide
  Target: SCN9A; (+) strand; PAM type: YTN; PAM sequence: TTC
ctatagcaagtacatttttg

SEQ ID NO: 107815 - DNA, 20 bp, Artificial Sequence
  Description of Artificial Sequence: Synthetic oligonucleotide
  Target: SCN9A; (+) strand; PAM type: YTN; PAM sequence: CTA
tagcaagtacatttttgaat

SEQ ID NO: 107816 - DNA, 20 bp, Artificial Sequence
  Description of Artificial Sequence: Synthetic oligonucleotide
  Target: SCN9A; (+) strand; PAM type: YTN; PAM sequence: TTT
ttgaattcctcagtcattgg

SEQ ID NO: 107817 - DNA, 20 bp, Artificial Sequence
  Description of Artificial Sequence: Synthetic oligonucleotide
  Target: SCN9A; (+) strand; PAM type: YTN; PAM sequence: TTT
tgaattcctcagtcattggg

SEQ ID NO: 107818 - DNA, 20 bp, Artificial Sequence
  Description of Artificial Sequence: Synthetic oligonucleotide
  Target: SCN9A; (+) strand; PAM type: YTN; PAM sequence: TTT
gaattcctcagtcattgggt

SEQ ID NO: 107819 - DNA, 20 bp, Artificial Sequence
  Description of Artificial Sequence: Synthetic oligonucleotide
  Target: SCN9A; (+) strand; PAM type: YTN; PAM sequence: TTG
aattcctcagtcattgggtg

SEQ ID NO: 107820 - DNA, 20 bp, Artificial Sequence
  Description of Artificial Sequence: Synthetic oligonucleotide
  Target: SCN9A; (+) strand; PAM type: YTN; PAM sequence: TTC
ctcagtcattgggtggtgtt

SEQ ID NO: 107821 - DNA, 20 bp, Artificial Sequence
  Description of Artificial Sequence: Synthetic oligonucleotide
  Target: SCN9A; (+) strand; PAM type: YTN; PAM sequence: CTC
agtcattgggtggtgttcca

SEQ ID NO: 107822 - DNA, 20 bp, Artificial Sequence
  Description of Artificial Sequence: Synthetic oligonucleotide
  Target: SCN9A; (+) strand; PAM type: YTN; PAM sequence: TTG
ggtggtgttccatagccata

SEQ ID NO: 107823 - DNA, 20 bp, Artificial Sequence
  Description of Artificial Sequence: Synthetic oligonucleotide
  Target: SCN9A; (+) strand; PAM type: YTN; PAM sequence: TTC
catagccataaataatgtgt

SEQ ID NO: 107824 - DNA, 20 bp, Artificial Sequence
  Description of Artificial Sequence: Synthetic oligonucleotide
  Target: SCN9A; (+) strand; PAM type: YTN; PAM sequence: TTT
aaaactatgcaaatggtaat

SEQ ID NO: 107825 - DNA, 20 bp, Artificial Sequence
  Description of Artificial Sequence: Synthetic oligonucleotide
  Target: SCN9A; (+) strand; PAM type: YTN; PAM sequence: TTA
aaactatgcaaatggtaatt

SEQ ID NO: 107826 - DNA, 20 bp, Artificial Sequence
  Description of Artificial Sequence: Synthetic oligonucleotide
  Target: SCN9A; (+) strand; PAM type: YTN; PAM sequence: CTA
tgcaaatggtaattgcaaga

SEQ ID NO: 107827 - DNA, 20 bp, Artificial Sequence
  Description of Artificial Sequence: Synthetic oligonucleotide
  Target: SCN9A; (+) strand; PAM type: YTN; PAM sequence: TTG
caagatctacaaaaggatcc

SEQ ID NO: 107828 - DNA, 20 bp, Artificial Sequence
  Description of Artificial Sequence: Synthetic oligonucleotide
  Target: SCN9A; (+) strand; PAM type: YTN; PAM sequence: CTA
caaaaggatccattacaata

SEQ ID NO: 107829 - DNA, 20 bp, Artificial Sequence
  Description of Artificial Sequence: Synthetic oligonucleotide
  Target: SCN9A; (+) strand; PAM type: YTN; PAM sequence: TTA
caataaaatagatacacttt

SEQ ID NO: 107830 - DNA, 20 bp, Artificial Sequence
  Description of Artificial Sequence: Synthetic oligonucleotide
  Target: SCN9A; (+) strand; PAM type: YTN; PAM sequence: CTT
tttgaattttatccaatatg

SEQ ID NO: 107831 - DNA, 20 bp, Artificial Sequence
  Description of Artificial Sequence: Synthetic oligonucleotide
  Target: SCN9A; (+) strand; PAM type: YTN; PAM sequence: TTT
ttgaattttatccaatatgg

SEQ ID NO: 107832 - DNA, 20 bp, Artificial Sequence
  Description of Artificial Sequence: Synthetic oligonucleotide
  Target: SCN9A; (+) strand; PAM type: YTN; PAM sequence: TTT
tgaattttatccaatatgga

SEQ ID NO: 107833 - DNA, 20 bp, Artificial Sequence
  Description of Artificial Sequence: Synthetic oligonucleotide
  Target: SCN9A; (+) strand; PAM type: YTN; PAM sequence: TTT
gaattttatccaatatggag

SEQ ID NO: 107834 - DNA, 20 bp, Artificial Sequence
  Description of Artificial Sequence: Synthetic oligonucleotide
  Target: SCN9A; (+) strand; PAM type: YTN; PAM sequence: TTG
aattttatccaatatggaga

SEQ ID NO: 107835 - DNA, 20 bp, Artificial Sequence
  Description of Artificial Sequence: Synthetic oligonucleotide
  Target: SCN9A; (+) strand; PAM type: YTN; PAM sequence: TTT
tatccaatatggagagcaat

SEQ ID NO: 107836 - DNA, 20 bp, Artificial Sequence
  Description of Artificial Sequence: Synthetic oligonucleotide
  Target: SCN9A; (+) strand; PAM type: YTN; PAM sequence: TTT
atccaatatggagagcaatt

SEQ ID NO: 107837 - DNA, 20 bp, Artificial Sequence
  Description of Artificial Sequence: Synthetic oligonucleotide
  Target: SCN9A; (+) strand; PAM type: YTN; PAM sequence: TTA
tccaatatggagagcaattc

SEQ ID NO: 107838 - DNA, 20 bp, Artificial Sequence
  Description of Artificial Sequence: Synthetic oligonucleotide
  Target: SCN9A; (+) strand; PAM type: YTN; PAM sequence: TTC
cagatcaagaatttgtgtgc

SEQ ID NO: 107839 - DNA, 20 bp, Artificial Sequence
  Description of Artificial Sequence: Synthetic oligonucleotide
  Target: SCN9A; (+) strand; PAM type: YTN; PAM sequence: TTT
gtgtgcaaatctgtaccacc

SEQ ID NO: 107840 - DNA, 20 bp, Artificial Sequence
  Description of Artificial Sequence: Synthetic oligonucleotide
  Target: SCN9A; (+) strand; PAM type: YTN; PAM sequence: TTG
tgtgcaaatctgtaccacca

SEQ ID NO: 107841 - DNA, 20 bp, Artificial Sequence
  Description of Artificial Sequence: Synthetic oligonucleotide
  Target: SCN9A; (+) strand; PAM type: YTN; PAM sequence: CTG
taccaccaaggtggacattt

SEQ ID NO: 107842 - DNA, 20 bp, Artificial Sequence
  Description of Artificial Sequence: Synthetic oligonucleotide
  Target: SCN9A; (+) strand; PAM type: YTN; PAM sequence: TTT
ttgtctggactcttcaagtt

SEQ ID NO: 107843 - DNA, 20 bp, Artificial Sequence
  Description of Artificial Sequence: Synthetic oligonucleotide
  Target: SCN9A; (+) strand; PAM type: YTN; PAM sequence: TTT
tgtctggactcttcaagttc

SEQ ID NO: 107844 - DNA, 20 bp, Artificial Sequence
  Description of Artificial Sequence: Synthetic oligonucleotide
  Target: SCN9A; (+) strand; PAM type: YTN; PAM sequence: TTT
gtctggactcttcaagttct

SEQ ID NO: 107845 - DNA, 20 bp, Artificial Sequence
  Description of Artificial Sequence: Synthetic oligonucleotide
  Target: SCN9A; (+) strand; PAM type: YTN; PAM sequence: TTG
tctggactcttcaagttctg

SEQ ID NO: 107846 - DNA, 20 bp, Artificial Sequence
  Description of Artificial Sequence: Synthetic oligonucleotide
  Target: SCN9A; (+) strand; PAM type: YTN; PAM sequence: CTG
gactcttcaagttctgggag

SEQ ID NO: 107847 - DNA, 20 bp, Artificial Sequence
  Description of Artificial Sequence: Synthetic oligonucleotide
  Target: SCN9A; (+) strand; PAM type: YTN; PAM sequence: CTC
ttcaagttctgggagaaaaa

SEQ ID NO: 107848 - DNA, 20 bp, Artificial Sequence
  Description of Artificial Sequence: Synthetic oligonucleotide
  Target: SCN9A; (+) strand; PAM type: YTN; PAM sequence: CTT
caagttctgggagaaaaaag

SEQ ID NO: 107849 - DNA, 20 bp, Artificial Sequence
  Description of Artificial Sequence: Synthetic oligonucleotide
  Target: SCN9A; (+) strand; PAM type: YTN; PAM sequence: TTC
aagttctgggagaaaaaagc

SEQ ID NO: 107850 - DNA, 20 bp, Artificial Sequence
  Description of Artificial Sequence: Synthetic oligonucleotide
  Target: SCN9A; (+) strand; PAM type: YTN; PAM sequence: TTC
tgggagaaaaaagcagagaa

SEQ ID NO: 107851 - DNA, 20 bp, Artificial Sequence
  Description of Artificial Sequence: Synthetic oligonucleotide
  Target: SCN9A; (+) strand; PAM type: YTN; PAM sequence: CTG
ggagaaaaaagcagagaaca

SEQ ID NO: 107852 - DNA, 20 bp, Artificial Sequence
  Description of Artificial Sequence: Synthetic oligonucleotide
  Target: SCN9A; (+) strand; PAM type: YTN; PAM sequence: TTT
gtctgtttcactcctaacca

SEQ ID NO: 107853 - DNA, 20 bp, Artificial Sequence
  Description of Artificial Sequence: Synthetic oligonucleotide
  Target: SCN9A; (+) strand; PAM type: YTN; PAM sequence: TTG
tctgtttcactcctaaccag

SEQ ID NO: 107854 - DNA, 20 bp, Artificial Sequence
  Description of Artificial Sequence: Synthetic oligonucleotide
  Target: SCN9A; (+) strand; PAM type: YTN; PAM sequence: CTG
tttcactcctaaccagatac

SEQ ID NO: 107855 - DNA, 20 bp, Artificial Sequence
  Description of Artificial Sequence: Synthetic oligonucleotide
  Target: SCN9A; (+) strand; PAM type: YTN; PAM sequence: TTT
cactcctaaccagatacaaa

SEQ ID NO: 107856 - DNA, 20 bp, Artificial Sequence
  Description of Artificial Sequence: Synthetic oligonucleotide
  Target: SCN9A; (+) strand; PAM type: YTN; PAM sequence: TTC
actcctaaccagatacaaat

SEQ ID NO: 107857 - DNA, 20 bp, Artificial Sequence
  Description of Artificial Sequence: Synthetic oligonucleotide
  Target: SCN9A; (+) strand; PAM type: YTN; PAM sequence: CTC
ctaaccagatacaaatcagt

SEQ ID NO: 107858 - DNA, 20 bp, Artificial Sequence
  Description of Artificial Sequence: Synthetic oligonucleotide
  Target: SCN9A; (+) strand; PAM type: YTN; PAM sequence: CTA
accagatacaaatcagtcag

SEQ ID NO: 107859 - DNA, 20 bp, Artificial Sequence
  Description of Artificial Sequence: Synthetic oligonucleotide
  Target: SCN9A; (+) strand; PAM type: YTN; PAM sequence: TTC
taatattgaaacaaggttta

SEQ ID NO: 107860 - DNA, 20 bp, Artificial Sequence
  Description of Artificial Sequence: Synthetic oligonucleotide
  Target: SCN9A; (+) strand; PAM type: YTN; PAM sequence: CTA
atattgaaacaaggtttata

SEQ ID NO: 107861 - DNA, 20 bp, Artificial Sequence
  Description of Artificial Sequence: Synthetic oligonucleotide
  Target: SCN9A; (+) strand; PAM type: YTN; PAM sequence: TTG
aaacaaggtttatagtttag

SEQ ID NO: 107862 - DNA, 20 bp, Artificial Sequence
  Description of Artificial Sequence: Synthetic oligonucleotide
  Target: SCN9A; (+) strand; PAM type: YTN; PAM sequence: TTT
atagtttagattttgaaaat

SEQ ID NO: 107863 - DNA, 20 bp, Artificial Sequence
  Description of Artificial Sequence: Synthetic oligonucleotide
  Target: SCN9A; (+) strand; PAM type: YTN; PAM sequence: TTA
tagtttagattttgaaaatt

SEQ ID NO: 107864 - DNA, 20 bp, Artificial Sequence
  Description of Artificial Sequence: Synthetic oligonucleotide
  Target: SCN9A; (+) strand; PAM type: YTN; PAM sequence: TTT
agattttgaaaatttaacag

SEQ ID NO: 107865 - DNA, 20 bp, Artificial Sequence
  Description of Artificial Sequence: Synthetic oligonucleotide
  Target: SCN9A; (+) strand; PAM type: YTN; PAM sequence: TTA
gattttgaaaatttaacagt

SEQ ID NO: 107866 - DNA, 20 bp, Artificial Sequence
  Description of Artificial Sequence: Synthetic oligonucleotide
  Target: SCN9A; (+) strand; PAM type: YTN; PAM sequence: TTT
tgaaaatttaacagtactat

SEQ ID NO: 107867 - DNA, 20 bp, Artificial Sequence
  Description of Artificial Sequence: Synthetic oligonucleotide
  Target: SCN9A; (+) strand; PAM type: YTN; PAM sequence: TTT
gaaaatttaacagtactatt

SEQ ID NO: 107868 - DNA, 20 bp, Artificial Sequence
  Description of Artificial Sequence: Synthetic oligonucleotide
  Target: SCN9A; (+) strand; PAM type: YTN; PAM sequence: TTG
aaaatttaacagtactattt

SEQ ID NO: 107869 - DNA, 20 bp, Artificial Sequence
  Description of Artificial Sequence: Synthetic oligonucleotide
  Target: SCN9A; (+) strand; PAM type: YTN; PAM sequence: TTT
aacagtactatttcaatgaa

SEQ ID NO: 107870 - DNA, 20 bp, Artificial Sequence
  Description of Artificial Sequence: Synthetic oligonucleotide
  Target: SCN9A; (+) strand; PAM type: YTN; PAM sequence: TTA
acagtactatttcaatgaaa

SEQ ID NO: 107871 - DNA, 20 bp, Artificial Sequence
  Description of Artificial Sequence: Synthetic oligonucleotide
  Target: SCN9A; (+) strand; PAM type: YTN; PAM sequence: CTA
tttcaatgaaagcatagcct

SEQ ID NO: 107872 - DNA, 20 bp, Artificial Sequence
  Description of Artificial Sequence: Synthetic oligonucleotide
  Target: SCN9A; (+) strand; PAM type: YTN; PAM sequence: TTT
caatgaaagcatagcctctt

SEQ ID NO: 107873 - DNA, 20 bp, Artificial Sequence
  Description of Artificial Sequence: Synthetic oligonucleotide
  Target: SCN9A; (+) strand; PAM type: YTN; PAM sequence: TTC
aatgaaagcatagcctctta

SEQ ID NO: 107874 - DNA, 20 bp, Artificial Sequence
  Description of Artificial Sequence: Synthetic oligonucleotide
  Target: SCN9A; (+) strand; PAM type: YTN; PAM sequence: CTC
ttatgtaagtctattatgac

SEQ ID NO: 107875 - DNA, 20 bp, Artificial Sequence
  Description of Artificial Sequence: Synthetic oligonucleotide
  Target: SCN9A; (+) strand; PAM type: YTN; PAM sequence: CTT
atgtaagtctattatgacat

SEQ ID NO: 107876 - DNA, 20 bp, Artificial Sequence
  Description of Artificial Sequence: Synthetic oligonucleotide
  Target: SCN9A; (+) strand; PAM type: YTN; PAM sequence: TTA
tgtaagtctattatgacatg

SEQ ID NO: 107877 - DNA, 20 bp, Artificial Sequence
  Description of Artificial Sequence: Synthetic oligonucleotide
  Target: SCN9A; (+) strand; PAM type: YTN; PAM sequence: CTA
ttatgacatgttcgttgcct

SEQ ID NO: 107878 - DNA, 20 bp, Artificial Sequence
  Description of Artificial Sequence: Synthetic oligonucleotide
  Target: SCN9A; (+) strand; PAM type: YTN; PAM sequence: TTA
tgacatgttcgttgcctaga

SEQ ID NO: 107879 - DNA, 20 bp, Artificial Sequence
  Description of Artificial Sequence: Synthetic oligonucleotide
  Target: SCN9A; (+) strand; PAM type: YTN; PAM sequence: TTC
gttgcctagatgaagcataa

SEQ ID NO: 107880 - DNA, 20 bp, Artificial Sequence
  Description of Artificial Sequence: Synthetic oligonucleotide
  Target: SCN9A; (+) strand; PAM type: YTN; PAM sequence: TTG
cctagatgaagcataagaga

SEQ ID NO: 107881 - DNA, 20 bp, Artificial Sequence
  Description of Artificial Sequence: Synthetic oligonucleotide
  Target: SCN9A; (+) strand; PAM type: YTN; PAM sequence: CTA
gatgaagcataagagagggt

SEQ ID NO: 107882 - DNA, 20 bp, Artificial Sequence
  Description of Artificial Sequence: Synthetic oligonucleotide
  Target: SCN9A; (+) strand; PAM type: YTN; PAM sequence: TTT
atgactgcaagcacatatgt

SEQ ID NO: 107883 - DNA, 20 bp, Artificial Sequence
  Description of Artificial Sequence: Synthetic oligonucleotide
  Target: SCN9A; (+) strand; PAM type: YTN; PAM sequence: TTA
tgactgcaagcacatatgtg

SEQ ID NO: 107884 - DNA, 20 bp, Artificial Sequence
  Description of Artificial Sequence: Synthetic oligonucleotide
  Target: SCN9A; (+) strand; PAM type: YTN; PAM sequence: CTG
caagcacatatgtgggcatc

SEQ ID NO: 107885 - DNA, 20 bp, Artificial Sequence
  Description of Artificial Sequence: Synthetic oligonucleotide
  Target: SCN9A; (+) strand; PAM type: YTN; PAM sequence: CTT
tcagagaaaaatgcacctaa

SEQ ID NO: 107886 - DNA, 20 bp, Artificial Sequence
  Description of Artificial Sequence: Synthetic oligonucleotide
  Target: SCN9A; (+) strand; PAM type: YTN; PAM sequence: TTT
cagagaaaaatgcacctaac

SEQ ID NO: 107887 - DNA, 20 bp, Artificial Sequence
  Description of Artificial Sequence: Synthetic oligonucleotide
  Target: SCN9A; (+) strand; PAM type: YTN; PAM sequence: TTC
agagaaaaatgcacctaaca

SEQ ID NO: 107888 - DNA, 20 bp, Artificial Sequence
  Description of Artificial Sequence: Synthetic oligonucleotide
  Target: SCN9A; (+) strand; PAM type: YTN; PAM sequence: CTA
acatgtgatggtaaacagga

SEQ ID NO: 107889 - DNA, 20 bp, Artificial Sequence
  Description of Artificial Sequence: Synthetic oligonucleotide
  Target: SCN9A; (+) strand; PAM type: YTN; PAM sequence: CTA
tgtttccttaacagagaaat

SEQ ID NO: 107890 - DNA, 20 bp, Artificial Sequence
  Description of Artificial Sequence: Synthetic oligonucleotide
  Target: SCN9A; (+) strand; PAM type: YTN; PAM sequence: TTT
ccttaacagagaaatgtatg

SEQ ID NO: 107891 - DNA, 20 bp, Artificial Sequence
  Description of Artificial Sequence: Synthetic oligonucleotide
  Target: SCN9A; (+) strand; PAM type: YTN; PAM sequence: TTC
cttaacagagaaatgtatgt

SEQ ID NO: 107892 - DNA, 20 bp, Artificial Sequence
  Description of Artificial Sequence: Synthetic oligonucleotide
  Target: SCN9A; (+) strand; PAM type: YTN; PAM sequence: CTT
aacagagaaatgtatgtttt

SEQ ID NO: 107893 - DNA, 20 bp, Artificial Sequence
  Description of Artificial Sequence: Synthetic oligonucleotide
  Target: SCN9A; (+) strand; PAM type: YTN; PAM sequence: TTA
acagagaaatgtatgttttc

SEQ ID NO: 107894 - DNA, 20 bp, Artificial Sequence
  Description of Artificial Sequence: Synthetic oligonucleotide
  Target: SCN9A; (+) strand; PAM type: YTN; PAM sequence: TTT
tccaccaatatgcatatttt

SEQ ID NO: 107895 - DNA, 20 bp, Artificial Sequence
  Description of Artificial Sequence: Synthetic oligonucleotide
  Target: SCN9A; (+) strand; PAM type: YTN; PAM sequence: TTT
ccaccaatatgcatattttt

SEQ ID NO: 107896 - DNA, 20 bp, Artificial Sequence
  Description of Artificial Sequence: Synthetic oligonucleotide
  Target: SCN9A; (+) strand; PAM type: YTN; PAM sequence: TTC
caccaatatgcatatttttc

SEQ ID NO: 107897 - DNA, 20 bp, Artificial Sequence
  Description of Artificial Sequence: Synthetic oligonucleotide
  Target: SCN9A; (+) strand; PAM type: YTN; PAM sequence: TTT
ttcacctgtgtttttagtcc

SEQ ID NO: 107898 - DNA, 20 bp, Artificial Sequence
  Description of Artificial Sequence: Synthetic oligonucleotide
  Target: SCN9A; (+) strand; PAM type: YTN; PAM sequence: TTT
tcacctgtgtttttagtccc

SEQ ID NO: 107899 - DNA, 20 bp, Artificial Sequence
  Description of Artificial Sequence: Synthetic oligonucleotide
  Target: SCN9A; (+) strand; PAM type: YTN; PAM sequence: TTT
cacctgtgtttttagtccca

SEQ ID NO: 107900 - DNA, 20 bp, Artificial Sequence
  Description of Artificial Sequence: Synthetic oligonucleotide
  Target: SCN9A; (+) strand; PAM type: YTN; PAM sequence: TTC
acctgtgtttttagtcccat

SEQ ID NO: 107901 - DNA, 20 bp, Artificial Sequence
  Description of Artificial Sequence: Synthetic oligonucleotide
  Target: SCN9A; (+) strand; PAM type: YTN; PAM sequence: CTG
tgtttttagtcccatgacaa

SEQ ID NO: 107902 - DNA, 20 bp, Artificial Sequence
  Description of Artificial Sequence: Synthetic oligonucleotide
  Target: SCN9A; (+) strand; PAM type: YTN; PAM sequence: TTT
ttagtcccatgacaacaata

SEQ ID NO: 107903 - DNA, 20 bp, Artificial Sequence
  Description of Artificial Sequence: Synthetic oligonucleotide
  Target: SCN9A; (+) strand; PAM type: YTN; PAM sequence: TTT
tagtcccatgacaacaataa

SEQ ID NO: 107904 - DNA, 20 bp, Artificial Sequence
  Description of Artificial Sequence: Synthetic oligonucleotide
  Target: SCN9A; (+) strand; PAM type: YTN; PAM sequence: TTT
agtcccatgacaacaataag

SEQ ID NO: 107905 - DNA, 20 bp, Artificial Sequence
  Description of Artificial Sequence: Synthetic oligonucleotide
  Target: SCN9A; (+) strand; PAM type: YTN; PAM sequence: TTA
gtcccatgacaacaataaga

SEQ ID NO: 107906 - DNA, 20 bp, Artificial Sequence
  Description of Artificial Sequence: Synthetic oligonucleotide
  Target: SCN9A; (+) strand; PAM type: YTN; PAM sequence: CTA
ttctgtccagaaaaaactct

SEQ ID NO: 107907 - DNA, 20 bp, Artificial Sequence
  Description of Artificial Sequence: Synthetic oligonucleotide
  Target: SCN9A; (+) strand; PAM type: YTN; PAM sequence: TTC
tgtccagaaaaaactcttgc

SEQ ID NO: 107908 - DNA, 20 bp, Artificial Sequence
  Description of Artificial Sequence: Synthetic oligonucleotide
  Target: SCN9A; (+) strand; PAM type: YTN; PAM sequence: CTG
tccagaaaaaactcttgctg

SEQ ID NO: 107909 - DNA, 20 bp, Artificial Sequence
  Description of Artificial Sequence: Synthetic oligonucleotide
  Target: SCN9A; (+) strand; PAM type: YTN; PAM sequence: CTC
ttgctgtaatagttcacagg

SEQ ID NO: 107910 - DNA, 20 bp, Artificial Sequence
  Description of Artificial Sequence: Synthetic oligonucleotide
  Target: SCN9A; (+) strand; PAM type: YTN; PAM sequence: CTT
gctgtaatagttcacaggtg

SEQ ID NO: 107911 - DNA, 20 bp, Artificial Sequence
  Description of Artificial Sequence: Synthetic oligonucleotide
  Target: SCN9A; (+) strand; PAM type: YTN; PAM sequence: TTG
ctgtaatagttcacaggtga

SEQ ID NO: 107912 - DNA, 20 bp, Artificial Sequence
  Description of Artificial Sequence: Synthetic oligonucleotide
  Target: SCN9A; (+) strand; PAM type: YTN; PAM sequence: CTG
taatagttcacaggtgaaaa

SEQ ID NO: 107913 - DNA, 20 bp, Artificial Sequence
  Description of Artificial Sequence: Synthetic oligonucleotide
  Target: SCN9A; (+) strand; PAM type: YTN; PAM sequence: TTC
acaggtgaaaacaatcctag

SEQ ID NO: 107914 - DNA, 20 bp, Artificial Sequence
  Description of Artificial Sequence: Synthetic oligonucleotide
  Target: SCN9A; (+) strand; PAM type: YTN; PAM sequence: CTA
gaaccaagcaactagaaata

SEQ ID NO: 107915 - DNA, 20 bp, Artificial Sequence
  Description of Artificial Sequence: Synthetic oligonucleotide
  Target: SCN9A; (+) strand; PAM type: YTN; PAM sequence: CTA
gaaataatttatggaggact

SEQ ID NO: 107916 - DNA, 20 bp, Artificial Sequence
  Description of Artificial Sequence: Synthetic oligonucleotide
  Target: SCN9A; (+) strand; PAM type: YTN; PAM sequence: TTT
atggaggactcatgaaatag

SEQ ID NO: 107917 - DNA, 20 bp, Artificial Sequence
  Description of Artificial Sequence: Synthetic oligonucleotide
  Target: SCN9A; (+) strand; PAM type: YTN; PAM sequence: TTA
tggaggactcatgaaataga

SEQ ID NO: 107918 - DNA, 20 bp, Artificial Sequence
  Description of Artificial Sequence: Synthetic oligonucleotide
  Target: SCN9A; (+) strand; PAM type: YTN; PAM sequence: CTC
atgaaatagacatttcacac

SEQ ID NO: 107919 - DNA, 20 bp, Artificial Sequence
  Description of Artificial Sequence: Synthetic oligonucleotide
  Target: SCN9A; (+) strand; PAM type: YTN; PAM sequence: TTT
cacaccattagcccatttac

SEQ ID NO: 107920 - DNA, 20 bp, Artificial Sequence
  Description of Artificial Sequence: Synthetic oligonucleotide
  Target: SCN9A; (+) strand; PAM type: YTN; PAM sequence: TTC
acaccattagcccatttact

SEQ ID NO: 107921 - DNA, 20 bp, Artificial Sequence
  Description of Artificial Sequence: Synthetic oligonucleotide
  Target: SCN9A; (+) strand; PAM type: YTN; PAM sequence: TTA
gcccatttacttctcaccat

SEQ ID NO: 107922 - DNA, 20 bp, Artificial Sequence
  Description of Artificial Sequence: Synthetic oligonucleotide
  Target: SCN9A; (+) strand; PAM type: YTN; PAM sequence: TTT
acttctcaccatttatttag

SEQ ID NO: 107923 - DNA, 20 bp, Artificial Sequence
  Description of Artificial Sequence: Synthetic oligonucleotide
  Target: SCN9A; (+) strand; PAM type: YTN; PAM sequence: TTA
cttctcaccatttatttagg

SEQ ID NO: 107924 - DNA, 20 bp, Artificial Sequence
  Description of Artificial Sequence: Synthetic oligonucleotide
  Target: SCN9A; (+) strand; PAM type: YTN; PAM sequence: CTT
ctcaccatttatttaggaga

SEQ ID NO: 107925 - DNA, 20 bp, Artificial Sequence
  Description of Artificial Sequence: Synthetic oligonucleotide
  Target: SCN9A; (+) strand; PAM type: YTN; PAM sequence: TTC
tcaccatttatttaggagat

SEQ ID NO: 107926 - DNA, 20 bp, Artificial Sequence
  Description of Artificial Sequence: Synthetic oligonucleotide
  Target: SCN9A; (+) strand; PAM type: YTN; PAM sequence: CTC
accatttatttaggagatga

SEQ ID NO: 107927 - DNA, 20 bp, Artificial Sequence
  Description of Artificial Sequence: Synthetic oligonucleotide
  Target: SCN9A; (+) strand; PAM type: YTN; PAM sequence: TTT
atttaggagatgagtagaca

SEQ ID NO: 107928 - DNA, 20 bp, Artificial Sequence
  Description of Artificial Sequence: Synthetic oligonucleotide
  Target: SCN9A; (+) strand; PAM type: YTN; PAM sequence: TTA
tttaggagatgagtagacac

SEQ ID NO: 107929 - DNA, 20 bp, Artificial Sequence
  Description of Artificial Sequence: Synthetic oligonucleotide
  Target: SCN9A; (+) strand; PAM type: YTN; PAM sequence: TTT
aggagatgagtagacacttt

SEQ ID NO: 107930 - DNA, 20 bp, Artificial Sequence
  Description of Artificial Sequence: Synthetic oligonucleotide
  Target: SCN9A; (+) strand; PAM type: YTN; PAM sequence: TTA
ggagatgagtagacactttg

SEQ ID NO: 107931 - DNA, 20 bp, Artificial Sequence
  Description of Artificial Sequence: Synthetic oligonucleotide
  Target: SCN9A; (+) strand; PAM type: YTN; PAM sequence: CTT
tgcccccacaatgggaatgt

SEQ ID NO: 107932 - DNA, 20 bp, Artificial Sequence
  Description of Artificial Sequence: Synthetic oligonucleotide
  Target: SCN9A; (+) strand; PAM type: YTN; PAM sequence: TTT
gcccccacaatgggaatgtg

SEQ ID NO: 107933 - DNA, 20 bp, Artificial Sequence
  Description of Artificial Sequence: Synthetic oligonucleotide
  Target: SCN9A; (+) strand; PAM type: YTN; PAM sequence: TTG
cccccacaatgggaatgtgg

SEQ ID NO: 107934 - DNA, 20 bp, Artificial Sequence
  Description of Artificial Sequence: Synthetic oligonucleotide
  Target: SCN9A; (+) strand; PAM type: YTN; PAM sequence: TTA
gacccagggaccaggtggga

SEQ ID NO: 107935 - DNA, 20 bp, Artificial Sequence
  Description of Artificial Sequence: Synthetic oligonucleotide
  Target: SCN9A; (+) strand; PAM type: YTN; PAM sequence: CTG
gggcatattgtcaggggaga

SEQ ID NO: 107936 - DNA, 20 bp, Artificial Sequence
  Description of Artificial Sequence: Synthetic oligonucleotide
  Target: SCN9A; (+) strand; PAM type: YTN; PAM sequence: TTG
tcaggggagagggtagaagc

SEQ ID NO: 107937 - DNA, 20 bp, Artificial Sequence
  Description of Artificial Sequence: Synthetic oligonucleotide
  Target: SCN9A; (+) strand; PAM type: YTN; PAM sequence: TTT
gtaaagttgtcaccctttga

SEQ ID NO: 107938 - DNA, 20 bp, Artificial Sequence
  Description of Artificial Sequence: Synthetic oligonucleotide
  Target: SCN9A; (+) strand; PAM type: YTN; PAM sequence: TTG
taaagttgtcaccctttgac

SEQ ID NO: 107939 - DNA, 20 bp, Artificial Sequence
  Description of Artificial Sequence: Synthetic oligonucleotide
  Target: SCN9A; (+) strand; PAM type: YTN; PAM sequence: TTG
tcaccctttgactatctttg

SEQ ID NO: 107940 - DNA, 20 bp, Artificial Sequence
  Description of Artificial Sequence: Synthetic oligonucleotide
  Target: SCN9A; (+) strand; PAM type: YTN; PAM sequence: CTT
tgactatctttgcttattag

SEQ ID NO: 107941 - DNA, 20 bp, Artificial Sequence
  Description of Artificial Sequence: Synthetic oligonucleotide
  Target: SCN9A; (+) strand; PAM type: YTN; PAM sequence: TTT
gactatctttgcttattaga

SEQ ID NO: 107942 - DNA, 20 bp, Artificial Sequence
  Description of Artificial Sequence: Synthetic oligonucleotide
  Target: SCN9A; (+) strand; PAM type: YTN; PAM sequence: TTG
actatctttgcttattagaa

SEQ ID NO: 107943 - DNA, 20 bp, Artificial Sequence
  Description of Artificial Sequence: Synthetic oligonucleotide
  Target: SCN9A; (+) strand; PAM type: YTN; PAM sequence: CTA
tctttgcttattagaagaga

SEQ ID NO: 107944 - DNA, 20 bp, Artificial Sequence
  Description of Artificial Sequence: Synthetic oligonucleotide
  Target: SCN9A; (+) strand; PAM type: YTN; PAM sequence: CTT
tgcttattagaagagacaat

SEQ ID NO: 107945 - DNA, 20 bp, Artificial Sequence
  Description of Artificial Sequence: Synthetic oligonucleotide
  Target: SCN9A; (+) strand; PAM type: YTN; PAM sequence: TTT
gcttattagaagagacaatt

SEQ ID NO: 107946 - DNA, 20 bp, Artificial Sequence
  Description of Artificial Sequence: Synthetic oligonucleotide
  Target: SCN9A; (+) strand; PAM type: YTN; PAM sequence: TTG
cttattagaagagacaattt

SEQ ID NO: 107947 - DNA, 20 bp, Artificial Sequence
  Description of Artificial Sequence: Synthetic oligonucleotide
  Target: SCN9A; (+) strand; PAM type: YTN; PAM sequence: CTT
attagaagagacaatttttg

SEQ ID NO: 107948 - DNA, 20 bp, Artificial Sequence
  Description of Artificial Sequence: Synthetic oligonucleotide
  Target: SCN9A; (+) strand; PAM type: YTN; PAM sequence: TTA
ttagaagagacaatttttga

SEQ ID NO: 107949 - DNA, 20 bp, Artificial Sequence
  Description of Artificial Sequence: Synthetic oligonucleotide
  Target: SCN9A; (+) strand; PAM type: YTN; PAM sequence: TTA
gaagagacaatttttgagcg

SEQ ID NO: 107950 - DNA, 20 bp, Artificial Sequence
  Description of Artificial Sequence: Synthetic oligonucleotide
  Target: SCN9A; (+) strand; PAM type: YTN; PAM sequence: TTT
ttgagcgaatatgtaatttg

SEQ ID NO: 107951 - DNA, 20 bp, Artificial Sequence
  Description of Artificial Sequence: Synthetic oligonucleotide
  Target: SCN9A; (+) strand; PAM type: YTN; PAM sequence: TTT
tgagcgaatatgtaatttgt

SEQ ID NO: 107952 - DNA, 20 bp, Artificial Sequence
  Description of Artificial Sequence: Synthetic oligonucleotide
  Target: SCN9A; (+) strand; PAM type: YTN; PAM sequence: TTT
gagcgaatatgtaatttgta

SEQ ID NO: 107953 - DNA, 20 bp, Artificial Sequence
  Description of Artificial Sequence: Synthetic oligonucleotide
  Target: SCN9A; (+) strand; PAM type: YTN; PAM sequence: TTG
agcgaatatgtaatttgtaa

SEQ ID NO: 107954 - DNA, 20 bp, Artificial Sequence
  Description of Artificial Sequence: Synthetic oligonucleotide
  Target: SCN9A; (+) strand; PAM type: YTN; PAM sequence: TTT
gtaagattatatagtgacag

SEQ ID NO: 107955 - DNA, 20 bp, Artificial Sequence
  Description of Artificial Sequence: Synthetic oligonucleotide
  Target: SCN9A; (+) strand; PAM type: YTN; PAM sequence: TTG
taagattatatagtgacaga

SEQ ID NO: 107956 - DNA, 20 bp, Artificial Sequence
  Description of Artificial Sequence: Synthetic oligonucleotide
  Target: SCN9A; (+) strand; PAM type: YTN; PAM sequence: TTA
tatagtgacagaatcacgta

SEQ ID NO: 107957 - DNA, 20 bp, Artificial Sequence
  Description of Artificial Sequence: Synthetic oligonucleotide
  Target: SCN9A; (+) strand; PAM type: YTN; PAM sequence: CTC
tgggttaaccttgttttctg

SEQ ID NO: 107958 - DNA, 20 bp, Artificial Sequence
  Description of Artificial Sequence: Synthetic oligonucleotide
  Target: SCN9A; (+) strand; PAM type: YTN; PAM sequence: CTG
ggttaaccttgttttctgca

SEQ ID NO: 107959 - DNA, 20 bp, Artificial Sequence
  Description of Artificial Sequence: Synthetic oligonucleotide
  Target: SCN9A; (+) strand; PAM type: YTN; PAM sequence: TTA
accttgttttctgcatcaat

SEQ ID NO: 107960 - DNA, 20 bp, Artificial Sequence
  Description of Artificial Sequence: Synthetic oligonucleotide
  Target: SCN9A; (+) strand; PAM type: YTN; PAM sequence: CTT
gttttctgcatcaattacta

SEQ ID NO: 107961 - DNA, 20 bp, Artificial Sequence
  Description of Artificial Sequence: Synthetic oligonucleotide
  Target: SCN9A; (+) strand; PAM type: YTN; PAM sequence: TTG
ttttctgcatcaattactat

SEQ ID NO: 107962 - DNA, 20 bp, Artificial Sequence
  Description of Artificial Sequence: Synthetic oligonucleotide
  Target: SCN9A; (+) strand; PAM type: YTN; PAM sequence: TTT
tctgcatcaattactattaa

SEQ ID NO: 107963 - DNA, 20 bp, Artificial Sequence
  Description of Artificial Sequence: Synthetic oligonucleotide
  Target: SCN9A; (+) strand; PAM type: YTN; PAM sequence: TTT
ctgcatcaattactattaaa

SEQ ID NO: 107964 - DNA, 20 bp, Artificial Sequence
  Description of Artificial Sequence: Synthetic oligonucleotide
  Target: SCN9A; (+) strand; PAM type: YTN; PAM sequence: TTC
tgcatcaattactattaaat

SEQ ID NO: 107965 - DNA, 20 bp, Artificial Sequence
  Description of Artificial Sequence: Synthetic oligonucleotide
  Target: SCN9A; (+) strand; PAM type: YTN; PAM sequence: CTG
catcaattactattaaatca

SEQ ID NO: 107966 - DNA, 20 bp, Artificial Sequence
  Description of Artificial Sequence: Synthetic oligonucleotide
  Target: SCN9A; (+) strand; PAM type: YTN; PAM sequence: TTA
ctattaaatcacttatcttt

SEQ ID NO: 107967 - DNA, 20 bp, Artificial Sequence
  Description of Artificial Sequence: Synthetic oligonucleotide
  Target: SCN9A; (+) strand; PAM type: YTN; PAM sequence: CTA
ttaaatcacttatctttgaa

SEQ ID NO: 107968 - DNA, 20 bp, Artificial Sequence
  Description of Artificial Sequence: Synthetic oligonucleotide
  Target: SCN9A; (+) strand; PAM type: YTN; PAM sequence: TTA
aatcacttatctttgaaagg

SEQ ID NO: 107969 - DNA, 20 bp, Artificial Sequence
  Description of Artificial Sequence: Synthetic oligonucleotide
  Target: SCN9A; (+) strand; PAM type: YTN; PAM sequence: CTT
atctttgaaaggtcagatca

SEQ ID NO: 107970 - DNA, 20 bp, Artificial Sequence
  Description of Artificial Sequence: Synthetic oligonucleotide
  Target: SCN9A; (+) strand; PAM type: YTN; PAM sequence: TTA
tctttgaaaggtcagatcac

SEQ ID NO: 107971 - DNA, 20 bp, Artificial Sequence
  Description of Artificial Sequence: Synthetic oligonucleotide
  Target: SCN9A; (+) strand; PAM type: YTN; PAM sequence: CTT
tgaaaggtcagatcacccaa

SEQ ID NO: 107972 - DNA, 20 bp, Artificial Sequence
  Description of Artificial Sequence: Synthetic oligonucleotide
  Target: SCN9A; (+) strand; PAM type: YTN; PAM sequence: TTT
gaaaggtcagatcacccaac

SEQ ID NO: 107973 - DNA, 20 bp, Artificial Sequence
  Description of Artificial Sequence: Synthetic oligonucleotide
  Target: SCN9A; (+) strand; PAM type: YTN; PAM sequence: TTG
aaaggtcagatcacccaaca

SEQ ID NO: 107974 - DNA, 20 bp, Artificial Sequence
  Description of Artificial Sequence: Synthetic oligonucleotide
  Target: SCN9A; (+) strand; PAM type: YTN; PAM sequence: CTG
tctttgtgggttttcttttt

SEQ ID NO: 107975 - DNA, 20 bp, Artificial Sequence
  Description of Artificial Sequence: Synthetic oligonucleotide
  Target: SCN9A; (+) strand; PAM type: YTN; PAM sequence: CTT
tgtgggttttctttttttca

SEQ ID NO: 107976 - DNA, 20 bp, Artificial Sequence
  Description of Artificial Sequence: Synthetic oligonucleotide
  Target: SCN9A; (+) strand; PAM type: YTN; PAM sequence: TTT
gtgggttttctttttttcat

SEQ ID NO: 107977 - DNA, 20 bp, Artificial Sequence
  Description of Artificial Sequence: Synthetic oligonucleotide
  Target: SCN9A; (+) strand; PAM type: YTN; PAM sequence: TTG
tgggttttctttttttcatt

SEQ ID NO: 107978 - DNA, 20 bp, Artificial Sequence
  Description of Artificial Sequence: Synthetic oligonucleotide
  Target: SCN9A; (+) strand; PAM type: YTN; PAM sequence: TTT
tctttttttcattttgcaaa

SEQ ID NO: 107979 - DNA, 20 bp, Artificial Sequence
  Description of Artificial Sequence: Synthetic oligonucleotide
  Target: SCN9A; (+) strand; PAM type: YTN; PAM sequence: TTT
ctttttttcattttgcaaag

SEQ ID NO: 107980 - DNA, 20 bp, Artificial Sequence
  Description of Artificial Sequence: Synthetic oligonucleotide
  Target: SCN9A; (+) strand; PAM type: YTN; PAM sequence: TTC
tttttttcattttgcaaagt

SEQ ID NO: 107981 - DNA, 20 bp, Artificial Sequence
  Description of Artificial Sequence: Synthetic oligonucleotide
  Target: SCN9A; (+) strand; PAM type: YTN; PAM sequence: CTT
tttttcattttgcaaagtca

SEQ ID NO: 107982 - DNA, 20 bp, Artificial Sequence
  Description of Artificial Sequence: Synthetic oligonucleotide
  Target: SCN9A; (+) strand; PAM type: YTN; PAM sequence: TTT
ttttcattttgcaaagtcat

SEQ ID NO: 107983 - DNA, 20 bp, Artificial Sequence
  Description of Artificial Sequence: Synthetic oligonucleotide
  Target: SCN9A; (+) strand; PAM type: YTN; PAM sequence: TTT
tttcattttgcaaagtcatt

SEQ ID NO: 107984 - DNA, 20 bp, Artificial Sequence
  Description of Artificial Sequence: Synthetic oligonucleotide
  Target: SCN9A; (+) strand; PAM type: YTN; PAM sequence: TTT
ttcattttgcaaagtcattt

SEQ ID NO: 107985 - DNA, 20 bp, Artificial Sequence
  Description of Artificial Sequence: Synthetic oligonucleotide
  Target: SCN9A; (+) strand; PAM type: YTN; PAM sequence: TTT
tcattttgcaaagtcatttt

SEQ ID NO: 107986 - DNA, 20 bp, Artificial Sequence
  Description of Artificial Sequence: Synthetic oligonucleotide
  Target: SCN9A; (+) strand; PAM type: YTN; PAM sequence: TTT
cattttgcaaagtcattttt

SEQ ID NO: 107987 - DNA, 20 bp, Artificial Sequence
  Description of Artificial Sequence: Synthetic oligonucleotide
  Target: SCN9A; (+) strand; PAM type: YTN; PAM sequence: TTC
attttgcaaagtcatttttg

SEQ ID NO: 107988 - DNA, 20 bp, Artificial Sequence
  Description of Artificial Sequence: Synthetic oligonucleotide
  Target: SCN9A; (+) strand; PAM type: YTN; PAM sequence: TTT
tgcaaagtcatttttgccat

SEQ ID NO: 107989 - DNA, 20 bp, Artificial Sequence
  Description of Artificial Sequence: Synthetic oligonucleotide
  Target: SCN9A; (+) strand; PAM type: YTN; PAM sequence: TTT
gcaaagtcatttttgccatg

SEQ ID NO: 107990 - DNA, 20 bp, Artificial Sequence
  Description of Artificial Sequence: Synthetic oligonucleotide
  Target: SCN9A; (+) strand; PAM type: YTN; PAM sequence: TTG
caaagtcatttttgccatgt

SEQ ID NO: 107991 - DNA, 20 bp, Artificial Sequence
  Description of Artificial Sequence: Synthetic oligonucleotide
  Target: SCN9A; (+) strand; PAM type: YTN; PAM sequence: TTT
ttgccatgttatcaatgtct

SEQ ID NO: 107992 - DNA, 20 bp, Artificial Sequence
  Description of Artificial Sequence: Synthetic oligonucleotide
  Target: SCN9A; (+) strand; PAM type: YTN; PAM sequence: TTT
tgccatgttatcaatgtctg

SEQ ID NO: 107993 - DNA, 20 bp, Artificial Sequence
  Description of Artificial Sequence: Synthetic oligonucleotide
  Target: SCN9A; (+) strand; PAM type: YTN; PAM sequence: TTT
gccatgttatcaatgtctgt

SEQ ID NO: 107994 - DNA, 20 bp, Artificial Sequence
  Description of Artificial Sequence: Synthetic oligonucleotide
  Target: SCN9A; (+) strand; PAM type: YTN; PAM sequence: TTG
ccatgttatcaatgtctgtg

SEQ ID NO: 107995 - DNA, 20 bp, Artificial Sequence
  Description of Artificial Sequence: Synthetic oligonucleotide
  Target: SCN9A; (+) strand; PAM type: YTN; PAM sequence: TTA
tcaatgtctgtgtttaatag

SEQ ID NO: 107996 - DNA, 20 bp, Artificial Sequence
  Description of Artificial Sequence: Synthetic oligonucleotide
  Target: SCN9A; (+) strand; PAM type: YTN; PAM sequence: CTG
tgtttaatagcaaataattt

SEQ ID NO: 107997 - DNA, 20 bp, Artificial Sequence
  Description of Artificial Sequence: Synthetic oligonucleotide
  Target: SCN9A; (+) strand; PAM type: YTN; PAM sequence: TTT
aatagcaaataattttatcc

SEQ ID NO: 107998 - DNA, 20 bp, Artificial Sequence
  Description of Artificial Sequence: Synthetic oligonucleotide
  Target: SCN9A; (+) strand; PAM type: YTN; PAM sequence: TTA
atagcaaataattttatcca

SEQ ID NO: 107999 - DNA, 20 bp, Artificial Sequence
  Description of Artificial Sequence: Synthetic oligonucleotide
  Target: SCN9A; (+) strand; PAM type: YTN; PAM sequence: TTT
tatccatttttaagcacata

SEQ ID NO: 108000 - DNA, 20 bp, Artificial Sequence
  Description of Artificial Sequence: Synthetic oligonucleotide
  Target: SCN9A; (+) strand; PAM type: YTN; PAM sequence: TTT
atccatttttaagcacataa

SEQ ID NO: 108001 - DNA, 20 bp, Artificial Sequence
  Description of Artificial Sequence: Synthetic oligonucleotide
  Target: SCN9A; (+) strand; PAM type: YTN; PAM sequence: TTA
tccatttttaagcacataaa

SEQ ID NO: 108002 - DNA, 20 bp, Artificial Sequence
  Description of Artificial Sequence: Synthetic oligonucleotide
  Target: SCN9A; (+) strand; PAM type: YTN; PAM sequence: TTT
ttaagcacataaaaacaatt

SEQ ID NO: 108003 - DNA, 20 bp, Artificial Sequence
  Description of Artificial Sequence: Synthetic oligonucleotide
  Target: SCN9A; (+) strand; PAM type: YTN; PAM sequence: TTT
taagcacataaaaacaattc

SEQ ID NO: 108004 - DNA, 20 bp, Artificial Sequence
  Description of Artificial Sequence: Synthetic oligonucleotide
  Target: SCN9A; (+) strand; PAM type: YTN; PAM sequence: TTT
aagcacataaaaacaattcc

SEQ ID NO: 108005 - DNA, 20 bp, Artificial Sequence
  Description of Artificial Sequence: Synthetic oligonucleotide
  Target: SCN9A; (+) strand; PAM type: YTN; PAM sequence: TTA
agcacataaaaacaattcca

SEQ ID NO: 108006 - DNA, 20 bp, Artificial Sequence
  Description of Artificial Sequence: Synthetic oligonucleotide
  Target: SCN9A; (+) strand; PAM type: YTN; PAM sequence: TTC
catcagtatccattggttat

SEQ ID NO: 108007 - DNA, 20 bp, Artificial Sequence
  Description of Artificial Sequence: Synthetic oligonucleotide
  Target: SCN9A; (+) strand; PAM type: YTN; PAM sequence: TTG
gttatctttaccatcattta

SEQ ID NO: 108008 - DNA, 20 bp, Artificial Sequence
  Description of Artificial Sequence: Synthetic oligonucleotide
  Target: SCN9A; (+) strand; PAM type: YTN; PAM sequence: TTA
tctttaccatcatttaaaac

SEQ ID NO: 108009 - DNA, 20 bp, Artificial Sequence
  Description of Artificial Sequence: Synthetic oligonucleotide
  Target: SCN9A; (+) strand; PAM type: YTN; PAM sequence: CTT
taccatcatttaaaaccatt

SEQ ID NO: 108010 - DNA, 20 bp, Artificial Sequence
  Description of Artificial Sequence: Synthetic oligonucleotide
  Target: SCN9A; (+) strand; PAM type: YTN; PAM sequence: TTT
accatcatttaaaaccattt

SEQ ID NO: 108011 - DNA, 20 bp, Artificial Sequence
  Description of Artificial Sequence: Synthetic oligonucleotide
  Target: SCN9A; (+) strand; PAM type: YTN; PAM sequence: TTA
ccatcatttaaaaccatttt

SEQ ID NO: 108012 - DNA, 20 bp, Artificial Sequence
  Description of Artificial Sequence: Synthetic oligonucleotide
  Target: SCN9A; (+) strand; PAM type: YTN; PAM sequence: TTT
aaaaccattttatggtctct

SEQ ID NO: 108013 - DNA, 20 bp, Artificial Sequence
  Description of Artificial Sequence: Synthetic oligonucleotide
  Target: SCN9A; (+) strand; PAM type: YTN; PAM sequence: TTA
aaaccattttatggtctctg

SEQ ID NO: 108014 - DNA, 20 bp, Artificial Sequence
  Description of Artificial Sequence: Synthetic oligonucleotide
  Target: SCN9A; (+) strand; PAM type: YTN; PAM sequence: TTT
tatggtctctgaattcttcc

SEQ ID NO: 108015 - DNA, 20 bp, Artificial Sequence
  Description of Artificial Sequence: Synthetic oligonucleotide
  Target: SCN9A; (+) strand; PAM type: YTN; PAM sequence: TTT
atggtctctgaattcttcct

SEQ ID NO: 108016 - DNA, 20 bp, Artificial Sequence
  Description of Artificial Sequence: Synthetic oligonucleotide
  Target: SCN9A; (+) strand; PAM type: YTN; PAM sequence: TTA
tggtctctgaattcttccta

SEQ ID NO: 108017 - DNA, 20 bp, Artificial Sequence
  Description of Artificial Sequence: Synthetic oligonucleotide
  Target: SCN9A; (+) strand; PAM type: YTN; PAM sequence: CTC
tgaattcttcctaagaattt

SEQ ID NO: 108018 - DNA, 20 bp, Artificial Sequence
  Description of Artificial Sequence: Synthetic oligonucleotide
  Target: SCN9A; (+) strand; PAM type: YTN; PAM sequence: CTG
aattcttcctaagaatttca

SEQ ID NO: 108019 - DNA, 20 bp, Artificial Sequence
  Description of Artificial Sequence: Synthetic oligonucleotide
  Target: SCN9A; (+) strand; PAM type: YTN; PAM sequence: TTC
ttcctaagaatttcatgtgc

SEQ ID NO: 108020 - DNA, 20 bp, Artificial Sequence
  Description of Artificial Sequence: Synthetic oligonucleotide
  Target: SCN9A; (+) strand; PAM type: YTN; PAM sequence: CTT
cctaagaatttcatgtgcct

SEQ ID NO: 108021 - DNA, 20 bp, Artificial Sequence
  Description of Artificial Sequence: Synthetic oligonucleotide
  Target: SCN9A; (+) strand; PAM type: YTN; PAM sequence: TTC
ctaagaatttcatgtgccta

SEQ ID NO: 108022 - DNA, 20 bp, Artificial Sequence
  Description of Artificial Sequence: Synthetic oligonucleotide
  Target: SCN9A; (+) strand; PAM type: YTN; PAM sequence: CTA
agaatttcatgtgcctattt

SEQ ID NO: 108023 - DNA, 20 bp, Artificial Sequence
  Description of Artificial Sequence: Synthetic oligonucleotide
  Target: SCN9A; (+) strand; PAM type: YTN; PAM sequence: TTT
catgtgcctatttaaggttg

SEQ ID NO: 108024 - DNA, 20 bp, Artificial Sequence
  Description of Artificial Sequence: Synthetic oligonucleotide
  Target: SCN9A; (+) strand; PAM type: YTN; PAM sequence: TTC
atgtgcctatttaaggttga

SEQ ID NO: 108025 - DNA, 20 bp, Artificial Sequence
  Description of Artificial Sequence: Synthetic oligonucleotide
  Target: SCN9A; (+) strand; PAM type: YTN; PAM sequence: CTA
tttaaggttgaccagattta

SEQ ID NO: 108026 - DNA, 20 bp, Artificial Sequence
  Description of Artificial Sequence: Synthetic oligonucleotide
  Target: SCN9A; (+) strand; PAM type: YTN; PAM sequence: TTT
aaggttgaccagatttatgt

SEQ ID NO: 108027 - DNA, 20 bp, Artificial Sequence
  Description of Artificial Sequence: Synthetic oligonucleotide
  Target: SCN9A; (+) strand; PAM type: YTN; PAM sequence: TTA
aggttgaccagatttatgtt

SEQ ID NO: 108028 - DNA, 20 bp, Artificial Sequence
  Description of Artificial Sequence: Synthetic oligonucleotide
  Target: SCN9A; (+) strand; PAM type: YTN; PAM sequence: TTG
accagatttatgttaatttt

SEQ ID NO: 108029 - DNA, 20 bp, Artificial Sequence
  Description of Artificial Sequence: Synthetic oligonucleotide
  Target: SCN9A; (+) strand; PAM type: YTN; PAM sequence: TTT
atgttaattttatttaagaa

SEQ ID NO: 108030 - DNA, 20 bp, Artificial Sequence
  Description of Artificial Sequence: Synthetic oligonucleotide
  Target: SCN9A; (+) strand; PAM type: YTN; PAM sequence: TTA
tgttaattttatttaagaat

SEQ ID NO: 108031 - DNA, 20 bp, Artificial Sequence
  Description of Artificial Sequence: Synthetic oligonucleotide
  Target: SCN9A; (+) strand; PAM type: YTN; PAM sequence: TTA
attttatttaagaatctgta

SEQ ID NO: 108032 - DNA, 20 bp, Artificial Sequence
  Description of Artificial Sequence: Synthetic oligonucleotide
  Target: SCN9A; (+) strand; PAM type: YTN; PAM sequence: TTT
tatttaagaatctgtacagt

SEQ ID NO: 108033 - DNA, 20 bp, Artificial Sequence
  Description of Artificial Sequence: Synthetic oligonucleotide
  Target: SCN9A; (+) strand; PAM type: YTN; PAM sequence: TTT
atttaagaatctgtacagta

SEQ ID NO: 108034 - DNA, 20 bp, Artificial Sequence
  Description of Artificial Sequence: Synthetic oligonucleotide
  Target: SCN9A; (+) strand; PAM type: YTN; PAM sequence: TTA
tttaagaatctgtacagtaa

SEQ ID NO: 108035 - DNA, 20 bp, Artificial Sequence
  Description of Artificial Sequence: Synthetic oligonucleotide
  Target: SCN9A; (+) strand; PAM type: YTN; PAM sequence: TTT
aagaatctgtacagtaaaag

SEQ ID NO: 108036 - DNA, 20 bp, Artificial Sequence
  Description of Artificial Sequence: Synthetic oligonucleotide
  Target: SCN9A; (+) strand; PAM type: YTN; PAM sequence: TTA
agaatctgtacagtaaaaga

SEQ ID NO: 108037 - DNA, 20 bp, Artificial Sequence
  Description of Artificial Sequence: Synthetic oligonucleotide
  Target: SCN9A; (+) strand; PAM type: YTN; PAM sequence: CTG
tacagtaaaagaagattatt

SEQ ID NO: 108038 - DNA, 20 bp, Artificial Sequence
  Description of Artificial Sequence: Synthetic oligonucleotide
  Target: SCN9A; (+) strand; PAM type: YTN; PAM sequence: TTA
ttacataccttccacagtgt

SEQ ID NO: 108039 - DNA, 20 bp, Artificial Sequence
  Description of Artificial Sequence: Synthetic oligonucleotide
  Target: SCN9A; (+) strand; PAM type: YTN; PAM sequence: TTA
cataccttccacagtgtttg

SEQ ID NO: 108040 - DNA, 20 bp, Artificial Sequence
  Description of Artificial Sequence: Synthetic oligonucleotide
  Target: SCN9A; (+) strand; PAM type: YTN; PAM sequence: CTT
ccacagtgtttgttaatatg

SEQ ID NO: 108041 - DNA, 20 bp, Artificial Sequence
  Description of Artificial Sequence: Synthetic oligonucleotide
  Target: SCN9A; (+) strand; PAM type: YTN; PAM sequence: TTC
cacagtgtttgttaatatgc

SEQ ID NO: 108042 - DNA, 20 bp, Artificial Sequence
  Description of Artificial Sequence: Synthetic oligonucleotide
  Target: SCN9A; (+) strand; PAM type: YTN; PAM sequence: TTT
gttaatatgcttgctctact

SEQ ID NO: 108043 - DNA, 20 bp, Artificial Sequence
  Description of Artificial Sequence: Synthetic oligonucleotide
  Target: SCN9A; (+) strand; PAM type: YTN; PAM sequence: TTG
ttaatatgcttgctctactc

SEQ ID NO: 108044 - DNA, 20 bp, Artificial Sequence
  Description of Artificial Sequence: Synthetic oligonucleotide
  Target: SCN9A; (+) strand; PAM type: YTN; PAM sequence: TTA
atatgcttgctctactcatt

SEQ ID NO: 108045 - DNA, 20 bp, Artificial Sequence
  Description of Artificial Sequence: Synthetic oligonucleotide
  Target: SCN9A; (+) strand; PAM type: YTN; PAM sequence: CTT
gctctactcattgctctctg

SEQ ID NO: 108046 - DNA, 20 bp, Artificial Sequence
  Description of Artificial Sequence: Synthetic oligonucleotide
  Target: SCN9A; (+) strand; PAM type: YTN; PAM sequence: TTG
ctctactcattgctctctgt

SEQ ID NO: 108047 - DNA, 20 bp, Artificial Sequence
  Description of Artificial Sequence: Synthetic oligonucleotide
  Target: SCN9A; (+) strand; PAM type: YTN; PAM sequence: CTC
tactcattgctctctgtctg

SEQ ID NO: 108048 - DNA, 20 bp, Artificial Sequence
  Description of Artificial Sequence: Synthetic oligonucleotide
  Target: SCN9A; (+) strand; PAM type: YTN; PAM sequence: CTA
ctcattgctctctgtctgag

SEQ ID NO: 108049 - DNA, 20 bp, Artificial Sequence
  Description of Artificial Sequence: Synthetic oligonucleotide
  Target: SCN9A; (+) strand; PAM type: YTN; PAM sequence: CTC
attgctctctgtctgaggtt

SEQ ID NO: 108050 - DNA, 20 bp, Artificial Sequence
  Description of Artificial Sequence: Synthetic oligonucleotide
  Target: SCN9A; (+) strand; PAM type: YTN; PAM sequence: TTG
ctctctgtctgaggttggga

SEQ ID NO: 108051 - DNA, 20 bp, Artificial Sequence
  Description of Artificial Sequence: Synthetic oligonucleotide
  Target: SCN9A; (+) strand; PAM type: YTN; PAM sequence: CTC
tctgtctgaggttgggatca

SEQ ID NO: 108052 - DNA, 20 bp, Artificial Sequence
  Description of Artificial Sequence: Synthetic oligonucleotide
  Target: SCN9A; (+) strand; PAM type: YTN; PAM sequence: CTC
tgtctgaggttgggatcatt

SEQ ID NO: 108053 - DNA, 20 bp, Artificial Sequence
  Description of Artificial Sequence: Synthetic oligonucleotide
  Target: SCN9A; (+) strand; PAM type: YTN; PAM sequence: CTG
tctgaggttgggatcattca

SEQ ID NO: 108054 - DNA, 20 bp, Artificial Sequence
  Description of Artificial Sequence: Synthetic oligonucleotide
  Target: SCN9A; (+) strand; PAM type: YTN; PAM sequence: CTG
aggttgggatcattcagcat

SEQ ID NO: 108055 - DNA, 20 bp, Artificial Sequence
  Description of Artificial Sequence: Synthetic oligonucleotide
  Target: SCN9A; (+) strand; PAM type: YTN; PAM sequence: TTG
ggatcattcagcatatcctc

SEQ ID NO: 108056 - DNA, 20 bp, Artificial Sequence
  Description of Artificial Sequence: Synthetic oligonucleotide
  Target: SCN9A; (+) strand; PAM type: YTN; PAM sequence: TTC
agcatatcctctgaaaggag

SEQ ID NO: 108057 - DNA, 20 bp, Artificial Sequence
  Description of Artificial Sequence: Synthetic oligonucleotide
  Target: SCN9A; (+) strand; PAM type: YTN; PAM sequence: CTC
tgaaaggagataggaactac

SEQ ID NO: 108058 - DNA, 20 bp, Artificial Sequence
  Description of Artificial Sequence: Synthetic oligonucleotide
  Target: SCN9A; (+) strand; PAM type: YTN; PAM sequence: CTG
aaaggagataggaactacaa

SEQ ID NO: 108059 - DNA, 20 bp, Artificial Sequence
  Description of Artificial Sequence: Synthetic oligonucleotide
  Target: SCN9A; (+) strand; PAM type: YTN; PAM sequence: CTA
caacgccttttcttgtgtat

SEQ ID NO: 108060 - DNA, 20 bp, Artificial Sequence
  Description of Artificial Sequence: Synthetic oligonucleotide
  Target: SCN9A; (+) strand; PAM type: YTN; PAM sequence: CTT
ttcttgtgtatttgattggt

SEQ ID NO: 108061 - DNA, 20 bp, Artificial Sequence
  Description of Artificial Sequence: Synthetic oligonucleotide
  Target: SCN9A; (+) strand; PAM type: YTN; PAM sequence: TTT
tcttgtgtatttgattggtc

SEQ ID NO: 108062 - DNA, 20 bp, Artificial Sequence
  Description of Artificial Sequence: Synthetic oligonucleotide
  Target: SCN9A; (+) strand; PAM type: YTN; PAM sequence: TTT
cttgtgtatttgattggtcg

SEQ ID NO: 108063 - DNA, 20 bp, Artificial Sequence
  Description of Artificial Sequence: Synthetic oligonucleotide
  Target: SCN9A; (+) strand; PAM type: YTN; PAM sequence: TTC
ttgtgtatttgattggtcgt

SEQ ID NO: 108064 - DNA, 20 bp, Artificial Sequence
  Description of Artificial Sequence: Synthetic oligonucleotide
  Target: SCN9A; (+) strand; PAM type: YTN; PAM sequence: CTT
gtgtatttgattggtcgtgc

SEQ ID NO: 108065 - DNA, 20 bp, Artificial Sequence
  Description of Artificial Sequence: Synthetic oligonucleotide
  Target: SCN9A; (+) strand; PAM type: YTN; PAM sequence: TTG
tgtatttgattggtcgtgcc

SEQ ID NO: 108066 - DNA, 20 bp, Artificial Sequence
  Description of Artificial Sequence: Synthetic oligonucleotide
  Target: SCN9A; (+) strand; PAM type: YTN; PAM sequence: TTT
gattggtcgtgccctaaaaa

SEQ ID NO: 108067 - DNA, 20 bp, Artificial Sequence
  Description of Artificial Sequence: Synthetic oligonucleotide
  Target: SCN9A; (+) strand; PAM type: YTN; PAM sequence: TTG
attggtcgtgccctaaaaaa

SEQ ID NO: 108068 - DNA, 20 bp, Artificial Sequence
  Description of Artificial Sequence: Synthetic oligonucleotide
  Target: SCN9A; (+) strand; PAM type: YTN; PAM sequence: TTG
gtcgtgccctaaaaaaaaaa

SEQ ID NO: 108069 - DNA, 20 bp, Artificial Sequence
  Description of Artificial Sequence: Synthetic oligonucleotide
  Target: SCN9A; (+) strand; PAM type: YTN; PAM sequence: CTA
aaaaaaaaatcaattaatgt

SEQ ID NO: 108070 - DNA, 20 bp, Artificial Sequence
  Description of Artificial Sequence: Synthetic oligonucleotide
  Target: SCN9A; (+) strand; PAM type: YTN; PAM sequence: TTA
atgtcttaagaacagaatcc

SEQ ID NO: 108071 - DNA, 20 bp, Artificial Sequence
  Description of Artificial Sequence: Synthetic oligonucleotide
  Target: SCN9A; (+) strand; PAM type: YTN; PAM sequence: CTT
aagaacagaatcctaataaa

SEQ ID NO: 108072 - DNA, 20 bp, Artificial Sequence
  Description of Artificial Sequence: Synthetic oligonucleotide
  Target: SCN9A; (+) strand; PAM type: YTN; PAM sequence: TTA
agaacagaatcctaataaat

SEQ ID NO: 108073 - DNA, 20 bp, Artificial Sequence
  Description of Artificial Sequence: Synthetic oligonucleotide
  Target: SCN9A; (+) strand; PAM type: YTN; PAM sequence: CTA
ataaattgtaggtataagat

SEQ ID NO: 108074 - DNA, 20 bp, Artificial Sequence
  Description of Artificial Sequence: Synthetic oligonucleotide
  Target: SCN9A; (+) strand; PAM type: YTN; PAM sequence: TTG
taggtataagataaaatctt

SEQ ID NO: 108075 - DNA, 20 bp, Artificial Sequence
  Description of Artificial Sequence: Synthetic oligonucleotide
  Target: SCN9A; (+) strand; PAM type: YTN; PAM sequence: CTT
gcttatatagctgtagtgag

SEQ ID NO: 108076 - DNA, 20 bp, Artificial Sequence
  Description of Artificial Sequence: Synthetic oligonucleotide
  Target: SCN9A; (+) strand; PAM type: YTN; PAM sequence: TTG
cttatatagctgtagtgagt

SEQ ID NO: 108077 - DNA, 20 bp, Artificial Sequence
  Description of Artificial Sequence: Synthetic oligonucleotide
  Target: SCN9A; (+) strand; PAM type: YTN; PAM sequence: CTT
atatagctgtagtgagtaat

SEQ ID NO: 108078 - DNA, 20 bp, Artificial Sequence
  Description of Artificial Sequence: Synthetic oligonucleotide
  Target: SCN9A; (+) strand; PAM type: YTN; PAM sequence: TTA
tatagctgtagtgagtaatt

SEQ ID NO: 108079 - DNA, 20 bp, Artificial Sequence
  Description of Artificial Sequence: Synthetic oligonucleotide
  Target: SCN9A; (+) strand; PAM type: YTN; PAM sequence: CTG
tagtgagtaattaaaagtag

SEQ ID NO: 108080 - DNA, 20 bp, Artificial Sequence
  Description of Artificial Sequence: Synthetic oligonucleotide
  Target: SCN9A; (+) strand; PAM type: YTN; PAM sequence: TTA
aaagtagagcctagattgct

SEQ ID NO: 108081 - DNA, 20 bp, Artificial Sequence
  Description of Artificial Sequence: Synthetic oligonucleotide
  Target: SCN9A; (+) strand; PAM type: YTN; PAM sequence: CTA
gattgctgggttcaaattat

SEQ ID NO: 108082 - DNA, 20 bp, Artificial Sequence
  Description of Artificial Sequence: Synthetic oligonucleotide
  Target: SCN9A; (+) strand; PAM type: YTN; PAM sequence: TTG
ctgggttcaaattatggctc

SEQ ID NO: 108083 - DNA, 20 bp, Artificial Sequence
  Description of Artificial Sequence: Synthetic oligonucleotide
  Target: SCN9A; (+) strand; PAM type: YTN; PAM sequence: CTG
ggttcaaattatggctctgc

SEQ ID NO: 108084 - DNA, 20 bp, Artificial Sequence
  Description of Artificial Sequence: Synthetic oligonucleotide
  Target: SCN9A; (+) strand; PAM type: YTN; PAM sequence: TTC
aaattatggctctgctactt

SEQ ID NO: 108085 - DNA, 20 bp, Artificial Sequence
  Description of Artificial Sequence: Synthetic oligonucleotide
  Target: SCN9A; (+) strand; PAM type: YTN; PAM sequence: TTA
tggctctgctacttactggc

SEQ ID NO: 108086 - DNA, 20 bp, Artificial Sequence
  Description of Artificial Sequence: Synthetic oligonucleotide
  Target: SCN9A; (+) strand; PAM type: YTN; PAM sequence: CTC
tgctacttactggctgtata

SEQ ID NO: 108087 - DNA, 20 bp, Artificial Sequence
  Description of Artificial Sequence: Synthetic oligonucleotide
  Target: SCN9A; (+) strand; PAM type: YTN; PAM sequence: CTG
ctacttactggctgtatatc

SEQ ID NO: 108088 - DNA, 20 bp, Artificial Sequence
  Description of Artificial Sequence: Synthetic oligonucleotide
  Target: SCN9A; (+) strand; PAM type: YTN; PAM sequence: CTA
cttactggctgtatatcata

SEQ ID NO: 108089 - DNA, 20 bp, Artificial Sequence
  Description of Artificial Sequence: Synthetic oligonucleotide
  Target: SCN9A; (+) strand; PAM type: YTN; PAM sequence: CTT
actggctgtatatcatagga

SEQ ID NO: 108090 - DNA, 20 bp, Artificial Sequence
  Description of Artificial Sequence: Synthetic oligonucleotide
  Target: SCN9A; (+) strand; PAM type: YTN; PAM sequence: TTA
ctggctgtatatcataggag

SEQ ID NO: 108091 - DNA, 20 bp, Artificial Sequence
  Description of Artificial Sequence: Synthetic oligonucleotide
  Target: SCN9A; (+) strand; PAM type: YTN; PAM sequence: CTG
gctgtatatcataggagagc

SEQ ID NO: 108092 - DNA, 20 bp, Artificial Sequence
  Description of Artificial Sequence: Synthetic oligonucleotide
  Target: SCN9A; (+) strand; PAM type: YTN; PAM sequence: CTG
tatatcataggagagctact

SEQ ID NO: 108093 - DNA, 20 bp, Artificial Sequence
  Description of Artificial Sequence: Synthetic oligonucleotide
  Target: SCN9A; (+) strand; PAM type: YTN; PAM sequence: CTA
cttaactgtctcagttttat

SEQ ID NO: 108094 - DNA, 20 bp, Artificial Sequence
  Description of Artificial Sequence: Synthetic oligonucleotide
  Target: SCN9A; (+) strand; PAM type: YTN; PAM sequence: CTT
aactgtctcagttttatatt

SEQ ID NO: 108095 - DNA, 20 bp, Artificial Sequence
  Description of Artificial Sequence: Synthetic oligonucleotide
  Target: SCN9A; (+) strand; PAM type: YTN; PAM sequence: TTA
actgtctcagttttatattg

SEQ ID NO: 108096 - DNA, 20 bp, Artificial Sequence
  Description of Artificial Sequence: Synthetic oligonucleotide
  Target: SCN9A; (+) strand; PAM type: YTN; PAM sequence: CTG
tctcagttttatattggtaa

SEQ ID NO: 108097 - DNA, 20 bp, Artificial Sequence
  Description of Artificial Sequence: Synthetic oligonucleotide
  Target: SCN9A; (+) strand; PAM type: YTN; PAM sequence: CTC
agttttatattggtaaaatg

SEQ ID NO: 108098 - DNA, 20 bp, Artificial Sequence
  Description of Artificial Sequence: Synthetic oligonucleotide
  Target: SCN9A; (+) strand; PAM type: YTN; PAM sequence: TTT
tatattggtaaaatggggat

SEQ ID NO: 108099 - DNA, 20 bp, Artificial Sequence
  Description of Artificial Sequence: Synthetic oligonucleotide
  Target: SCN9A; (+) strand; PAM type: YTN; PAM sequence: TTT
atattggtaaaatggggata

SEQ ID NO: 108100 - DNA, 20 bp, Artificial Sequence
  Description of Artificial Sequence: Synthetic oligonucleotide
  Target: SCN9A; (+) strand; PAM type: YTN; PAM sequence: TTA
tattggtaaaatggggataa

SEQ ID NO: 108101 - DNA, 20 bp, Artificial Sequence
  Description of Artificial Sequence: Synthetic oligonucleotide
  Target: SCN9A; (+) strand; PAM type: YTN; PAM sequence: TTG
gtaaaatggggataatcata

SEQ ID NO: 108102 - DNA, 20 bp, Artificial Sequence
  Description of Artificial Sequence: Synthetic oligonucleotide
  Target: SCN9A; (+) strand; PAM type: YTN; PAM sequence: CTT
gcttcatattcttgtgagga

SEQ ID NO: 108103 - DNA, 20 bp, Artificial Sequence
  Description of Artificial Sequence: Synthetic oligonucleotide
  Target: SCN9A; (+) strand; PAM type: YTN; PAM sequence: TTG
cttcatattcttgtgaggat

SEQ ID NO: 108104 - DNA, 20 bp, Artificial Sequence
  Description of Artificial Sequence: Synthetic oligonucleotide
  Target: SCN9A; (+) strand; PAM type: YTN; PAM sequence: CTT
catattcttgtgaggattaa

SEQ ID NO: 108105 - DNA, 20 bp, Artificial Sequence
  Description of Artificial Sequence: Synthetic oligonucleotide
  Target: SCN9A; (+) strand; PAM type: YTN; PAM sequence: TTC
atattcttgtgaggattaaa

SEQ ID NO: 108106 - DNA, 20 bp, Artificial Sequence
  Description of Artificial Sequence: Synthetic oligonucleotide
  Target: SCN9A; (+) strand; PAM type: YTN; PAM sequence: TTC
ttgtgaggattaaaggaatt

SEQ ID NO: 108107 - DNA, 20 bp, Artificial Sequence
  Description of Artificial Sequence: Synthetic oligonucleotide
  Target: SCN9A; (+) strand; PAM type: YTN; PAM sequence: CTT
gtgaggattaaaggaattaa

SEQ ID NO: 108108 - DNA, 20 bp, Artificial Sequence
  Description of Artificial Sequence: Synthetic oligonucleotide
  Target: SCN9A; (+) strand; PAM type: YTN; PAM sequence: TTG
tgaggattaaaggaattaat

SEQ ID NO: 108109 - DNA, 20 bp, Artificial Sequence
  Description of Artificial Sequence: Synthetic oligonucleotide
  Target: SCN9A; (+) strand; PAM type: YTN; PAM sequence: TTA
aaggaattaatatttatgag

SEQ ID NO: 108110 - DNA, 20 bp, Artificial Sequence
  Description of Artificial Sequence: Synthetic oligonucleotide
  Target: SCN9A; (+) strand; PAM type: YTN; PAM sequence: TTA
atatttatgagataaaaaat

SEQ ID NO: 108111 - DNA, 20 bp, Artificial Sequence
  Description of Artificial Sequence: Synthetic oligonucleotide
  Target: SCN9A; (+) strand; PAM type: YTN; PAM sequence: TTT
atgagataaaaaataaagct

SEQ ID NO: 108112 - DNA, 20 bp, Artificial Sequence
  Description of Artificial Sequence: Synthetic oligonucleotide
  Target: SCN9A; (+) strand; PAM type: YTN; PAM sequence: TTA
tgagataaaaaataaagcta

SEQ ID NO: 108113 - DNA, 20 bp, Artificial Sequence
  Description of Artificial Sequence: Synthetic oligonucleotide
  Target: SCN9A; (+) strand; PAM type: YTN; PAM sequence: CTA
gctgcttttttgttatatca

SEQ ID NO: 108114 - DNA, 20 bp, Artificial Sequence
  Description of Artificial Sequence: Synthetic oligonucleotide
  Target: SCN9A; (+) strand; PAM type: YTN; PAM sequence: CTG
cttttttgttatatcatcac

SEQ ID NO: 108115 - DNA, 20 bp, Artificial Sequence
  Description of Artificial Sequence: Synthetic oligonucleotide
  Target: SCN9A; (+) strand; PAM type: YTN; PAM sequence: CTT
ttttgttatatcatcactat

SEQ ID NO: 108116 - DNA, 20 bp, Artificial Sequence
  Description of Artificial Sequence: Synthetic oligonucleotide
  Target: SCN9A; (+) strand; PAM type: YTN; PAM sequence: TTT
tttgttatatcatcactatc

SEQ ID NO: 108117 - DNA, 20 bp, Artificial Sequence
  Description of Artificial Sequence: Synthetic oligonucleotide
  Target: SCN9A; (+) strand; PAM type: YTN; PAM sequence: TTT
ttgttatatcatcactatca

SEQ ID NO: 108118 - DNA, 20 bp, Artificial Sequence
  Description of Artificial Sequence: Synthetic oligonucleotide
  Target: SCN9A; (+) strand; PAM type: YTN; PAM sequence: TTT
tgttatatcatcactatcat

SEQ ID NO: 108119 - DNA, 20 bp, Artificial Sequence
  Description of Artificial Sequence: Synthetic oligonucleotide
  Target: SCN9A; (+) strand; PAM type: YTN; PAM sequence: TTT
gttatatcatcactatcatc

SEQ ID NO: 108120 - DNA, 20 bp, Artificial Sequence
  Description of Artificial Sequence: Synthetic oligonucleotide
  Target: SCN9A; (+) strand; PAM type: YTN; PAM sequence: TTG
ttatatcatcactatcatca

SEQ ID NO: 108121 - DNA, 20 bp, Artificial Sequence
  Description of Artificial Sequence: Synthetic oligonucleotide
  Target: SCN9A; (+) strand; PAM type: YTN; PAM sequence: TTA
tatcatcactatcatcacct

SEQ ID NO: 108122 - DNA, 20 bp, Artificial Sequence
  Description of Artificial Sequence: Synthetic oligonucleotide
  Target: SCN9A; (+) strand; PAM type: YTN; PAM sequence: CTA
tcatcacctctctgcctttc

SEQ ID NO: 108123 - DNA, 20 bp, Artificial Sequence
  Description of Artificial Sequence: Synthetic oligonucleotide
  Target: SCN9A; (+) strand; PAM type: YTN; PAM sequence: CTC
tctgcctttctgagtgttca

SEQ ID NO: 108124 - DNA, 20 bp, Artificial Sequence
  Description of Artificial Sequence: Synthetic oligonucleotide
  Target: SCN9A; (+) strand; PAM type: YTN; PAM sequence: CTC
tgcctttctgagtgttcaat

SEQ ID NO: 108125 - DNA, 20 bp, Artificial Sequence
  Description of Artificial Sequence: Synthetic oligonucleotide
  Target: SCN9A; (+) strand; PAM type: YTN; PAM sequence: CTG
cctttctgagtgttcaattt

SEQ ID NO: 108126 - DNA, 20 bp, Artificial Sequence
  Description of Artificial Sequence: Synthetic oligonucleotide
  Target: SCN9A; (+) strand; PAM type: YTN; PAM sequence: CTT
tctgagtgttcaatttattc

SEQ ID NO: 108127 - DNA, 20 bp, Artificial Sequence
  Description of Artificial Sequence: Synthetic oligonucleotide
  Target: SCN9A; (+) strand; PAM type: YTN; PAM sequence: TTT
ctgagtgttcaatttattca

SEQ ID NO: 108128 - DNA, 20 bp, Artificial Sequence
  Description of Artificial Sequence: Synthetic oligonucleotide
  Target: SCN9A; (+) strand; PAM type: YTN; PAM sequence: TTC
tgagtgttcaatttattcag

SEQ ID NO: 108129 - DNA, 20 bp, Artificial Sequence
  Description of Artificial Sequence: Synthetic oligonucleotide
  Target: SCN9A; (+) strand; PAM type: YTN; PAM sequence: CTG
agtgttcaatttattcagat

SEQ ID NO: 108130 - DNA, 20 bp, Artificial Sequence
  Description of Artificial Sequence: Synthetic oligonucleotide
  Target: SCN9A; (+) strand; PAM type: YTN; PAM sequence: TTC
aatttattcagatagtttgt

SEQ ID NO: 108131 - DNA, 20 bp, Artificial Sequence
  Description of Artificial Sequence: Synthetic oligonucleotide
  Target: SCN9A; (+) strand; PAM type: YTN; PAM sequence: TTT
attcagatagtttgtcatgt

SEQ ID NO: 108132 - DNA, 20 bp, Artificial Sequence
  Description of Artificial Sequence: Synthetic oligonucleotide
  Target: SCN9A; (+) strand; PAM type: YTN; PAM sequence: TTA
ttcagatagtttgtcatgtg

SEQ ID NO: 108133 - DNA, 20 bp, Artificial Sequence
  Description of Artificial Sequence: Synthetic oligonucleotide
  Target: SCN9A; (+) strand; PAM type: YTN; PAM sequence: TTC
agatagtttgtcatgtgaca

SEQ ID NO: 108134 - DNA, 20 bp, Artificial Sequence
  Description of Artificial Sequence: Synthetic oligonucleotide
  Target: SCN9A; (+) strand; PAM type: YTN; PAM sequence: TTT
gtcatgtgacagtcctacat

SEQ ID NO: 108135 - DNA, 20 bp, Artificial Sequence
  Description of Artificial Sequence: Synthetic oligonucleotide
  Target: SCN9A; (+) strand; PAM type: YTN; PAM sequence: TTG
tcatgtgacagtcctacatg

SEQ ID NO: 108136 - DNA, 20 bp, Artificial Sequence
  Description of Artificial Sequence: Synthetic oligonucleotide
  Target: SCN9A; (+) strand; PAM type: YTN; PAM sequence: CTA
catgaaaacagtgaaagtgc

SEQ ID NO: 108137 - DNA, 20 bp, Artificial Sequence
  Description of Artificial Sequence: Synthetic oligonucleotide
  Target: SCN9A; (+) strand; PAM type: YTN; PAM sequence: CTG
tagtgctgtgtatctaaagg

SEQ ID NO: 108138 - DNA, 20 bp, Artificial Sequence
  Description of Artificial Sequence: Synthetic oligonucleotide
  Target: SCN9A; (+) strand; PAM type: YTN; PAM sequence: CTG
tgtatctaaaggggtagaat

SEQ ID NO: 108139 - DNA, 20 bp, Artificial Sequence
  Description of Artificial Sequence: Synthetic oligonucleotide
  Target: SCN9A; (+) strand; PAM type: YTN; PAM sequence: CTA
aaggggtagaatctcagtat

SEQ ID NO: 108140 - DNA, 20 bp, Artificial Sequence
  Description of Artificial Sequence: Synthetic oligonucleotide
  Target: SCN9A; (+) strand; PAM type: YTN; PAM sequence: CTC
agtattctctgataaatttc

SEQ ID NO: 108141 - DNA, 20 bp, Artificial Sequence
  Description of Artificial Sequence: Synthetic oligonucleotide
  Target: SCN9A; (+) strand; PAM type: YTN; PAM sequence: TTC
tctgataaatttctggaatt

SEQ ID NO: 108142 - DNA, 20 bp, Artificial Sequence
  Description of Artificial Sequence: Synthetic oligonucleotide
  Target: SCN9A; (+) strand; PAM type: YTN; PAM sequence: CTC
tgataaatttctggaattac

SEQ ID NO: 108143 - DNA, 20 bp, Artificial Sequence
  Description of Artificial Sequence: Synthetic oligonucleotide
  Target: SCN9A; (+) strand; PAM type: YTN; PAM sequence: CTG
ataaatttctggaattactt

SEQ ID NO: 108144 - DNA, 20 bp, Artificial Sequence
  Description of Artificial Sequence: Synthetic oligonucleotide
  Target: SCN9A; (+) strand; PAM type: YTN; PAM sequence: TTT
ctggaattactttttattga

SEQ ID NO: 108145 - DNA, 20 bp, Artificial Sequence
  Description of Artificial Sequence: Synthetic oligonucleotide
  Target: SCN9A; (+) strand; PAM type: YTN; PAM sequence: TTC
tggaattactttttattgag

SEQ ID NO: 108146 - DNA, 20 bp, Artificial Sequence
  Description of Artificial Sequence: Synthetic oligonucleotide
  Target: SCN9A; (+) strand; PAM type: YTN; PAM sequence: CTG
gaattactttttattgaggg

SEQ ID NO: 108147 - DNA, 20 bp, Artificial Sequence
  Description of Artificial Sequence: Synthetic oligonucleotide
  Target: SCN9A; (+) strand; PAM type: YTN; PAM sequence: TTA
ctttttattgagggaacaac

SEQ ID NO: 108148 - DNA, 20 bp, Artificial Sequence
  Description of Artificial Sequence: Synthetic oligonucleotide
  Target: SCN9A; (+) strand; PAM type: YTN; PAM sequence: CTT
tttattgagggaacaacatt

SEQ ID NO: 108149 - DNA, 20 bp, Artificial Sequence
  Description of Artificial Sequence: Synthetic oligonucleotide
  Target: SCN9A; (+) strand; PAM type: YTN; PAM sequence: TTT
ttattgagggaacaacatta

SEQ ID NO: 108150 - DNA, 20 bp, Artificial Sequence
  Description of Artificial Sequence: Synthetic oligonucleotide
  Target: SCN9A; (+) strand; PAM type: YTN; PAM sequence: TTT
tattgagggaacaacattaa

SEQ ID NO: 108151 - DNA, 20 bp, Artificial Sequence
  Description of Artificial Sequence: Synthetic oligonucleotide
  Target: SCN9A; (+) strand; PAM type: YTN; PAM sequence: TTT
attgagggaacaacattaat

SEQ ID NO: 108152 - DNA, 20 bp, Artificial Sequence
  Description of Artificial Sequence: Synthetic oligonucleotide
  Target: SCN9A; (+) strand; PAM type: YTN; PAM sequence: TTA
ttgagggaacaacattaatg

SEQ ID NO: 108153 - DNA, 20 bp, Artificial Sequence
  Description of Artificial Sequence: Synthetic oligonucleotide
  Target: SCN9A; (+) strand; PAM type: YTN; PAM sequence: TTG
agggaacaacattaatgaag

SEQ ID NO: 108154 - DNA, 20 bp, Artificial Sequence
  Description of Artificial Sequence: Synthetic oligonucleotide
  Target: SCN9A; (+) strand; PAM type: YTN; PAM sequence: TTA
atgaagctcctgtaatggtt

SEQ ID NO: 108155 - DNA, 20 bp, Artificial Sequence
  Description of Artificial Sequence: Synthetic oligonucleotide
  Target: SCN9A; (+) strand; PAM type: YTN; PAM sequence: CTC
ctgtaatggttgtctcttac

SEQ ID NO: 108156 - DNA, 20 bp, Artificial Sequence
  Description of Artificial Sequence: Synthetic oligonucleotide
  Target: SCN9A; (+) strand; PAM type: YTN; PAM sequence: CTG
taatggttgtctcttactgc

SEQ ID NO: 108157 - DNA, 20 bp, Artificial Sequence
  Description of Artificial Sequence: Synthetic oligonucleotide
  Target: SCN9A; (+) strand; PAM type: YTN; PAM sequence: TTG
tctcttactgccaaggaaga

SEQ ID NO: 108158 - DNA, 20 bp, Artificial Sequence
  Description of Artificial Sequence: Synthetic oligonucleotide
  Target: SCN9A; (+) strand; PAM type: YTN; PAM sequence: CTC
ttactgccaaggaagacctc

SEQ ID NO: 108159 - DNA, 20 bp, Artificial Sequence
  Description of Artificial Sequence: Synthetic oligonucleotide
  Target: SCN9A; (+) strand; PAM type: YTN; PAM sequence: CTT
actgccaaggaagacctcat

SEQ ID NO: 108160 - DNA, 20 bp, Artificial Sequence
  Description of Artificial Sequence: Synthetic oligonucleotide
  Target: SCN9A; (+) strand; PAM type: YTN; PAM sequence: TTA
ctgccaaggaagacctcatg

SEQ ID NO: 108161 - DNA, 20 bp, Artificial Sequence
  Description of Artificial Sequence: Synthetic oligonucleotide
  Target: SCN9A; (+) strand; PAM type: YTN; PAM sequence: CTG
ccaaggaagacctcatgaac

SEQ ID NO: 108162 - DNA, 20 bp, Artificial Sequence
  Description of Artificial Sequence: Synthetic oligonucleotide
  Target: SCN9A; (+) strand; PAM type: YTN; PAM sequence: CTC
atgaactgagcagagcatat

SEQ ID NO: 108163 - DNA, 20 bp, Artificial Sequence
  Description of Artificial Sequence: Synthetic oligonucleotide
  Target: SCN9A; (+) strand; PAM type: YTN; PAM sequence: CTG
agcagagcatatgatgataa

SEQ ID NO: 108164 - DNA, 20 bp, Artificial Sequence
  Description of Artificial Sequence: Synthetic oligonucleotide
  Target: SCN9A; (+) strand; PAM type: YTN; PAM sequence: CTC
agtttgaaaggaacaattag

SEQ ID NO: 108165 - DNA, 20 bp, Artificial Sequence
  Description of Artificial Sequence: Synthetic oligonucleotide
  Target: SCN9A; (+) strand; PAM type: YTN; PAM sequence: TTT
gaaaggaacaattagtgaaa

SEQ ID NO: 108166 - DNA, 20 bp, Artificial Sequence
  Description of Artificial Sequence: Synthetic oligonucleotide
  Target: SCN9A; (+) strand; PAM type: YTN; PAM sequence: TTG
aaaggaacaattagtgaaat

SEQ ID NO: 108167 - DNA, 20 bp, Artificial Sequence
  Description of Artificial Sequence: Synthetic oligonucleotide
  Target: SCN9A; (+) strand; PAM type: YTN; PAM sequence: TTA
gtgaaatggagaatgcaagc

SEQ ID NO: 108168 - DNA, 20 bp, Artificial Sequence
  Description of Artificial Sequence: Synthetic oligonucleotide
  Target: SCN9A; (+) strand; PAM type: YTN; PAM sequence: CTA
catctgaaagaggtgacctc

SEQ ID NO: 108169 - DNA, 20 bp, Artificial Sequence
  Description of Artificial Sequence: Synthetic oligonucleotide
  Target: SCN9A; (+) strand; PAM type: YTN; PAM sequence: CTG
aaagaggtgacctctcttca

SEQ ID NO: 108170 - DNA, 20 bp, Artificial Sequence
  Description of Artificial Sequence: Synthetic oligonucleotide
  Target: SCN9A; (+) strand; PAM type: YTN; PAM sequence: CTC
tcttcagctctagaaattgt

SEQ ID NO: 108171 - DNA, 20 bp, Artificial Sequence
  Description of Artificial Sequence: Synthetic oligonucleotide
  Target: SCN9A; (+) strand; PAM type: YTN; PAM sequence: CTC
ttcagctctagaaattgttg

SEQ ID NO: 108172 - DNA, 20 bp, Artificial Sequence
  Description of Artificial Sequence: Synthetic oligonucleotide
  Target: SCN9A; (+) strand; PAM type: YTN; PAM sequence: CTT
cagctctagaaattgttgcc

SEQ ID NO: 108173 - DNA, 20 bp, Artificial Sequence
  Description of Artificial Sequence: Synthetic oligonucleotide
  Target: SCN9A; (+) strand; PAM type: YTN; PAM sequence: TTC
agctctagaaattgttgcca

SEQ ID NO: 108174 - DNA, 20 bp, Artificial Sequence
  Description of Artificial Sequence: Synthetic oligonucleotide
  Target: SCN9A; (+) strand; PAM type: YTN; PAM sequence: CTC
tagaaattgttgccatgcaa

SEQ ID NO: 108175 - DNA, 20 bp, Artificial Sequence
  Description of Artificial Sequence: Synthetic oligonucleotide
  Target: SCN9A; (+) strand; PAM type: YTN; PAM sequence: CTA
gaaattgttgccatgcaaaa

SEQ ID NO: 108176 - DNA, 20 bp, Artificial Sequence
  Description of Artificial Sequence: Synthetic oligonucleotide
  Target: SCN9A; (+) strand; PAM type: YTN; PAM sequence: TTG
ttgccatgcaaaaacatgaa

SEQ ID NO: 108177 - DNA, 20 bp, Artificial Sequence
  Description of Artificial Sequence: Synthetic oligonucleotide
  Target: SCN9A; (+) strand; PAM type: YTN; PAM sequence: TTG
ccatgcaaaaacatgaactc

SEQ ID NO: 108178 - DNA, 20 bp, Artificial Sequence
  Description of Artificial Sequence: Synthetic oligonucleotide
  Target: SCN9A; (+) strand; PAM type: YTN; PAM sequence: CTC
atgcataacaagtgtattta

SEQ ID NO: 108179 - DNA, 20 bp, Artificial Sequence
  Description of Artificial Sequence: Synthetic oligonucleotide
  Target: SCN9A; (+) strand; PAM type: YTN; PAM sequence: TTT
atttttgtgagaaaatgtct

SEQ ID NO: 108180 - DNA, 20 bp, Artificial Sequence
  Description of Artificial Sequence: Synthetic oligonucleotide
  Target: SCN9A; (+) strand; PAM type: YTN; PAM sequence: TTA
tttttgtgagaaaatgtctt

SEQ ID NO: 108181 - DNA, 20 bp, Artificial Sequence
  Description of Artificial Sequence: Synthetic oligonucleotide
  Target: SCN9A; (+) strand; PAM type: YTN; PAM sequence: TTT
ttgtgagaaaatgtcttatt

SEQ ID NO: 108182 - DNA, 20 bp, Artificial Sequence
  Description of Artificial Sequence: Synthetic oligonucleotide
  Target: SCN9A; (+) strand; PAM type: YTN; PAM sequence: TTT
tgtgagaaaatgtcttattt

SEQ ID NO: 108183 - DNA, 20 bp, Artificial Sequence
  Description of Artificial Sequence: Synthetic oligonucleotide
  Target: SCN9A; (+) strand; PAM type: YTN; PAM sequence: TTT
gtgagaaaatgtcttatttt

SEQ ID NO: 108184 - DNA, 20 bp, Artificial Sequence
  Description of Artificial Sequence: Synthetic oligonucleotide
  Target: SCN9A; (+) strand; PAM type: YTN; PAM sequence: TTG
tgagaaaatgtcttattttt

SEQ ID NO: 108185 - DNA, 20 bp, Artificial Sequence
  Description of Artificial Sequence: Synthetic oligonucleotide
  Target: SCN9A; (+) strand; PAM type: YTN; PAM sequence: CTT
atttttaaaacttggaaact

SEQ ID NO: 108186 - DNA, 20 bp, Artificial Sequence
  Description of Artificial Sequence: Synthetic oligonucleotide
  Target: SCN9A; (+) strand; PAM type: YTN; PAM sequence: TTA
tttttaaaacttggaaacta

SEQ ID NO: 108187 - DNA, 20 bp, Artificial Sequence
  Description of Artificial Sequence: Synthetic oligonucleotide
  Target: SCN9A; (+) strand; PAM type: YTN; PAM sequence: TTT
ttaaaacttggaaactaatt

SEQ ID NO: 108188 - DNA, 20 bp, Artificial Sequence
  Description of Artificial Sequence: Synthetic oligonucleotide
  Target: SCN9A; (+) strand; PAM type: YTN; PAM sequence: TTT
taaaacttggaaactaattc

SEQ ID NO: 108189 - DNA, 20 bp, Artificial Sequence
  Description of Artificial Sequence: Synthetic oligonucleotide
  Target: SCN9A; (+) strand; PAM type: YTN; PAM sequence: TTT
aaaacttggaaactaattca

SEQ ID NO: 108190 - DNA, 20 bp, Artificial Sequence
  Description of Artificial Sequence: Synthetic oligonucleotide
  Target: SCN9A; (+) strand; PAM type: YTN; PAM sequence: TTA
aaacttggaaactaattcaa

SEQ ID NO: 108191 - DNA, 20 bp, Artificial Sequence
  Description of Artificial Sequence: Synthetic oligonucleotide
  Target: SCN9A; (+) strand; PAM type: YTN; PAM sequence: CTT
ggaaactaattcaaatttaa

SEQ ID NO: 108192 - DNA, 20 bp, Artificial Sequence
  Description of Artificial Sequence: Synthetic oligonucleotide
  Target: SCN9A; (+) strand; PAM type: YTN; PAM sequence: TTG
gaaactaattcaaatttaaa

SEQ ID NO: 108193 - DNA, 20 bp, Artificial Sequence
  Description of Artificial Sequence: Synthetic oligonucleotide
  Target: SCN9A; (+) strand; PAM type: YTN; PAM sequence: CTA
attcaaatttaaaacactat

SEQ ID NO: 108194 - DNA, 20 bp, Artificial Sequence
  Description of Artificial Sequence: Synthetic oligonucleotide
  Target: SCN9A; (+) strand; PAM type: YTN; PAM sequence: TTC
aaatttaaaacactatgttg

SEQ ID NO: 108195 - DNA, 20 bp, Artificial Sequence
  Description of Artificial Sequence: Synthetic oligonucleotide
  Target: SCN9A; (+) strand; PAM type: YTN; PAM sequence: TTT
aaaacactatgttggttcca

SEQ ID NO: 108196 - DNA, 20 bp, Artificial Sequence
  Description of Artificial Sequence: Synthetic oligonucleotide
  Target: SCN9A; (+) strand; PAM type: YTN; PAM sequence: TTA
aaacactatgttggttccat

SEQ ID NO: 108197 - DNA, 20 bp, Artificial Sequence
  Description of Artificial Sequence: Synthetic oligonucleotide
  Target: SCN9A; (+) strand; PAM type: YTN; PAM sequence: CTA
tgttggttccatgcaggcca

SEQ ID NO: 108198 - DNA, 20 bp, Artificial Sequence
  Description of Artificial Sequence: Synthetic oligonucleotide
  Target: SCN9A; (+) strand; PAM type: YTN; PAM sequence: TTG
gttccatgcaggccagaaat

SEQ ID NO: 108199 - DNA, 20 bp, Artificial Sequence
  Description of Artificial Sequence: Synthetic oligonucleotide
  Target: SCN9A; (+) strand; PAM type: YTN; PAM sequence: TTC
catgcaggccagaaatacac

SEQ ID NO: 108200 - DNA, 20 bp, Artificial Sequence
  Description of Artificial Sequence: Synthetic oligonucleotide
  Target: SCN9A; (+) strand; PAM type: YTN; PAM sequence: CTC
acacacacatatatacacaa

SEQ ID NO: 108201 - DNA, 20 bp, Artificial Sequence
  Description of Artificial Sequence: Synthetic oligonucleotide
  Target: SCN9A; (+) strand; PAM type: YTN; PAM sequence: CTA
tacaactctagatctatcat

SEQ ID NO: 108202 - DNA, 20 bp, Artificial Sequence
  Description of Artificial Sequence: Synthetic oligonucleotide
  Target: SCN9A; (+) strand; PAM type: YTN; PAM sequence: CTC
tagatctatcatgtttgtct

SEQ ID NO: 108203 - DNA, 20 bp, Artificial Sequence
  Description of Artificial Sequence: Synthetic oligonucleotide
  Target: SCN9A; (+) strand; PAM type: YTN; PAM sequence: CTA
gatctatcatgtttgtctgc

SEQ ID NO: 108204 - DNA, 20 bp, Artificial Sequence
  Description of Artificial Sequence: Synthetic oligonucleotide
  Target: SCN9A; (+) strand; PAM type: YTN; PAM sequence: CTA
tcatgtttgtctgcttgtgt

SEQ ID NO: 108205 - DNA, 20 bp, Artificial Sequence
  Description of Artificial Sequence: Synthetic oligonucleotide
  Target: SCN9A; (+) strand; PAM type: YTN; PAM sequence: TTT
gtctgcttgtgtgtggtatg

SEQ ID NO: 108206 - DNA, 20 bp, Artificial Sequence
  Description of Artificial Sequence: Synthetic oligonucleotide
  Target: SCN9A; (+) strand; PAM type: YTN; PAM sequence: TTG
tctgcttgtgtgtggtatgt

SEQ ID NO: 108207 - DNA, 20 bp, Artificial Sequence
  Description of Artificial Sequence: Synthetic oligonucleotide
  Target: SCN9A; (+) strand; PAM type: YTN; PAM sequence: CTG
cttgtgtgtggtatgtggta

SEQ ID NO: 108208 - DNA, 20 bp, Artificial Sequence
  Description of Artificial Sequence: Synthetic oligonucleotide
  Target: SCN9A; (+) strand; PAM type: YTN; PAM sequence: CTT
gtgtgtggtatgtggtatat

SEQ ID NO: 108209 - DNA, 20 bp, Artificial Sequence
  Description of Artificial Sequence: Synthetic oligonucleotide
  Target: SCN9A; (+) strand; PAM type: YTN; PAM sequence: TTG
tgtgtggtatgtggtatata

SEQ ID NO: 108210 - DNA, 20 bp, Artificial Sequence
  Description of Artificial Sequence: Synthetic oligonucleotide
  Target: SCN9A; (+) strand; PAM type: YTN; PAM sequence: TTT
taaatatatatttctagatt

SEQ ID NO: 108211 - DNA, 20 bp, Artificial Sequence
  Description of Artificial Sequence: Synthetic oligonucleotide
  Target: SCN9A; (+) strand; PAM type: YTN; PAM sequence: TTT
aaatatatatttctagattt

SEQ ID NO: 108212 - DNA, 20 bp, Artificial Sequence
  Description of Artificial Sequence: Synthetic oligonucleotide
  Target: SCN9A; (+) strand; PAM type: YTN; PAM sequence: TTA
aatatatatttctagatttg

SEQ ID NO: 108213 - DNA, 20 bp, Artificial Sequence
  Description of Artificial Sequence: Synthetic oligonucleotide
  Target: SCN9A; (+) strand; PAM type: YTN; PAM sequence: TTT
ctagatttgtaaagttgtat

SEQ ID NO: 108214 - DNA, 20 bp, Artificial Sequence
  Description of Artificial Sequence: Synthetic oligonucleotide
  Target: SCN9A; (+) strand; PAM type: YTN; PAM sequence: TTC
tagatttgtaaagttgtata

SEQ ID NO: 108215 - DNA, 20 bp, Artificial Sequence
  Description of Artificial Sequence: Synthetic oligonucleotide
  Target: SCN9A; (+) strand; PAM type: YTN; PAM sequence: CTA
gatttgtaaagttgtatagt

SEQ ID NO: 108216 - DNA, 20 bp, Artificial Sequence
  Description of Artificial Sequence: Synthetic oligonucleotide
  Target: SCN9A; (+) strand; PAM type: YTN; PAM sequence: TTT
gtaaagttgtatagttgtat

SEQ ID NO: 108217 - DNA, 20 bp, Artificial Sequence
  Description of Artificial Sequence: Synthetic oligonucleotide
  Target: SCN9A; (+) strand; PAM type: YTN; PAM sequence: TTG
taaagttgtatagttgtata

SEQ ID NO: 108218 - DNA, 20 bp, Artificial Sequence
  Description of Artificial Sequence: Synthetic oligonucleotide
  Target: SCN9A; (+) strand; PAM type: YTN; PAM sequence: TTG
tatagttgtataggtatagt

SEQ ID NO: 108219 - DNA, 20 bp, Artificial Sequence
  Description of Artificial Sequence: Synthetic oligonucleotide
  Target: SCN9A; (+) strand; PAM type: YTN; PAM sequence: TTG
tataggtatagtcatgcatg

SEQ ID NO: 108220 - DNA, 20 bp, Artificial Sequence
  Description of Artificial Sequence: Synthetic oligonucleotide
  Target: SCN9A; (+) strand; PAM type: YTN; PAM sequence: TTA
tgcatctatgtgtatgtgaa

SEQ ID NO: 108221 - DNA, 20 bp, Artificial Sequence
  Description of Artificial Sequence: Synthetic oligonucleotide
  Target: SCN9A; (+) strand; PAM type: YTN; PAM sequence: CTA
tgtgtatgtgaacagacaca

SEQ ID NO: 108222 - DNA, 20 bp, Artificial Sequence
  Description of Artificial Sequence: Synthetic oligonucleotide
  Target: SCN9A; (+) strand; PAM type: YTN; PAM sequence: TTT
gagagatctctgtaaaaagt

SEQ ID NO: 108223 - DNA, 20 bp, Artificial Sequence
  Description of Artificial Sequence: Synthetic oligonucleotide
  Target: SCN9A; (+) strand; PAM type: YTN; PAM sequence: TTG
agagatctctgtaaaaagtc

SEQ ID NO: 108224 - DNA, 20 bp, Artificial Sequence
  Description of Artificial Sequence: Synthetic oligonucleotide
  Target: SCN9A; (+) strand; PAM type: YTN; PAM sequence: CTC
tgtaaaaagtcaactttttg

SEQ ID NO: 108225 - DNA, 20 bp, Artificial Sequence
  Description of Artificial Sequence: Synthetic oligonucleotide
  Target: SCN9A; (+) strand; PAM type: YTN; PAM sequence: CTG
taaaaagtcaactttttgaa

SEQ ID NO: 108226 - DNA, 20 bp, Artificial Sequence
  Description of Artificial Sequence: Synthetic oligonucleotide
  Target: SCN9A; (+) strand; PAM type: YTN; PAM sequence: CTT
tttgaaaagtctcgaaaacc

SEQ ID NO: 108227 - DNA, 20 bp, Artificial Sequence
  Description of Artificial Sequence: Synthetic oligonucleotide
  Target: SCN9A; (+) strand; PAM type: YTN; PAM sequence: TTT
ttgaaaagtctcgaaaacca

SEQ ID NO: 108228 - DNA, 20 bp, Artificial Sequence
  Description of Artificial Sequence: Synthetic oligonucleotide
  Target: SCN9A; (+) strand; PAM type: YTN; PAM sequence: TTT
tgaaaagtctcgaaaaccag

SEQ ID NO: 108229 - DNA, 20 bp, Artificial Sequence
  Description of Artificial Sequence: Synthetic oligonucleotide
  Target: SCN9A; (+) strand; PAM type: YTN; PAM sequence: TTT
gaaaagtctcgaaaaccagg

SEQ ID NO: 108230 - DNA, 20 bp, Artificial Sequence
  Description of Artificial Sequence: Synthetic oligonucleotide
  Target: SCN9A; (+) strand; PAM type: YTN; PAM sequence: TTG
aaaagtctcgaaaaccaggt

SEQ ID NO: 108231 - DNA, 20 bp, Artificial Sequence
  Description of Artificial Sequence: Synthetic oligonucleotide
  Target: SCN9A; (+) strand; PAM type: YTN; PAM sequence: CTC
gaaaaccaggttttctgtgc

SEQ ID NO: 108232 - DNA, 20 bp, Artificial Sequence
  Description of Artificial Sequence: Synthetic oligonucleotide
  Target: SCN9A; (+) strand; PAM type: YTN; PAM sequence: TTT
tctgtgctatagtctgtcaa

SEQ ID NO: 108233 - DNA, 20 bp, Artificial Sequence
  Description of Artificial Sequence: Synthetic oligonucleotide
  Target: SCN9A; (+) strand; PAM type: YTN; PAM sequence: TTT
ctgtgctatagtctgtcaaa

SEQ ID NO: 108234 - DNA, 20 bp, Artificial Sequence
  Description of Artificial Sequence: Synthetic oligonucleotide
  Target: SCN9A; (+) strand; PAM type: YTN; PAM sequence: TTC
tgtgctatagtctgtcaaac

SEQ ID NO: 108235 - DNA, 20 bp, Artificial Sequence
  Description of Artificial Sequence: Synthetic oligonucleotide
  Target: SCN9A; (+) strand; PAM type: YTN; PAM sequence: CTG
tgctatagtctgtcaaacaa

SEQ ID NO: 108236 - DNA, 20 bp, Artificial Sequence
  Description of Artificial Sequence: Synthetic oligonucleotide
  Target: SCN9A; (+) strand; PAM type: YTN; PAM sequence: CTA
tagtctgtcaaacaagaatt

SEQ ID NO: 108237 - DNA, 20 bp, Artificial Sequence
  Description of Artificial Sequence: Synthetic oligonucleotide
  Target: SCN9A; (+) strand; PAM type: YTN; PAM sequence: CTG
tcaaacaagaatttgtcaga

SEQ ID NO: 108238 - DNA, 20 bp, Artificial Sequence
  Description of Artificial Sequence: Synthetic oligonucleotide
  Target: SCN9A; (+) strand; PAM type: YTN; PAM sequence: TTT
gtcagattaaacaaattatt

SEQ ID NO: 108239 - DNA, 20 bp, Artificial Sequence
  Description of Artificial Sequence: Synthetic oligonucleotide
  Target: SCN9A; (+) strand; PAM type: YTN; PAM sequence: TTG
tcagattaaacaaattattt

SEQ ID NO: 108240 - DNA, 20 bp, Artificial Sequence
  Description of Artificial Sequence: Synthetic oligonucleotide
  Target: SCN9A; (+) strand; PAM type: YTN; PAM sequence: TTA
aacaaattattttccatgta

SEQ ID NO: 108241 - DNA, 20 bp, Artificial Sequence
  Description of Artificial Sequence: Synthetic oligonucleotide
  Target: SCN9A; (+) strand; PAM type: YTN; PAM sequence: TTA
ttttccatgtagacatgttt

SEQ ID NO: 108242 - DNA, 20 bp, Artificial Sequence
  Description of Artificial Sequence: Synthetic oligonucleotide
  Target: SCN9A; (+) strand; PAM type: YTN; PAM sequence: TTT
tccatgtagacatgtttcag

SEQ ID NO: 108243 - DNA, 20 bp, Artificial Sequence
  Description of Artificial Sequence: Synthetic oligonucleotide
  Target: SCN9A; (+) strand; PAM type: YTN; PAM sequence: TTT
ccatgtagacatgtttcagg

SEQ ID NO: 108244 - DNA, 20 bp, Artificial Sequence
  Description of Artificial Sequence: Synthetic oligonucleotide
  Target: SCN9A; (+) strand; PAM type: YTN; PAM sequence: TTC
catgtagacatgtttcaggt

SEQ ID NO: 108245 - DNA, 20 bp, Artificial Sequence
  Description of Artificial Sequence: Synthetic oligonucleotide
  Target: SCN9A; (+) strand; PAM type: YTN; PAM sequence: TTT
caggtatagagatgacgtta

SEQ ID NO: 108246 - DNA, 20 bp, Artificial Sequence
  Description of Artificial Sequence: Synthetic oligonucleotide
  Target: SCN9A; (+) strand; PAM type: YTN; PAM sequence: TTC
aggtatagagatgacgttat

SEQ ID NO: 108247 - DNA, 20 bp, Artificial Sequence
  Description of Artificial Sequence: Synthetic oligonucleotide
  Target: SCN9A; (+) strand; PAM type: YTN; PAM sequence: TTA
ttagttatgcagtgttttca

SEQ ID NO: 108248 - DNA, 20 bp, Artificial Sequence
  Description of Artificial Sequence: Synthetic oligonucleotide
  Target: SCN9A; (+) strand; PAM type: YTN; PAM sequence: TTA
gttatgcagtgttttcatat

SEQ ID NO: 108249 - DNA, 20 bp, Artificial Sequence
  Description of Artificial Sequence: Synthetic oligonucleotide
  Target: SCN9A; (+) strand; PAM type: YTN; PAM sequence: TTA
tgcagtgttttcatataaac

SEQ ID NO: 108250 - DNA, 20 bp, Artificial Sequence
  Description of Artificial Sequence: Synthetic oligonucleotide
  Target: SCN9A; (+) strand; PAM type: YTN; PAM sequence: TTT
tcatataaaccatatattgt

SEQ ID NO: 108251 - DNA, 20 bp, Artificial Sequence
  Description of Artificial Sequence: Synthetic oligonucleotide
  Target: SCN9A; (+) strand; PAM type: YTN; PAM sequence: TTT
catataaaccatatattgtg

SEQ ID NO: 108252 - DNA, 20 bp, Artificial Sequence
  Description of Artificial Sequence: Synthetic oligonucleotide
  Target: SCN9A; (+) strand; PAM type: YTN; PAM sequence: TTC
atataaaccatatattgtgc

SEQ ID NO: 108253 - DNA, 20 bp, Artificial Sequence
  Description of Artificial Sequence: Synthetic oligonucleotide
  Target: SCN9A; (+) strand; PAM type: YTN; PAM sequence: TTG
tgccacaattttatgtttac

SEQ ID NO: 108254 - DNA, 20 bp, Artificial Sequence
  Description of Artificial Sequence: Synthetic oligonucleotide
  Target: SCN9A; (+) strand; PAM type: YTN; PAM sequence: TTT
tatgtttactgtatttccat

SEQ ID NO: 108255 - DNA, 20 bp, Artificial Sequence
  Description of Artificial Sequence: Synthetic oligonucleotide
  Target: SCN9A; (+) strand; PAM type: YTN; PAM sequence: TTT
atgtttactgtatttccatt

SEQ ID NO: 108256 - DNA, 20 bp, Artificial Sequence
  Description of Artificial Sequence: Synthetic oligonucleotide
  Target: SCN9A; (+) strand; PAM type: YTN; PAM sequence: TTA
tgtttactgtatttccattg

SEQ ID NO: 108257 - DNA, 20 bp, Artificial Sequence
  Description of Artificial Sequence: Synthetic oligonucleotide
  Target: SCN9A; (+) strand; PAM type: YTN; PAM sequence: TTT
actgtatttccattgtatct

SEQ ID NO: 108258 - DNA, 20 bp, Artificial Sequence
  Description of Artificial Sequence: Synthetic oligonucleotide
  Target: SCN9A; (+) strand; PAM type: YTN; PAM sequence: TTA
ctgtatttccattgtatctt

SEQ ID NO: 108259 - DNA, 20 bp, Artificial Sequence
  Description of Artificial Sequence: Synthetic oligonucleotide
  Target: SCN9A; (+) strand; PAM type: YTN; PAM sequence: CTG
tatttccattgtatcttata

SEQ ID NO: 108260 - DNA, 20 bp, Artificial Sequence
  Description of Artificial Sequence: Synthetic oligonucleotide
  Target: SCN9A; (+) strand; PAM type: YTN; PAM sequence: TTT
ccattgtatcttataagtat

SEQ ID NO: 108261 - DNA, 20 bp, Artificial Sequence
  Description of Artificial Sequence: Synthetic oligonucleotide
  Target: SCN9A; (+) strand; PAM type: YTN; PAM sequence: TTC
cattgtatcttataagtatc

SEQ ID NO: 108262 - DNA, 20 bp, Artificial Sequence
  Description of Artificial Sequence: Synthetic oligonucleotide
  Target: SCN9A; (+) strand; PAM type: YTN; PAM sequence: TTG
tatcttataagtatccacta

SEQ ID NO: 108263 - DNA, 20 bp, Artificial Sequence
  Description of Artificial Sequence: Synthetic oligonucleotide
  Target: SCN9A; (+) strand; PAM type: YTN; PAM sequence: CTT
ataagtatccactaattcct

SEQ ID NO: 108264 - DNA, 20 bp, Artificial Sequence
  Description of Artificial Sequence: Synthetic oligonucleotide
  Target: SCN9A; (+) strand; PAM type: YTN; PAM sequence: TTA
taagtatccactaattcctc

SEQ ID NO: 108265 - DNA, 20 bp, Artificial Sequence
  Description of Artificial Sequence: Synthetic oligonucleotide
  Target: SCN9A; (+) strand; PAM type: YTN; PAM sequence: CTA
attcctctagttttgtagtt

SEQ ID NO: 108266 - DNA, 20 bp, Artificial Sequence
  Description of Artificial Sequence: Synthetic oligonucleotide
  Target: SCN9A; (+) strand; PAM type: YTN; PAM sequence: TTC
ctctagttttgtagttttca

SEQ ID NO: 108267 - DNA, 20 bp, Artificial Sequence
  Description of Artificial Sequence: Synthetic oligonucleotide
  Target: SCN9A; (+) strand; PAM type: YTN; PAM sequence: CTC
tagttttgtagttttcactt

SEQ ID NO: 108268 - DNA, 20 bp, Artificial Sequence
  Description of Artificial Sequence: Synthetic oligonucleotide
  Target: SCN9A; (+) strand; PAM type: YTN; PAM sequence: CTA
gttttgtagttttcacttta

SEQ ID NO: 108269 - DNA, 20 bp, Artificial Sequence
  Description of Artificial Sequence: Synthetic oligonucleotide
  Target: SCN9A; (+) strand; PAM type: YTN; PAM sequence: TTT
tgtagttttcactttaggat

SEQ ID NO: 108270 - DNA, 20 bp, Artificial Sequence
  Description of Artificial Sequence: Synthetic oligonucleotide
  Target: SCN9A; (+) strand; PAM type: YTN; PAM sequence: TTT
gtagttttcactttaggatt

SEQ ID NO: 108271 - DNA, 20 bp, Artificial Sequence
  Description of Artificial Sequence: Synthetic oligonucleotide
  Target: SCN9A; (+) strand; PAM type: YTN; PAM sequence: TTG
tagttttcactttaggattt

SEQ ID NO: 108272 - DNA, 20 bp, Artificial Sequence
  Description of Artificial Sequence: Synthetic oligonucleotide
  Target: SCN9A; (+) strand; PAM type: YTN; PAM sequence: TTT
tcactttaggatttattgtg

SEQ ID NO: 108273 - DNA, 20 bp, Artificial Sequence
  Description of Artificial Sequence: Synthetic oligonucleotide
  Target: SCN9A; (+) strand; PAM type: YTN; PAM sequence: TTT
cactttaggatttattgtga

SEQ ID NO: 108274 - DNA, 20 bp, Artificial Sequence
  Description of Artificial Sequence: Synthetic oligonucleotide
  Target: SCN9A; (+) strand; PAM type: YTN; PAM sequence: TTC
actttaggatttattgtgat

SEQ ID NO: 108275 - DNA, 20 bp, Artificial Sequence
  Description of Artificial Sequence: Synthetic oligonucleotide
  Target: SCN9A; (+) strand; PAM type: YTN; PAM sequence: CTT
taggatttattgtgatactg

SEQ ID NO: 108276 - DNA, 20 bp, Artificial Sequence
  Description of Artificial Sequence: Synthetic oligonucleotide
  Target: SCN9A; (+) strand; PAM type: YTN; PAM sequence: TTT
aggatttattgtgatactga

SEQ ID NO: 108277 - DNA, 20 bp, Artificial Sequence
  Description of Artificial Sequence: Synthetic oligonucleotide
  Target: SCN9A; (+) strand; PAM type: YTN; PAM sequence: TTA
ggatttattgtgatactgat

SEQ ID NO: 108278 - DNA, 20 bp, Artificial Sequence
  Description of Artificial Sequence: Synthetic oligonucleotide
  Target: SCN9A; (+) strand; PAM type: YTN; PAM sequence: TTT
attgtgatactgatttttct

SEQ ID NO: 108279 - DNA, 20 bp, Artificial Sequence
  Description of Artificial Sequence: Synthetic oligonucleotide
  Target: SCN9A; (+) strand; PAM type: YTN; PAM sequence: TTA
ttgtgatactgatttttcta

SEQ ID NO: 108280 - DNA, 20 bp, Artificial Sequence
  Description of Artificial Sequence: Synthetic oligonucleotide
  Target: SCN9A; (+) strand; PAM type: YTN; PAM sequence: TTG
tgatactgatttttctatgg

SEQ ID NO: 108281 - DNA, 20 bp, Artificial Sequence
  Description of Artificial Sequence: Synthetic oligonucleotide
  Target: SCN9A; (+) strand; PAM type: YTN; PAM sequence: CTG
atttttctatggtgaaaaaa

SEQ ID NO: 108282 - DNA, 20 bp, Artificial Sequence
  Description of Artificial Sequence: Synthetic oligonucleotide
  Target: SCN9A; (+) strand; PAM type: YTN; PAM sequence: TTT
ttctatggtgaaaaaactct

SEQ ID NO: 108283 - DNA, 20 bp, Artificial Sequence
  Description of Artificial Sequence: Synthetic oligonucleotide
  Target: SCN9A; (+) strand; PAM type: YTN; PAM sequence: TTT
tctatggtgaaaaaactctt

SEQ ID NO: 108284 - DNA, 20 bp, Artificial Sequence
  Description of Artificial Sequence: Synthetic oligonucleotide
  Target: SCN9A; (+) strand; PAM type: YTN; PAM sequence: TTT
ctatggtgaaaaaactctta

SEQ ID NO: 108285 - DNA, 20 bp, Artificial Sequence
  Description of Artificial Sequence: Synthetic oligonucleotide
  Target: SCN9A; (+) strand; PAM type: YTN; PAM sequence: TTC
tatggtgaaaaaactcttaa

SEQ ID NO: 108286 - DNA, 20 bp, Artificial Sequence
  Description of Artificial Sequence: Synthetic oligonucleotide
  Target: SCN9A; (+) strand; PAM type: YTN; PAM sequence: CTA
tggtgaaaaaactcttaaat

SEQ ID NO: 108287 - DNA, 20 bp, Artificial Sequence
  Description of Artificial Sequence: Synthetic oligonucleotide
  Target: SCN9A; (+) strand; PAM type: YTN; PAM sequence: CTC
ttaaatgaagaaacttcatt

SEQ ID NO: 108288 - DNA, 20 bp, Artificial Sequence
  Description of Artificial Sequence: Synthetic oligonucleotide
  Target: SCN9A; (+) strand; PAM type: YTN; PAM sequence: CTT
aaatgaagaaacttcattaa

SEQ ID NO: 108289 - DNA, 20 bp, Artificial Sequence
  Description of Artificial Sequence: Synthetic oligonucleotide
  Target: SCN9A; (+) strand; PAM type: YTN; PAM sequence: TTA
aatgaagaaacttcattaaa

SEQ ID NO: 108290 - DNA, 20 bp, Artificial Sequence
  Description of Artificial Sequence: Synthetic oligonucleotide
  Target: SCN9A; (+) strand; PAM type: YTN; PAM sequence: CTT
cattaaaaatatgaaataat

SEQ ID NO: 108291 - DNA, 20 bp, Artificial Sequence
  Description of Artificial Sequence: Synthetic oligonucleotide
  Target: SCN9A; (+) strand; PAM type: YTN; PAM sequence: TTC
attaaaaatatgaaataatc

SEQ ID NO: 108292 - DNA, 20 bp, Artificial Sequence
  Description of Artificial Sequence: Synthetic oligonucleotide
  Target: SCN9A; (+) strand; PAM type: YTN; PAM sequence: TTA
aaaatatgaaataatctcct

SEQ ID NO: 108293 - DNA, 20 bp, Artificial Sequence
  Description of Artificial Sequence: Synthetic oligonucleotide
  Target: SCN9A; (+) strand; PAM type: YTN; PAM sequence: CTC
ctaatctgatataaattata

SEQ ID NO: 108294 - DNA, 20 bp, Artificial Sequence
  Description of Artificial Sequence: Synthetic oligonucleotide
  Target: SCN9A; (+) strand; PAM type: YTN; PAM sequence: CTA
atctgatataaattatatag

SEQ ID NO: 108295 - DNA, 20 bp, Artificial Sequence
  Description of Artificial Sequence: Synthetic oligonucleotide
  Target: SCN9A; (+) strand; PAM type: YTN; PAM sequence: CTG
atataaattatatagtattt

SEQ ID NO: 108296 - DNA, 20 bp, Artificial Sequence
  Description of Artificial Sequence: Synthetic oligonucleotide
  Target: SCN9A; (+) strand; PAM type: YTN; PAM sequence: TTA
tatagtattttacatattac

SEQ ID NO: 108297 - DNA, 20 bp, Artificial Sequence
  Description of Artificial Sequence: Synthetic oligonucleotide
  Target: SCN9A; (+) strand; PAM type: YTN; PAM sequence: TTT
tacatattacacacataatt

SEQ ID NO: 108298 - DNA, 20 bp, Artificial Sequence
  Description of Artificial Sequence: Synthetic oligonucleotide
  Target: SCN9A; (+) strand; PAM type: YTN; PAM sequence: TTT
acatattacacacataattg

SEQ ID NO: 108299 - DNA, 20 bp, Artificial Sequence
  Description of Artificial Sequence: Synthetic oligonucleotide
  Target: SCN9A; (+) strand; PAM type: YTN; PAM sequence: TTA
catattacacacataattgc

SEQ ID NO: 108300 - DNA, 20 bp, Artificial Sequence
  Description of Artificial Sequence: Synthetic oligonucleotide
  Target: SCN9A; (+) strand; PAM type: YTN; PAM sequence: TTA
cacacataattgcaaaacaa

SEQ ID NO: 108301 - DNA, 20 bp, Artificial Sequence
  Description of Artificial Sequence: Synthetic oligonucleotide
  Target: SCN9A; (+) strand; PAM type: YTN; PAM sequence: TTG
caaaacaaaatgcaagcaaa

SEQ ID NO: 108302 - DNA, 20 bp, Artificial Sequence
  Description of Artificial Sequence: Synthetic oligonucleotide
  Target: SCN9A; (+) strand; PAM type: YTN; PAM sequence: TTT
gattccacagaaatttaaca

SEQ ID NO: 108303 - DNA, 20 bp, Artificial Sequence
  Description of Artificial Sequence: Synthetic oligonucleotide
  Target: SCN9A; (+) strand; PAM type: YTN; PAM sequence: TTG
attccacagaaatttaacat

SEQ ID NO: 108304 - DNA, 20 bp, Artificial Sequence
  Description of Artificial Sequence: Synthetic oligonucleotide
  Target: SCN9A; (+) strand; PAM type: YTN; PAM sequence: TTC
cacagaaatttaacatgctc

SEQ ID NO: 108305 - DNA, 20 bp, Artificial Sequence
  Description of Artificial Sequence: Synthetic oligonucleotide
  Target: SCN9A; (+) strand; PAM type: YTN; PAM sequence: TTT
aacatgctcattcaataatg

SEQ ID NO: 108306 - DNA, 20 bp, Artificial Sequence
  Description of Artificial Sequence: Synthetic oligonucleotide
  Target: SCN9A; (+) strand; PAM type: YTN; PAM sequence: TTA
acatgctcattcaataatga

SEQ ID NO: 108307 - DNA, 20 bp, Artificial Sequence
  Description of Artificial Sequence: Synthetic oligonucleotide
  Target: SCN9A; (+) strand; PAM type: YTN; PAM sequence: CTC
attcaataatgaaaaatacc

SEQ ID NO: 108308 - DNA, 20 bp, Artificial Sequence
  Description of Artificial Sequence: Synthetic oligonucleotide
  Target: SCN9A; (+) strand; PAM type: YTN; PAM sequence: TTC
aataatgaaaaataccttgc

SEQ ID NO: 108309 - DNA, 20 bp, Artificial Sequence
  Description of Artificial Sequence: Synthetic oligonucleotide
  Target: SCN9A; (+) strand; PAM type: YTN; PAM sequence: CTT
gcagaagggcttaagctgta

SEQ ID NO: 108310 - DNA, 20 bp, Artificial Sequence
  Description of Artificial Sequence: Synthetic oligonucleotide
  Target: SCN9A; (+) strand; PAM type: YTN; PAM sequence: TTG
cagaagggcttaagctgtat

SEQ ID NO: 108311 - DNA, 20 bp, Artificial Sequence
  Description of Artificial Sequence: Synthetic oligonucleotide
  Target: SCN9A; (+) strand; PAM type: YTN; PAM sequence: CTT
aagctgtatcatgcacacat

SEQ ID NO: 108312 - DNA, 20 bp, Artificial Sequence
  Description of Artificial Sequence: Synthetic oligonucleotide
  Target: SCN9A; (+) strand; PAM type: YTN; PAM sequence: TTA
agctgtatcatgcacacata

SEQ ID NO: 108313 - DNA, 20 bp, Artificial Sequence
  Description of Artificial Sequence: Synthetic oligonucleotide
  Target: SCN9A; (+) strand; PAM type: YTN; PAM sequence: CTG
tatcatgcacacatagaggt

SEQ ID NO: 108314 - DNA, 20 bp, Artificial Sequence
  Description of Artificial Sequence: Synthetic oligonucleotide
  Target: SCN9A; (+) strand; PAM type: YTN; PAM sequence: TTA
cctaaaagcacatgcattta

SEQ ID NO: 108315 - DNA, 20 bp, Artificial Sequence
  Description of Artificial Sequence: Synthetic oligonucleotide
  Target: SCN9A; (+) strand; PAM type: YTN; PAM sequence: CTA
aaagcacatgcatttattca

SEQ ID NO: 108316 - DNA, 20 bp, Artificial Sequence
  Description of Artificial Sequence: Synthetic oligonucleotide
  Target: SCN9A; (+) strand; PAM type: YTN; PAM sequence: TTT
attcaaattgaaatatatgt

SEQ ID NO: 108317 - DNA, 20 bp, Artificial Sequence
  Description of Artificial Sequence: Synthetic oligonucleotide
  Target: SCN9A; (+) strand; PAM type: YTN; PAM sequence: TTA
ttcaaattgaaatatatgtg

SEQ ID NO: 108318 - DNA, 20 bp, Artificial Sequence
  Description of Artificial Sequence: Synthetic oligonucleotide
  Target: SCN9A; (+) strand; PAM type: YTN; PAM sequence: TTC
aaattgaaatatatgtgtgg

SEQ ID NO: 108319 - DNA, 20 bp, Artificial Sequence
  Description of Artificial Sequence: Synthetic oligonucleotide
  Target: SCN9A; (+) strand; PAM type: YTN; PAM sequence: TTG
aaatatatgtgtggccatgg

SEQ ID NO: 108320 - DNA, 20 bp, Artificial Sequence
  Description of Artificial Sequence: Synthetic oligonucleotide
  Target: SCN9A; (+) strand; PAM type: YTN; PAM sequence: TTT
gatggaactttactctcact

SEQ ID NO: 108321 - DNA, 20 bp, Artificial Sequence
  Description of Artificial Sequence: Synthetic oligonucleotide
  Target: SCN9A; (+) strand; PAM type: YTN; PAM sequence: TTG
atggaactttactctcactt

SEQ ID NO: 108322 - DNA, 20 bp, Artificial Sequence
  Description of Artificial Sequence: Synthetic oligonucleotide
  Target: SCN9A; (+) strand; PAM type: YTN; PAM sequence: CTT
tactctcacttgaaatacta

SEQ ID NO: 108323 - DNA, 20 bp, Artificial Sequence
  Description of Artificial Sequence: Synthetic oligonucleotide
  Target: SCN9A; (+) strand; PAM type: YTN; PAM sequence: TTT
actctcacttgaaatactac

SEQ ID NO: 108324 - DNA, 20 bp, Artificial Sequence
  Description of Artificial Sequence: Synthetic oligonucleotide
  Target: SCN9A; (+) strand; PAM type: YTN; PAM sequence: TTA
ctctcacttgaaatactaca

SEQ ID NO: 108325 - DNA, 20 bp, Artificial Sequence
  Description of Artificial Sequence: Synthetic oligonucleotide
  Target: SCN9A; (+) strand; PAM type: YTN; PAM sequence: CTC
tcacttgaaatactacattg

SEQ ID NO: 108326 - DNA, 20 bp, Artificial Sequence
  Description of Artificial Sequence: Synthetic oligonucleotide
  Target: SCN9A; (+) strand; PAM type: YTN; PAM sequence: CTC
acttgaaatactacattgtc

SEQ ID NO: 108327 - DNA, 20 bp, Artificial Sequence
  Description of Artificial Sequence: Synthetic oligonucleotide
  Target: SCN9A; (+) strand; PAM type: YTN; PAM sequence: CTT
gaaatactacattgtctgca

SEQ ID NO: 108328 - DNA, 20 bp, Artificial Sequence
  Description of Artificial Sequence: Synthetic oligonucleotide
  Target: SCN9A; (+) strand; PAM type: YTN; PAM sequence: TTG
aaatactacattgtctgcaa

SEQ ID NO: 108329 - DNA, 20 bp, Artificial Sequence
  Description of Artificial Sequence: Synthetic oligonucleotide
  Target: SCN9A; (+) strand; PAM type: YTN; PAM sequence: CTA
cattgtctgcaaatataaat

SEQ ID NO: 108330 - DNA, 20 bp, Artificial Sequence
  Description of Artificial Sequence: Synthetic oligonucleotide
  Target: SCN9A; (+) strand; PAM type: YTN; PAM sequence: TTG
tctgcaaatataaatatata

SEQ ID NO: 108331 - DNA, 20 bp, Artificial Sequence
  Description of Artificial Sequence: Synthetic oligonucleotide
  Target: SCN9A; (+) strand; PAM type: YTN; PAM sequence: CTG
caaatataaatatataagca

SEQ ID NO: 108332 - DNA, 20 bp, Artificial Sequence
  Description of Artificial Sequence: Synthetic oligonucleotide
  Target: SCN9A; (+) strand; PAM type: YTN; PAM sequence: TTT
gaagcttattgggttagtca

SEQ ID NO: 108333 - DNA, 20 bp, Artificial Sequence
  Description of Artificial Sequence: Synthetic oligonucleotide
  Target: SCN9A; (+) strand; PAM type: YTN; PAM sequence: TTG
aagcttattgggttagtcaa

SEQ ID NO: 108334 - DNA, 20 bp, Artificial Sequence
  Description of Artificial Sequence: Synthetic oligonucleotide
  Target: SCN9A; (+) strand; PAM type: YTN; PAM sequence: CTT
attgggttagtcaaagccct

SEQ ID NO: 108335 - DNA, 20 bp, Artificial Sequence
  Description of Artificial Sequence: Synthetic oligonucleotide
  Target: SCN9A; (+) strand; PAM type: YTN; PAM sequence: TTA
ttgggttagtcaaagccctt

SEQ ID NO: 108336 - DNA, 20 bp, Artificial Sequence
  Description of Artificial Sequence: Synthetic oligonucleotide
  Target: SCN9A; (+) strand; PAM type: YTN; PAM sequence: TTG
ggttagtcaaagcccttgct

SEQ ID NO: 108337 - DNA, 20 bp, Artificial Sequence
  Description of Artificial Sequence: Synthetic oligonucleotide
  Target: SCN9A; (+) strand; PAM type: YTN; PAM sequence: TTA
gtcaaagcccttgctgatat

SEQ ID NO: 108338 - DNA, 20 bp, Artificial Sequence
  Description of Artificial Sequence: Synthetic oligonucleotide
  Target: SCN9A; (+) strand; PAM type: YTN; PAM sequence: CTT
gctgatattggtaatgcagc

SEQ ID NO: 108339 - DNA, 20 bp, Artificial Sequence
  Description of Artificial Sequence: Synthetic oligonucleotide
  Target: SCN9A; (+) strand; PAM type: YTN; PAM sequence: TTG
ctgatattggtaatgcagca

SEQ ID NO: 108340 - DNA, 20 bp, Artificial Sequence
  Description of Artificial Sequence: Synthetic oligonucleotide
  Target: SCN9A; (+) strand; PAM type: YTN; PAM sequence: CTG
atattggtaatgcagcatag

SEQ ID NO: 108341 - DNA, 20 bp, Artificial Sequence
  Description of Artificial Sequence: Synthetic oligonucleotide
  Target: SCN9A; (+) strand; PAM type: YTN; PAM sequence: TTG
gtaatgcagcatagcatagt

SEQ ID NO: 108342 - DNA, 20 bp, Artificial Sequence
  Description of Artificial Sequence: Synthetic oligonucleotide
  Target: SCN9A; (+) strand; PAM type: YTN; PAM sequence: CTA
aagagatatcctggaaactc

SEQ ID NO: 108343 - DNA, 20 bp, Artificial Sequence
  Description of Artificial Sequence: Synthetic oligonucleotide
  Target: SCN9A; (+) strand; PAM type: YTN; PAM sequence: CTG
gaaactccaggaatgagaaa

SEQ ID NO: 108344 - DNA, 20 bp, Artificial Sequence
  Description of Artificial Sequence: Synthetic oligonucleotide
  Target: SCN9A; (+) strand; PAM type: YTN; PAM sequence: CTC
caggaatgagaaagatctca

SEQ ID NO: 108345 - DNA, 20 bp, Artificial Sequence
  Description of Artificial Sequence: Synthetic oligonucleotide
  Target: SCN9A; (+) strand; PAM type: YTN; PAM sequence: CTC
actttcaagcctaatcagac

SEQ ID NO: 108346 - DNA, 20 bp, Artificial Sequence
  Description of Artificial Sequence: Synthetic oligonucleotide
  Target: SCN9A; (+) strand; PAM type: YTN; PAM sequence: CTT
tcaagcctaatcagacacct

SEQ ID NO: 108347 - DNA, 20 bp, Artificial Sequence
  Description of Artificial Sequence: Synthetic oligonucleotide
  Target: SCN9A; (+) strand; PAM type: YTN; PAM sequence: TTT
caagcctaatcagacacctt

SEQ ID NO: 108348 - DNA, 20 bp, Artificial Sequence
  Description of Artificial Sequence: Synthetic oligonucleotide
  Target: SCN9A; (+) strand; PAM type: YTN; PAM sequence: TTC
aagcctaatcagacaccttt

SEQ ID NO: 108349 - DNA, 20 bp, Artificial Sequence
  Description of Artificial Sequence: Synthetic oligonucleotide
  Target: SCN9A; (+) strand; PAM type: YTN; PAM sequence: CTA
atcagacacctttctctaac

SEQ ID NO: 108350 - DNA, 20 bp, Artificial Sequence
  Description of Artificial Sequence: Synthetic oligonucleotide
  Target: SCN9A; (+) strand; PAM type: YTN; PAM sequence: CTT
tctctaaccacttagtgact

SEQ ID NO: 108351 - DNA, 20 bp, Artificial Sequence
  Description of Artificial Sequence: Synthetic oligonucleotide
  Target: SCN9A; (+) strand; PAM type: YTN; PAM sequence: TTT
ctctaaccacttagtgactc

SEQ ID NO: 108352 - DNA, 20 bp, Artificial Sequence
  Description of Artificial Sequence: Synthetic oligonucleotide
  Target: SCN9A; (+) strand; PAM type: YTN; PAM sequence: TTC
tctaaccacttagtgactcg

SEQ ID NO: 108353 - DNA, 20 bp, Artificial Sequence
  Description of Artificial Sequence: Synthetic oligonucleotide
  Target: SCN9A; (+) strand; PAM type: YTN; PAM sequence: CTC
taaccacttagtgactcgta

SEQ ID NO: 108354 - DNA, 20 bp, Artificial Sequence
  Description of Artificial Sequence: Synthetic oligonucleotide
  Target: SCN9A; (+) strand; PAM type: YTN; PAM sequence: CTA
accacttagtgactcgtaga

SEQ ID NO: 108355 - DNA, 20 bp, Artificial Sequence
  Description of Artificial Sequence: Synthetic oligonucleotide
  Target: SCN9A; (+) strand; PAM type: YTN; PAM sequence: CTT
agtgactcgtagacctttgg

SEQ ID NO: 108356 - DNA, 20 bp, Artificial Sequence
  Description of Artificial Sequence: Synthetic oligonucleotide
  Target: SCN9A; (+) strand; PAM type: YTN; PAM sequence: TTA
gtgactcgtagacctttgga

SEQ ID NO: 108357 - DNA, 20 bp, Artificial Sequence
  Description of Artificial Sequence: Synthetic oligonucleotide
  Target: SCN9A; (+) strand; PAM type: YTN; PAM sequence: CTC
gtagacctttggaactgctg

SEQ ID NO: 108358 - DNA, 20 bp, Artificial Sequence
  Description of Artificial Sequence: Synthetic oligonucleotide
  Target: SCN9A; (+) strand; PAM type: YTN; PAM sequence: CTT
tggaactgctgtaaaatgat

SEQ ID NO: 108359 - DNA, 20 bp, Artificial Sequence
  Description of Artificial Sequence: Synthetic oligonucleotide
  Target: SCN9A; (+) strand; PAM type: YTN; PAM sequence: TTT
ggaactgctgtaaaatgatt

SEQ ID NO: 108360 - DNA, 20 bp, Artificial Sequence
  Description of Artificial Sequence: Synthetic oligonucleotide
  Target: SCN9A; (+) strand; PAM type: YTN; PAM sequence: TTG
gaactgctgtaaaatgattg

SEQ ID NO: 108361 - DNA, 20 bp, Artificial Sequence
  Description of Artificial Sequence: Synthetic oligonucleotide
  Target: SCN9A; (+) strand; PAM type: YTN; PAM sequence: CTG
ctgtaaaatgattgttttgc

SEQ ID NO: 108362 - DNA, 20 bp, Artificial Sequence
  Description of Artificial Sequence: Synthetic oligonucleotide
  Target: SCN9A; (+) strand; PAM type: YTN; PAM sequence: CTG
taaaatgattgttttgcttt

SEQ ID NO: 108363 - DNA, 20 bp, Artificial Sequence
  Description of Artificial Sequence: Synthetic oligonucleotide
  Target: SCN9A; (+) strand; PAM type: YTN; PAM sequence: TTG
ttttgcttttatgtttgttt

SEQ ID NO: 108364 - DNA, 20 bp, Artificial Sequence
  Description of Artificial Sequence: Synthetic oligonucleotide
  Target: SCN9A; (+) strand; PAM type: YTN; PAM sequence: TTT
tgcttttatgtttgtttgtg

SEQ ID NO: 108365 - DNA, 20 bp, Artificial Sequence
  Description of Artificial Sequence: Synthetic oligonucleotide
  Target: SCN9A; (+) strand; PAM type: YTN; PAM sequence: TTT
gcttttatgtttgtttgtgt

SEQ ID NO: 108366 - DNA, 20 bp, Artificial Sequence
  Description of Artificial Sequence: Synthetic oligonucleotide
  Target: SCN9A; (+) strand; PAM type: YTN; PAM sequence: TTG
cttttatgtttgtttgtgtc

SEQ ID NO: 108367 - DNA, 20 bp, Artificial Sequence
  Description of Artificial Sequence: Synthetic oligonucleotide
  Target: SCN9A; (+) strand; PAM type: YTN; PAM sequence: CTT
ttatgtttgtttgtgtcaat

SEQ ID NO: 108368 - DNA, 20 bp, Artificial Sequence
  Description of Artificial Sequence: Synthetic oligonucleotide
  Target: SCN9A; (+) strand; PAM type: YTN; PAM sequence: TTT
tatgtttgtttgtgtcaatg

SEQ ID NO: 108369 - DNA, 20 bp, Artificial Sequence
  Description of Artificial Sequence: Synthetic oligonucleotide
  Target: SCN9A; (+) strand; PAM type: YTN; PAM sequence: TTT
atgtttgtttgtgtcaatgc

SEQ ID NO: 108370 - DNA, 20 bp, Artificial Sequence
  Description of Artificial Sequence: Synthetic oligonucleotide
  Target: SCN9A; (+) strand; PAM type: YTN; PAM sequence: TTA
tgtttgtttgtgtcaatgct

SEQ ID NO: 108371 - DNA, 20 bp, Artificial Sequence
  Description of Artificial Sequence: Synthetic oligonucleotide
  Target: SCN9A; (+) strand; PAM type: YTN; PAM sequence: TTT
gtttgtgtcaatgcttgcat

SEQ ID NO: 108372 - DNA, 20 bp, Artificial Sequence
  Description of Artificial Sequence: Synthetic oligonucleotide
  Target: SCN9A; (+) strand; PAM type: YTN; PAM sequence: TTG
tttgtgtcaatgcttgcatt

SEQ ID NO: 108373 - DNA, 20 bp, Artificial Sequence
  Description of Artificial Sequence: Synthetic oligonucleotide
  Target: SCN9A; (+) strand; PAM type: YTN; PAM sequence: TTT
gtgtcaatgcttgcatttca

SEQ ID NO: 108374 - DNA, 20 bp, Artificial Sequence
  Description of Artificial Sequence: Synthetic oligonucleotide
  Target: SCN9A; (+) strand; PAM type: YTN; PAM sequence: TTG
tgtcaatgcttgcatttcag

SEQ ID NO: 108375 - DNA, 20 bp, Artificial Sequence
  Description of Artificial Sequence: Synthetic oligonucleotide
  Target: SCN9A; (+) strand; PAM type: YTN; PAM sequence: CTT
gcatttcagatattttgttt

SEQ ID NO: 108376 - DNA, 20 bp, Artificial Sequence
  Description of Artificial Sequence: Synthetic oligonucleotide
  Target: SCN9A; (+) strand; PAM type: YTN; PAM sequence: TTG
catttcagatattttgtttt

SEQ ID NO: 108377 - DNA, 20 bp, Artificial Sequence
  Description of Artificial Sequence: Synthetic oligonucleotide
  Target: SCN9A; (+) strand; PAM type: YTN; PAM sequence: TTT
cagatattttgttttgattc

SEQ ID NO: 108378 - DNA, 20 bp, Artificial Sequence
  Description of Artificial Sequence: Synthetic oligonucleotide
  Target: SCN9A; (+) strand; PAM type: YTN; PAM sequence: TTC
agatattttgttttgattca

SEQ ID NO: 108379 - DNA, 20 bp, Artificial Sequence
  Description of Artificial Sequence: Synthetic oligonucleotide
  Target: SCN9A; (+) strand; PAM type: YTN; PAM sequence: TTT
tgttttgattcatagactcc

SEQ ID NO: 108380 - DNA, 20 bp, Artificial Sequence
  Description of Artificial Sequence: Synthetic oligonucleotide
  Target: SCN9A; (+) strand; PAM type: YTN; PAM sequence: TTT
gttttgattcatagactcca

SEQ ID NO: 108381 - DNA, 20 bp, Artificial Sequence
  Description of Artificial Sequence: Synthetic oligonucleotide
  Target: SCN9A; (+) strand; PAM type: YTN; PAM sequence: TTG
ttttgattcatagactccag

SEQ ID NO: 108382 - DNA, 20 bp, Artificial Sequence
  Description of Artificial Sequence: Synthetic oligonucleotide
  Target: SCN9A; (+) strand; PAM type: YTN; PAM sequence: TTT
tgattcatagactccagatg

SEQ ID NO: 108383 - DNA, 20 bp, Artificial Sequence
  Description of Artificial Sequence: Synthetic oligonucleotide
  Target: SCN9A; (+) strand; PAM type: YTN; PAM sequence: TTT
gattcatagactccagatga

SEQ ID NO: 108384 - DNA, 20 bp, Artificial Sequence
  Description of Artificial Sequence: Synthetic oligonucleotide
  Target: SCN9A; (+) strand; PAM type: YTN; PAM sequence: TTG
attcatagactccagatgaa

SEQ ID NO: 108385 - DNA, 20 bp, Artificial Sequence
  Description of Artificial Sequence: Synthetic oligonucleotide
  Target: SCN9A; (+) strand; PAM type: YTN; PAM sequence: TTC
atagactccagatgaaatat

SEQ ID NO: 108386 - DNA, 20 bp, Artificial Sequence
  Description of Artificial Sequence: Synthetic oligonucleotide
  Target: SCN9A; (+) strand; PAM type: YTN; PAM sequence: CTC
cagatgaaatattttttaaa

SEQ ID NO: 108387 - DNA, 20 bp, Artificial Sequence
  Description of Artificial Sequence: Synthetic oligonucleotide
  Target: SCN9A; (+) strand; PAM type: YTN; PAM sequence: TTT
tttaaaaatgaaaacagtta

SEQ ID NO: 108388 - DNA, 20 bp, Artificial Sequence
  Description of Artificial Sequence: Synthetic oligonucleotide
  Target: SCN9A; (+) strand; PAM type: YTN; PAM sequence: TTT
ttaaaaatgaaaacagttat

SEQ ID NO: 108389 - DNA, 20 bp, Artificial Sequence
  Description of Artificial Sequence: Synthetic oligonucleotide
  Target: SCN9A; (+) strand; PAM type: YTN; PAM sequence: TTT
taaaaatgaaaacagttatg

SEQ ID NO: 108390 - DNA, 20 bp, Artificial Sequence
  Description of Artificial Sequence: Synthetic oligonucleotide
  Target: SCN9A; (+) strand; PAM type: YTN; PAM sequence: TTT
aaaaatgaaaacagttatgt

SEQ ID NO: 108391 - DNA, 20 bp, Artificial Sequence
  Description of Artificial Sequence: Synthetic oligonucleotide
  Target: SCN9A; (+) strand; PAM type: YTN; PAM sequence: TTA
aaaatgaaaacagttatgtt

SEQ ID NO: 108392 - DNA, 20 bp, Artificial Sequence
  Description of Artificial Sequence: Synthetic oligonucleotide
  Target: SCN9A; (+) strand; PAM type: YTN; PAM sequence: TTA
tgtttcatttatatggagga

SEQ ID NO: 108393 - DNA, 20 bp, Artificial Sequence
  Description of Artificial Sequence: Synthetic oligonucleotide
  Target: SCN9A; (+) strand; PAM type: YTN; PAM sequence: TTT
catttatatggaggacctaa

SEQ ID NO: 108394 - DNA, 20 bp, Artificial Sequence
  Description of Artificial Sequence: Synthetic oligonucleotide
  Target: SCN9A; (+) strand; PAM type: YTN; PAM sequence: TTC
atttatatggaggacctaat

SEQ ID NO: 108395 - DNA, 20 bp, Artificial Sequence
  Description of Artificial Sequence: Synthetic oligonucleotide
  Target: SCN9A; (+) strand; PAM type: YTN; PAM sequence: TTT
atatggaggacctaatacat

SEQ ID NO: 108396 - DNA, 20 bp, Artificial Sequence
  Description of Artificial Sequence: Synthetic oligonucleotide
  Target: SCN9A; (+) strand; PAM type: YTN; PAM sequence: TTA
tatggaggacctaatacata

SEQ ID NO: 108397 - DNA, 20 bp, Artificial Sequence
  Description of Artificial Sequence: Synthetic oligonucleotide
  Target: SCN9A; (+) strand; PAM type: YTN; PAM sequence: CTA
atacatagccattctaaatt

SEQ ID NO: 108398 - DNA, 20 bp, Artificial Sequence
  Description of Artificial Sequence: Synthetic oligonucleotide
  Target: SCN9A; (+) strand; PAM type: YTN; PAM sequence: TTC
taaattttttcaagataaga

SEQ ID NO: 108399 - DNA, 20 bp, Artificial Sequence
  Description of Artificial Sequence: Synthetic oligonucleotide
  Target: SCN9A; (+) strand; PAM type: YTN; PAM sequence: CTA
aattttttcaagataagaag

SEQ ID NO: 108400 - DNA, 20 bp, Artificial Sequence
  Description of Artificial Sequence: Synthetic oligonucleotide
  Target: SCN9A; (+) strand; PAM type: YTN; PAM sequence: TTT
tttcaagataagaagcctac

SEQ ID NO: 108401 - DNA, 20 bp, Artificial Sequence
  Description of Artificial Sequence: Synthetic oligonucleotide
  Target: SCN9A; (+) strand; PAM type: YTN; PAM sequence: TTT
ttcaagataagaagcctact

SEQ ID NO: 108402 - DNA, 20 bp, Artificial Sequence
  Description of Artificial Sequence: Synthetic oligonucleotide
  Target: SCN9A; (+) strand; PAM type: YTN; PAM sequence: TTT
tcaagataagaagcctactg

SEQ ID NO: 108403 - DNA, 20 bp, Artificial Sequence
  Description of Artificial Sequence: Synthetic oligonucleotide
  Target: SCN9A; (+) strand; PAM type: YTN; PAM sequence: TTT
caagataagaagcctactgc

SEQ ID NO: 108404 - DNA, 20 bp, Artificial Sequence
  Description of Artificial Sequence: Synthetic oligonucleotide
  Target: SCN9A; (+) strand; PAM type: YTN; PAM sequence: TTC
aagataagaagcctactgca

SEQ ID NO: 108405 - DNA, 20 bp, Artificial Sequence
  Description of Artificial Sequence: Synthetic oligonucleotide
  Target: SCN9A; (+) strand; PAM type: YTN; PAM sequence: CTA
ctgcacattggagagatagc

SEQ ID NO: 108406 - DNA, 20 bp, Artificial Sequence
  Description of Artificial Sequence: Synthetic oligonucleotide
  Target: SCN9A; (+) strand; PAM type: YTN; PAM sequence: CTG
cacattggagagatagcaga

SEQ ID NO: 108407 - DNA, 20 bp, Artificial Sequence
  Description of Artificial Sequence: Synthetic oligonucleotide
  Target: SCN9A; (+) strand; PAM type: YTN; PAM sequence: TTG
gagagatagcagagtgagtg

SEQ ID NO: 108408 - DNA, 20 bp, Artificial Sequence
  Description of Artificial Sequence: Synthetic oligonucleotide
  Target: SCN9A; (+) strand; PAM type: YTN; PAM sequence: TTA
agagcacaagatctgaaaca

SEQ ID NO: 108409 - DNA, 20 bp, Artificial Sequence
  Description of Artificial Sequence: Synthetic oligonucleotide
  Target: SCN9A; (+) strand; PAM type: YTN; PAM sequence: CTG
aaacagacagcctccgtttc

SEQ ID NO: 108410 - DNA, 20 bp, Artificial Sequence
  Description of Artificial Sequence: Synthetic oligonucleotide
  Target: SCN9A; (+) strand; PAM type: YTN; PAM sequence: CTC
cgtttcaacttaggagctac

SEQ ID NO: 108411 - DNA, 20 bp, Artificial Sequence
  Description of Artificial Sequence: Synthetic oligonucleotide
  Target: SCN9A; (+) strand; PAM type: YTN; PAM sequence: TTT
caacttaggagctaccattt

SEQ ID NO: 108412 - DNA, 20 bp, Artificial Sequence
  Description of Artificial Sequence: Synthetic oligonucleotide
  Target: SCN9A; (+) strand; PAM type: YTN; PAM sequence: TTC
aacttaggagctaccattta

SEQ ID NO: 108413 - DNA, 20 bp, Artificial Sequence
  Description of Artificial Sequence: Synthetic oligonucleotide
  Target: SCN9A; (+) strand; PAM type: YTN; PAM sequence: CTT
aggagctaccatttattagc

SEQ ID NO: 108414 - DNA, 20 bp, Artificial Sequence
  Description of Artificial Sequence: Synthetic oligonucleotide
  Target: SCN9A; (+) strand; PAM type: YTN; PAM sequence: TTA
ggagctaccatttattagct

SEQ ID NO: 108415 - DNA, 20 bp, Artificial Sequence
  Description of Artificial Sequence: Synthetic oligonucleotide
  Target: SCN9A; (+) strand; PAM type: YTN; PAM sequence: CTA
ccatttattagctgagtaaa

SEQ ID NO: 108416 - DNA, 20 bp, Artificial Sequence
  Description of Artificial Sequence: Synthetic oligonucleotide
  Target: SCN9A; (+) strand; PAM type: YTN; PAM sequence: TTT
attagctgagtaaattgggg

SEQ ID NO: 108417 - DNA, 20 bp, Artificial Sequence
  Description of Artificial Sequence: Synthetic oligonucleotide
  Target: SCN9A; (+) strand; PAM type: YTN; PAM sequence: TTA
ttagctgagtaaattggggc

SEQ ID NO: 108418 - DNA, 20 bp, Artificial Sequence
  Description of Artificial Sequence: Synthetic oligonucleotide
  Target: SCN9A; (+) strand; PAM type: YTN; PAM sequence: TTA
gctgagtaaattggggcaag

SEQ ID NO: 108419 - DNA, 20 bp, Artificial Sequence
  Description of Artificial Sequence: Synthetic oligonucleotide
  Target: SCN9A; (+) strand; PAM type: YTN; PAM sequence: CTG
agtaaattggggcaagttgc

SEQ ID NO: 108420 - DNA, 20 bp, Artificial Sequence
  Description of Artificial Sequence: Synthetic oligonucleotide
  Target: SCN9A; (+) strand; PAM type: YTN; PAM sequence: TTG
gggcaagttgcttcatttcc

SEQ ID NO: 108421 - DNA, 20 bp, Artificial Sequence
  Description of Artificial Sequence: Synthetic oligonucleotide
  Target: SCN9A; (+) strand; PAM type: YTN; PAM sequence: TTG
cttcatttccccatgcctca

SEQ ID NO: 108422 - DNA, 20 bp, Artificial Sequence
  Description of Artificial Sequence: Synthetic oligonucleotide
  Target: SCN9A; (+) strand; PAM type: YTN; PAM sequence: CTT
catttccccatgcctcaatt

SEQ ID NO: 108423 - DNA, 20 bp, Artificial Sequence
  Description of Artificial Sequence: Synthetic oligonucleotide
  Target: SCN9A; (+) strand; PAM type: YTN; PAM sequence: TTC
atttccccatgcctcaattt

SEQ ID NO: 108424 - DNA, 20 bp, Artificial Sequence
  Description of Artificial Sequence: Synthetic oligonucleotide
  Target: SCN9A; (+) strand; PAM type: YTN; PAM sequence: TTT
ccccatgcctcaattttccc

SEQ ID NO: 108425 - DNA, 20 bp, Artificial Sequence
  Description of Artificial Sequence: Synthetic oligonucleotide
  Target: SCN9A; (+) strand; PAM type: YTN; PAM sequence: TTC
cccatgcctcaattttccca

SEQ ID NO: 108426 - DNA, 20 bp, Artificial Sequence
  Description of Artificial Sequence: Synthetic oligonucleotide
  Target: SCN9A; (+) strand; PAM type: YTN; PAM sequence: CTC
aattttcccatttgtaaaac

SEQ ID NO: 108427 - DNA, 20 bp, Artificial Sequence
  Description of Artificial Sequence: Synthetic oligonucleotide
  Target: SCN9A; (+) strand; PAM type: YTN; PAM sequence: TTT
tcccatttgtaaaacagaga

SEQ ID NO: 108428 - DNA, 20 bp, Artificial Sequence
  Description of Artificial Sequence: Synthetic oligonucleotide
  Target: SCN9A; (+) strand; PAM type: YTN; PAM sequence: TTT
cccatttgtaaaacagagat

SEQ ID NO: 108429 - DNA, 20 bp, Artificial Sequence
  Description of Artificial Sequence: Synthetic oligonucleotide
  Target: SCN9A; (+) strand; PAM type: YTN; PAM sequence: TTC
ccatttgtaaaacagagata

SEQ ID NO: 108430 - DNA, 20 bp, Artificial Sequence
  Description of Artificial Sequence: Synthetic oligonucleotide
  Target: SCN9A; (+) strand; PAM type: YTN; PAM sequence: TTT
gtaaaacagagataataatg

SEQ ID NO: 108431 - DNA, 20 bp, Artificial Sequence
  Description of Artificial Sequence: Synthetic oligonucleotide
  Target: SCN9A; (+) strand; PAM type: YTN; PAM sequence: TTG
taaaacagagataataatgt

SEQ ID NO: 108432 - DNA, 20 bp, Artificial Sequence
  Description of Artificial Sequence: Synthetic oligonucleotide
  Target: SCN9A; (+) strand; PAM type: YTN; PAM sequence: CTC
atggggttgtcataaatact

SEQ ID NO: 108433 - DNA, 20 bp, Artificial Sequence
  Description of Artificial Sequence: Synthetic oligonucleotide
  Target: SCN9A; (+) strand; PAM type: YTN; PAM sequence: TTG
tcataaatactaaatatgtg

SEQ ID NO: 108434 - DNA, 20 bp, Artificial Sequence
  Description of Artificial Sequence: Synthetic oligonucleotide
  Target: SCN9A; (+) strand; PAM type: YTN; PAM sequence: CTA
aatatgtgtttgctgttatt

SEQ ID NO: 108435 - DNA, 20 bp, Artificial Sequence
  Description of Artificial Sequence: Synthetic oligonucleotide
  Target: SCN9A; (+) strand; PAM type: YTN; PAM sequence: TTT
gctgttattaacaactcaaa

SEQ ID NO: 108436 - DNA, 20 bp, Artificial Sequence
  Description of Artificial Sequence: Synthetic oligonucleotide
  Target: SCN9A; (+) strand; PAM type: YTN; PAM sequence: TTG
ctgttattaacaactcaaat

SEQ ID NO: 108437 - DNA, 20 bp, Artificial Sequence
  Description of Artificial Sequence: Synthetic oligonucleotide
  Target: SCN9A; (+) strand; PAM type: YTN; PAM sequence: CTG
ttattaacaactcaaataag

SEQ ID NO: 108438 - DNA, 20 bp, Artificial Sequence
  Description of Artificial Sequence: Synthetic oligonucleotide
  Target: SCN9A; (+) strand; PAM type: YTN; PAM sequence: TTA
ttaacaactcaaataagatt

SEQ ID NO: 108439 - DNA, 20 bp, Artificial Sequence
  Description of Artificial Sequence: Synthetic oligonucleotide
  Target: SCN9A; (+) strand; PAM type: YTN; PAM sequence: TTA
acaactcaaataagattcct

SEQ ID NO: 108440 - DNA, 20 bp, Artificial Sequence
  Description of Artificial Sequence: Synthetic oligonucleotide
  Target: SCN9A; (+) strand; PAM type: YTN; PAM sequence: CTC
aaataagattccttggaata

SEQ ID NO: 108441 - DNA, 20 bp, Artificial Sequence
  Description of Artificial Sequence: Synthetic oligonucleotide
  Target: SCN9A; (+) strand; PAM type: YTN; PAM sequence: TTC
cttggaataggtacatatta

SEQ ID NO: 108442 - DNA, 20 bp, Artificial Sequence
  Description of Artificial Sequence: Synthetic oligonucleotide
  Target: SCN9A; (+) strand; PAM type: YTN; PAM sequence: CTT
ggaataggtacatattaagc

SEQ ID NO: 108443 - DNA, 20 bp, Artificial Sequence
  Description of Artificial Sequence: Synthetic oligonucleotide
  Target: SCN9A; (+) strand; PAM type: YTN; PAM sequence: TTG
gaataggtacatattaagct

SEQ ID NO: 108444 - DNA, 20 bp, Artificial Sequence
  Description of Artificial Sequence: Synthetic oligonucleotide
  Target: SCN9A; (+) strand; PAM type: YTN; PAM sequence: TTA
agctgtgacctgaaaaagat

SEQ ID NO: 108445 - DNA, 20 bp, Artificial Sequence
  Description of Artificial Sequence: Synthetic oligonucleotide
  Target: SCN9A; (+) strand; PAM type: YTN; PAM sequence: CTG
tgacctgaaaaagatagcag

SEQ ID NO: 108446 - DNA, 20 bp, Artificial Sequence
  Description of Artificial Sequence: Synthetic oligonucleotide
  Target: SCN9A; (+) strand; PAM type: YTN; PAM sequence: CTG
aaaaagatagcagtagctgg

SEQ ID NO: 108447 - DNA, 20 bp, Artificial Sequence
  Description of Artificial Sequence: Synthetic oligonucleotide
  Target: SCN9A; (+) strand; PAM type: YTN; PAM sequence: CTG
gcaagtaatccaaatttctt

SEQ ID NO: 108448 - DNA, 20 bp, Artificial Sequence
  Description of Artificial Sequence: Synthetic oligonucleotide
  Target: SCN9A; (+) strand; PAM type: YTN; PAM sequence: TTT
cttcatagaaatgggatcta

SEQ ID NO: 108449 - DNA, 20 bp, Artificial Sequence
  Description of Artificial Sequence: Synthetic oligonucleotide
  Target: SCN9A; (+) strand; PAM type: YTN; PAM sequence: TTC
ttcatagaaatgggatctat

SEQ ID NO: 108450 - DNA, 20 bp, Artificial Sequence
  Description of Artificial Sequence: Synthetic oligonucleotide
  Target: SCN9A; (+) strand; PAM type: YTN; PAM sequence: CTT
catagaaatgggatctatta

SEQ ID NO: 108451 - DNA, 20 bp, Artificial Sequence
  Description of Artificial Sequence: Synthetic oligonucleotide
  Target: SCN9A; (+) strand; PAM type: YTN; PAM sequence: TTC
atagaaatgggatctattat

SEQ ID NO: 108452 - DNA, 20 bp, Artificial Sequence
  Description of Artificial Sequence: Synthetic oligonucleotide
  Target: SCN9A; (+) strand; PAM type: YTN; PAM sequence: CTA
ttattaactaatatcagcat

SEQ ID NO: 108453 - DNA, 20 bp, Artificial Sequence
  Description of Artificial Sequence: Synthetic oligonucleotide
  Target: SCN9A; (+) strand; PAM type: YTN; PAM sequence: TTA
ttaactaatatcagcattat

SEQ ID NO: 108454 - DNA, 20 bp, Artificial Sequence
  Description of Artificial Sequence: Synthetic oligonucleotide
  Target: SCN9A; (+) strand; PAM type: YTN; PAM sequence: TTA
actaatatcagcattatcct

SEQ ID NO: 108455 - DNA, 20 bp, Artificial Sequence
  Description of Artificial Sequence: Synthetic oligonucleotide
  Target: SCN9A; (+) strand; PAM type: YTN; PAM sequence: CTA
atatcagcattatccttgca

SEQ ID NO: 108456 - DNA, 20 bp, Artificial Sequence
  Description of Artificial Sequence: Synthetic oligonucleotide
  Target: SCN9A; (+) strand; PAM type: YTN; PAM sequence: TTA
tccttgcattttctgtactg

SEQ ID NO: 108457 - DNA, 20 bp, Artificial Sequence
  Description of Artificial Sequence: Synthetic oligonucleotide
  Target: SCN9A; (+) strand; PAM type: YTN; PAM sequence: CTT
gcattttctgtactgatatc

SEQ ID NO: 108458 - DNA, 20 bp, Artificial Sequence
  Description of Artificial Sequence: Synthetic oligonucleotide
  Target: SCN9A; (+) strand; PAM type: YTN; PAM sequence: TTG
cattttctgtactgatatct

SEQ ID NO: 108459 - DNA, 20 bp, Artificial Sequence
  Description of Artificial Sequence: Synthetic oligonucleotide
  Target: SCN9A; (+) strand; PAM type: YTN; PAM sequence: TTT
tctgtactgatatctatcta

SEQ ID NO: 108460 - DNA, 20 bp, Artificial Sequence
  Description of Artificial Sequence: Synthetic oligonucleotide
  Target: SCN9A; (+) strand; PAM type: YTN; PAM sequence: TTT
ctgtactgatatctatctat

SEQ ID NO: 108461 - DNA, 20 bp, Artificial Sequence
  Description of Artificial Sequence: Synthetic oligonucleotide
  Target: SCN9A; (+) strand; PAM type: YTN; PAM sequence: TTC
tgtactgatatctatctata

SEQ ID NO: 108462 - DNA, 20 bp, Artificial Sequence
  Description of Artificial Sequence: Synthetic oligonucleotide
  Target: SCN9A; (+) strand; PAM type: YTN; PAM sequence: CTG
tactgatatctatctatata

SEQ ID NO: 108463 - DNA, 20 bp, Artificial Sequence
  Description of Artificial Sequence: Synthetic oligonucleotide
  Target: SCN9A; (+) strand; PAM type: YTN; PAM sequence: CTG
atatctatctatatatgtat

SEQ ID NO: 108464 - DNA, 20 bp, Artificial Sequence
  Description of Artificial Sequence: Synthetic oligonucleotide
  Target: SCN9A; (+) strand; PAM type: YTN; PAM sequence: CTA
tctatatatgtatccgtcat

SEQ ID NO: 108465 - DNA, 20 bp, Artificial Sequence
  Description of Artificial Sequence: Synthetic oligonucleotide
  Target: SCN9A; (+) strand; PAM type: YTN; PAM sequence: CTA
tatatgtatccgtcataaat

SEQ ID NO: 108466 - DNA, 20 bp, Artificial Sequence
  Description of Artificial Sequence: Synthetic oligonucleotide
  Target: SCN9A; (+) strand; PAM type: YTN; PAM sequence: TTG
ttctctaaagagattattta

SEQ ID NO: 108467 - DNA, 20 bp, Artificial Sequence
  Description of Artificial Sequence: Synthetic oligonucleotide
  Target: SCN9A; (+) strand; PAM type: YTN; PAM sequence: TTC
tctaaagagattatttataa

SEQ ID NO: 108468 - DNA, 20 bp, Artificial Sequence
  Description of Artificial Sequence: Synthetic oligonucleotide
  Target: SCN9A; (+) strand; PAM type: YTN; PAM sequence: CTC
taaagagattatttataatc

SEQ ID NO: 108469 - DNA, 20 bp, Artificial Sequence
  Description of Artificial Sequence: Synthetic oligonucleotide
  Target: SCN9A; (+) strand; PAM type: YTN; PAM sequence: CTA
aagagattatttataatctt

SEQ ID NO: 108470 - DNA, 20 bp, Artificial Sequence
  Description of Artificial Sequence: Synthetic oligonucleotide
  Target: SCN9A; (+) strand; PAM type: YTN; PAM sequence: TTA
tttataatcttcaattataa

SEQ ID NO: 108471 - DNA, 20 bp, Artificial Sequence
  Description of Artificial Sequence: Synthetic oligonucleotide
  Target: SCN9A; (+) strand; PAM type: YTN; PAM sequence: TTT
ataatcttcaattataaaat

SEQ ID NO: 108472 - DNA, 20 bp, Artificial Sequence
  Description of Artificial Sequence: Synthetic oligonucleotide
  Target: SCN9A; (+) strand; PAM type: YTN; PAM sequence: TTA
taatcttcaattataaaatt

SEQ ID NO: 108473 - DNA, 20 bp, Artificial Sequence
  Description of Artificial Sequence: Synthetic oligonucleotide
  Target: SCN9A; (+) strand; PAM type: YTN; PAM sequence: CTT
caattataaaattaatagac

SEQ ID NO: 108474 - DNA, 20 bp, Artificial Sequence
  Description of Artificial Sequence: Synthetic oligonucleotide
  Target: SCN9A; (+) strand; PAM type: YTN; PAM sequence: TTC
aattataaaattaatagaca

SEQ ID NO: 108475 - DNA, 20 bp, Artificial Sequence
  Description of Artificial Sequence: Synthetic oligonucleotide
  Target: SCN9A; (+) strand; PAM type: YTN; PAM sequence: TTA
taaaattaatagacaagtac

SEQ ID NO: 108476 - DNA, 20 bp, Artificial Sequence
  Description of Artificial Sequence: Synthetic oligonucleotide
  Target: SCN9A; (+) strand; PAM type: YTN; PAM sequence: TTA
atagacaagtacctttttac

SEQ ID NO: 108477 - DNA, 20 bp, Artificial Sequence
  Description of Artificial Sequence: Synthetic oligonucleotide
  Target: SCN9A; (+) strand; PAM type: YTN; PAM sequence: CTT
tttacaaaaatgggatttta

SEQ ID NO: 108478 - DNA, 20 bp, Artificial Sequence
  Description of Artificial Sequence: Synthetic oligonucleotide
  Target: SCN9A; (+) strand; PAM type: YTN; PAM sequence: TTT
ttacaaaaatgggattttat

SEQ ID NO: 108479 - DNA, 20 bp, Artificial Sequence
  Description of Artificial Sequence: Synthetic oligonucleotide
  Target: SCN9A; (+) strand; PAM type: YTN; PAM sequence: TTT
tacaaaaatgggattttatc

SEQ ID NO: 108480 - DNA, 20 bp, Artificial Sequence
  Description of Artificial Sequence: Synthetic oligonucleotide
  Target: SCN9A; (+) strand; PAM type: YTN; PAM sequence: TTT
acaaaaatgggattttatct

SEQ ID NO: 108481 - DNA, 20 bp, Artificial Sequence
  Description of Artificial Sequence: Synthetic oligonucleotide
  Target: SCN9A; (+) strand; PAM type: YTN; PAM sequence: TTA
caaaaatgggattttatctt

SEQ ID NO: 108482 - DNA, 20 bp, Artificial Sequence
  Description of Artificial Sequence: Synthetic oligonucleotide
  Target: SCN9A; (+) strand; PAM type: YTN; PAM sequence: TTT
tatctttgagttagatgcct

SEQ ID NO: 108483 - DNA, 20 bp, Artificial Sequence
  Description of Artificial Sequence: Synthetic oligonucleotide
  Target: SCN9A; (+) strand; PAM type: YTN; PAM sequence: TTT
atctttgagttagatgccta

SEQ ID NO: 108484 - DNA, 20 bp, Artificial Sequence
  Description of Artificial Sequence: Synthetic oligonucleotide
  Target: SCN9A; (+) strand; PAM type: YTN; PAM sequence: TTA
tctttgagttagatgcctac

SEQ ID NO: 108485 - DNA, 20 bp, Artificial Sequence
  Description of Artificial Sequence: Synthetic oligonucleotide
  Target: SCN9A; (+) strand; PAM type: YTN; PAM sequence: CTT
tgagttagatgcctacaaca

SEQ ID NO: 108486 - DNA, 20 bp, Artificial Sequence
  Description of Artificial Sequence: Synthetic oligonucleotide
  Target: SCN9A; (+) strand; PAM type: YTN; PAM sequence: TTT
gagttagatgcctacaacac

SEQ ID NO: 108487 - DNA, 20 bp, Artificial Sequence
  Description of Artificial Sequence: Synthetic oligonucleotide
  Target: SCN9A; (+) strand; PAM type: YTN; PAM sequence: TTG
agttagatgcctacaacaca

SEQ ID NO: 108488 - DNA, 20 bp, Artificial Sequence
  Description of Artificial Sequence: Synthetic oligonucleotide
  Target: SCN9A; (+) strand; PAM type: YTN; PAM sequence: TTA
gatgcctacaacacatagaa

SEQ ID NO: 108489 - DNA, 20 bp, Artificial Sequence
  Description of Artificial Sequence: Synthetic oligonucleotide
  Target: SCN9A; (+) strand; PAM type: YTN; PAM sequence: CTA
caacacatagaatgaggatt

SEQ ID NO: 108490 - DNA, 20 bp, Artificial Sequence
  Description of Artificial Sequence: Synthetic oligonucleotide
  Target: SCN9A; (+) strand; PAM type: YTN; PAM sequence: TTA
ggctaatgaatcaaaggtgt

SEQ ID NO: 108491 - DNA, 20 bp, Artificial Sequence
  Description of Artificial Sequence: Synthetic oligonucleotide
  Target: SCN9A; (+) strand; PAM type: YTN; PAM sequence: CTA
atgaatcaaaggtgtgttcc

SEQ ID NO: 108492 - DNA, 20 bp, Artificial Sequence
  Description of Artificial Sequence: Synthetic oligonucleotide
  Target: SCN9A; (+) strand; PAM type: YTN; PAM sequence: TTC
ctatagaaaaagtattgcaa

SEQ ID NO: 108493 - DNA, 20 bp, Artificial Sequence
  Description of Artificial Sequence: Synthetic oligonucleotide
  Target: SCN9A; (+) strand; PAM type: YTN; PAM sequence: CTA
tagaaaaagtattgcaaaat

SEQ ID NO: 108494 - DNA, 20 bp, Artificial Sequence
  Description of Artificial Sequence: Synthetic oligonucleotide
  Target: SCN9A; (+) strand; PAM type: YTN; PAM sequence: TTG
caaaatgcagagccattcac

SEQ ID NO: 108495 - DNA, 20 bp, Artificial Sequence
  Description of Artificial Sequence: Synthetic oligonucleotide
  Target: SCN9A; (+) strand; PAM type: YTN; PAM sequence: TTC
acaagaccagagaaggccct

SEQ ID NO: 108496 - DNA, 20 bp, Artificial Sequence
  Description of Artificial Sequence: Synthetic oligonucleotide
  Target: SCN9A; (+) strand; PAM type: YTN; PAM sequence: CTT
cagcagagagactgactgat

SEQ ID NO: 108497 - DNA, 20 bp, Artificial Sequence
  Description of Artificial Sequence: Synthetic oligonucleotide
  Target: SCN9A; (+) strand; PAM type: YTN; PAM sequence: TTC
agcagagagactgactgatg

SEQ ID NO: 108498 - DNA, 20 bp, Artificial Sequence
  Description of Artificial Sequence: Synthetic oligonucleotide
  Target: SCN9A; (+) strand; PAM type: YTN; PAM sequence: CTG
actgatgcaggaacaagggc

SEQ ID NO: 108499 - DNA, 20 bp, Artificial Sequence
  Description of Artificial Sequence: Synthetic oligonucleotide
  Target: SCN9A; (+) strand; PAM type: YTN; PAM sequence: CTG
atgcaggaacaagggcccag

SEQ ID NO: 108500 - DNA, 20 bp, Artificial Sequence
  Description of Artificial Sequence: Synthetic oligonucleotide
  Target: SCN9A; (+) strand; PAM type: YTN; PAM sequence: CTG
agctatgtaaaacgtcctta

SEQ ID NO: 108501 - DNA, 20 bp, Artificial Sequence
  Description of Artificial Sequence: Synthetic oligonucleotide
  Target: SCN9A; (+) strand; PAM type: YTN; PAM sequence: CTA
tgtaaaacgtccttacgctg

SEQ ID NO: 108502 - DNA, 20 bp, Artificial Sequence
  Description of Artificial Sequence: Synthetic oligonucleotide
  Target: SCN9A; (+) strand; PAM type: YTN; PAM sequence: CTT
acgctgtcatcagaagttgc

SEQ ID NO: 108503 - DNA, 20 bp, Artificial Sequence
  Description of Artificial Sequence: Synthetic oligonucleotide
  Target: SCN9A; (+) strand; PAM type: YTN; PAM sequence: TTA
cgctgtcatcagaagttgcc

SEQ ID NO: 108504 - DNA, 20 bp, Artificial Sequence
  Description of Artificial Sequence: Synthetic oligonucleotide
  Target: SCN9A; (+) strand; PAM type: YTN; PAM sequence: CTG
tcatcagaagttgccttatc

SEQ ID NO: 108505 - DNA, 20 bp, Artificial Sequence
  Description of Artificial Sequence: Synthetic oligonucleotide
  Target: SCN9A; (+) strand; PAM type: YTN; PAM sequence: TTG
ccttatctattatcacctct

SEQ ID NO: 108506 - DNA, 20 bp, Artificial Sequence
  Description of Artificial Sequence: Synthetic oligonucleotide
  Target: SCN9A; (+) strand; PAM type: YTN; PAM sequence: CTT
atctattatcacctctggca

SEQ ID NO: 108507 - DNA, 20 bp, Artificial Sequence
  Description of Artificial Sequence: Synthetic oligonucleotide
  Target: SCN9A; (+) strand; PAM type: YTN; PAM sequence: TTA
tctattatcacctctggcag

SEQ ID NO: 108508 - DNA, 20 bp, Artificial Sequence
  Description of Artificial Sequence: Synthetic oligonucleotide
  Target: SCN9A; (+) strand; PAM type: YTN; PAM sequence: CTA
ttatcacctctggcagaagc

SEQ ID NO: 108509 - DNA, 20 bp, Artificial Sequence
  Description of Artificial Sequence: Synthetic oligonucleotide
  Target: SCN9A; (+) strand; PAM type: YTN; PAM sequence: TTA
tcacctctggcagaagctgt

SEQ ID NO: 108510 - DNA, 20 bp, Artificial Sequence
  Description of Artificial Sequence: Synthetic oligonucleotide
  Target: SCN9A; (+) strand; PAM type: YTN; PAM sequence: CTC
tggcagaagctgtccattgg

SEQ ID NO: 108511 - DNA, 20 bp, Artificial Sequence
  Description of Artificial Sequence: Synthetic oligonucleotide
  Target: SCN9A; (+) strand; PAM type: YTN; PAM sequence: CTG
gcagaagctgtccattgggg

SEQ ID NO: 108512 - DNA, 20 bp, Artificial Sequence
  Description of Artificial Sequence: Synthetic oligonucleotide
  Target: SCN9A; (+) strand; PAM type: YTN; PAM sequence: CTG
tccattggggagcatgaggg

SEQ ID NO: 108513 - DNA, 20 bp, Artificial Sequence
  Description of Artificial Sequence: Synthetic oligonucleotide
  Target: SCN9A; (+) strand; PAM type: YTN; PAM sequence: TTG
gggagcatgagggctgagcg

SEQ ID NO: 108514 - DNA, 20 bp, Artificial Sequence
  Description of Artificial Sequence: Synthetic oligonucleotide
  Target: SCN9A; (+) strand; PAM type: YTN; PAM sequence: CTG
agcgtccatcaaccagggag

SEQ ID NO: 108515 - DNA, 20 bp, Artificial Sequence
  Description of Artificial Sequence: Synthetic oligonucleotide
  Target: SCN9A; (+) strand; PAM type: YTN; PAM sequence: TTG
cagtccacagcactgtgcat

SEQ ID NO: 108516 - DNA, 20 bp, Artificial Sequence
  Description of Artificial Sequence: Synthetic oligonucleotide
  Target: SCN9A; (+) strand; PAM type: YTN; PAM sequence: CTG
tgcattttcccgttcaccgg

SEQ ID NO: 108517 - DNA, 20 bp, Artificial Sequence
  Description of Artificial Sequence: Synthetic oligonucleotide
  Target: SCN9A; (+) strand; PAM type: YTN; PAM sequence: TTT
tcccgttcaccggcagcatt

SEQ ID NO: 108518 - DNA, 20 bp, Artificial Sequence
  Description of Artificial Sequence: Synthetic oligonucleotide
  Target: SCN9A; (+) strand; PAM type: YTN; PAM sequence: TTT
cccgttcaccggcagcattg

SEQ ID NO: 108519 - DNA, 20 bp, Artificial Sequence
  Description of Artificial Sequence: Synthetic oligonucleotide
  Target: SCN9A; (+) strand; PAM type: YTN; PAM sequence: TTC
ccgttcaccggcagcattgg

SEQ ID NO: 108520 - DNA, 20 bp, Artificial Sequence
  Description of Artificial Sequence: Synthetic oligonucleotide
  Target: SCN9A; (+) strand; PAM type: YTN; PAM sequence: TTC
accggcagcattggtgggga

SEQ ID NO: 108521 - DNA, 20 bp, Artificial Sequence
  Description of Artificial Sequence: Synthetic oligonucleotide
  Target: SCN9A; (+) strand; PAM type: YTN; PAM sequence: TTG
gtggggacctactggcttgg

SEQ ID NO: 108522 - DNA, 20 bp, Artificial Sequence
  Description of Artificial Sequence: Synthetic oligonucleotide
  Target: SCN9A; (+) strand; PAM type: YTN; PAM sequence: CTA
ctggcttggctgatgttact

SEQ ID NO: 108523 - DNA, 20 bp, Artificial Sequence
  Description of Artificial Sequence: Synthetic oligonucleotide
  Target: SCN9A; (+) strand; PAM type: YTN; PAM sequence: CTG
gcttggctgatgttactgct

SEQ ID NO: 108524 - DNA, 20 bp, Artificial Sequence
  Description of Artificial Sequence: Synthetic oligonucleotide
  Target: SCN9A; (+) strand; PAM type: YTN; PAM sequence: CTT
ggctgatgttactgctgcgt

SEQ ID NO: 108525 - DNA, 20 bp, Artificial Sequence
  Description of Artificial Sequence: Synthetic oligonucleotide
  Target: SCN9A; (+) strand; PAM type: YTN; PAM sequence: TTG
gctgatgttactgctgcgtc

SEQ ID NO: 108526 - DNA, 20 bp, Artificial Sequence
  Description of Artificial Sequence: Synthetic oligonucleotide
  Target: SCN9A; (+) strand; PAM type: YTN; PAM sequence: CTG
atgttactgctgcgtcgctc

SEQ ID NO: 108527 - DNA, 20 bp, Artificial Sequence
  Description of Artificial Sequence: Synthetic oligonucleotide
  Target: SCN9A; (+) strand; PAM type: YTN; PAM sequence: TTA
ctgctgcgtcgctcctgggg

SEQ ID NO: 108528 - DNA, 20 bp, Artificial Sequence
  Description of Artificial Sequence: Synthetic oligonucleotide
  Target: SCN9A; (+) strand; PAM type: YTN; PAM sequence: CTG
ctgcgtcgctcctggggtct

SEQ ID NO: 108529 - DNA, 20 bp, Artificial Sequence
  Description of Artificial Sequence: Synthetic oligonucleotide
  Target: SCN9A; (+) strand; PAM type: YTN; PAM sequence: CTG
cgtcgctcctggggtctgtg

SEQ ID NO: 108530 - DNA, 20 bp, Artificial Sequence
  Description of Artificial Sequence: Synthetic oligonucleotide
  Target: SCN9A; (+) strand; PAM type: YTN; PAM sequence: CTC
ctggggtctgtggggcacaa

SEQ ID NO: 108531 - DNA, 20 bp, Artificial Sequence
  Description of Artificial Sequence: Synthetic oligonucleotide
  Target: SCN9A; (+) strand; PAM type: YTN; PAM sequence: CTG
gggtctgtggggcacaaaca

SEQ ID NO: 108532 - DNA, 20 bp, Artificial Sequence
  Description of Artificial Sequence: Synthetic oligonucleotide
  Target: SCN9A; (+) strand; PAM type: YTN; PAM sequence: CTG
tggggcacaaacagtgagcc

SEQ ID NO: 108533 - DNA, 20 bp, Artificial Sequence
  Description of Artificial Sequence: Synthetic oligonucleotide
  Target: SCN9A; (+) strand; PAM type: YTN; PAM sequence: CTT
ctgctctcattgtctccaaa

SEQ ID NO: 108534 - DNA, 20 bp, Artificial Sequence
  Description of Artificial Sequence: Synthetic oligonucleotide
  Target: SCN9A; (+) strand; PAM type: YTN; PAM sequence: TTC
tgctctcattgtctccaaaa

SEQ ID NO: 108535 - DNA, 20 bp, Artificial Sequence
  Description of Artificial Sequence: Synthetic oligonucleotide
  Target: SCN9A; (+) strand; PAM type: YTN; PAM sequence: CTG
ctctcattgtctccaaaaat

SEQ ID NO: 108536 - DNA, 20 bp, Artificial Sequence
  Description of Artificial Sequence: Synthetic oligonucleotide
  Target: SCN9A; (+) strand; PAM type: YTN; PAM sequence: CTC
tcattgtctccaaaaatgct

SEQ ID NO: 108537 - DNA, 20 bp, Artificial Sequence
  Description of Artificial Sequence: Synthetic oligonucleotide
  Target: SCN9A; (+) strand; PAM type: YTN; PAM sequence: CTC
attgtctccaaaaatgctgt

SEQ ID NO: 108538 - DNA, 20 bp, Artificial Sequence
  Description of Artificial Sequence: Synthetic oligonucleotide
  Target: SCN9A; (+) strand; PAM type: YTN; PAM sequence: TTG
tctccaaaaatgctgtgctc

SEQ ID NO: 108539 - DNA, 20 bp, Artificial Sequence
  Description of Artificial Sequence: Synthetic oligonucleotide
  Target: SCN9A; (+) strand; PAM type: YTN; PAM sequence: CTC
caaaaatgctgtgctcatca

SEQ ID NO: 108540 - DNA, 20 bp, Artificial Sequence
  Description of Artificial Sequence: Synthetic oligonucleotide
  Target: SCN9A; (+) strand; PAM type: YTN; PAM sequence: CTG
tgctcatcatcggcaaattc

SEQ ID NO: 108541 - DNA, 20 bp, Artificial Sequence
  Description of Artificial Sequence: Synthetic oligonucleotide
  Target: SCN9A; (+) strand; PAM type: YTN; PAM sequence: CTC
atcatcggcaaattcagtct

SEQ ID NO: 108542 - DNA, 20 bp, Artificial Sequence
  Description of Artificial Sequence: Synthetic oligonucleotide
  Target: SCN9A; (+) strand; PAM type: YTN; PAM sequence: TTC
agtctcagatcctatatctc

SEQ ID NO: 108543 - DNA, 20 bp, Artificial Sequence
  Description of Artificial Sequence: Synthetic oligonucleotide
  Target: SCN9A; (+) strand; PAM type: YTN; PAM sequence: CTC
agatcctatatctcttcctc

SEQ ID NO: 108544 - DNA, 20 bp, Artificial Sequence
  Description of Artificial Sequence: Synthetic oligonucleotide
  Target: SCN9A; (+) strand; PAM type: YTN; PAM sequence: CTA
tatctcttcctctgcctttg

SEQ ID NO: 108545 - DNA, 20 bp, Artificial Sequence
  Description of Artificial Sequence: Synthetic oligonucleotide
  Target: SCN9A; (+) strand; PAM type: YTN; PAM sequence: CTC
ttcctctgcctttgaaacta

SEQ ID NO: 108546 - DNA, 20 bp, Artificial Sequence
  Description of Artificial Sequence: Synthetic oligonucleotide
  Target: SCN9A; (+) strand; PAM type: YTN; PAM sequence: CTT
cctctgcctttgaaactaaa

SEQ ID NO: 108547 - DNA, 20 bp, Artificial Sequence
  Description of Artificial Sequence: Synthetic oligonucleotide
  Target: SCN9A; (+) strand; PAM type: YTN; PAM sequence: TTC
ctctgcctttgaaactaaaa

SEQ ID NO: 108548 - DNA, 20 bp, Artificial Sequence
  Description of Artificial Sequence: Synthetic oligonucleotide
  Target: SCN9A; (+) strand; PAM type: YTN; PAM sequence: CTC
tgcctttgaaactaaaaaga

SEQ ID NO: 108549 - DNA, 20 bp, Artificial Sequence
  Description of Artificial Sequence: Synthetic oligonucleotide
  Target: SCN9A; (+) strand; PAM type: YTN; PAM sequence: CTG
cctttgaaactaaaaagact

SEQ ID NO: 108550 - DNA, 20 bp, Artificial Sequence
  Description of Artificial Sequence: Synthetic oligonucleotide
  Target: SCN9A; (+) strand; PAM type: YTN; PAM sequence: CTT
tgaaactaaaaagacttgtt

SEQ ID NO: 108551 - DNA, 20 bp, Artificial Sequence
  Description of Artificial Sequence: Synthetic oligonucleotide
  Target: SCN9A; (+) strand; PAM type: YTN; PAM sequence: TTT
gaaactaaaaagacttgttc

SEQ ID NO: 108552 - DNA, 20 bp, Artificial Sequence
  Description of Artificial Sequence: Synthetic oligonucleotide
  Target: SCN9A; (+) strand; PAM type: YTN; PAM sequence: TTG
aaactaaaaagacttgttct

SEQ ID NO: 108553 - DNA, 20 bp, Artificial Sequence
  Description of Artificial Sequence: Synthetic oligonucleotide
  Target: SCN9A; (+) strand; PAM type: YTN; PAM sequence: CTA
aaaagacttgttctgctgct

SEQ ID NO: 108554 - DNA, 20 bp, Artificial Sequence
  Description of Artificial Sequence: Synthetic oligonucleotide
  Target: SCN9A; (+) strand; PAM type: YTN; PAM sequence: CTT
gttctgctgcttcgccttgc

SEQ ID NO: 108555 - DNA, 20 bp, Artificial Sequence
  Description of Artificial Sequence: Synthetic oligonucleotide
  Target: SCN9A; (+) strand; PAM type: YTN; PAM sequence: TTG
ttctgctgcttcgccttgca

SEQ ID NO: 108556 - DNA, 20 bp, Artificial Sequence
  Description of Artificial Sequence: Synthetic oligonucleotide
  Target: SCN9A; (+) strand; PAM type: YTN; PAM sequence: TTC
tgctgcttcgccttgcagaa

SEQ ID NO: 108557 - DNA, 20 bp, Artificial Sequence
  Description of Artificial Sequence: Synthetic oligonucleotide
  Target: SCN9A; (+) strand; PAM type: YTN; PAM sequence: CTG
ctgcttcgccttgcagaaaa

SEQ ID NO: 108558 - DNA, 20 bp, Artificial Sequence
  Description of Artificial Sequence: Synthetic oligonucleotide
  Target: SCN9A; (+) strand; PAM type: YTN; PAM sequence: CTG
cttcgccttgcagaaaacaa

SEQ ID NO: 108559 - DNA, 20 bp, Artificial Sequence
  Description of Artificial Sequence: Synthetic oligonucleotide
  Target: SCN9A; (+) strand; PAM type: YTN; PAM sequence: CTT
cgccttgcagaaaacaagga

SEQ ID NO: 108560 - DNA, 20 bp, Artificial Sequence
  Description of Artificial Sequence: Synthetic oligonucleotide
  Target: SCN9A; (+) strand; PAM type: YTN; PAM sequence: TTC
gccttgcagaaaacaaggag

SEQ ID NO: 108561 - DNA, 20 bp, Artificial Sequence
  Description of Artificial Sequence: Synthetic oligonucleotide
  Target: SCN9A; (+) strand; PAM type: YTN; PAM sequence: CTT
gcagaaaacaaggagccacg

SEQ ID NO: 108562 - DNA, 20 bp, Artificial Sequence
  Description of Artificial Sequence: Synthetic oligonucleotide
  Target: SCN9A; (+) strand; PAM type: YTN; PAM sequence: TTG
cagaaaacaaggagccacga

SEQ ID NO: 108563 - DNA, 20 bp, Artificial Sequence
  Description of Artificial Sequence: Synthetic oligonucleotide
  Target: SCN9A; (+) strand; PAM type: YTN; PAM sequence: CTG
agtggtgactgcagaaaaat

SEQ ID NO: 108564 - DNA, 20 bp, Artificial Sequence
  Description of Artificial Sequence: Synthetic oligonucleotide
  Target: SCN9A; (+) strand; PAM type: YTN; PAM sequence: CTG
cagaaaaattaaaaaaaacg

SEQ ID NO: 108565 - DNA, 20 bp, Artificial Sequence
  Description of Artificial Sequence: Synthetic oligonucleotide
  Target: SCN9A; (+) strand; PAM type: YTN; PAM sequence: TTA
aaaaaaacgtggttgctgaa

SEQ ID NO: 108566 - DNA, 20 bp, Artificial Sequence
  Description of Artificial Sequence: Synthetic oligonucleotide
  Target: SCN9A; (+) strand; PAM type: YTN; PAM sequence: TTG
ctgaagcacctactgataga

SEQ ID NO: 108567 - DNA, 20 bp, Artificial Sequence
  Description of Artificial Sequence: Synthetic oligonucleotide
  Target: SCN9A; (+) strand; PAM type: YTN; PAM sequence: CTG
aagcacctactgatagaagt

SEQ ID NO: 108568 - DNA, 20 bp, Artificial Sequence
  Description of Artificial Sequence: Synthetic oligonucleotide
  Target: SCN9A; (+) strand; PAM type: YTN; PAM sequence: CTA
ctgatagaagtacacttcat

SEQ ID NO: 108569 - DNA, 20 bp, Artificial Sequence
  Description of Artificial Sequence: Synthetic oligonucleotide
  Target: SCN9A; (+) strand; PAM type: YTN; PAM sequence: CTG
atagaagtacacttcatata

SEQ ID NO: 108570 - DNA, 20 bp, Artificial Sequence
  Description of Artificial Sequence: Synthetic oligonucleotide
  Target: SCN9A; (+) strand; PAM type: YTN; PAM sequence: CTT
catataaataccactgaacc

SEQ ID NO: 108571 - DNA, 20 bp, Artificial Sequence
  Description of Artificial Sequence: Synthetic oligonucleotide
  Target: SCN9A; (+) strand; PAM type: YTN; PAM sequence: TTC
atataaataccactgaaccc

SEQ ID NO: 108572 - DNA, 20 bp, Artificial Sequence
  Description of Artificial Sequence: Synthetic oligonucleotide
  Target: SCN9A; (+) strand; PAM type: YTN; PAM sequence: CTG
aacccactggcctgagggca

SEQ ID NO: 108573 - DNA, 20 bp, Artificial Sequence
  Description of Artificial Sequence: Synthetic oligonucleotide
  Target: SCN9A; (+) strand; PAM type: YTN; PAM sequence: CTG
gcctgagggcaggtggctct

SEQ ID NO: 108574 - DNA, 20 bp, Artificial Sequence
  Description of Artificial Sequence: Synthetic oligonucleotide
  Target: SCN9A; (+) strand; PAM type: YTN; PAM sequence: CTG
agggcaggtggctctgtact

SEQ ID NO: 108575 - DNA, 20 bp, Artificial Sequence
  Description of Artificial Sequence: Synthetic oligonucleotide
  Target: SCN9A; (+) strand; PAM type: YTN; PAM sequence: CTC
tgtactgacttaaaagaaac

SEQ ID NO: 108576 - DNA, 20 bp, Artificial Sequence
  Description of Artificial Sequence: Synthetic oligonucleotide
  Target: SCN9A; (+) strand; PAM type: YTN; PAM sequence: CTG
tactgacttaaaagaaacat

SEQ ID NO: 108577 - DNA, 20 bp, Artificial Sequence
  Description of Artificial Sequence: Synthetic oligonucleotide
  Target: SCN9A; (+) strand; PAM type: YTN; PAM sequence: CTG
acttaaaagaaacatactta

SEQ ID NO: 108578 - DNA, 20 bp, Artificial Sequence
  Description of Artificial Sequence: Synthetic oligonucleotide
  Target: SCN9A; (+) strand; PAM type: YTN; PAM sequence: CTT
aaaagaaacatacttaaaaa

SEQ ID NO: 108579 - DNA, 20 bp, Artificial Sequence
  Description of Artificial Sequence: Synthetic oligonucleotide
  Target: SCN9A; (+) strand; PAM type: YTN; PAM sequence: TTA
aaagaaacatacttaaaaac

SEQ ID NO: 108580 - DNA, 20 bp, Artificial Sequence
  Description of Artificial Sequence: Synthetic oligonucleotide
  Target: SCN9A; (+) strand; PAM type: YTN; PAM sequence: CTT
aaaaacgaagcaattcagtg

SEQ ID NO: 108581 - DNA, 20 bp, Artificial Sequence
  Description of Artificial Sequence: Synthetic oligonucleotide
  Target: SCN9A; (+) strand; PAM type: YTN; PAM sequence: TTA
aaaacgaagcaattcagtga

SEQ ID NO: 108582 - DNA, 20 bp, Artificial Sequence
  Description of Artificial Sequence: Synthetic oligonucleotide
  Target: SCN9A; (+) strand; PAM type: YTN; PAM sequence: TTC
agtgagaagaaaacttcttc

SEQ ID NO: 108583 - DNA, 20 bp, Artificial Sequence
  Description of Artificial Sequence: Synthetic oligonucleotide
  Target: SCN9A; (+) strand; PAM type: YTN; PAM sequence: CTT
cttccacttaagggatgaaa

SEQ ID NO: 108584 - DNA, 20 bp, Artificial Sequence
  Description of Artificial Sequence: Synthetic oligonucleotide
  Target: SCN9A; (+) strand; PAM type: YTN; PAM sequence: TTC
ttccacttaagggatgaaac

SEQ ID NO: 108585 - DNA, 20 bp, Artificial Sequence
  Description of Artificial Sequence: Synthetic oligonucleotide
  Target: SCN9A; (+) strand; PAM type: YTN; PAM sequence: CTT
ccacttaagggatgaaacaa

SEQ ID NO: 108586 - DNA, 20 bp, Artificial Sequence
  Description of Artificial Sequence: Synthetic oligonucleotide
  Target: SCN9A; (+) strand; PAM type: YTN; PAM sequence: TTC
cacttaagggatgaaacaat

SEQ ID NO: 108587 - DNA, 20 bp, Artificial Sequence
  Description of Artificial Sequence: Synthetic oligonucleotide
  Target: SCN9A; (+) strand; PAM type: YTN; PAM sequence: CTT
aagggatgaaacaatttgta

SEQ ID NO: 108588 - DNA, 20 bp, Artificial Sequence
  Description of Artificial Sequence: Synthetic oligonucleotide
  Target: SCN9A; (+) strand; PAM type: YTN; PAM sequence: TTA
agggatgaaacaatttgtag

SEQ ID NO: 108589 - DNA, 20 bp, Artificial Sequence
  Description of Artificial Sequence: Synthetic oligonucleotide
  Target: SCN9A; (+) strand; PAM type: YTN; PAM sequence: TTT
gtagaattcatcctttcagg

SEQ ID NO: 108590 - DNA, 20 bp, Artificial Sequence
  Description of Artificial Sequence: Synthetic oligonucleotide
  Target: SCN9A; (+) strand; PAM type: YTN; PAM sequence: TTG
tagaattcatcctttcagga

SEQ ID NO: 108591 - DNA, 20 bp, Artificial Sequence
  Description of Artificial Sequence: Synthetic oligonucleotide
  Target: SCN9A; (+) strand; PAM type: YTN; PAM sequence: TTC
atcctttcaggaccaggtaa

SEQ ID NO: 108592 - DNA, 20 bp, Artificial Sequence
  Description of Artificial Sequence: Synthetic oligonucleotide
  Target: SCN9A; (+) strand; PAM type: YTN; PAM sequence: CTT
tcaggaccaggtaaattatt

SEQ ID NO: 108593 - DNA, 20 bp, Artificial Sequence
  Description of Artificial Sequence: Synthetic oligonucleotide
  Target: SCN9A; (+) strand; PAM type: YTN; PAM sequence: TTT
caggaccaggtaaattattt

SEQ ID NO: 108594 - DNA, 20 bp, Artificial Sequence
  Description of Artificial Sequence: Synthetic oligonucleotide
  Target: SCN9A; (+) strand; PAM type: YTN; PAM sequence: TTC
aggaccaggtaaattatttg

SEQ ID NO: 108595 - DNA, 20 bp, Artificial Sequence
  Description of Artificial Sequence: Synthetic oligonucleotide
  Target: SCN9A; (+) strand; PAM type: YTN; PAM sequence: TTA
tttgttgctatacagctctc

SEQ ID NO: 108596 - DNA, 20 bp, Artificial Sequence
  Description of Artificial Sequence: Synthetic oligonucleotide
  Target: SCN9A; (+) strand; PAM type: YTN; PAM sequence: TTT
gttgctatacagctctctaa

SEQ ID NO: 108597 - DNA, 20 bp, Artificial Sequence
  Description of Artificial Sequence: Synthetic oligonucleotide
  Target: SCN9A; (+) strand; PAM type: YTN; PAM sequence: TTG
ttgctatacagctctctaat

SEQ ID NO: 108598 - DNA, 20 bp, Artificial Sequence
  Description of Artificial Sequence: Synthetic oligonucleotide
  Target: SCN9A; (+) strand; PAM type: YTN; PAM sequence: TTG
ctatacagctctctaatatt

SEQ ID NO: 108599 - DNA, 20 bp, Artificial Sequence
  Description of Artificial Sequence: Synthetic oligonucleotide
  Target: SCN9A; (+) strand; PAM type: YTN; PAM sequence: CTA
tacagctctctaatattctg

SEQ ID NO: 108600 - DNA, 20 bp, Artificial Sequence
  Description of Artificial Sequence: Synthetic oligonucleotide
  Target: SCN9A; (+) strand; PAM type: YTN; PAM sequence: CTC
tctaatattctggcctagag

SEQ ID NO: 108601 - DNA, 20 bp, Artificial Sequence
  Description of Artificial Sequence: Synthetic oligonucleotide
  Target: SCN9A; (+) strand; PAM type: YTN; PAM sequence: CTC
taatattctggcctagagtt

SEQ ID NO: 108602 - DNA, 20 bp, Artificial Sequence
  Description of Artificial Sequence: Synthetic oligonucleotide
  Target: SCN9A; (+) strand; PAM type: YTN; PAM sequence: CTA
atattctggcctagagttac

SEQ ID NO: 108603 - DNA, 20 bp, Artificial Sequence
  Description of Artificial Sequence: Synthetic oligonucleotide
  Target: SCN9A; (+) strand; PAM type: YTN; PAM sequence: TTC
tggcctagagttactgctcc

SEQ ID NO: 108604 - DNA, 20 bp, Artificial Sequence
  Description of Artificial Sequence: Synthetic oligonucleotide
  Target: SCN9A; (+) strand; PAM type: YTN; PAM sequence: CTG
gcctagagttactgctccat

SEQ ID NO: 108605 - DNA, 20 bp, Artificial Sequence
  Description of Artificial Sequence: Synthetic oligonucleotide
  Target: SCN9A; (+) strand; PAM type: YTN; PAM sequence: CTA
gagttactgctccattcttt

SEQ ID NO: 108606 - DNA, 20 bp, Artificial Sequence
  Description of Artificial Sequence: Synthetic oligonucleotide
  Target: SCN9A; (+) strand; PAM type: YTN; PAM sequence: TTA
ctgctccattcttttaatgc

SEQ ID NO: 108607 - DNA, 20 bp, Artificial Sequence
  Description of Artificial Sequence: Synthetic oligonucleotide
  Target: SCN9A; (+) strand; PAM type: YTN; PAM sequence: CTG
ctccattcttttaatgccat

SEQ ID NO: 108608 - DNA, 20 bp, Artificial Sequence
  Description of Artificial Sequence: Synthetic oligonucleotide
  Target: SCN9A; (+) strand; PAM type: YTN; PAM sequence: CTC
cattcttttaatgccattca

SEQ ID NO: 108609 - DNA, 20 bp, Artificial Sequence
  Description of Artificial Sequence: Synthetic oligonucleotide
  Target: SCN9A; (+) strand; PAM type: YTN; PAM sequence: TTC
ttttaatgccattcattttg

SEQ ID NO: 108610 - DNA, 20 bp, Artificial Sequence
  Description of Artificial Sequence: Synthetic oligonucleotide
  Target: SCN9A; (+) strand; PAM type: YTN; PAM sequence: CTT
ttaatgccattcattttgct

SEQ ID NO: 108611 - DNA, 20 bp, Artificial Sequence
  Description of Artificial Sequence: Synthetic oligonucleotide
  Target: SCN9A; (+) strand; PAM type: YTN; PAM sequence: TTT
taatgccattcattttgctg

SEQ ID NO: 108612 - DNA, 20 bp, Artificial Sequence
  Description of Artificial Sequence: Synthetic oligonucleotide
  Target: SCN9A; (+) strand; PAM type: YTN; PAM sequence: TTT
aatgccattcattttgctgc

SEQ ID NO: 108613 - DNA, 20 bp, Artificial Sequence
  Description of Artificial Sequence: Synthetic oligonucleotide
  Target: SCN9A; (+) strand; PAM type: YTN; PAM sequence: TTA
atgccattcattttgctgca

SEQ ID NO: 108614 - DNA, 20 bp, Artificial Sequence
  Description of Artificial Sequence: Synthetic oligonucleotide
  Target: SCN9A; (+) strand; PAM type: YTN; PAM sequence: TTC
attttgctgcacagaactta

SEQ ID NO: 108615 - DNA, 20 bp, Artificial Sequence
  Description of Artificial Sequence: Synthetic oligonucleotide
  Target: SCN9A; (+) strand; PAM type: YTN; PAM sequence: TTT
tgctgcacagaacttataac

SEQ ID NO: 108616 - DNA, 20 bp, Artificial Sequence
  Description of Artificial Sequence: Synthetic oligonucleotide
  Target: SCN9A; (+) strand; PAM type: YTN; PAM sequence: TTT
gctgcacagaacttataact

SEQ ID NO: 108617 - DNA, 20 bp, Artificial Sequence
  Description of Artificial Sequence: Synthetic oligonucleotide
  Target: SCN9A; (+) strand; PAM type: YTN; PAM sequence: TTG
ctgcacagaacttataactt

SEQ ID NO: 108618 - DNA, 20 bp, Artificial Sequence
  Description of Artificial Sequence: Synthetic oligonucleotide
  Target: SCN9A; (+) strand; PAM type: YTN; PAM sequence: CTG
cacagaacttataacttaaa

SEQ ID NO: 108619 - DNA, 20 bp, Artificial Sequence
  Description of Artificial Sequence: Synthetic oligonucleotide
  Target: SCN9A; (+) strand; PAM type: YTN; PAM sequence: CTT
ataacttaaaaaaagaactt

SEQ ID NO: 108620 - DNA, 20 bp, Artificial Sequence
  Description of Artificial Sequence: Synthetic oligonucleotide
  Target: SCN9A; (+) strand; PAM type: YTN; PAM sequence: TTA
taacttaaaaaaagaactta

SEQ ID NO: 108621 - DNA, 20 bp, Artificial Sequence
  Description of Artificial Sequence: Synthetic oligonucleotide
  Target: SCN9A; (+) strand; PAM type: YTN; PAM sequence: CTT
aaaaaaagaacttagtattg

SEQ ID NO: 108622 - DNA, 20 bp, Artificial Sequence
  Description of Artificial Sequence: Synthetic oligonucleotide
  Target: SCN9A; (+) strand; PAM type: YTN; PAM sequence: TTA
aaaaaagaacttagtattgc

SEQ ID NO: 108623 - DNA, 20 bp, Artificial Sequence
  Description of Artificial Sequence: Synthetic oligonucleotide
  Target: SCN9A; (+) strand; PAM type: YTN; PAM sequence: CTT
agtattgctactggtcattc

SEQ ID NO: 108624 - DNA, 20 bp, Artificial Sequence
  Description of Artificial Sequence: Synthetic oligonucleotide
  Target: SCN9A; (+) strand; PAM type: YTN; PAM sequence: TTA
gtattgctactggtcattca

SEQ ID NO: 108625 - DNA, 20 bp, Artificial Sequence
  Description of Artificial Sequence: Synthetic oligonucleotide
  Target: SCN9A; (+) strand; PAM type: YTN; PAM sequence: TTG
ctactggtcattcaactttt

SEQ ID NO: 108626 - DNA, 20 bp, Artificial Sequence
  Description of Artificial Sequence: Synthetic oligonucleotide
  Target: SCN9A; (+) strand; PAM type: YTN; PAM sequence: CTA
ctggtcattcaactttttat

SEQ ID NO: 108627 - DNA, 20 bp, Artificial Sequence
  Description of Artificial Sequence: Synthetic oligonucleotide
  Target: SCN9A; (+) strand; PAM type: YTN; PAM sequence: CTG
gtcattcaactttttatata

SEQ ID NO: 108628 - DNA, 20 bp, Artificial Sequence
  Description of Artificial Sequence: Synthetic oligonucleotide
  Target: SCN9A; (+) strand; PAM type: YTN; PAM sequence: TTC
aactttttatatatcaatcc

SEQ ID NO: 108629 - DNA, 20 bp, Artificial Sequence
  Description of Artificial Sequence: Synthetic oligonucleotide
  Target: SCN9A; (+) strand; PAM type: YTN; PAM sequence: CTT
tttatatatcaatccccagg

SEQ ID NO: 108630 - DNA, 20 bp, Artificial Sequence
  Description of Artificial Sequence: Synthetic oligonucleotide
  Target: SCN9A; (+) strand; PAM type: YTN; PAM sequence: TTT
ttatatatcaatccccaggc

SEQ ID NO: 108631 - DNA, 20 bp, Artificial Sequence
  Description of Artificial Sequence: Synthetic oligonucleotide
  Target: SCN9A; (+) strand; PAM type: YTN; PAM sequence: TTT
tatatatcaatccccaggct

SEQ ID NO: 108632 - DNA, 20 bp, Artificial Sequence
  Description of Artificial Sequence: Synthetic oligonucleotide
  Target: SCN9A; (+) strand; PAM type: YTN; PAM sequence: TTT
atatatcaatccccaggctt

SEQ ID NO: 108633 - DNA, 20 bp, Artificial Sequence
  Description of Artificial Sequence: Synthetic oligonucleotide
  Target: SCN9A; (+) strand; PAM type: YTN; PAM sequence: TTA
tatatcaatccccaggcttc

SEQ ID NO: 108634 - DNA, 20 bp, Artificial Sequence
  Description of Artificial Sequence: Synthetic oligonucleotide
  Target: SCN9A; (+) strand; PAM type: YTN; PAM sequence: CTT
cacaaaaaaattggaaatca

SEQ ID NO: 108635 - DNA, 20 bp, Artificial Sequence
  Description of Artificial Sequence: Synthetic oligonucleotide
  Target: SCN9A; (+) strand; PAM type: YTN; PAM sequence: TTC
acaaaaaaattggaaatcat

SEQ ID NO: 108636 - DNA, 20 bp, Artificial Sequence
  Description of Artificial Sequence: Synthetic oligonucleotide
  Target: SCN9A; (+) strand; PAM type: YTN; PAM sequence: TTG
gaaatcatgctgtatggttc

SEQ ID NO: 108637 - DNA, 20 bp, Artificial Sequence
  Description of Artificial Sequence: Synthetic oligonucleotide
  Target: SCN9A; (+) strand; PAM type: YTN; PAM sequence: CTG
tatggttctttgcattgaaa

SEQ ID NO: 108638 - DNA, 20 bp, Artificial Sequence
  Description of Artificial Sequence: Synthetic oligonucleotide
  Target: SCN9A; (+) strand; PAM type: YTN; PAM sequence: TTC
tttgcattgaaaatccacct

SEQ ID NO: 108639 - DNA, 20 bp, Artificial Sequence
  Description of Artificial Sequence: Synthetic oligonucleotide
  Target: SCN9A; (+) strand; PAM type: YTN; PAM sequence: CTT
tgcattgaaaatccacctta

SEQ ID NO: 108640 - DNA, 20 bp, Artificial Sequence
  Description of Artificial Sequence: Synthetic oligonucleotide
  Target: SCN9A; (+) strand; PAM type: YTN; PAM sequence: TTT
gcattgaaaatccaccttac

SEQ ID NO: 108641 - DNA, 20 bp, Artificial Sequence
  Description of Artificial Sequence: Synthetic oligonucleotide
  Target: SCN9A; (+) strand; PAM type: YTN; PAM sequence: TTG
cattgaaaatccaccttaca

SEQ ID NO: 108642 - DNA, 20 bp, Artificial Sequence
  Description of Artificial Sequence: Synthetic oligonucleotide
  Target: SCN9A; (+) strand; PAM type: YTN; PAM sequence: TTG
aaaatccaccttacatacta

SEQ ID NO: 108643 - DNA, 20 bp, Artificial Sequence
  Description of Artificial Sequence: Synthetic oligonucleotide
  Target: SCN9A; (+) strand; PAM type: YTN; PAM sequence: CTT
acatactaagagctcagtta

SEQ ID NO: 108644 - DNA, 20 bp, Artificial Sequence
  Description of Artificial Sequence: Synthetic oligonucleotide
  Target: SCN9A; (+) strand; PAM type: YTN; PAM sequence: TTA
catactaagagctcagttaa

SEQ ID NO: 108645 - DNA, 20 bp, Artificial Sequence
  Description of Artificial Sequence: Synthetic oligonucleotide
  Target: SCN9A; (+) strand; PAM type: YTN; PAM sequence: CTA
agagctcagttaaagtgtat

SEQ ID NO: 108646 - DNA, 20 bp, Artificial Sequence
  Description of Artificial Sequence: Synthetic oligonucleotide
  Target: SCN9A; (+) strand; PAM type: YTN; PAM sequence: CTC
agttaaagtgtatttaaaga

SEQ ID NO: 108647 - DNA, 20 bp, Artificial Sequence
  Description of Artificial Sequence: Synthetic oligonucleotide
  Target: SCN9A; (+) strand; PAM type: YTN; PAM sequence: TTA
aagtgtatttaaagagagct

SEQ ID NO: 108648 - DNA, 20 bp, Artificial Sequence
  Description of Artificial Sequence: Synthetic oligonucleotide
  Target: SCN9A; (+) strand; PAM type: YTN; PAM sequence: TTT
aaagagagcttttagcacca

SEQ ID NO: 108649 - DNA, 20 bp, Artificial Sequence
  Description of Artificial Sequence: Synthetic oligonucleotide
  Target: SCN9A; (+) strand; PAM type: YTN; PAM sequence: TTA
aagagagcttttagcaccag

SEQ ID NO: 108650 - DNA, 20 bp, Artificial Sequence
  Description of Artificial Sequence: Synthetic oligonucleotide
  Target: SCN9A; (+) strand; PAM type: YTN; PAM sequence: CTT
ttagcaccagttaatttata

SEQ ID NO: 108651 - DNA, 20 bp, Artificial Sequence
  Description of Artificial Sequence: Synthetic oligonucleotide
  Target: SCN9A; (+) strand; PAM type: YTN; PAM sequence: TTT
tagcaccagttaatttataa

SEQ ID NO: 108652 - DNA, 20 bp, Artificial Sequence
  Description of Artificial Sequence: Synthetic oligonucleotide
  Target: SCN9A; (+) strand; PAM type: YTN; PAM sequence: TTT
agcaccagttaatttataaa

SEQ ID NO: 108653 - DNA, 20 bp, Artificial Sequence
  Description of Artificial Sequence: Synthetic oligonucleotide
  Target: SCN9A; (+) strand; PAM type: YTN; PAM sequence: TTA
gcaccagttaatttataaag

SEQ ID NO: 108654 - DNA, 20 bp, Artificial Sequence
  Description of Artificial Sequence: Synthetic oligonucleotide
  Target: SCN9A; (+) strand; PAM type: YTN; PAM sequence: TTA
atttataaagtcattaaata

SEQ ID NO: 108655 - DNA, 20 bp, Artificial Sequence
  Description of Artificial Sequence: Synthetic oligonucleotide
  Target: SCN9A; (+) strand; PAM type: YTN; PAM sequence: TTT
ataaagtcattaaatattta

SEQ ID NO: 108656 - DNA, 20 bp, Artificial Sequence
  Description of Artificial Sequence: Synthetic oligonucleotide
  Target: SCN9A; (+) strand; PAM type: YTN; PAM sequence: TTA
taaagtcattaaatatttaa

SEQ ID NO: 108657 - DNA, 20 bp, Artificial Sequence
  Description of Artificial Sequence: Synthetic oligonucleotide
  Target: SCN9A; (+) strand; PAM type: YTN; PAM sequence: TTA
aatatttaaaaagaagttgc

SEQ ID NO: 108658 - DNA, 20 bp, Artificial Sequence
  Description of Artificial Sequence: Synthetic oligonucleotide
  Target: SCN9A; (+) strand; PAM type: YTN; PAM sequence: TTT
aaaaagaagttgcccaatac

SEQ ID NO: 108659 - DNA, 20 bp, Artificial Sequence
  Description of Artificial Sequence: Synthetic oligonucleotide
  Target: SCN9A; (+) strand; PAM type: YTN; PAM sequence: TTA
aaaagaagttgcccaatacc

SEQ ID NO: 108660 - DNA, 20 bp, Artificial Sequence
  Description of Artificial Sequence: Synthetic oligonucleotide
  Target: SCN9A; (+) strand; PAM type: YTN; PAM sequence: TTG
cccaataccaaagaggagga

SEQ ID NO: 108661 - DNA, 20 bp, Artificial Sequence
  Description of Artificial Sequence: Synthetic oligonucleotide
  Target: SCN9A; (+) strand; PAM type: YTN; PAM sequence: TTC
aattcatgcttatatgactc

SEQ ID NO: 108662 - DNA, 20 bp, Artificial Sequence
  Description of Artificial Sequence: Synthetic oligonucleotide
  Target: SCN9A; (+) strand; PAM type: YTN; PAM sequence: TTC
atgcttatatgactcatgtc

SEQ ID NO: 108663 - DNA, 20 bp, Artificial Sequence
  Description of Artificial Sequence: Synthetic oligonucleotide
  Target: SCN9A; (+) strand; PAM type: YTN; PAM sequence: CTT
atatgactcatgtccagggt

SEQ ID NO: 108664 - DNA, 20 bp, Artificial Sequence
  Description of Artificial Sequence: Synthetic oligonucleotide
  Target: SCN9A; (+) strand; PAM type: YTN; PAM sequence: TTA
tatgactcatgtccagggtg

SEQ ID NO: 108665 - DNA, 20 bp, Artificial Sequence
  Description of Artificial Sequence: Synthetic oligonucleotide
  Target: SCN9A; (+) strand; PAM type: YTN; PAM sequence: CTC
atgtccagggtgtaaatcct

SEQ ID NO: 108666 - DNA, 20 bp, Artificial Sequence
  Description of Artificial Sequence: Synthetic oligonucleotide
  Target: SCN9A; (+) strand; PAM type: YTN; PAM sequence: CTT
tggaaggatctagttcaata

SEQ ID NO: 108667 - DNA, 20 bp, Artificial Sequence
  Description of Artificial Sequence: Synthetic oligonucleotide
  Target: SCN9A; (+) strand; PAM type: YTN; PAM sequence: TTT
ggaaggatctagttcaatag

SEQ ID NO: 108668 - DNA, 20 bp, Artificial Sequence
  Description of Artificial Sequence: Synthetic oligonucleotide
  Target: SCN9A; (+) strand; PAM type: YTN; PAM sequence: TTG
gaaggatctagttcaataga

SEQ ID NO: 108669 - DNA, 20 bp, Artificial Sequence
  Description of Artificial Sequence: Synthetic oligonucleotide
  Target: SCN9A; (+) strand; PAM type: YTN; PAM sequence: CTA
gttcaatagacattagtgct

SEQ ID NO: 108670 - DNA, 20 bp, Artificial Sequence
  Description of Artificial Sequence: Synthetic oligonucleotide
  Target: SCN9A; (+) strand; PAM type: YTN; PAM sequence: TTC
aatagacattagtgcttact

SEQ ID NO: 108671 - DNA, 20 bp, Artificial Sequence
  Description of Artificial Sequence: Synthetic oligonucleotide
  Target: SCN9A; (+) strand; PAM type: YTN; PAM sequence: TTA
gtgcttactatgtaaagaac

SEQ ID NO: 108672 - DNA, 20 bp, Artificial Sequence
  Description of Artificial Sequence: Synthetic oligonucleotide
  Target: SCN9A; (+) strand; PAM type: YTN; PAM sequence: CTT
actatgtaaagaacaaagtg

SEQ ID NO: 108673 - DNA, 20 bp, Artificial Sequence
  Description of Artificial Sequence: Synthetic oligonucleotide
  Target: SCN9A; (+) strand; PAM type: YTN; PAM sequence: TTA
ctatgtaaagaacaaagtgg

SEQ ID NO: 108674 - DNA, 20 bp, Artificial Sequence
  Description of Artificial Sequence: Synthetic oligonucleotide
  Target: SCN9A; (+) strand; PAM type: YTN; PAM sequence: CTA
tgtaaagaacaaagtggcaa

SEQ ID NO: 108675 - DNA, 20 bp, Artificial Sequence
  Description of Artificial Sequence: Synthetic oligonucleotide
  Target: SCN9A; (+) strand; PAM type: YTN; PAM sequence: CTA
ttgtgaacaatggaaaaagt

SEQ ID NO: 108676 - DNA, 20 bp, Artificial Sequence
  Description of Artificial Sequence: Synthetic oligonucleotide
  Target: SCN9A; (+) strand; PAM type: YTN; PAM sequence: TTG
tgaacaatggaaaaagtatg

SEQ ID NO: 108677 - DNA, 20 bp, Artificial Sequence
  Description of Artificial Sequence: Synthetic oligonucleotide
  Target: SCN9A; (+) strand; PAM type: YTN; PAM sequence: CTT
tgcctcaaaaccagcttgga

SEQ ID NO: 108678 - DNA, 20 bp, Artificial Sequence
  Description of Artificial Sequence: Synthetic oligonucleotide
  Target: SCN9A; (+) strand; PAM type: YTN; PAM sequence: TTT
gcctcaaaaccagcttggac

SEQ ID NO: 108679 - DNA, 20 bp, Artificial Sequence
  Description of Artificial Sequence: Synthetic oligonucleotide
  Target: SCN9A; (+) strand; PAM type: YTN; PAM sequence: TTG
cctcaaaaccagcttggact

SEQ ID NO: 108680 - DNA, 20 bp, Artificial Sequence
  Description of Artificial Sequence: Synthetic oligonucleotide
  Target: SCN9A; (+) strand; PAM type: YTN; PAM sequence: CTC
aaaaccagcttggactgctc

SEQ ID NO: 108681 - DNA, 20 bp, Artificial Sequence
  Description of Artificial Sequence: Synthetic oligonucleotide
  Target: SCN9A; (+) strand; PAM type: YTN; PAM sequence: CTT
ggactgctcctgtcatattt

SEQ ID NO: 108682 - DNA, 20 bp, Artificial Sequence
  Description of Artificial Sequence: Synthetic oligonucleotide
  Target: SCN9A; (+) strand; PAM type: YTN; PAM sequence: TTG
gactgctcctgtcatattta

SEQ ID NO: 108683 - DNA, 20 bp, Artificial Sequence
  Description of Artificial Sequence: Synthetic oligonucleotide
  Target: SCN9A; (+) strand; PAM type: YTN; PAM sequence: CTG
ctcctgtcatatttattttt

SEQ ID NO: 108684 - DNA, 20 bp, Artificial Sequence
  Description of Artificial Sequence: Synthetic oligonucleotide
  Target: SCN9A; (+) strand; PAM type: YTN; PAM sequence: CTC
ctgtcatatttatttttatt

SEQ ID NO: 108685 - DNA, 20 bp, Artificial Sequence
  Description of Artificial Sequence: Synthetic oligonucleotide
  Target: SCN9A; (+) strand; PAM type: YTN; PAM sequence: CTG
tcatatttatttttattgat

SEQ ID NO: 108686 - DNA, 20 bp, Artificial Sequence
  Description of Artificial Sequence: Synthetic oligonucleotide
  Target: SCN9A; (+) strand; PAM type: YTN; PAM sequence: TTT
atttttattgatatatgtgt

SEQ ID NO: 108687 - DNA, 20 bp, Artificial Sequence
  Description of Artificial Sequence: Synthetic oligonucleotide
  Target: SCN9A; (+) strand; PAM type: YTN; PAM sequence: TTA
tttttattgatatatgtgtc

SEQ ID NO: 108688 - DNA, 20 bp, Artificial Sequence
  Description of Artificial Sequence: Synthetic oligonucleotide
  Target: SCN9A; (+) strand; PAM type: YTN; PAM sequence: TTT
ttattgatatatgtgtccaa

SEQ ID NO: 108689 - DNA, 20 bp, Artificial Sequence
  Description of Artificial Sequence: Synthetic oligonucleotide
  Target: SCN9A; (+) strand; PAM type: YTN; PAM sequence: TTT
tattgatatatgtgtccaag

SEQ ID NO: 108690 - DNA, 20 bp, Artificial Sequence
  Description of Artificial Sequence: Synthetic oligonucleotide
  Target: SCN9A; (+) strand; PAM type: YTN; PAM sequence: TTT
attgatatatgtgtccaagt

SEQ ID NO: 108691 - DNA, 20 bp, Artificial Sequence
  Description of Artificial Sequence: Synthetic oligonucleotide
  Target: SCN9A; (+) strand; PAM type: YTN; PAM sequence: TTA
ttgatatatgtgtccaagtt

SEQ ID NO: 108692 - DNA, 20 bp, Artificial Sequence
  Description of Artificial Sequence: Synthetic oligonucleotide
  Target: SCN9A; (+) strand; PAM type: YTN; PAM sequence: TTG
atatatgtgtccaagttctg

SEQ ID NO: 108693 - DNA, 20 bp, Artificial Sequence
  Description of Artificial Sequence: Synthetic oligonucleotide
  Target: SCN9A; (+) strand; PAM type: YTN; PAM sequence: TTC
tgtatcatcacctaggttca

SEQ ID NO: 108694 - DNA, 20 bp, Artificial Sequence
  Description of Artificial Sequence: Synthetic oligonucleotide
  Target: SCN9A; (+) strand; PAM type: YTN; PAM sequence: CTG
tatcatcacctaggttcaag

SEQ ID NO: 108695 - DNA, 20 bp, Artificial Sequence
  Description of Artificial Sequence: Synthetic oligonucleotide
  Target: SCN9A; (+) strand; PAM type: YTN; PAM sequence: CTA
ggttcaagtgaaattttgaa

SEQ ID NO: 108696 - DNA, 20 bp, Artificial Sequence
  Description of Artificial Sequence: Synthetic oligonucleotide
  Target: SCN9A; (+) strand; PAM type: YTN; PAM sequence: TTC
aagtgaaattttgaaggcag

SEQ ID NO: 108697 - DNA, 20 bp, Artificial Sequence
  Description of Artificial Sequence: Synthetic oligonucleotide
  Target: SCN9A; (+) strand; PAM type: YTN; PAM sequence: TTT
tgaaggcagggactctatct

SEQ ID NO: 108698 - DNA, 20 bp, Artificial Sequence
  Description of Artificial Sequence: Synthetic oligonucleotide
  Target: SCN9A; (+) strand; PAM type: YTN; PAM sequence: TTT
gaaggcagggactctatctt

SEQ ID NO: 108699 - DNA, 20 bp, Artificial Sequence
  Description of Artificial Sequence: Synthetic oligonucleotide
  Target: SCN9A; (+) strand; PAM type: YTN; PAM sequence: TTG
aaggcagggactctatcttt

SEQ ID NO: 108700 - DNA, 20 bp, Artificial Sequence
  Description of Artificial Sequence: Synthetic oligonucleotide
  Target: SCN9A; (+) strand; PAM type: YTN; PAM sequence: CTC
tatctttttttactgtgtat

SEQ ID NO: 108701 - DNA, 20 bp, Artificial Sequence
  Description of Artificial Sequence: Synthetic oligonucleotide
  Target: SCN9A; (+) strand; PAM type: YTN; PAM sequence: CTA
tctttttttactgtgtatat

SEQ ID NO: 108702 - DNA, 20 bp, Artificial Sequence
  Description of Artificial Sequence: Synthetic oligonucleotide
  Target: SCN9A; (+) strand; PAM type: YTN; PAM sequence: CTT
tttttactgtgtatatcagg

SEQ ID NO: 108703 - DNA, 20 bp, Artificial Sequence
  Description of Artificial Sequence: Synthetic oligonucleotide
  Target: SCN9A; (+) strand; PAM type: YTN; PAM sequence: TTT
ttttactgtgtatatcagga

SEQ ID NO: 108704 - DNA, 20 bp, Artificial Sequence
  Description of Artificial Sequence: Synthetic oligonucleotide
  Target: SCN9A; (+) strand; PAM type: YTN; PAM sequence: TTT
tttactgtgtatatcaggag

SEQ ID NO: 108705 - DNA, 20 bp, Artificial Sequence
  Description of Artificial Sequence: Synthetic oligonucleotide
  Target: SCN9A; (+) strand; PAM type: YTN; PAM sequence: TTT
ttactgtgtatatcaggaga

SEQ ID NO: 108706 - DNA, 20 bp, Artificial Sequence
  Description of Artificial Sequence: Synthetic oligonucleotide
  Target: SCN9A; (+) strand; PAM type: YTN; PAM sequence: TTT
tactgtgtatatcaggagaa

SEQ ID NO: 108707 - DNA, 20 bp, Artificial Sequence
  Description of Artificial Sequence: Synthetic oligonucleotide
  Target: SCN9A; (+) strand; PAM type: YTN; PAM sequence: TTT
actgtgtatatcaggagaat

SEQ ID NO: 108708 - DNA, 20 bp, Artificial Sequence
  Description of Artificial Sequence: Synthetic oligonucleotide
  Target: SCN9A; (+) strand; PAM type: YTN; PAM sequence: TTA
ctgtgtatatcaggagaatc

SEQ ID NO: 108709 - DNA, 20 bp, Artificial Sequence
  Description of Artificial Sequence: Synthetic oligonucleotide
  Target: SCN9A; (+) strand; PAM type: YTN; PAM sequence: CTG
tgtatatcaggagaatcttg

SEQ ID NO: 108710 - DNA, 20 bp, Artificial Sequence
  Description of Artificial Sequence: Synthetic oligonucleotide
  Target: SCN9A; (+) strand; PAM type: YTN; PAM sequence: CTT
gtagatttttaactagattt

SEQ ID NO: 108711 - DNA, 20 bp, Artificial Sequence
  Description of Artificial Sequence: Synthetic oligonucleotide
  Target: SCN9A; (+) strand; PAM type: YTN; PAM sequence: TTG
tagatttttaactagatttt

SEQ ID NO: 108712 - DNA, 20 bp, Artificial Sequence
  Description of Artificial Sequence: Synthetic oligonucleotide
  Target: SCN9A; (+) strand; PAM type: YTN; PAM sequence: TTT
ttaactagatttttagttta

SEQ ID NO: 108713 - DNA, 20 bp, Artificial Sequence
  Description of Artificial Sequence: Synthetic oligonucleotide
  Target: SCN9A; (+) strand; PAM type: YTN; PAM sequence: TTT
taactagatttttagtttag

SEQ ID NO: 108714 - DNA, 20 bp, Artificial Sequence
  Description of Artificial Sequence: Synthetic oligonucleotide
  Target: SCN9A; (+) strand; PAM type: YTN; PAM sequence: TTT
aactagatttttagtttaga

SEQ ID NO: 108715 - DNA, 20 bp, Artificial Sequence
  Description of Artificial Sequence: Synthetic oligonucleotide
  Target: SCN9A; (+) strand; PAM type: YTN; PAM sequence: TTA
actagatttttagtttagaa

SEQ ID NO: 108716 - DNA, 20 bp, Artificial Sequence
  Description of Artificial Sequence: Synthetic oligonucleotide
  Target: SCN9A; (+) strand; PAM type: YTN; PAM sequence: CTA
gatttttagtttagaaaagt

SEQ ID NO: 108717 - DNA, 20 bp, Artificial Sequence
  Description of Artificial Sequence: Synthetic oligonucleotide
  Target: SCN9A; (+) strand; PAM type: YTN; PAM sequence: TTT
ttagtttagaaaagtgattt

SEQ ID NO: 108718 - DNA, 20 bp, Artificial Sequence
  Description of Artificial Sequence: Synthetic oligonucleotide
  Target: SCN9A; (+) strand; PAM type: YTN; PAM sequence: TTT
tagtttagaaaagtgatttg

SEQ ID NO: 108719 - DNA, 20 bp, Artificial Sequence
  Description of Artificial Sequence: Synthetic oligonucleotide
  Target: SCN9A; (+) strand; PAM type: YTN; PAM sequence: TTT
agtttagaaaagtgatttgt

SEQ ID NO: 108720 - DNA, 20 bp, Artificial Sequence
  Description of Artificial Sequence: Synthetic oligonucleotide
  Target: SCN9A; (+) strand; PAM type: YTN; PAM sequence: TTA
gtttagaaaagtgatttgtg

SEQ ID NO: 108721 - DNA, 20 bp, Artificial Sequence
  Description of Artificial Sequence: Synthetic oligonucleotide
  Target: SCN9A; (+) strand; PAM type: YTN; PAM sequence: TTT
agaaaagtgatttgtggggt

SEQ ID NO: 108722 - DNA, 20 bp, Artificial Sequence
  Description of Artificial Sequence: Synthetic oligonucleotide
  Target: SCN9A; (+) strand; PAM type: YTN; PAM sequence: TTA
gaaaagtgatttgtggggtt

SEQ ID NO: 108723 - DNA, 20 bp, Artificial Sequence
  Description of Artificial Sequence: Synthetic oligonucleotide
  Target: SCN9A; (+) strand; PAM type: YTN; PAM sequence: TTT
gtggggttgtgtgatggaaa

SEQ ID NO: 108724 - DNA, 20 bp, Artificial Sequence
  Description of Artificial Sequence: Synthetic oligonucleotide
  Target: SCN9A; (+) strand; PAM type: YTN; PAM sequence: TTG
tggggttgtgtgatggaaaa

SEQ ID NO: 108725 - DNA, 20 bp, Artificial Sequence
  Description of Artificial Sequence: Synthetic oligonucleotide
  Target: SCN9A; (+) strand; PAM type: YTN; PAM sequence: TTG
tgtgatggaaaacagggaag

SEQ ID NO: 108726 - DNA, 20 bp, Artificial Sequence
  Description of Artificial Sequence: Synthetic oligonucleotide
  Target: SCN9A; (+) strand; PAM type: YTN; PAM sequence: CTA
aggaaaacagaagcaatggt

SEQ ID NO: 108727 - DNA, 20 bp, Artificial Sequence
  Description of Artificial Sequence: Synthetic oligonucleotide
  Target: SCN9A; (+) strand; PAM type: YTN; PAM sequence: TTC
atcttggggatttgtgcaga

SEQ ID NO: 108728 - DNA, 20 bp, Artificial Sequence
  Description of Artificial Sequence: Synthetic oligonucleotide
  Target: SCN9A; (+) strand; PAM type: YTN; PAM sequence: CTT
ggggatttgtgcagaattat

SEQ ID NO: 108729 - DNA, 20 bp, Artificial Sequence
  Description of Artificial Sequence: Synthetic oligonucleotide
  Target: SCN9A; (+) strand; PAM type: YTN; PAM sequence: TTG
gggatttgtgcagaattata

SEQ ID NO: 108730 - DNA, 20 bp, Artificial Sequence
  Description of Artificial Sequence: Synthetic oligonucleotide
  Target: SCN9A; (+) strand; PAM type: YTN; PAM sequence: TTT
gtgcagaattataagcaggg

SEQ ID NO: 108731 - DNA, 20 bp, Artificial Sequence
  Description of Artificial Sequence: Synthetic oligonucleotide
  Target: SCN9A; (+) strand; PAM type: YTN; PAM sequence: TTG
tgcagaattataagcaggga

SEQ ID NO: 108732 - DNA, 20 bp, Artificial Sequence
  Description of Artificial Sequence: Synthetic oligonucleotide
  Target: SCN9A; (+) strand; PAM type: YTN; PAM sequence: TTA
taagcagggaggcctgagag

SEQ ID NO: 108733 - DNA, 20 bp, Artificial Sequence
  Description of Artificial Sequence: Synthetic oligonucleotide
  Target: SCN9A; (+) strand; PAM type: YTN; PAM sequence: CTG
agagatgaaggtttcagtga

SEQ ID NO: 108734 - DNA, 20 bp, Artificial Sequence
  Description of Artificial Sequence: Synthetic oligonucleotide
  Target: SCN9A; (+) strand; PAM type: YTN; PAM sequence: TTT
cagtgaaaagagaaagggaa

SEQ ID NO: 108735 - DNA, 20 bp, Artificial Sequence
  Description of Artificial Sequence: Synthetic oligonucleotide
  Target: SCN9A; (+) strand; PAM type: YTN; PAM sequence: TTC
agtgaaaagagaaagggaaa

SEQ ID NO: 108736 - DNA, 20 bp, Artificial Sequence
  Description of Artificial Sequence: Synthetic oligonucleotide
  Target: SCN9A; (+) strand; PAM type: YTN; PAM sequence: CTT
ccacataaacagaattaaca

SEQ ID NO: 108737 - DNA, 20 bp, Artificial Sequence
  Description of Artificial Sequence: Synthetic oligonucleotide
  Target: SCN9A; (+) strand; PAM type: YTN; PAM sequence: TTC
cacataaacagaattaacag

SEQ ID NO: 108738 - DNA, 20 bp, Artificial Sequence
  Description of Artificial Sequence: Synthetic oligonucleotide
  Target: SCN9A; (+) strand; PAM type: YTN; PAM sequence: TTA
acagactatggcactacata

SEQ ID NO: 108739 - DNA, 20 bp, Artificial Sequence
  Description of Artificial Sequence: Synthetic oligonucleotide
  Target: SCN9A; (+) strand; PAM type: YTN; PAM sequence: CTA
tggcactacatattagtagt

SEQ ID NO: 108740 - DNA, 20 bp, Artificial Sequence
  Description of Artificial Sequence: Synthetic oligonucleotide
  Target: SCN9A; (+) strand; PAM type: YTN; PAM sequence: CTA
catattagtagttgatgtgg

SEQ ID NO: 108741 - DNA, 20 bp, Artificial Sequence
  Description of Artificial Sequence: Synthetic oligonucleotide
  Target: SCN9A; (+) strand; PAM type: YTN; PAM sequence: TTA
gtagttgatgtggttggggg

SEQ ID NO: 108742 - DNA, 20 bp, Artificial Sequence
  Description of Artificial Sequence: Synthetic oligonucleotide
  Target: SCN9A; (+) strand; PAM type: YTN; PAM sequence: TTG
atgtggttgggggtggagga

SEQ ID NO: 108743 - DNA, 20 bp, Artificial Sequence
  Description of Artificial Sequence: Synthetic oligonucleotide
  Target: SCN9A; (+) strand; PAM type: YTN; PAM sequence: TTG
ggggtggaggatatcaaagg

SEQ ID NO: 108744 - DNA, 20 bp, Artificial Sequence
  Description of Artificial Sequence: Synthetic oligonucleotide
  Target: SCN9A; (+) strand; PAM type: YTN; PAM sequence: CTT
ctccaaagttccaaatgggt

SEQ ID NO: 108745 - DNA, 20 bp, Artificial Sequence
  Description of Artificial Sequence: Synthetic oligonucleotide
  Target: SCN9A; (+) strand; PAM type: YTN; PAM sequence: TTC
tccaaagttccaaatgggtg

SEQ ID NO: 108746 - DNA, 20 bp, Artificial Sequence
  Description of Artificial Sequence: Synthetic oligonucleotide
  Target: SCN9A; (+) strand; PAM type: YTN; PAM sequence: CTC
caaagttccaaatgggtgag

SEQ ID NO: 108747 - DNA, 20 bp, Artificial Sequence
  Description of Artificial Sequence: Synthetic oligonucleotide
  Target: SCN9A; (+) strand; PAM type: YTN; PAM sequence: TTC
caaatgggtgagtgatacta

SEQ ID NO: 108748 - DNA, 20 bp, Artificial Sequence
  Description of Artificial Sequence: Synthetic oligonucleotide
  Target: SCN9A; (+) strand; PAM type: YTN; PAM sequence: CTA
ttacctatactgtttaagaa

SEQ ID NO: 108749 - DNA, 20 bp, Artificial Sequence
  Description of Artificial Sequence: Synthetic oligonucleotide
  Target: SCN9A; (+) strand; PAM type: YTN; PAM sequence: TTA
cctatactgtttaagaaaga

SEQ ID NO: 108750 - DNA, 20 bp, Artificial Sequence
  Description of Artificial Sequence: Synthetic oligonucleotide
  Target: SCN9A; (+) strand; PAM type: YTN; PAM sequence: CTA
tactgtttaagaaagaagag

SEQ ID NO: 108751 - DNA, 20 bp, Artificial Sequence
  Description of Artificial Sequence: Synthetic oligonucleotide
  Target: SCN9A; (+) strand; PAM type: YTN; PAM sequence: CTG
tttaagaaagaagagaaact

SEQ ID NO: 108752 - DNA, 20 bp, Artificial Sequence
  Description of Artificial Sequence: Synthetic oligonucleotide
  Target: SCN9A; (+) strand; PAM type: YTN; PAM sequence: TTT
aagaaagaagagaaactagt

SEQ ID NO: 108753 - DNA, 20 bp, Artificial Sequence
  Description of Artificial Sequence: Synthetic oligonucleotide
  Target: SCN9A; (+) strand; PAM type: YTN; PAM sequence: TTA
agaaagaagagaaactagtc

SEQ ID NO: 108754 - DNA, 20 bp, Artificial Sequence
  Description of Artificial Sequence: Synthetic oligonucleotide
  Target: SCN9A; (+) strand; PAM type: YTN; PAM sequence: CTA
gtctaagattagtttttaac

SEQ ID NO: 108755 - DNA, 20 bp, Artificial Sequence
  Description of Artificial Sequence: Synthetic oligonucleotide
  Target: SCN9A; (+) strand; PAM type: YTN; PAM sequence: CTA
agattagtttttaaccaatg

SEQ ID NO: 108756 - DNA, 20 bp, Artificial Sequence
  Description of Artificial Sequence: Synthetic oligonucleotide
  Target: SCN9A; (+) strand; PAM type: YTN; PAM sequence: TTA
gtttttaaccaatgaagcat

SEQ ID NO: 108757 - DNA, 20 bp, Artificial Sequence
  Description of Artificial Sequence: Synthetic oligonucleotide
  Target: SCN9A; (+) strand; PAM type: YTN; PAM sequence: TTT
ttaaccaatgaagcattaca

SEQ ID NO: 108758 - DNA, 20 bp, Artificial Sequence
  Description of Artificial Sequence: Synthetic oligonucleotide
  Target: SCN9A; (+) strand; PAM type: YTN; PAM sequence: TTT
taaccaatgaagcattacaa

SEQ ID NO: 108759 - DNA, 20 bp, Artificial Sequence
  Description of Artificial Sequence: Synthetic oligonucleotide
  Target: SCN9A; (+) strand; PAM type: YTN; PAM sequence: TTT
aaccaatgaagcattacaaa

SEQ ID NO: 108760 - DNA, 20 bp, Artificial Sequence
  Description of Artificial Sequence: Synthetic oligonucleotide
  Target: SCN9A; (+) strand; PAM type: YTN; PAM sequence: TTA
accaatgaagcattacaaaa

SEQ ID NO: 108761 - DNA, 20 bp, Artificial Sequence
  Description of Artificial Sequence: Synthetic oligonucleotide
  Target: SCN9A; (+) strand; PAM type: YTN; PAM sequence: TTA
caaaacacagactaaataca

SEQ ID NO: 108762 - DNA, 20 bp, Artificial Sequence
  Description of Artificial Sequence: Synthetic oligonucleotide
  Target: SCN9A; (+) strand; PAM type: YTN; PAM sequence: CTA
aatacaaatataaaagttat

SEQ ID NO: 108763 - DNA, 20 bp, Artificial Sequence
  Description of Artificial Sequence: Synthetic oligonucleotide
  Target: SCN9A; (+) strand; PAM type: YTN; PAM sequence: TTA
ttctatagtgtgaatggtct

SEQ ID NO: 108764 - DNA, 20 bp, Artificial Sequence
  Description of Artificial Sequence: Synthetic oligonucleotide
  Target: SCN9A; (+) strand; PAM type: YTN; PAM sequence: TTC
tatagtgtgaatggtctctt

SEQ ID NO: 108765 - DNA, 20 bp, Artificial Sequence
  Description of Artificial Sequence: Synthetic oligonucleotide
  Target: SCN9A; (+) strand; PAM type: YTN; PAM sequence: CTA
tagtgtgaatggtctcttta

SEQ ID NO: 108766 - DNA, 20 bp, Artificial Sequence
  Description of Artificial Sequence: Synthetic oligonucleotide
  Target: SCN9A; (+) strand; PAM type: YTN; PAM sequence: CTC
tttatttctacaatggttct

SEQ ID NO: 108767 - DNA, 20 bp, Artificial Sequence
  Description of Artificial Sequence: Synthetic oligonucleotide
  Target: SCN9A; (+) strand; PAM type: YTN; PAM sequence: CTT
tatttctacaatggttctca

SEQ ID NO: 108768 - DNA, 20 bp, Artificial Sequence
  Description of Artificial Sequence: Synthetic oligonucleotide
  Target: SCN9A; (+) strand; PAM type: YTN; PAM sequence: TTT
atttctacaatggttctcag

SEQ ID NO: 108769 - DNA, 20 bp, Artificial Sequence
  Description of Artificial Sequence: Synthetic oligonucleotide
  Target: SCN9A; (+) strand; PAM type: YTN; PAM sequence: TTA
tttctacaatggttctcagg

SEQ ID NO: 108770 - DNA, 20 bp, Artificial Sequence
  Description of Artificial Sequence: Synthetic oligonucleotide
  Target: SCN9A; (+) strand; PAM type: YTN; PAM sequence: TTT
ctacaatggttctcaggaac

SEQ ID NO: 108771 - DNA, 20 bp, Artificial Sequence
  Description of Artificial Sequence: Synthetic oligonucleotide
  Target: SCN9A; (+) strand; PAM type: YTN; PAM sequence: TTC
tacaatggttctcaggaaca

SEQ ID NO: 108772 - DNA, 20 bp, Artificial Sequence
  Description of Artificial Sequence: Synthetic oligonucleotide
  Target: SCN9A; (+) strand; PAM type: YTN; PAM sequence: CTA
caatggttctcaggaacatt

SEQ ID NO: 108773 - DNA, 20 bp, Artificial Sequence
  Description of Artificial Sequence: Synthetic oligonucleotide
  Target: SCN9A; (+) strand; PAM type: YTN; PAM sequence: TTC
tcaggaacattttgcttctg

SEQ ID NO: 108774 - DNA, 20 bp, Artificial Sequence
  Description of Artificial Sequence: Synthetic oligonucleotide
  Target: SCN9A; (+) strand; PAM type: YTN; PAM sequence: CTC
aggaacattttgcttctgaa

SEQ ID NO: 108775 - DNA, 20 bp, Artificial Sequence
  Description of Artificial Sequence: Synthetic oligonucleotide
  Target: SCN9A; (+) strand; PAM type: YTN; PAM sequence: TTT
tgcttctgaaaattagttta

SEQ ID NO: 108776 - DNA, 20 bp, Artificial Sequence
  Description of Artificial Sequence: Synthetic oligonucleotide
  Target: SCN9A; (+) strand; PAM type: YTN; PAM sequence: TTT
gcttctgaaaattagtttat

SEQ ID NO: 108777 - DNA, 20 bp, Artificial Sequence
  Description of Artificial Sequence: Synthetic oligonucleotide
  Target: SCN9A; (+) strand; PAM type: YTN; PAM sequence: TTG
cttctgaaaattagtttatt

SEQ ID NO: 108778 - DNA, 20 bp, Artificial Sequence
  Description of Artificial Sequence: Synthetic oligonucleotide
  Target: SCN9A; (+) strand; PAM type: YTN; PAM sequence: CTT
ctgaaaattagtttattaga

SEQ ID NO: 108779 - DNA, 20 bp, Artificial Sequence
  Description of Artificial Sequence: Synthetic oligonucleotide
  Target: SCN9A; (+) strand; PAM type: YTN; PAM sequence: TTC
tgaaaattagtttattagag

SEQ ID NO: 108780 - DNA, 20 bp, Artificial Sequence
  Description of Artificial Sequence: Synthetic oligonucleotide
  Target: SCN9A; (+) strand; PAM type: YTN; PAM sequence: CTG
aaaattagtttattagagaa

SEQ ID NO: 108781 - DNA, 20 bp, Artificial Sequence
  Description of Artificial Sequence: Synthetic oligonucleotide
  Target: SCN9A; (+) strand; PAM type: YTN; PAM sequence: TTA
gtttattagagaatatattg

SEQ ID NO: 108782 - DNA, 20 bp, Artificial Sequence
  Description of Artificial Sequence: Synthetic oligonucleotide
  Target: SCN9A; (+) strand; PAM type: YTN; PAM sequence: TTT
attagagaatatattgacaa

SEQ ID NO: 108783 - DNA, 20 bp, Artificial Sequence
  Description of Artificial Sequence: Synthetic oligonucleotide
  Target: SCN9A; (+) strand; PAM type: YTN; PAM sequence: TTA
ttagagaatatattgacaat

SEQ ID NO: 108784 - DNA, 20 bp, Artificial Sequence
  Description of Artificial Sequence: Synthetic oligonucleotide
  Target: SCN9A; (+) strand; PAM type: YTN; PAM sequence: TTA
gagaatatattgacaattct

SEQ ID NO: 108785 - DNA, 20 bp, Artificial Sequence
  Description of Artificial Sequence: Synthetic oligonucleotide
  Target: SCN9A; (+) strand; PAM type: YTN; PAM sequence: TTG
acaattctgaaactataagg

SEQ ID NO: 108786 - DNA, 20 bp, Artificial Sequence
  Description of Artificial Sequence: Synthetic oligonucleotide
  Target: SCN9A; (+) strand; PAM type: YTN; PAM sequence: TTC
tgaaactataaggtctttca

SEQ ID NO: 108787 - DNA, 20 bp, Artificial Sequence
  Description of Artificial Sequence: Synthetic oligonucleotide
  Target: SCN9A; (+) strand; PAM type: YTN; PAM sequence: CTG
aaactataaggtctttcaaa

SEQ ID NO: 108788 - DNA, 20 bp, Artificial Sequence
  Description of Artificial Sequence: Synthetic oligonucleotide
  Target: SCN9A; (+) strand; PAM type: YTN; PAM sequence: CTA
taaggtctttcaaaaatgat

SEQ ID NO: 108789 - DNA, 20 bp, Artificial Sequence
  Description of Artificial Sequence: Synthetic oligonucleotide
  Target: SCN9A; (+) strand; PAM type: YTN; PAM sequence: CTT
tcaaaaatgattgaacccaa

SEQ ID NO: 108790 - DNA, 20 bp, Artificial Sequence
  Description of Artificial Sequence: Synthetic oligonucleotide
  Target: SCN9A; (+) strand; PAM type: YTN; PAM sequence: TTT
caaaaatgattgaacccaaa

SEQ ID NO: 108791 - DNA, 20 bp, Artificial Sequence
  Description of Artificial Sequence: Synthetic oligonucleotide
  Target: SCN9A; (+) strand; PAM type: YTN; PAM sequence: TTC
aaaaatgattgaacccaaat

SEQ ID NO: 108792 - DNA, 20 bp, Artificial Sequence
  Description of Artificial Sequence: Synthetic oligonucleotide
  Target: SCN9A; (+) strand; PAM type: YTN; PAM sequence: TTG
aacccaaatggaaacctgtg

SEQ ID NO: 108793 - DNA, 20 bp, Artificial Sequence
  Description of Artificial Sequence: Synthetic oligonucleotide
  Target: SCN9A; (+) strand; PAM type: YTN; PAM sequence: CTG
tgtacatctttccataaatg

SEQ ID NO: 108794 - DNA, 20 bp, Artificial Sequence
  Description of Artificial Sequence: Synthetic oligonucleotide
  Target: SCN9A; (+) strand; PAM type: YTN; PAM sequence: CTT
tccataaatgcctagcgata

SEQ ID NO: 108795 - DNA, 20 bp, Artificial Sequence
  Description of Artificial Sequence: Synthetic oligonucleotide
  Target: SCN9A; (+) strand; PAM type: YTN; PAM sequence: TTT
ccataaatgcctagcgatac

SEQ ID NO: 108796 - DNA, 20 bp, Artificial Sequence
  Description of Artificial Sequence: Synthetic oligonucleotide
  Target: SCN9A; (+) strand; PAM type: YTN; PAM sequence: TTC
cataaatgcctagcgatact

SEQ ID NO: 108797 - DNA, 20 bp, Artificial Sequence
  Description of Artificial Sequence: Synthetic oligonucleotide
  Target: SCN9A; (+) strand; PAM type: YTN; PAM sequence: CTA
gcgatactaggtttttacct

SEQ ID NO: 108798 - DNA, 20 bp, Artificial Sequence
  Description of Artificial Sequence: Synthetic oligonucleotide
  Target: SCN9A; (+) strand; PAM type: YTN; PAM sequence: CTA
ggtttttacctaaaatcata

SEQ ID NO: 108799 - DNA, 20 bp, Artificial Sequence
  Description of Artificial Sequence: Synthetic oligonucleotide
  Target: SCN9A; (+) strand; PAM type: YTN; PAM sequence: TTT
ttacctaaaatcataccaat

SEQ ID NO: 108800 - DNA, 20 bp, Artificial Sequence
  Description of Artificial Sequence: Synthetic oligonucleotide
  Target: SCN9A; (+) strand; PAM type: YTN; PAM sequence: TTT
tacctaaaatcataccaatg

SEQ ID NO: 108801 - DNA, 20 bp, Artificial Sequence
  Description of Artificial Sequence: Synthetic oligonucleotide
  Target: SCN9A; (+) strand; PAM type: YTN; PAM sequence: TTT
acctaaaatcataccaatga

SEQ ID NO: 108802 - DNA, 20 bp, Artificial Sequence
  Description of Artificial Sequence: Synthetic oligonucleotide
  Target: SCN9A; (+) strand; PAM type: YTN; PAM sequence: TTA
cctaaaatcataccaatgaa

SEQ ID NO: 108803 - DNA, 20 bp, Artificial Sequence
  Description of Artificial Sequence: Synthetic oligonucleotide
  Target: SCN9A; (+) strand; PAM type: YTN; PAM sequence: CTA
aaatcataccaatgaaatca

SEQ ID NO: 108804 - DNA, 20 bp, Artificial Sequence
  Description of Artificial Sequence: Synthetic oligonucleotide
  Target: SCN9A; (+) strand; PAM type: YTN; PAM sequence: CTC
actatcctctcccgagttct

SEQ ID NO: 108805 - DNA, 20 bp, Artificial Sequence
  Description of Artificial Sequence: Synthetic oligonucleotide
  Target: SCN9A; (+) strand; PAM type: YTN; PAM sequence: CTA
tcctctcccgagttctctta

SEQ ID NO: 108806 - DNA, 20 bp, Artificial Sequence
  Description of Artificial Sequence: Synthetic oligonucleotide
  Target: SCN9A; (+) strand; PAM type: YTN; PAM sequence: CTC
tcccgagttctcttacccta

SEQ ID NO: 108807 - DNA, 20 bp, Artificial Sequence
  Description of Artificial Sequence: Synthetic oligonucleotide
  Target: SCN9A; (+) strand; PAM type: YTN; PAM sequence: CTC
ccgagttctcttaccctaaa

SEQ ID NO: 108808 - DNA, 20 bp, Artificial Sequence
  Description of Artificial Sequence: Synthetic oligonucleotide
  Target: SCN9A; (+) strand; PAM type: YTN; PAM sequence: TTC
tcttaccctaaaataagaca

SEQ ID NO: 108809 - DNA, 20 bp, Artificial Sequence
  Description of Artificial Sequence: Synthetic oligonucleotide
  Target: SCN9A; (+) strand; PAM type: YTN; PAM sequence: CTC
ttaccctaaaataagacatt

SEQ ID NO: 108810 - DNA, 20 bp, Artificial Sequence
  Description of Artificial Sequence: Synthetic oligonucleotide
  Target: SCN9A; (+) strand; PAM type: YTN; PAM sequence: CTT
accctaaaataagacatttt

SEQ ID NO: 108811 - DNA, 20 bp, Artificial Sequence
  Description of Artificial Sequence: Synthetic oligonucleotide
  Target: SCN9A; (+) strand; PAM type: YTN; PAM sequence: TTA
ccctaaaataagacattttt

SEQ ID NO: 108812 - DNA, 20 bp, Artificial Sequence
  Description of Artificial Sequence: Synthetic oligonucleotide
  Target: SCN9A; (+) strand; PAM type: YTN; PAM sequence: CTA
aaataagacatttttctcta

SEQ ID NO: 108813 - DNA, 20 bp, Artificial Sequence
  Description of Artificial Sequence: Synthetic oligonucleotide
  Target: SCN9A; (+) strand; PAM type: YTN; PAM sequence: TTT
ttctctagcattctgcctcg

SEQ ID NO: 108814 - DNA, 20 bp, Artificial Sequence
  Description of Artificial Sequence: Synthetic oligonucleotide
  Target: SCN9A; (+) strand; PAM type: YTN; PAM sequence: TTT
tctctagcattctgcctcgg

SEQ ID NO: 108815 - DNA, 20 bp, Artificial Sequence
  Description of Artificial Sequence: Synthetic oligonucleotide
  Target: SCN9A; (+) strand; PAM type: YTN; PAM sequence: TTT
ctctagcattctgcctcggg

SEQ ID NO: 108816 - DNA, 20 bp, Artificial Sequence
  Description of Artificial Sequence: Synthetic oligonucleotide
  Target: SCN9A; (+) strand; PAM type: YTN; PAM sequence: TTC
tctagcattctgcctcgggt

SEQ ID NO: 108817 - DNA, 20 bp, Artificial Sequence
  Description of Artificial Sequence: Synthetic oligonucleotide
  Target: SCN9A; (+) strand; PAM type: YTN; PAM sequence: CTC
tagcattctgcctcgggtga

SEQ ID NO: 108818 - DNA, 20 bp, Artificial Sequence
  Description of Artificial Sequence: Synthetic oligonucleotide
  Target: SCN9A; (+) strand; PAM type: YTN; PAM sequence: CTA
gcattctgcctcgggtgata

SEQ ID NO: 108819 - DNA, 20 bp, Artificial Sequence
  Description of Artificial Sequence: Synthetic oligonucleotide
  Target: SCN9A; (+) strand; PAM type: YTN; PAM sequence: TTC
tgcctcgggtgatacacatt

SEQ ID NO: 108820 - DNA, 20 bp, Artificial Sequence
  Description of Artificial Sequence: Synthetic oligonucleotide
  Target: SCN9A; (+) strand; PAM type: YTN; PAM sequence: CTG
cctcgggtgatacacattta

SEQ ID NO: 108821 - DNA, 20 bp, Artificial Sequence
  Description of Artificial Sequence: Synthetic oligonucleotide
  Target: SCN9A; (+) strand; PAM type: YTN; PAM sequence: CTC
gggtgatacacatttagcaa

SEQ ID NO: 108822 - DNA, 20 bp, Artificial Sequence
  Description of Artificial Sequence: Synthetic oligonucleotide
  Target: SCN9A; (+) strand; PAM type: YTN; PAM sequence: TTT
agcaatttgggtggtacctg

SEQ ID NO: 108823 - DNA, 20 bp, Artificial Sequence
  Description of Artificial Sequence: Synthetic oligonucleotide
  Target: SCN9A; (+) strand; PAM type: YTN; PAM sequence: TTA
gcaatttgggtggtacctga

SEQ ID NO: 108824 - DNA, 20 bp, Artificial Sequence
  Description of Artificial Sequence: Synthetic oligonucleotide
  Target: SCN9A; (+) strand; PAM type: YTN; PAM sequence: TTT
gggtggtacctgattggggg

SEQ ID NO: 108825 - DNA, 20 bp, Artificial Sequence
  Description of Artificial Sequence: Synthetic oligonucleotide
  Target: SCN9A; (+) strand; PAM type: YTN; PAM sequence: TTG
ggtggtacctgattgggggt

SEQ ID NO: 108826 - DNA, 20 bp, Artificial Sequence
  Description of Artificial Sequence: Synthetic oligonucleotide
  Target: SCN9A; (+) strand; PAM type: YTN; PAM sequence: CTG
attgggggtagacaacctct

SEQ ID NO: 108827 - DNA, 20 bp, Artificial Sequence
  Description of Artificial Sequence: Synthetic oligonucleotide
  Target: SCN9A; (+) strand; PAM type: YTN; PAM sequence: TTG
ggggtagacaacctcttttc

SEQ ID NO: 108828 - DNA, 20 bp, Artificial Sequence
  Description of Artificial Sequence: Synthetic oligonucleotide
  Target: SCN9A; (+) strand; PAM type: YTN; PAM sequence: CTC
ttttcatgtgctcgcctatg

SEQ ID NO: 108829 - DNA, 20 bp, Artificial Sequence
  Description of Artificial Sequence: Synthetic oligonucleotide
  Target: SCN9A; (+) strand; PAM type: YTN; PAM sequence: CTT
ttcatgtgctcgcctatgcc

SEQ ID NO: 108830 - DNA, 20 bp, Artificial Sequence
  Description of Artificial Sequence: Synthetic oligonucleotide
  Target: SCN9A; (+) strand; PAM type: YTN; PAM sequence: TTT
tcatgtgctcgcctatgccc

SEQ ID NO: 108831 - DNA, 20 bp, Artificial Sequence
  Description of Artificial Sequence: Synthetic oligonucleotide
  Target: SCN9A; (+) strand; PAM type: YTN; PAM sequence: TTT
catgtgctcgcctatgccct

SEQ ID NO: 108832 - DNA, 20 bp, Artificial Sequence
  Description of Artificial Sequence: Synthetic oligonucleotide
  Target: SCN9A; (+) strand; PAM type: YTN; PAM sequence: TTC
atgtgctcgcctatgccctt

SEQ ID NO: 108833 - DNA, 20 bp, Artificial Sequence
  Description of Artificial Sequence: Synthetic oligonucleotide
  Target: SCN9A; (+) strand; PAM type: YTN; PAM sequence: CTC
gcctatgcccttcgacacca

SEQ ID NO: 108834 - DNA, 20 bp, Artificial Sequence
  Description of Artificial Sequence: Synthetic oligonucleotide
  Target: SCN9A; (+) strand; PAM type: YTN; PAM sequence: CTA
tgcccttcgacaccaaggtg

SEQ ID NO: 108835 - DNA, 20 bp, Artificial Sequence
  Description of Artificial Sequence: Synthetic oligonucleotide
  Target: SCN9A; (+) strand; PAM type: YTN; PAM sequence: CTT
cgacaccaaggtggaaactt

SEQ ID NO: 108836 - DNA, 20 bp, Artificial Sequence
  Description of Artificial Sequence: Synthetic oligonucleotide
  Target: SCN9A; (+) strand; PAM type: YTN; PAM sequence: TTC
gacaccaaggtggaaacttt

SEQ ID NO: 108837 - DNA, 20 bp, Artificial Sequence
  Description of Artificial Sequence: Synthetic oligonucleotide
  Target: SCN9A; (+) strand; PAM type: YTN; PAM sequence: CTT
tttcttctgatgctgtcctc

SEQ ID NO: 108838 - DNA, 20 bp, Artificial Sequence
  Description of Artificial Sequence: Synthetic oligonucleotide
  Target: SCN9A; (+) strand; PAM type: YTN; PAM sequence: TTT
ttcttctgatgctgtcctct

SEQ ID NO: 108839 - DNA, 20 bp, Artificial Sequence
  Description of Artificial Sequence: Synthetic oligonucleotide
  Target: SCN9A; (+) strand; PAM type: YTN; PAM sequence: TTT
tcttctgatgctgtcctctg

SEQ ID NO: 108840 - DNA, 20 bp, Artificial Sequence
  Description of Artificial Sequence: Synthetic oligonucleotide
  Target: SCN9A; (+) strand; PAM type: YTN; PAM sequence: TTT
cttctgatgctgtcctctga

SEQ ID NO: 108841 - DNA, 20 bp, Artificial Sequence
  Description of Artificial Sequence: Synthetic oligonucleotide
  Target: SCN9A; (+) strand; PAM type: YTN; PAM sequence: TTC
ttctgatgctgtcctctgat

SEQ ID NO: 108842 - DNA, 20 bp, Artificial Sequence
  Description of Artificial Sequence: Synthetic oligonucleotide
  Target: SCN9A; (+) strand; PAM type: YTN; PAM sequence: CTT
ctgatgctgtcctctgattc

SEQ ID NO: 108843 - DNA, 20 bp, Artificial Sequence
  Description of Artificial Sequence: Synthetic oligonucleotide
  Target: SCN9A; (+) strand; PAM type: YTN; PAM sequence: TTC
tgatgctgtcctctgattct

SEQ ID NO: 108844 - DNA, 20 bp, Artificial Sequence
  Description of Artificial Sequence: Synthetic oligonucleotide
  Target: SCN9A; (+) strand; PAM type: YTN; PAM sequence: CTG
atgctgtcctctgattctga

SEQ ID NO: 108845 - DNA, 20 bp, Artificial Sequence
  Description of Artificial Sequence: Synthetic oligonucleotide
  Target: SCN9A; (+) strand; PAM type: YTN; PAM sequence: CTG
tcctctgattctgatttcga

SEQ ID NO: 108846 - DNA, 20 bp, Artificial Sequence
  Description of Artificial Sequence: Synthetic oligonucleotide
  Target: SCN9A; (+) strand; PAM type: YTN; PAM sequence: CTC
tgattctgatttcgacaatt

SEQ ID NO: 108847 - DNA, 20 bp, Artificial Sequence
  Description of Artificial Sequence: Synthetic oligonucleotide
  Target: SCN9A; (+) strand; PAM type: YTN; PAM sequence: CTG
attctgatttcgacaatttc

SEQ ID NO: 108848 - DNA, 20 bp, Artificial Sequence
  Description of Artificial Sequence: Synthetic oligonucleotide
  Target: SCN9A; (+) strand; PAM type: YTN; PAM sequence: TTC
tgatttcgacaatttctcag

SEQ ID NO: 108849 - DNA, 20 bp, Artificial Sequence
  Description of Artificial Sequence: Synthetic oligonucleotide
  Target: SCN9A; (+) strand; PAM type: YTN; PAM sequence: CTG
atttcgacaatttctcagca

SEQ ID NO: 108850 - DNA, 20 bp, Artificial Sequence
  Description of Artificial Sequence: Synthetic oligonucleotide
  Target: SCN9A; (+) strand; PAM type: YTN; PAM sequence: TTT
cgacaatttctcagcatctc

SEQ ID NO: 108851 - DNA, 20 bp, Artificial Sequence
  Description of Artificial Sequence: Synthetic oligonucleotide
  Target: SCN9A; (+) strand; PAM type: YTN; PAM sequence: TTC
gacaatttctcagcatctcc

SEQ ID NO: 108852 - DNA, 20 bp, Artificial Sequence
  Description of Artificial Sequence: Synthetic oligonucleotide
  Target: SCN9A; (+) strand; PAM type: YTN; PAM sequence: TTT
ctcagcatctcccttttcct

SEQ ID NO: 108853 - DNA, 20 bp, Artificial Sequence
  Description of Artificial Sequence: Synthetic oligonucleotide
  Target: SCN9A; (+) strand; PAM type: YTN; PAM sequence: TTC
tcagcatctcccttttcctc

SEQ ID NO: 108854 - DNA, 20 bp, Artificial Sequence
  Description of Artificial Sequence: Synthetic oligonucleotide
  Target: SCN9A; (+) strand; PAM type: YTN; PAM sequence: CTC
agcatctcccttttcctctc

SEQ ID NO: 108855 - DNA, 20 bp, Artificial Sequence
  Description of Artificial Sequence: Synthetic oligonucleotide
  Target: SCN9A; (+) strand; PAM type: YTN; PAM sequence: CTC
ccttttcctctccactggag

SEQ ID NO: 108856 - DNA, 20 bp, Artificial Sequence
  Description of Artificial Sequence: Synthetic oligonucleotide
  Target: SCN9A; (+) strand; PAM type: YTN; PAM sequence: CTT
ttcctctccactggagagct

SEQ ID NO: 108857 - DNA, 20 bp, Artificial Sequence
  Description of Artificial Sequence: Synthetic oligonucleotide
  Target: SCN9A; (+) strand; PAM type: YTN; PAM sequence: TTT
tcctctccactggagagctt

SEQ ID NO: 108858 - DNA, 20 bp, Artificial Sequence
  Description of Artificial Sequence: Synthetic oligonucleotide
  Target: SCN9A; (+) strand; PAM type: YTN; PAM sequence: TTT
cctctccactggagagcttc

SEQ ID NO: 108859 - DNA, 20 bp, Artificial Sequence
  Description of Artificial Sequence: Synthetic oligonucleotide
  Target: SCN9A; (+) strand; PAM type: YTN; PAM sequence: TTC
ctctccactggagagcttct

SEQ ID NO: 108860 - DNA, 20 bp, Artificial Sequence
  Description of Artificial Sequence: Synthetic oligonucleotide
  Target: SCN9A; (+) strand; PAM type: YTN; PAM sequence: CTC
tccactggagagcttctttt

SEQ ID NO: 108861 - DNA, 20 bp, Artificial Sequence
  Description of Artificial Sequence: Synthetic oligonucleotide
  Target: SCN9A; (+) strand; PAM type: YTN; PAM sequence: CTC
cactggagagcttcttttga

SEQ ID NO: 108862 - DNA, 20 bp, Artificial Sequence
  Description of Artificial Sequence: Synthetic oligonucleotide
  Target: SCN9A; (+) strand; PAM type: YTN; PAM sequence: CTG
gagagcttcttttgattctt

SEQ ID NO: 108863 - DNA, 20 bp, Artificial Sequence
  Description of Artificial Sequence: Synthetic oligonucleotide
  Target: SCN9A; (+) strand; PAM type: YTN; PAM sequence: CTT
cttttgattctttttctttc

SEQ ID NO: 108864 - DNA, 20 bp, Artificial Sequence
  Description of Artificial Sequence: Synthetic oligonucleotide
  Target: SCN9A; (+) strand; PAM type: YTN; PAM sequence: TTC
ttttgattctttttctttct

SEQ ID NO: 108865 - DNA, 20 bp, Artificial Sequence
  Description of Artificial Sequence: Synthetic oligonucleotide
  Target: SCN9A; (+) strand; PAM type: YTN; PAM sequence: CTT
ttgattctttttctttcttc

SEQ ID NO: 108866 - DNA, 20 bp, Artificial Sequence
  Description of Artificial Sequence: Synthetic oligonucleotide
  Target: SCN9A; (+) strand; PAM type: YTN; PAM sequence: TTT
tgattctttttctttcttct

SEQ ID NO: 108867 - DNA, 20 bp, Artificial Sequence
  Description of Artificial Sequence: Synthetic oligonucleotide
  Target: SCN9A; (+) strand; PAM type: YTN; PAM sequence: TTT
gattctttttctttcttctg

SEQ ID NO: 108868 - DNA, 20 bp, Artificial Sequence
  Description of Artificial Sequence: Synthetic oligonucleotide
  Target: SCN9A; (+) strand; PAM type: YTN; PAM sequence: TTG
attctttttctttcttctgt

SEQ ID NO: 108869 - DNA, 20 bp, Artificial Sequence
  Description of Artificial Sequence: Synthetic oligonucleotide
  Target: SCN9A; (+) strand; PAM type: YTN; PAM sequence: TTC
tttttctttcttctgtttct

SEQ ID NO: 108870 - DNA, 20 bp, Artificial Sequence
  Description of Artificial Sequence: Synthetic oligonucleotide
  Target: SCN9A; (+) strand; PAM type: YTN; PAM sequence: CTT
tttctttcttctgtttcttc

SEQ ID NO: 108871 - DNA, 20 bp, Artificial Sequence
  Description of Artificial Sequence: Synthetic oligonucleotide
  Target: SCN9A; (+) strand; PAM type: YTN; PAM sequence: TTT
ttctttcttctgtttcttct

SEQ ID NO: 108872 - DNA, 20 bp, Artificial Sequence
  Description of Artificial Sequence: Synthetic oligonucleotide
  Target: SCN9A; (+) strand; PAM type: YTN; PAM sequence: TTT
tctttcttctgtttcttctt

SEQ ID NO: 108873 - DNA, 20 bp, Artificial Sequence
  Description of Artificial Sequence: Synthetic oligonucleotide
  Target: SCN9A; (+) strand; PAM type: YTN; PAM sequence: TTT
ctttcttctgtttcttcttt

SEQ ID NO: 108874 - DNA, 20 bp, Artificial Sequence
  Description of Artificial Sequence: Synthetic oligonucleotide
  Target: SCN9A; (+) strand; PAM type: YTN; PAM sequence: TTC
tttcttctgtttcttctttc

SEQ ID NO: 108875 - DNA, 20 bp, Artificial Sequence
  Description of Artificial Sequence: Synthetic oligonucleotide
  Target: SCN9A; (+) strand; PAM type: YTN; PAM sequence: CTT
tcttctgtttcttctttctt

SEQ ID NO: 108876 - DNA, 20 bp, Artificial Sequence
  Description of Artificial Sequence: Synthetic oligonucleotide
  Target: SCN9A; (+) strand; PAM type: YTN; PAM sequence: TTT
cttctgtttcttctttcttt

SEQ ID NO: 108877 - DNA, 20 bp, Artificial Sequence
  Description of Artificial Sequence: Synthetic oligonucleotide
  Target: SCN9A; (+) strand; PAM type: YTN; PAM sequence: TTC
ttctgtttcttctttcttta

SEQ ID NO: 108878 - DNA, 20 bp, Artificial Sequence
  Description of Artificial Sequence: Synthetic oligonucleotide
  Target: SCN9A; (+) strand; PAM type: YTN; PAM sequence: CTT
ctgtttcttctttctttagc

SEQ ID NO: 108879 - DNA, 20 bp, Artificial Sequence
  Description of Artificial Sequence: Synthetic oligonucleotide
  Target: SCN9A; (+) strand; PAM type: YTN; PAM sequence: TTC
tgtttcttctttctttagca

SEQ ID NO: 108880 - DNA, 20 bp, Artificial Sequence
  Description of Artificial Sequence: Synthetic oligonucleotide
  Target: SCN9A; (+) strand; PAM type: YTN; PAM sequence: CTG
tttcttctttctttagcact

SEQ ID NO: 108881 - DNA, 20 bp, Artificial Sequence
  Description of Artificial Sequence: Synthetic oligonucleotide
  Target: SCN9A; (+) strand; PAM type: YTN; PAM sequence: TTT
cttctttctttagcactttt

SEQ ID NO: 108882 - DNA, 20 bp, Artificial Sequence
  Description of Artificial Sequence: Synthetic oligonucleotide
  Target: SCN9A; (+) strand; PAM type: YTN; PAM sequence: TTC
ttctttctttagcactttta

SEQ ID NO: 108883 - DNA, 20 bp, Artificial Sequence
  Description of Artificial Sequence: Synthetic oligonucleotide
  Target: SCN9A; (+) strand; PAM type: YTN; PAM sequence: CTT
ctttctttagcacttttaga

SEQ ID NO: 108884 - DNA, 20 bp, Artificial Sequence
  Description of Artificial Sequence: Synthetic oligonucleotide
  Target: SCN9A; (+) strand; PAM type: YTN; PAM sequence: TTC
tttctttagcacttttagag

SEQ ID NO: 108885 - DNA, 20 bp, Artificial Sequence
  Description of Artificial Sequence: Synthetic oligonucleotide
  Target: SCN9A; (+) strand; PAM type: YTN; PAM sequence: CTT
tctttagcacttttagagct

SEQ ID NO: 108886 - DNA, 20 bp, Artificial Sequence
  Description of Artificial Sequence: Synthetic oligonucleotide
  Target: SCN9A; (+) strand; PAM type: YTN; PAM sequence: TTT
ctttagcacttttagagctc

SEQ ID NO: 108887 - DNA, 20 bp, Artificial Sequence
  Description of Artificial Sequence: Synthetic oligonucleotide
  Target: SCN9A; (+) strand; PAM type: YTN; PAM sequence: TTC
tttagcacttttagagctca

SEQ ID NO: 108888 - DNA, 20 bp, Artificial Sequence
  Description of Artificial Sequence: Synthetic oligonucleotide
  Target: SCN9A; (+) strand; PAM type: YTN; PAM sequence: CTT
tagcacttttagagctcagt

SEQ ID NO: 108889 - DNA, 20 bp, Artificial Sequence
  Description of Artificial Sequence: Synthetic oligonucleotide
  Target: SCN9A; (+) strand; PAM type: YTN; PAM sequence: TTT
agcacttttagagctcagtt

SEQ ID NO: 108890 - DNA, 20 bp, Artificial Sequence
  Description of Artificial Sequence: Synthetic oligonucleotide
  Target: SCN9A; (+) strand; PAM type: YTN; PAM sequence: TTA
gcacttttagagctcagttt

SEQ ID NO: 108891 - DNA, 20 bp, Artificial Sequence
  Description of Artificial Sequence: Synthetic oligonucleotide
  Target: SCN9A; (+) strand; PAM type: YTN; PAM sequence: CTT
ttagagctcagtttggatgt

SEQ ID NO: 108892 - DNA, 20 bp, Artificial Sequence
  Description of Artificial Sequence: Synthetic oligonucleotide
  Target: SCN9A; (+) strand; PAM type: YTN; PAM sequence: TTT
tagagctcagtttggatgtt

SEQ ID NO: 108893 - DNA, 20 bp, Artificial Sequence
  Description of Artificial Sequence: Synthetic oligonucleotide
  Target: SCN9A; (+) strand; PAM type: YTN; PAM sequence: TTT
agagctcagtttggatgttt

SEQ ID NO: 108894 - DNA, 20 bp, Artificial Sequence
  Description of Artificial Sequence: Synthetic oligonucleotide
  Target: SCN9A; (+) strand; PAM type: YTN; PAM sequence: TTA
gagctcagtttggatgtttc

SEQ ID NO: 108895 - DNA, 20 bp, Artificial Sequence
  Description of Artificial Sequence: Synthetic oligonucleotide
  Target: SCN9A; (+) strand; PAM type: YTN; PAM sequence: CTC
agtttggatgtttcagaaga

SEQ ID NO: 108896 - DNA, 20 bp, Artificial Sequence
  Description of Artificial Sequence: Synthetic oligonucleotide
  Target: SCN9A; (+) strand; PAM type: YTN; PAM sequence: TTT
ggatgtttcagaagaactct

SEQ ID NO: 108897 - DNA, 20 bp, Artificial Sequence
  Description of Artificial Sequence: Synthetic oligonucleotide
  Target: SCN9A; (+) strand; PAM type: YTN; PAM sequence: TTG
gatgtttcagaagaactctc

SEQ ID NO: 108898 - DNA, 20 bp, Artificial Sequence
  Description of Artificial Sequence: Synthetic oligonucleotide
  Target: SCN9A; (+) strand; PAM type: YTN; PAM sequence: TTT
cagaagaactctctgagagg

SEQ ID NO: 108899 - DNA, 20 bp, Artificial Sequence
  Description of Artificial Sequence: Synthetic oligonucleotide
  Target: SCN9A; (+) strand; PAM type: YTN; PAM sequence: TTC
agaagaactctctgagaggc

SEQ ID NO: 108900 - DNA, 20 bp, Artificial Sequence
  Description of Artificial Sequence: Synthetic oligonucleotide
  Target: SCN9A; (+) strand; PAM type: YTN; PAM sequence: CTC
tctgagaggcccataattct

SEQ ID NO: 108901 - DNA, 20 bp, Artificial Sequence
  Description of Artificial Sequence: Synthetic oligonucleotide
  Target: SCN9A; (+) strand; PAM type: YTN; PAM sequence: CTC
tgagaggcccataattctgc

SEQ ID NO: 108902 - DNA, 20 bp, Artificial Sequence
  Description of Artificial Sequence: Synthetic oligonucleotide
  Target: SCN9A; (+) strand; PAM type: YTN; PAM sequence: CTG
agaggcccataattctgctt

SEQ ID NO: 108903 - DNA, 20 bp, Artificial Sequence
  Description of Artificial Sequence: Synthetic oligonucleotide
  Target: SCN9A; (+) strand; PAM type: YTN; PAM sequence: TTC
tgcttctcctaatacttgta

SEQ ID NO: 108904 - DNA, 20 bp, Artificial Sequence
  Description of Artificial Sequence: Synthetic oligonucleotide
  Target: SCN9A; (+) strand; PAM type: YTN; PAM sequence: CTG
cttctcctaatacttgtata

SEQ ID NO: 108905 - DNA, 20 bp, Artificial Sequence
  Description of Artificial Sequence: Synthetic oligonucleotide
  Target: SCN9A; (+) strand; PAM type: YTN; PAM sequence: CTT
ctcctaatacttgtatattc

SEQ ID NO: 108906 - DNA, 20 bp, Artificial Sequence
  Description of Artificial Sequence: Synthetic oligonucleotide
  Target: SCN9A; (+) strand; PAM type: YTN; PAM sequence: TTC
tcctaatacttgtatattca

SEQ ID NO: 108907 - DNA, 20 bp, Artificial Sequence
  Description of Artificial Sequence: Synthetic oligonucleotide
  Target: SCN9A; (+) strand; PAM type: YTN; PAM sequence: CTC
ctaatacttgtatattcagc

SEQ ID NO: 108908 - DNA, 20 bp, Artificial Sequence
  Description of Artificial Sequence: Synthetic oligonucleotide
  Target: SCN9A; (+) strand; PAM type: YTN; PAM sequence: CTA
atacttgtatattcagccgc

SEQ ID NO: 108909 - DNA, 20 bp, Artificial Sequence
  Description of Artificial Sequence: Synthetic oligonucleotide
  Target: SCN9A; (+) strand; PAM type: YTN; PAM sequence: CTT
gtatattcagccgctgccgc

SEQ ID NO: 108910 - DNA, 20 bp, Artificial Sequence
  Description of Artificial Sequence: Synthetic oligonucleotide
  Target: SCN9A; (+) strand; PAM type: YTN; PAM sequence: TTG
tatattcagccgctgccgct

SEQ ID NO: 108911 - DNA, 20 bp, Artificial Sequence
  Description of Artificial Sequence: Synthetic oligonucleotide
  Target: SCN9A; (+) strand; PAM type: YTN; PAM sequence: TTC
agccgctgccgctgcaattg

SEQ ID NO: 108912 - DNA, 20 bp, Artificial Sequence
  Description of Artificial Sequence: Synthetic oligonucleotide
  Target: SCN9A; (+) strand; PAM type: YTN; PAM sequence: CTG
ccgctgcaattgcctggttg

SEQ ID NO: 108913 - DNA, 20 bp, Artificial Sequence
  Description of Artificial Sequence: Synthetic oligonucleotide
  Target: SCN9A; (+) strand; PAM type: YTN; PAM sequence: CTG
caattgcctggttgggccaa

SEQ ID NO: 108914 - DNA, 20 bp, Artificial Sequence
  Description of Artificial Sequence: Synthetic oligonucleotide
  Target: SCN9A; (+) strand; PAM type: YTN; PAM sequence: TTG
cctggttgggccaagacgtt

SEQ ID NO: 108915 - DNA, 20 bp, Artificial Sequence
  Description of Artificial Sequence: Synthetic oligonucleotide
  Target: SCN9A; (+) strand; PAM type: YTN; PAM sequence: CTG
gttgggccaagacgttaaca

SEQ ID NO: 108916 - DNA, 20 bp, Artificial Sequence
  Description of Artificial Sequence: Synthetic oligonucleotide
  Target: SCN9A; (+) strand; PAM type: YTN; PAM sequence: TTG
ggccaagacgttaacactta

SEQ ID NO: 108917 - DNA, 20 bp, Artificial Sequence
  Description of Artificial Sequence: Synthetic oligonucleotide
  Target: SCN9A; (+) strand; PAM type: YTN; PAM sequence: TTA
acacttaaatgagtcatttc

SEQ ID NO: 108918 - DNA, 20 bp, Artificial Sequence
  Description of Artificial Sequence: Synthetic oligonucleotide
  Target: SCN9A; (+) strand; PAM type: YTN; PAM sequence: CTT
aaatgagtcatttccaaatc

SEQ ID NO: 108919 - DNA, 20 bp, Artificial Sequence
  Description of Artificial Sequence: Synthetic oligonucleotide
  Target: SCN9A; (+) strand; PAM type: YTN; PAM sequence: TTA
aatgagtcatttccaaatcc

SEQ ID NO: 108920 - DNA, 20 bp, Artificial Sequence
  Description of Artificial Sequence: Synthetic oligonucleotide
  Target: SCN9A; (+) strand; PAM type: YTN; PAM sequence: TTT
ccaaatcctaggaaacccta

SEQ ID NO: 108921 - DNA, 20 bp, Artificial Sequence
  Description of Artificial Sequence: Synthetic oligonucleotide
  Target: SCN9A; (+) strand; PAM type: YTN; PAM sequence: TTC
caaatcctaggaaaccctag

SEQ ID NO: 108922 - DNA, 20 bp, Artificial Sequence
  Description of Artificial Sequence: Synthetic oligonucleotide
  Target: SCN9A; (+) strand; PAM type: YTN; PAM sequence: CTA
ggaaaccctaggacaggaca

SEQ ID NO: 108923 - DNA, 20 bp, Artificial Sequence
  Description of Artificial Sequence: Synthetic oligonucleotide
  Target: SCN9A; (+) strand; PAM type: YTN; PAM sequence: CTA
ggacaggacatctttcacct

SEQ ID NO: 108924 - DNA, 20 bp, Artificial Sequence
  Description of Artificial Sequence: Synthetic oligonucleotide
  Target: SCN9A; (+) strand; PAM type: YTN; PAM sequence: CTT
tcacctattagcataacaac

SEQ ID NO: 108925 - DNA, 20 bp, Artificial Sequence
  Description of Artificial Sequence: Synthetic oligonucleotide
  Target: SCN9A; (+) strand; PAM type: YTN; PAM sequence: TTT
cacctattagcataacaaca

SEQ ID NO: 108926 - DNA, 20 bp, Artificial Sequence
  Description of Artificial Sequence: Synthetic oligonucleotide
  Target: SCN9A; (+) strand; PAM type: YTN; PAM sequence: TTC
acctattagcataacaacat

SEQ ID NO: 108927 - DNA, 20 bp, Artificial Sequence
  Description of Artificial Sequence: Synthetic oligonucleotide
  Target: SCN9A; (+) strand; PAM type: YTN; PAM sequence: CTA
ttagcataacaacatggtgc

SEQ ID NO: 108928 - DNA, 20 bp, Artificial Sequence
  Description of Artificial Sequence: Synthetic oligonucleotide
  Target: SCN9A; (+) strand; PAM type: YTN; PAM sequence: TTA
gcataacaacatggtgcata

SEQ ID NO: 108929 - DNA, 20 bp, Artificial Sequence
  Description of Artificial Sequence: Synthetic oligonucleotide
  Target: SCN9A; (+) strand; PAM type: YTN; PAM sequence: CTT
taaacatgaaatgatcgttt

SEQ ID NO: 108930 - DNA, 20 bp, Artificial Sequence
  Description of Artificial Sequence: Synthetic oligonucleotide
  Target: SCN9A; (+) strand; PAM type: YTN; PAM sequence: TTT
aaacatgaaatgatcgtttt

SEQ ID NO: 108931 - DNA, 20 bp, Artificial Sequence
  Description of Artificial Sequence: Synthetic oligonucleotide
  Target: SCN9A; (+) strand; PAM type: YTN; PAM sequence: TTA
aacatgaaatgatcgttttc

SEQ ID NO: 108932 - DNA, 20 bp, Artificial Sequence
  Description of Artificial Sequence: Synthetic oligonucleotide
  Target: SCN9A; (+) strand; PAM type: YTN; PAM sequence: TTT
tctttacacaatgatcagaa

SEQ ID NO: 108933 - DNA, 20 bp, Artificial Sequence
  Description of Artificial Sequence: Synthetic oligonucleotide
  Target: SCN9A; (+) strand; PAM type: YTN; PAM sequence: TTT
ctttacacaatgatcagaat

SEQ ID NO: 108934 - DNA, 20 bp, Artificial Sequence
  Description of Artificial Sequence: Synthetic oligonucleotide
  Target: SCN9A; (+) strand; PAM type: YTN; PAM sequence: TTC
tttacacaatgatcagaatg

SEQ ID NO: 108935 - DNA, 20 bp, Artificial Sequence
  Description of Artificial Sequence: Synthetic oligonucleotide
  Target: SCN9A; (+) strand; PAM type: YTN; PAM sequence: CTT
tacacaatgatcagaatgct

SEQ ID NO: 108936 - DNA, 20 bp, Artificial Sequence
  Description of Artificial Sequence: Synthetic oligonucleotide
  Target: SCN9A; (+) strand; PAM type: YTN; PAM sequence: TTT
acacaatgatcagaatgctt

SEQ ID NO: 108937 - DNA, 20 bp, Artificial Sequence
  Description of Artificial Sequence: Synthetic oligonucleotide
  Target: SCN9A; (+) strand; PAM type: YTN; PAM sequence: TTA
cacaatgatcagaatgctta

SEQ ID NO: 108938 - DNA, 20 bp, Artificial Sequence
  Description of Artificial Sequence: Synthetic oligonucleotide
  Target: SCN9A; (+) strand; PAM type: YTN; PAM sequence: CTT
acaaagtatatatttggttt

SEQ ID NO: 108939 - DNA, 20 bp, Artificial Sequence
  Description of Artificial Sequence: Synthetic oligonucleotide
  Target: SCN9A; (+) strand; PAM type: YTN; PAM sequence: TTA
caaagtatatatttggtttt

SEQ ID NO: 108940 - DNA, 20 bp, Artificial Sequence
  Description of Artificial Sequence: Synthetic oligonucleotide
  Target: SCN9A; (+) strand; PAM type: YTN; PAM sequence: TTT
ggtttttgtctcaggttgaa

SEQ ID NO: 108941 - DNA, 20 bp, Artificial Sequence
  Description of Artificial Sequence: Synthetic oligonucleotide
  Target: SCN9A; (+) strand; PAM type: YTN; PAM sequence: TTG
gtttttgtctcaggttgaaa

SEQ ID NO: 108942 - DNA, 20 bp, Artificial Sequence
  Description of Artificial Sequence: Synthetic oligonucleotide
  Target: SCN9A; (+) strand; PAM type: YTN; PAM sequence: TTT
ttgtctcaggttgaaataaa

SEQ ID NO: 108943 - DNA, 20 bp, Artificial Sequence
  Description of Artificial Sequence: Synthetic oligonucleotide
  Target: SCN9A; (+) strand; PAM type: YTN; PAM sequence: TTT
tgtctcaggttgaaataaag

SEQ ID NO: 108944 - DNA, 20 bp, Artificial Sequence
  Description of Artificial Sequence: Synthetic oligonucleotide
  Target: SCN9A; (+) strand; PAM type: YTN; PAM sequence: TTT
gtctcaggttgaaataaagc

SEQ ID NO: 108945 - DNA, 20 bp, Artificial Sequence
  Description of Artificial Sequence: Synthetic oligonucleotide
  Target: SCN9A; (+) strand; PAM type: YTN; PAM sequence: TTG
tctcaggttgaaataaagct

SEQ ID NO: 108946 - DNA, 20 bp, Artificial Sequence
  Description of Artificial Sequence: Synthetic oligonucleotide
  Target: SCN9A; (+) strand; PAM type: YTN; PAM sequence: CTC
aggttgaaataaagctctat

SEQ ID NO: 108947 - DNA, 20 bp, Artificial Sequence
  Description of Artificial Sequence: Synthetic oligonucleotide
  Target: SCN9A; (+) strand; PAM type: YTN; PAM sequence: TTG
aaataaagctctattgtatt

SEQ ID NO: 108948 - DNA, 20 bp, Artificial Sequence
  Description of Artificial Sequence: Synthetic oligonucleotide
  Target: SCN9A; (+) strand; PAM type: YTN; PAM sequence: CTC
tattgtattttagaattaaa

SEQ ID NO: 108949 - DNA, 20 bp, Artificial Sequence
  Description of Artificial Sequence: Synthetic oligonucleotide
  Target: SCN9A; (+) strand; PAM type: YTN; PAM sequence: CTA
ttgtattttagaattaaact

SEQ ID NO: 108950 - DNA, 20 bp, Artificial Sequence
  Description of Artificial Sequence: Synthetic oligonucleotide
  Target: SCN9A; (+) strand; PAM type: YTN; PAM sequence: TTG
tattttagaattaaactatt

SEQ ID NO: 108951 - DNA, 20 bp, Artificial Sequence
  Description of Artificial Sequence: Synthetic oligonucleotide
  Target: SCN9A; (+) strand; PAM type: YTN; PAM sequence: TTT
tagaattaaactattacatg

SEQ ID NO: 108952 - DNA, 20 bp, Artificial Sequence
  Description of Artificial Sequence: Synthetic oligonucleotide
  Target: SCN9A; (+) strand; PAM type: YTN; PAM sequence: TTT
agaattaaactattacatgt

SEQ ID NO: 108953 - DNA, 20 bp, Artificial Sequence
  Description of Artificial Sequence: Synthetic oligonucleotide
  Target: SCN9A; (+) strand; PAM type: YTN; PAM sequence: TTA
gaattaaactattacatgtt

SEQ ID NO: 108954 - DNA, 20 bp, Artificial Sequence
  Description of Artificial Sequence: Synthetic oligonucleotide
  Target: SCN9A; (+) strand; PAM type: YTN; PAM sequence: TTA
aactattacatgttattaat

SEQ ID NO: 108955 - DNA, 20 bp, Artificial Sequence
  Description of Artificial Sequence: Synthetic oligonucleotide
  Target: SCN9A; (+) strand; PAM type: YTN; PAM sequence: CTA
ttacatgttattaatttgct

SEQ ID NO: 108956 - DNA, 20 bp, Artificial Sequence
  Description of Artificial Sequence: Synthetic oligonucleotide
  Target: SCN9A; (+) strand; PAM type: YTN; PAM sequence: TTA
catgttattaatttgcttac

SEQ ID NO: 108957 - DNA, 20 bp, Artificial Sequence
  Description of Artificial Sequence: Synthetic oligonucleotide
  Target: SCN9A; (+) strand; PAM type: YTN; PAM sequence: TTA
ttaatttgcttacagtaaag

SEQ ID NO: 108958 - DNA, 20 bp, Artificial Sequence
  Description of Artificial Sequence: Synthetic oligonucleotide
  Target: SCN9A; (+) strand; PAM type: YTN; PAM sequence: TTA
atttgcttacagtaaagaca

SEQ ID NO: 108959 - DNA, 20 bp, Artificial Sequence
  Description of Artificial Sequence: Synthetic oligonucleotide
  Target: SCN9A; (+) strand; PAM type: YTN; PAM sequence: TTT
gcttacagtaaagacaaatt

SEQ ID NO: 108960 - DNA, 20 bp, Artificial Sequence
  Description of Artificial Sequence: Synthetic oligonucleotide
  Target: SCN9A; (+) strand; PAM type: YTN; PAM sequence: TTG
cttacagtaaagacaaatta

SEQ ID NO: 108961 - DNA, 20 bp, Artificial Sequence
  Description of Artificial Sequence: Synthetic oligonucleotide
  Target: SCN9A; (+) strand; PAM type: YTN; PAM sequence: CTT
acagtaaagacaaattaaat

SEQ ID NO: 108962 - DNA, 20 bp, Artificial Sequence
  Description of Artificial Sequence: Synthetic oligonucleotide
  Target: SCN9A; (+) strand; PAM type: YTN; PAM sequence: TTA
cagtaaagacaaattaaata

SEQ ID NO: 108963 - DNA, 20 bp, Artificial Sequence
  Description of Artificial Sequence: Synthetic oligonucleotide
  Target: SCN9A; (+) strand; PAM type: YTN; PAM sequence: TTA
aatattatatgttaaagttt

SEQ ID NO: 108964 - DNA, 20 bp, Artificial Sequence
  Description of Artificial Sequence: Synthetic oligonucleotide
  Target: SCN9A; (+) strand; PAM type: YTN; PAM sequence: TTA
tatgttaaagttttacaagg

SEQ ID NO: 108965 - DNA, 20 bp, Artificial Sequence
  Description of Artificial Sequence: Synthetic oligonucleotide
  Target: SCN9A; (+) strand; PAM type: YTN; PAM sequence: TTA
aagttttacaaggtaatttt

SEQ ID NO: 108966 - DNA, 20 bp, Artificial Sequence
  Description of Artificial Sequence: Synthetic oligonucleotide
  Target: SCN9A; (+) strand; PAM type: YTN; PAM sequence: TTT
tacaaggtaattttggaatg

SEQ ID NO: 108967 - DNA, 20 bp, Artificial Sequence
  Description of Artificial Sequence: Synthetic oligonucleotide
  Target: SCN9A; (+) strand; PAM type: YTN; PAM sequence: TTT
acaaggtaattttggaatgt

SEQ ID NO: 108968 - DNA, 20 bp, Artificial Sequence
  Description of Artificial Sequence: Synthetic oligonucleotide
  Target: SCN9A; (+) strand; PAM type: YTN; PAM sequence: TTA
caaggtaattttggaatgta

SEQ ID NO: 108969 - DNA, 20 bp, Artificial Sequence
  Description of Artificial Sequence: Synthetic oligonucleotide
  Target: SCN9A; (+) strand; PAM type: YTN; PAM sequence: TTT
tggaatgtaaaactcgcata

SEQ ID NO: 108970 - DNA, 20 bp, Artificial Sequence
  Description of Artificial Sequence: Synthetic oligonucleotide
  Target: SCN9A; (+) strand; PAM type: YTN; PAM sequence: TTT
ggaatgtaaaactcgcataa

SEQ ID NO: 108971 - DNA, 20 bp, Artificial Sequence
  Description of Artificial Sequence: Synthetic oligonucleotide
  Target: SCN9A; (+) strand; PAM type: YTN; PAM sequence: TTG
gaatgtaaaactcgcataaa

SEQ ID NO: 108972 - DNA, 20 bp, Artificial Sequence
  Description of Artificial Sequence: Synthetic oligonucleotide
  Target: SCN9A; (+) strand; PAM type: YTN; PAM sequence: CTC
gcataaaccatgcaataaga

SEQ ID NO: 108973 - DNA, 20 bp, Artificial Sequence
  Description of Artificial Sequence: Synthetic oligonucleotide
  Target: SCN9A; (+) strand; PAM type: YTN; PAM sequence: TTT
gattatcaggcaattaactc

SEQ ID NO: 108974 - DNA, 20 bp, Artificial Sequence
  Description of Artificial Sequence: Synthetic oligonucleotide
  Target: SCN9A; (+) strand; PAM type: YTN; PAM sequence: TTG
attatcaggcaattaactcc

SEQ ID NO: 108975 - DNA, 20 bp, Artificial Sequence
  Description of Artificial Sequence: Synthetic oligonucleotide
  Target: SCN9A; (+) strand; PAM type: YTN; PAM sequence: TTA
tcaggcaattaactccatat

SEQ ID NO: 108976 - DNA, 20 bp, Artificial Sequence
  Description of Artificial Sequence: Synthetic oligonucleotide
  Target: SCN9A; (+) strand; PAM type: YTN; PAM sequence: TTA
actccatatcatcaatagaa

SEQ ID NO: 108977 - DNA, 20 bp, Artificial Sequence
  Description of Artificial Sequence: Synthetic oligonucleotide
  Target: SCN9A; (+) strand; PAM type: YTN; PAM sequence: CTC
catatcatcaatagaatcag

SEQ ID NO: 108978 - DNA, 20 bp, Artificial Sequence
  Description of Artificial Sequence: Synthetic oligonucleotide
  Target: SCN9A; (+) strand; PAM type: YTN; PAM sequence: CTC
tatggtttaataaagattga

SEQ ID NO: 108979 - DNA, 20 bp, Artificial Sequence
  Description of Artificial Sequence: Synthetic oligonucleotide
  Target: SCN9A; (+) strand; PAM type: YTN; PAM sequence: CTA
tggtttaataaagattgagt

SEQ ID NO: 108980 - DNA, 20 bp, Artificial Sequence
  Description of Artificial Sequence: Synthetic oligonucleotide
  Target: SCN9A; (+) strand; PAM type: YTN; PAM sequence: TTT
aataaagattgagttatttg

SEQ ID NO: 108981 - DNA, 20 bp, Artificial Sequence
  Description of Artificial Sequence: Synthetic oligonucleotide
  Target: SCN9A; (+) strand; PAM type: YTN; PAM sequence: TTA
ataaagattgagttatttga

SEQ ID NO: 108982 - DNA, 20 bp, Artificial Sequence
  Description of Artificial Sequence: Synthetic oligonucleotide
  Target: SCN9A; (+) strand; PAM type: YTN; PAM sequence: TTG
agttatttgaaaaataaatg

SEQ ID NO: 108983 - DNA, 20 bp, Artificial Sequence
  Description of Artificial Sequence: Synthetic oligonucleotide
  Target: SCN9A; (+) strand; PAM type: YTN; PAM sequence: TTA
tttgaaaaataaatgaatta

SEQ ID NO: 108984 - DNA, 20 bp, Artificial Sequence
  Description of Artificial Sequence: Synthetic oligonucleotide
  Target: SCN9A; (+) strand; PAM type: YTN; PAM sequence: TTT
gaaaaataaatgaattatta

SEQ ID NO: 108985 - DNA, 20 bp, Artificial Sequence
  Description of Artificial Sequence: Synthetic oligonucleotide
  Target: SCN9A; (+) strand; PAM type: YTN; PAM sequence: TTG
aaaaataaatgaattattaa

SEQ ID NO: 108986 - DNA, 20 bp, Artificial Sequence
  Description of Artificial Sequence: Synthetic oligonucleotide
  Target: SCN9A; (+) strand; PAM type: YTN; PAM sequence: TTA
ttaaagcataatattgtaag

SEQ ID NO: 108987 - DNA, 20 bp, Artificial Sequence
  Description of Artificial Sequence: Synthetic oligonucleotide
  Target: SCN9A; (+) strand; PAM type: YTN; PAM sequence: TTA
aagcataatattgtaagaaa

SEQ ID NO: 108988 - DNA, 20 bp, Artificial Sequence
  Description of Artificial Sequence: Synthetic oligonucleotide
  Target: SCN9A; (+) strand; PAM type: YTN; PAM sequence: TTG
taagaaagtggtaaggtcaa

SEQ ID NO: 108989 - DNA, 20 bp, Artificial Sequence
  Description of Artificial Sequence: Synthetic oligonucleotide
  Target: SCN9A; (+) strand; PAM type: YTN; PAM sequence: CTA
ttggcctaaatgaaacttct

SEQ ID NO: 108990 - DNA, 20 bp, Artificial Sequence
  Description of Artificial Sequence: Synthetic oligonucleotide
  Target: SCN9A; (+) strand; PAM type: YTN; PAM sequence: TTG
gcctaaatgaaacttctggg

SEQ ID NO: 108991 - DNA, 20 bp, Artificial Sequence
  Description of Artificial Sequence: Synthetic oligonucleotide
  Target: SCN9A; (+) strand; PAM type: YTN; PAM sequence: CTA
aatgaaacttctgggaattc

SEQ ID NO: 108992 - DNA, 20 bp, Artificial Sequence
  Description of Artificial Sequence: Synthetic oligonucleotide
  Target: SCN9A; (+) strand; PAM type: YTN; PAM sequence: CTT
ctgggaattccctaggtagt

SEQ ID NO: 108993 - DNA, 20 bp, Artificial Sequence
  Description of Artificial Sequence: Synthetic oligonucleotide
  Target: SCN9A; (+) strand; PAM type: YTN; PAM sequence: TTC
tgggaattccctaggtagta

SEQ ID NO: 108994 - DNA, 20 bp, Artificial Sequence
  Description of Artificial Sequence: Synthetic oligonucleotide
  Target: SCN9A; (+) strand; PAM type: YTN; PAM sequence: CTG
ggaattccctaggtagtacc

SEQ ID NO: 108995 - DNA, 20 bp, Artificial Sequence
  Description of Artificial Sequence: Synthetic oligonucleotide
  Target: SCN9A; (+) strand; PAM type: YTN; PAM sequence: TTC
cctaggtagtacctgggata

SEQ ID NO: 108996 - DNA, 20 bp, Artificial Sequence
  Description of Artificial Sequence: Synthetic oligonucleotide
  Target: SCN9A; (+) strand; PAM type: YTN; PAM sequence: CTA
ggtagtacctgggataacct

SEQ ID NO: 108997 - DNA, 20 bp, Artificial Sequence
  Description of Artificial Sequence: Synthetic oligonucleotide
  Target: SCN9A; (+) strand; PAM type: YTN; PAM sequence: CTG
ggataacctagtactatccc

SEQ ID NO: 108998 - DNA, 20 bp, Artificial Sequence
  Description of Artificial Sequence: Synthetic oligonucleotide
  Target: SCN9A; (+) strand; PAM type: YTN; PAM sequence: CTA
gtactatccctttacaaaat

SEQ ID NO: 108999 - DNA, 20 bp, Artificial Sequence
  Description of Artificial Sequence: Synthetic oligonucleotide
  Target: SCN9A; (+) strand; PAM type: YTN; PAM sequence: CTA
tccctttacaaaatgttttg

SEQ ID NO: 109000 - DNA, 20 bp, Artificial Sequence
  Description of Artificial Sequence: Synthetic oligonucleotide
  Target: SCN9A; (+) strand; PAM type: YTN; PAM sequence: CTT
tacaaaatgttttgtttata

SEQ ID NO: 109001 - DNA, 20 bp, Artificial Sequence
  Description of Artificial Sequence: Synthetic oligonucleotide
  Target: SCN9A; (+) strand; PAM type: YTN; PAM sequence: TTT
acaaaatgttttgtttataa

SEQ ID NO: 109002 - DNA, 20 bp, Artificial Sequence
  Description of Artificial Sequence: Synthetic oligonucleotide
  Target: SCN9A; (+) strand; PAM type: YTN; PAM sequence: TTA
caaaatgttttgtttataaa

SEQ ID NO: 109003 - DNA, 20 bp, Artificial Sequence
  Description of Artificial Sequence: Synthetic oligonucleotide
  Target: SCN9A; (+) strand; PAM type: YTN; PAM sequence: TTT
tgtttataaacactaaaaaa

SEQ ID NO: 109004 - DNA, 20 bp, Artificial Sequence
  Description of Artificial Sequence: Synthetic oligonucleotide
  Target: SCN9A; (+) strand; PAM type: YTN; PAM sequence: TTT
gtttataaacactaaaaaat

SEQ ID NO: 109005 - DNA, 20 bp, Artificial Sequence
  Description of Artificial Sequence: Synthetic oligonucleotide
  Target: SCN9A; (+) strand; PAM type: YTN; PAM sequence: TTG
tttataaacactaaaaaatt

SEQ ID NO: 109006 - DNA, 20 bp, Artificial Sequence
  Description of Artificial Sequence: Synthetic oligonucleotide
  Target: SCN9A; (+) strand; PAM type: YTN; PAM sequence: TTT
ataaacactaaaaaattctt

SEQ ID NO: 109007 - DNA, 20 bp, Artificial Sequence
  Description of Artificial Sequence: Synthetic oligonucleotide
  Target: SCN9A; (+) strand; PAM type: YTN; PAM sequence: TTA
taaacactaaaaaattcttg

SEQ ID NO: 109008 - DNA, 20 bp, Artificial Sequence
  Description of Artificial Sequence: Synthetic oligonucleotide
  Target: SCN9A; (+) strand; PAM type: YTN; PAM sequence: CTA
aaaaattcttgtaaaaacat

SEQ ID NO: 109009 - DNA, 20 bp, Artificial Sequence
  Description of Artificial Sequence: Synthetic oligonucleotide
  Target: SCN9A; (+) strand; PAM type: YTN; PAM sequence: TTC
ttgtaaaaacatgggaaata

SEQ ID NO: 109010 - DNA, 20 bp, Artificial Sequence
  Description of Artificial Sequence: Synthetic oligonucleotide
  Target: SCN9A; (+) strand; PAM type: YTN; PAM sequence: CTT
gtaaaaacatgggaaataaa

SEQ ID NO: 109011 - DNA, 20 bp, Artificial Sequence
  Description of Artificial Sequence: Synthetic oligonucleotide
  Target: SCN9A; (+) strand; PAM type: YTN; PAM sequence: TTG
taaaaacatgggaaataaag

SEQ ID NO: 109012 - DNA, 20 bp, Artificial Sequence
  Description of Artificial Sequence: Synthetic oligonucleotide
  Target: SCN9A; (+) strand; PAM type: YTN; PAM sequence: CTT
acctcccagaaataattggt

SEQ ID NO: 109013 - DNA, 20 bp, Artificial Sequence
  Description of Artificial Sequence: Synthetic oligonucleotide
  Target: SCN9A; (+) strand; PAM type: YTN; PAM sequence: TTA
cctcccagaaataattggtg

SEQ ID NO: 109014 - DNA, 20 bp, Artificial Sequence
  Description of Artificial Sequence: Synthetic oligonucleotide
  Target: SCN9A; (+) strand; PAM type: YTN; PAM sequence: CTC
ccagaaataattggtgctaa

SEQ ID NO: 109015 - DNA, 20 bp, Artificial Sequence
  Description of Artificial Sequence: Synthetic oligonucleotide
  Target: SCN9A; (+) strand; PAM type: YTN; PAM sequence: TTG
gtgctaatatttcttccatt

SEQ ID NO: 109016 - DNA, 20 bp, Artificial Sequence
  Description of Artificial Sequence: Synthetic oligonucleotide
  Target: SCN9A; (+) strand; PAM type: YTN; PAM sequence: CTA
atatttcttccattcttttt

SEQ ID NO: 109017 - DNA, 20 bp, Artificial Sequence
  Description of Artificial Sequence: Synthetic oligonucleotide
  Target: SCN9A; (+) strand; PAM type: YTN; PAM sequence: TTT
cttccattctttttatatgt

SEQ ID NO: 109018 - DNA, 20 bp, Artificial Sequence
  Description of Artificial Sequence: Synthetic oligonucleotide
  Target: SCN9A; (+) strand; PAM type: YTN; PAM sequence: TTC
ttccattctttttatatgta

SEQ ID NO: 109019 - DNA, 20 bp, Artificial Sequence
  Description of Artificial Sequence: Synthetic oligonucleotide
  Target: SCN9A; (+) strand; PAM type: YTN; PAM sequence: CTT
ccattctttttatatgtatg

SEQ ID NO: 109020 - DNA, 20 bp, Artificial Sequence
  Description of Artificial Sequence: Synthetic oligonucleotide
  Target: SCN9A; (+) strand; PAM type: YTN; PAM sequence: TTC
cattctttttatatgtatgt

SEQ ID NO: 109021 - DNA, 20 bp, Artificial Sequence
  Description of Artificial Sequence: Synthetic oligonucleotide
  Target: SCN9A; (+) strand; PAM type: YTN; PAM sequence: TTC
tttttatatgtatgtataat

SEQ ID NO: 109022 - DNA, 20 bp, Artificial Sequence
  Description of Artificial Sequence: Synthetic oligonucleotide
  Target: SCN9A; (+) strand; PAM type: YTN; PAM sequence: CTT
tttatatgtatgtataattt

SEQ ID NO: 109023 - DNA, 20 bp, Artificial Sequence
  Description of Artificial Sequence: Synthetic oligonucleotide
  Target: SCN9A; (+) strand; PAM type: YTN; PAM sequence: TTT
ttatatgtatgtataatttt

SEQ ID NO: 109024 - DNA, 20 bp, Artificial Sequence
  Description of Artificial Sequence: Synthetic oligonucleotide
  Target: SCN9A; (+) strand; PAM type: YTN; PAM sequence: TTT
tatatgtatgtataatttta

SEQ ID NO: 109025 - DNA, 20 bp, Artificial Sequence
  Description of Artificial Sequence: Synthetic oligonucleotide
  Target: SCN9A; (+) strand; PAM type: YTN; PAM sequence: TTT
atatgtatgtataattttaa

SEQ ID NO: 109026 - DNA, 20 bp, Artificial Sequence
  Description of Artificial Sequence: Synthetic oligonucleotide
  Target: SCN9A; (+) strand; PAM type: YTN; PAM sequence: TTA
tatgtatgtataattttaaa

SEQ ID NO: 109027 - DNA, 20 bp, Artificial Sequence
  Description of Artificial Sequence: Synthetic oligonucleotide
  Target: SCN9A; (+) strand; PAM type: YTN; PAM sequence: TTT
taaaattgagattgtatcgg

SEQ ID NO: 109028 - DNA, 20 bp, Artificial Sequence
  Description of Artificial Sequence: Synthetic oligonucleotide
  Target: SCN9A; (+) strand; PAM type: YTN; PAM sequence: TTT
aaaattgagattgtatcgga

SEQ ID NO: 109029 - DNA, 20 bp, Artificial Sequence
  Description of Artificial Sequence: Synthetic oligonucleotide
  Target: SCN9A; (+) strand; PAM type: YTN; PAM sequence: TTA
aaattgagattgtatcggac

SEQ ID NO: 109030 - DNA, 20 bp, Artificial Sequence
  Description of Artificial Sequence: Synthetic oligonucleotide
  Target: SCN9A; (+) strand; PAM type: YTN; PAM sequence: TTG
agattgtatcggactatatt

SEQ ID NO: 109031 - DNA, 20 bp, Artificial Sequence
  Description of Artificial Sequence: Synthetic oligonucleotide
  Target: SCN9A; (+) strand; PAM type: YTN; PAM sequence: TTG
tatcggactatattatttaa

SEQ ID NO: 109032 - DNA, 20 bp, Artificial Sequence
  Description of Artificial Sequence: Synthetic oligonucleotide
  Target: SCN9A; (+) strand; PAM type: YTN; PAM sequence: CTA
tattatttaatccatcatta

SEQ ID NO: 109033 - DNA, 20 bp, Artificial Sequence
  Description of Artificial Sequence: Synthetic oligonucleotide
  Target: SCN9A; (+) strand; PAM type: YTN; PAM sequence: TTA
tttaatccatcattattcta

SEQ ID NO: 109034 - DNA, 20 bp, Artificial Sequence
  Description of Artificial Sequence: Synthetic oligonucleotide
  Target: SCN9A; (+) strand; PAM type: YTN; PAM sequence: TTT
aatccatcattattctaaaa

SEQ ID NO: 109035 - DNA, 20 bp, Artificial Sequence
  Description of Artificial Sequence: Synthetic oligonucleotide
  Target: SCN9A; (+) strand; PAM type: YTN; PAM sequence: TTA
atccatcattattctaaaag

SEQ ID NO: 109036 - DNA, 20 bp, Artificial Sequence
  Description of Artificial Sequence: Synthetic oligonucleotide
  Target: SCN9A; (+) strand; PAM type: YTN; PAM sequence: TTA
ttctaaaagatttttcctca

SEQ ID NO: 109037 - DNA, 20 bp, Artificial Sequence
  Description of Artificial Sequence: Synthetic oligonucleotide
  Target: SCN9A; (+) strand; PAM type: YTN; PAM sequence: TTC
taaaagatttttcctcatga

SEQ ID NO: 109038 - DNA, 20 bp, Artificial Sequence
  Description of Artificial Sequence: Synthetic oligonucleotide
  Target: SCN9A; (+) strand; PAM type: YTN; PAM sequence: CTA
aaagatttttcctcatgata

SEQ ID NO: 109039 - DNA, 20 bp, Artificial Sequence
  Description of Artificial Sequence: Synthetic oligonucleotide
  Target: SCN9A; (+) strand; PAM type: YTN; PAM sequence: TTT
ttcctcatgataaaataatt

SEQ ID NO: 109040 - DNA, 20 bp, Artificial Sequence
  Description of Artificial Sequence: Synthetic oligonucleotide
  Target: SCN9A; (+) strand; PAM type: YTN; PAM sequence: TTT
tcctcatgataaaataattt

SEQ ID NO: 109041 - DNA, 20 bp, Artificial Sequence
  Description of Artificial Sequence: Synthetic oligonucleotide
  Target: SCN9A; (+) strand; PAM type: YTN; PAM sequence: TTT
cctcatgataaaataatttt

SEQ ID NO: 109042 - DNA, 20 bp, Artificial Sequence
  Description of Artificial Sequence: Synthetic oligonucleotide
  Target: SCN9A; (+) strand; PAM type: YTN; PAM sequence: TTC
ctcatgataaaataatttta

SEQ ID NO: 109043 - DNA, 20 bp, Artificial Sequence
  Description of Artificial Sequence: Synthetic oligonucleotide
  Target: SCN9A; (+) strand; PAM type: YTN; PAM sequence: CTC
atgataaaataattttaaaa

SEQ ID NO: 109044 - DNA, 20 bp, Artificial Sequence
  Description of Artificial Sequence: Synthetic oligonucleotide
  Target: SCN9A; (+) strand; PAM type: YTN; PAM sequence: TTT
taaaaaaacacatagttcta

SEQ ID NO: 109045 - DNA, 20 bp, Artificial Sequence
  Description of Artificial Sequence: Synthetic oligonucleotide
  Target: SCN9A; (+) strand; PAM type: YTN; PAM sequence: TTT
aaaaaaacacatagttctat

SEQ ID NO: 109046 - DNA, 20 bp, Artificial Sequence
  Description of Artificial Sequence: Synthetic oligonucleotide
  Target: SCN9A; (+) strand; PAM type: YTN; PAM sequence: TTA
aaaaaacacatagttctatg

SEQ ID NO: 109047 - DNA, 20 bp, Artificial Sequence
  Description of Artificial Sequence: Synthetic oligonucleotide
  Target: SCN9A; (+) strand; PAM type: YTN; PAM sequence: TTC
tatggcaaaataatacttta

SEQ ID NO: 109048 - DNA, 20 bp, Artificial Sequence
  Description of Artificial Sequence: Synthetic oligonucleotide
  Target: SCN9A; (+) strand; PAM type: YTN; PAM sequence: CTA
tggcaaaataatactttaag

SEQ ID NO: 109049 - DNA, 20 bp, Artificial Sequence
  Description of Artificial Sequence: Synthetic oligonucleotide
  Target: SCN9A; (+) strand; PAM type: YTN; PAM sequence: CTT
taagatatacaattttcata

SEQ ID NO: 109050 - DNA, 20 bp, Artificial Sequence
  Description of Artificial Sequence: Synthetic oligonucleotide
  Target: SCN9A; (+) strand; PAM type: YTN; PAM sequence: TTT
aagatatacaattttcataa

SEQ ID NO: 109051 - DNA, 20 bp, Artificial Sequence
  Description of Artificial Sequence: Synthetic oligonucleotide
  Target: SCN9A; (+) strand; PAM type: YTN; PAM sequence: TTA
agatatacaattttcataat

SEQ ID NO: 109052 - DNA, 20 bp, Artificial Sequence
  Description of Artificial Sequence: Synthetic oligonucleotide
  Target: SCN9A; (+) strand; PAM type: YTN; PAM sequence: TTT
tcataattttcttagttatt

SEQ ID NO: 109053 - DNA, 20 bp, Artificial Sequence
  Description of Artificial Sequence: Synthetic oligonucleotide
  Target: SCN9A; (+) strand; PAM type: YTN; PAM sequence: TTT
cataattttcttagttattt

SEQ ID NO: 109054 - DNA, 20 bp, Artificial Sequence
  Description of Artificial Sequence: Synthetic oligonucleotide
  Target: SCN9A; (+) strand; PAM type: YTN; PAM sequence: TTC
ataattttcttagttatttt

SEQ ID NO: 109055 - DNA, 20 bp, Artificial Sequence
  Description of Artificial Sequence: Synthetic oligonucleotide
  Target: SCN9A; (+) strand; PAM type: YTN; PAM sequence: TTT
tcttagttattttctaattt

SEQ ID NO: 109056 - DNA, 20 bp, Artificial Sequence
  Description of Artificial Sequence: Synthetic oligonucleotide
  Target: SCN9A; (+) strand; PAM type: YTN; PAM sequence: TTT
cttagttattttctaatttt

SEQ ID NO: 109057 - DNA, 20 bp, Artificial Sequence
  Description of Artificial Sequence: Synthetic oligonucleotide
  Target: SCN9A; (+) strand; PAM type: YTN; PAM sequence: TTC
ttagttattttctaattttc

SEQ ID NO: 109058 - DNA, 20 bp, Artificial Sequence
  Description of Artificial Sequence: Synthetic oligonucleotide
  Target: SCN9A; (+) strand; PAM type: YTN; PAM sequence: CTT
agttattttctaattttcca

SEQ ID NO: 109059 - DNA, 20 bp, Artificial Sequence
  Description of Artificial Sequence: Synthetic oligonucleotide
  Target: SCN9A; (+) strand; PAM type: YTN; PAM sequence: TTA
gttattttctaattttccaa

SEQ ID NO: 109060 - DNA, 20 bp, Artificial Sequence
  Description of Artificial Sequence: Synthetic oligonucleotide
  Target: SCN9A; (+) strand; PAM type: YTN; PAM sequence: TTA
ttttctaattttccaaaatt

SEQ ID NO: 109061 - DNA, 20 bp, Artificial Sequence
  Description of Artificial Sequence: Synthetic oligonucleotide
  Target: SCN9A; (+) strand; PAM type: YTN; PAM sequence: TTT
tctaattttccaaaatttaa

SEQ ID NO: 109062 - DNA, 20 bp, Artificial Sequence
  Description of Artificial Sequence: Synthetic oligonucleotide
  Target: SCN9A; (+) strand; PAM type: YTN; PAM sequence: TTT
ctaattttccaaaatttaaa

SEQ ID NO: 109063 - DNA, 20 bp, Artificial Sequence
  Description of Artificial Sequence: Synthetic oligonucleotide
  Target: SCN9A; (+) strand; PAM type: YTN; PAM sequence: TTC
taattttccaaaatttaaat

SEQ ID NO: 109064 - DNA, 20 bp, Artificial Sequence
  Description of Artificial Sequence: Synthetic oligonucleotide
  Target: SCN9A; (+) strand; PAM type: YTN; PAM sequence: CTA
attttccaaaatttaaattt

SEQ ID NO: 109065 - DNA, 20 bp, Artificial Sequence
  Description of Artificial Sequence: Synthetic oligonucleotide
  Target: SCN9A; (+) strand; PAM type: YTN; PAM sequence: TTT
tccaaaatttaaattttttc

SEQ ID NO: 109066 - DNA, 20 bp, Artificial Sequence
  Description of Artificial Sequence: Synthetic oligonucleotide
  Target: SCN9A; (+) strand; PAM type: YTN; PAM sequence: TTT
ccaaaatttaaattttttct

SEQ ID NO: 109067 - DNA, 20 bp, Artificial Sequence
  Description of Artificial Sequence: Synthetic oligonucleotide
  Target: SCN9A; (+) strand; PAM type: YTN; PAM sequence: TTC
caaaatttaaattttttctg

SEQ ID NO: 109068 - DNA, 20 bp, Artificial Sequence
  Description of Artificial Sequence: Synthetic oligonucleotide
  Target: SCN9A; (+) strand; PAM type: YTN; PAM sequence: TTT
aaattttttctgatttttac

SEQ ID NO: 109069 - DNA, 20 bp, Artificial Sequence
  Description of Artificial Sequence: Synthetic oligonucleotide
  Target: SCN9A; (+) strand; PAM type: YTN; PAM sequence: TTA
aattttttctgatttttacc

SEQ ID NO: 109070 - DNA, 20 bp, Artificial Sequence
  Description of Artificial Sequence: Synthetic oligonucleotide
  Target: SCN9A; (+) strand; PAM type: YTN; PAM sequence: TTT
tttctgatttttaccattat

SEQ ID NO: 109071 - DNA, 20 bp, Artificial Sequence
  Description of Artificial Sequence: Synthetic oligonucleotide
  Target: SCN9A; (+) strand; PAM type: YTN; PAM sequence: TTT
ttctgatttttaccattatt

SEQ ID NO: 109072 - DNA, 20 bp, Artificial Sequence
  Description of Artificial Sequence: Synthetic oligonucleotide
  Target: SCN9A; (+) strand; PAM type: YTN; PAM sequence: TTT
tctgatttttaccattatta

SEQ ID NO: 109073 - DNA, 20 bp, Artificial Sequence
  Description of Artificial Sequence: Synthetic oligonucleotide
  Target: SCN9A; (+) strand; PAM type: YTN; PAM sequence: TTT
ctgatttttaccattattaa

SEQ ID NO: 109074 - DNA, 20 bp, Artificial Sequence
  Description of Artificial Sequence: Synthetic oligonucleotide
  Target: SCN9A; (+) strand; PAM type: YTN; PAM sequence: TTC
tgatttttaccattattaaa

SEQ ID NO: 109075 - DNA, 20 bp, Artificial Sequence
  Description of Artificial Sequence: Synthetic oligonucleotide
  Target: SCN9A; (+) strand; PAM type: YTN; PAM sequence: CTG
atttttaccattattaaaat

SEQ ID NO: 109076 - DNA, 20 bp, Artificial Sequence
  Description of Artificial Sequence: Synthetic oligonucleotide
  Target: SCN9A; (+) strand; PAM type: YTN; PAM sequence: TTT
ttaccattattaaaatgctg

SEQ ID NO: 109077 - DNA, 20 bp, Artificial Sequence
  Description of Artificial Sequence: Synthetic oligonucleotide
  Target: SCN9A; (+) strand; PAM type: YTN; PAM sequence: TTT
taccattattaaaatgctgc

SEQ ID NO: 109078 - DNA, 20 bp, Artificial Sequence
  Description of Artificial Sequence: Synthetic oligonucleotide
  Target: SCN9A; (+) strand; PAM type: YTN; PAM sequence: TTT
accattattaaaatgctgca

SEQ ID NO: 109079 - DNA, 20 bp, Artificial Sequence
  Description of Artificial Sequence: Synthetic oligonucleotide
  Target: SCN9A; (+) strand; PAM type: YTN; PAM sequence: TTA
ccattattaaaatgctgcac

SEQ ID NO: 109080 - DNA, 20 bp, Artificial Sequence
  Description of Artificial Sequence: Synthetic oligonucleotide
  Target: SCN9A; (+) strand; PAM type: YTN; PAM sequence: TTA
ttaaaatgctgcactgaata

SEQ ID NO: 109081 - DNA, 20 bp, Artificial Sequence
  Description of Artificial Sequence: Synthetic oligonucleotide
  Target: SCN9A; (+) strand; PAM type: YTN; PAM sequence: TTA
aaatgctgcactgaatattt

SEQ ID NO: 109082 - DNA, 20 bp, Artificial Sequence
  Description of Artificial Sequence: Synthetic oligonucleotide
  Target: SCN9A; (+) strand; PAM type: YTN; PAM sequence: CTG
cactgaatatttgtgcatca

SEQ ID NO: 109083 - DNA, 20 bp, Artificial Sequence
  Description of Artificial Sequence: Synthetic oligonucleotide
  Target: SCN9A; (+) strand; PAM type: YTN; PAM sequence: CTG
aatatttgtgcatcagaatt

SEQ ID NO: 109084 - DNA, 20 bp, Artificial Sequence
  Description of Artificial Sequence: Synthetic oligonucleotide
  Target: SCN9A; (+) strand; PAM type: YTN; PAM sequence: TTT
gtgcatcagaatttatctgc

SEQ ID NO: 109085 - DNA, 20 bp, Artificial Sequence
  Description of Artificial Sequence: Synthetic oligonucleotide
  Target: SCN9A; (+) strand; PAM type: YTN; PAM sequence: TTG
tgcatcagaatttatctgca

SEQ ID NO: 109086 - DNA, 20 bp, Artificial Sequence
  Description of Artificial Sequence: Synthetic oligonucleotide
  Target: SCN9A; (+) strand; PAM type: YTN; PAM sequence: TTT
atctgcattgcagatgattg

SEQ ID NO: 109087 - DNA, 20 bp, Artificial Sequence
  Description of Artificial Sequence: Synthetic oligonucleotide
  Target: SCN9A; (+) strand; PAM type: YTN; PAM sequence: TTA
tctgcattgcagatgattgc

SEQ ID NO: 109088 - DNA, 20 bp, Artificial Sequence
  Description of Artificial Sequence: Synthetic oligonucleotide
  Target: SCN9A; (+) strand; PAM type: YTN; PAM sequence: CTG
cattgcagatgattgccctc

SEQ ID NO: 109089 - DNA, 20 bp, Artificial Sequence
  Description of Artificial Sequence: Synthetic oligonucleotide
  Target: SCN9A; (+) strand; PAM type: YTN; PAM sequence: TTG
cagatgattgccctccccta

SEQ ID NO: 109090 - DNA, 20 bp, Artificial Sequence
  Description of Artificial Sequence: Synthetic oligonucleotide
  Target: SCN9A; (+) strand; PAM type: YTN; PAM sequence: TTG
ccctcccctaatacattaga

SEQ ID NO: 109091 - DNA, 20 bp, Artificial Sequence
  Description of Artificial Sequence: Synthetic oligonucleotide
  Target: SCN9A; (+) strand; PAM type: YTN; PAM sequence: CTC
ccctaatacattagactcct

SEQ ID NO: 109092 - DNA, 20 bp, Artificial Sequence
  Description of Artificial Sequence: Synthetic oligonucleotide
  Target: SCN9A; (+) strand; PAM type: YTN; PAM sequence: CTA
atacattagactccttgaag

SEQ ID NO: 109093 - DNA, 20 bp, Artificial Sequence
  Description of Artificial Sequence: Synthetic oligonucleotide
  Target: SCN9A; (+) strand; PAM type: YTN; PAM sequence: TTA
gactccttgaagagatttaa

SEQ ID NO: 109094 - DNA, 20 bp, Artificial Sequence
  Description of Artificial Sequence: Synthetic oligonucleotide
  Target: SCN9A; (+) strand; PAM type: YTN; PAM sequence: CTC
cttgaagagatttaactagg

SEQ ID NO: 109095 - DNA, 20 bp, Artificial Sequence
  Description of Artificial Sequence: Synthetic oligonucleotide
  Target: SCN9A; (+) strand; PAM type: YTN; PAM sequence: CTT
gaagagatttaactaggtga

SEQ ID NO: 109096 - DNA, 20 bp, Artificial Sequence
  Description of Artificial Sequence: Synthetic oligonucleotide
  Target: SCN9A; (+) strand; PAM type: YTN; PAM sequence: TTG
aagagatttaactaggtgaa

SEQ ID NO: 109097 - DNA, 20 bp, Artificial Sequence
  Description of Artificial Sequence: Synthetic oligonucleotide
  Target: SCN9A; (+) strand; PAM type: YTN; PAM sequence: TTT
aactaggtgaaaccttcaga

SEQ ID NO: 109098 - DNA, 20 bp, Artificial Sequence
  Description of Artificial Sequence: Synthetic oligonucleotide
  Target: SCN9A; (+) strand; PAM type: YTN; PAM sequence: TTA
actaggtgaaaccttcagac

SEQ ID NO: 109099 - DNA, 20 bp, Artificial Sequence
  Description of Artificial Sequence: Synthetic oligonucleotide
  Target: SCN9A; (+) strand; PAM type: YTN; PAM sequence: CTA
ggtgaaaccttcagacaaat

SEQ ID NO: 109100 - DNA, 20 bp, Artificial Sequence
  Description of Artificial Sequence: Synthetic oligonucleotide
  Target: SCN9A; (+) strand; PAM type: YTN; PAM sequence: CTT
cagacaaatgttaaggcaac

SEQ ID NO: 109101 - DNA, 20 bp, Artificial Sequence
  Description of Artificial Sequence: Synthetic oligonucleotide
  Target: SCN9A; (+) strand; PAM type: YTN; PAM sequence: TTC
agacaaatgttaaggcaact

SEQ ID NO: 109102 - DNA, 20 bp, Artificial Sequence
  Description of Artificial Sequence: Synthetic oligonucleotide
  Target: SCN9A; (+) strand; PAM type: YTN; PAM sequence: TTA
aggcaactgcagtacatttg

SEQ ID NO: 109103 - DNA, 20 bp, Artificial Sequence
  Description of Artificial Sequence: Synthetic oligonucleotide
  Target: SCN9A; (+) strand; PAM type: YTN; PAM sequence: CTG
cagtacatttgaaattatgt

SEQ ID NO: 109104 - DNA, 20 bp, Artificial Sequence
  Description of Artificial Sequence: Synthetic oligonucleotide
  Target: SCN9A; (+) strand; PAM type: YTN; PAM sequence: TTT
gaaattatgtttctcttagt

SEQ ID NO: 109105 - DNA, 20 bp, Artificial Sequence
  Description of Artificial Sequence: Synthetic oligonucleotide
  Target: SCN9A; (+) strand; PAM type: YTN; PAM sequence: TTG
aaattatgtttctcttagta

SEQ ID NO: 109106 - DNA, 20 bp, Artificial Sequence
  Description of Artificial Sequence: Synthetic oligonucleotide
  Target: SCN9A; (+) strand; PAM type: YTN; PAM sequence: TTA
tgtttctcttagtacaagcc

SEQ ID NO: 109107 - DNA, 20 bp, Artificial Sequence
  Description of Artificial Sequence: Synthetic oligonucleotide
  Target: SCN9A; (+) strand; PAM type: YTN; PAM sequence: TTT
ctcttagtacaagccttctc

SEQ ID NO: 109108 - DNA, 20 bp, Artificial Sequence
  Description of Artificial Sequence: Synthetic oligonucleotide
  Target: SCN9A; (+) strand; PAM type: YTN; PAM sequence: TTC
tcttagtacaagccttctca

SEQ ID NO: 109109 - DNA, 20 bp, Artificial Sequence
  Description of Artificial Sequence: Synthetic oligonucleotide
  Target: SCN9A; (+) strand; PAM type: YTN; PAM sequence: CTC
ttagtacaagccttctcaaa

SEQ ID NO: 109110 - DNA, 20 bp, Artificial Sequence
  Description of Artificial Sequence: Synthetic oligonucleotide
  Target: SCN9A; (+) strand; PAM type: YTN; PAM sequence: CTT
agtacaagccttctcaaaca

SEQ ID NO: 109111 - DNA, 20 bp, Artificial Sequence
  Description of Artificial Sequence: Synthetic oligonucleotide
  Target: SCN9A; (+) strand; PAM type: YTN; PAM sequence: TTA
gtacaagccttctcaaacat

SEQ ID NO: 109112 - DNA, 20 bp, Artificial Sequence
  Description of Artificial Sequence: Synthetic oligonucleotide
  Target: SCN9A; (+) strand; PAM type: YTN; PAM sequence: CTT
ctcaaacatttacactgaag

SEQ ID NO: 109113 - DNA, 20 bp, Artificial Sequence
  Description of Artificial Sequence: Synthetic oligonucleotide
  Target: SCN9A; (+) strand; PAM type: YTN; PAM sequence: TTC
tcaaacatttacactgaaga

SEQ ID NO: 109114 - DNA, 20 bp, Artificial Sequence
  Description of Artificial Sequence: Synthetic oligonucleotide
  Target: SCN9A; (+) strand; PAM type: YTN; PAM sequence: CTC
aaacatttacactgaagaat

SEQ ID NO: 109115 - DNA, 20 bp, Artificial Sequence
  Description of Artificial Sequence: Synthetic oligonucleotide
  Target: SCN9A; (+) strand; PAM type: YTN; PAM sequence: TTT
acactgaagaatctctctgg

SEQ ID NO: 109116 - DNA, 20 bp, Artificial Sequence
  Description of Artificial Sequence: Synthetic oligonucleotide
  Target: SCN9A; (+) strand; PAM type: YTN; PAM sequence: TTA
cactgaagaatctctctgga

SEQ ID NO: 109117 - DNA, 20 bp, Artificial Sequence
  Description of Artificial Sequence: Synthetic oligonucleotide
  Target: SCN9A; (+) strand; PAM type: YTN; PAM sequence: CTG
aagaatctctctggaaagag

SEQ ID NO: 109118 - DNA, 20 bp, Artificial Sequence
  Description of Artificial Sequence: Synthetic oligonucleotide
  Target: SCN9A; (+) strand; PAM type: YTN; PAM sequence: CTC
tctggaaagaggattaagga

SEQ ID NO: 109119 - DNA, 20 bp, Artificial Sequence
  Description of Artificial Sequence: Synthetic oligonucleotide
  Target: SCN9A; (+) strand; PAM type: YTN; PAM sequence: CTC
tggaaagaggattaaggagg

SEQ ID NO: 109120 - DNA, 20 bp, Artificial Sequence
  Description of Artificial Sequence: Synthetic oligonucleotide
  Target: SCN9A; (+) strand; PAM type: YTN; PAM sequence: CTG
gaaagaggattaaggaggaa

SEQ ID NO: 109121 - DNA, 20 bp, Artificial Sequence
  Description of Artificial Sequence: Synthetic oligonucleotide
  Target: SCN9A; (+) strand; PAM type: YTN; PAM sequence: TTA
aggaggaaactttcgagaat

SEQ ID NO: 109122 - DNA, 20 bp, Artificial Sequence
  Description of Artificial Sequence: Synthetic oligonucleotide
  Target: SCN9A; (+) strand; PAM type: YTN; PAM sequence: CTT
tcgagaatctatgacaacct

SEQ ID NO: 109123 - DNA, 20 bp, Artificial Sequence
  Description of Artificial Sequence: Synthetic oligonucleotide
  Target: SCN9A; (+) strand; PAM type: YTN; PAM sequence: TTT
cgagaatctatgacaaccta

SEQ ID NO: 109124 - DNA, 20 bp, Artificial Sequence
  Description of Artificial Sequence: Synthetic oligonucleotide
  Target: SCN9A; (+) strand; PAM type: YTN; PAM sequence: TTC
gagaatctatgacaacctaa

SEQ ID NO: 109125 - DNA, 20 bp, Artificial Sequence
  Description of Artificial Sequence: Synthetic oligonucleotide
  Target: SCN9A; (+) strand; PAM type: YTN; PAM sequence: CTA
tgacaacctaaattagccac

SEQ ID NO: 109126 - DNA, 20 bp, Artificial Sequence
  Description of Artificial Sequence: Synthetic oligonucleotide
  Target: SCN9A; (+) strand; PAM type: YTN; PAM sequence: CTA
aattagccacaccaaaatta

SEQ ID NO: 109127 - DNA, 20 bp, Artificial Sequence
  Description of Artificial Sequence: Synthetic oligonucleotide
  Target: SCN9A; (+) strand; PAM type: YTN; PAM sequence: TTA
gccacaccaaaattattttc

SEQ ID NO: 109128 - DNA, 20 bp, Artificial Sequence
  Description of Artificial Sequence: Synthetic oligonucleotide
  Target: SCN9A; (+) strand; PAM type: YTN; PAM sequence: TTA
ttttcttaatatctcatgtt

SEQ ID NO: 109129 - DNA, 20 bp, Artificial Sequence
  Description of Artificial Sequence: Synthetic oligonucleotide
  Target: SCN9A; (+) strand; PAM type: YTN; PAM sequence: TTT
tcttaatatctcatgtttta

SEQ ID NO: 109130 - DNA, 20 bp, Artificial Sequence
  Description of Artificial Sequence: Synthetic oligonucleotide
  Target: SCN9A; (+) strand; PAM type: YTN; PAM sequence: TTT
cttaatatctcatgttttat

SEQ ID NO: 109131 - DNA, 20 bp, Artificial Sequence
  Description of Artificial Sequence: Synthetic oligonucleotide
  Target: SCN9A; (+) strand; PAM type: YTN; PAM sequence: TTC
ttaatatctcatgttttatc

SEQ ID NO: 109132 - DNA, 20 bp, Artificial Sequence
  Description of Artificial Sequence: Synthetic oligonucleotide
  Target: SCN9A; (+) strand; PAM type: YTN; PAM sequence: CTT
aatatctcatgttttatctt

SEQ ID NO: 109133 - DNA, 20 bp, Artificial Sequence
  Description of Artificial Sequence: Synthetic oligonucleotide
  Target: SCN9A; (+) strand; PAM type: YTN; PAM sequence: TTA
atatctcatgttttatctta

SEQ ID NO: 109134 - DNA, 20 bp, Artificial Sequence
  Description of Artificial Sequence: Synthetic oligonucleotide
  Target: SCN9A; (+) strand; PAM type: YTN; PAM sequence: CTC
atgttttatcttaaaaatcc

SEQ ID NO: 109135 - DNA, 20 bp, Artificial Sequence
  Description of Artificial Sequence: Synthetic oligonucleotide
  Target: SCN9A; (+) strand; PAM type: YTN; PAM sequence: TTT
tatcttaaaaatccttgtga

SEQ ID NO: 109136 - DNA, 20 bp, Artificial Sequence
  Description of Artificial Sequence: Synthetic oligonucleotide
  Target: SCN9A; (+) strand; PAM type: YTN; PAM sequence: TTT
atcttaaaaatccttgtgac

SEQ ID NO: 109137 - DNA, 20 bp, Artificial Sequence
  Description of Artificial Sequence: Synthetic oligonucleotide
  Target: SCN9A; (+) strand; PAM type: YTN; PAM sequence: TTA
tcttaaaaatccttgtgaca

SEQ ID NO: 109138 - DNA, 20 bp, Artificial Sequence
  Description of Artificial Sequence: Synthetic oligonucleotide
  Target: SCN9A; (+) strand; PAM type: YTN; PAM sequence: CTT
aaaaatccttgtgacattaa

SEQ ID NO: 109139 - DNA, 20 bp, Artificial Sequence
  Description of Artificial Sequence: Synthetic oligonucleotide
  Target: SCN9A; (+) strand; PAM type: YTN; PAM sequence: TTA
aaaatccttgtgacattaac

SEQ ID NO: 109140 - DNA, 20 bp, Artificial Sequence
  Description of Artificial Sequence: Synthetic oligonucleotide
  Target: SCN9A; (+) strand; PAM type: YTN; PAM sequence: CTT
gtgacattaacaaaacatga

SEQ ID NO: 109141 - DNA, 20 bp, Artificial Sequence
  Description of Artificial Sequence: Synthetic oligonucleotide
  Target: SCN9A; (+) strand; PAM type: YTN; PAM sequence: TTG
tgacattaacaaaacatgat

SEQ ID NO: 109142 - DNA, 20 bp, Artificial Sequence
  Description of Artificial Sequence: Synthetic oligonucleotide
  Target: SCN9A; (+) strand; PAM type: YTN; PAM sequence: TTA
acaaaacatgatgcactgtt

SEQ ID NO: 109143 - DNA, 20 bp, Artificial Sequence
  Description of Artificial Sequence: Synthetic oligonucleotide
  Target: SCN9A; (+) strand; PAM type: YTN; PAM sequence: CTG
ttttagtcataccccataga

SEQ ID NO: 109144 - DNA, 20 bp, Artificial Sequence
  Description of Artificial Sequence: Synthetic oligonucleotide
  Target: SCN9A; (+) strand; PAM type: YTN; PAM sequence: TTT
tagtcataccccatagaaga

SEQ ID NO: 109145 - DNA, 20 bp, Artificial Sequence
  Description of Artificial Sequence: Synthetic oligonucleotide
  Target: SCN9A; (+) strand; PAM type: YTN; PAM sequence: TTT
agtcataccccatagaagag

SEQ ID NO: 109146 - DNA, 20 bp, Artificial Sequence
  Description of Artificial Sequence: Synthetic oligonucleotide
  Target: SCN9A; (+) strand; PAM type: YTN; PAM sequence: TTA
gtcataccccatagaagagt

SEQ ID NO: 109147 - DNA, 20 bp, Artificial Sequence
  Description of Artificial Sequence: Synthetic oligonucleotide
  Target: SCN9A; (+) strand; PAM type: YTN; PAM sequence: CTG
ttaattttaacgttaaaata

SEQ ID NO: 109148 - DNA, 20 bp, Artificial Sequence
  Description of Artificial Sequence: Synthetic oligonucleotide
  Target: SCN9A; (+) strand; PAM type: YTN; PAM sequence: TTA
attttaacgttaaaataatt

SEQ ID NO: 109149 - DNA, 20 bp, Artificial Sequence
  Description of Artificial Sequence: Synthetic oligonucleotide
  Target: SCN9A; (+) strand; PAM type: YTN; PAM sequence: TTT
taacgttaaaataattttca

SEQ ID NO: 109150 - DNA, 20 bp, Artificial Sequence
  Description of Artificial Sequence: Synthetic oligonucleotide
  Target: SCN9A; (+) strand; PAM type: YTN; PAM sequence: TTT
aacgttaaaataattttcat

SEQ ID NO: 109151 - DNA, 20 bp, Artificial Sequence
  Description of Artificial Sequence: Synthetic oligonucleotide
  Target: SCN9A; (+) strand; PAM type: YTN; PAM sequence: TTA
acgttaaaataattttcatg

SEQ ID NO: 109152 - DNA, 20 bp, Artificial Sequence
  Description of Artificial Sequence: Synthetic oligonucleotide
  Target: SCN9A; (+) strand; PAM type: YTN; PAM sequence: TTA
aaataattttcatgaaacca

SEQ ID NO: 109153 - DNA, 20 bp, Artificial Sequence
  Description of Artificial Sequence: Synthetic oligonucleotide
  Target: SCN9A; (+) strand; PAM type: YTN; PAM sequence: TTT
tcatgaaaccactgtataca

SEQ ID NO: 109154 - DNA, 20 bp, Artificial Sequence
  Description of Artificial Sequence: Synthetic oligonucleotide
  Target: SCN9A; (+) strand; PAM type: YTN; PAM sequence: TTT
catgaaaccactgtatacaa

SEQ ID NO: 109155 - DNA, 20 bp, Artificial Sequence
  Description of Artificial Sequence: Synthetic oligonucleotide
  Target: SCN9A; (+) strand; PAM type: YTN; PAM sequence: TTC
atgaaaccactgtatacaat

SEQ ID NO: 109156 - DNA, 20 bp, Artificial Sequence
  Description of Artificial Sequence: Synthetic oligonucleotide
  Target: SCN9A; (+) strand; PAM type: YTN; PAM sequence: CTG
tatacaattggtactctggg

SEQ ID NO: 109157 - DNA, 20 bp, Artificial Sequence
  Description of Artificial Sequence: Synthetic oligonucleotide
  Target: SCN9A; (+) strand; PAM type: YTN; PAM sequence: TTG
gtactctggggaaatccatt

SEQ ID NO: 109158 - DNA, 20 bp, Artificial Sequence
  Description of Artificial Sequence: Synthetic oligonucleotide
  Target: SCN9A; (+) strand; PAM type: YTN; PAM sequence: CTC
tggggaaatccattgtgtgt

SEQ ID NO: 109159 - DNA, 20 bp, Artificial Sequence
  Description of Artificial Sequence: Synthetic oligonucleotide
  Target: SCN9A; (+) strand; PAM type: YTN; PAM sequence: CTG
gggaaatccattgtgtgtat

SEQ ID NO: 109160 - DNA, 20 bp, Artificial Sequence
  Description of Artificial Sequence: Synthetic oligonucleotide
  Target: SCN9A; (+) strand; PAM type: YTN; PAM sequence: TTG
tgtgtatgtgtgtatatata

SEQ ID NO: 109161 - DNA, 20 bp, Artificial Sequence
  Description of Artificial Sequence: Synthetic oligonucleotide
  Target: SCN9A; (+) strand; PAM type: YTN; PAM sequence: TTG
tatatatatataaattgaga

SEQ ID NO: 109162 - DNA, 20 bp, Artificial Sequence
  Description of Artificial Sequence: Synthetic oligonucleotide
  Target: SCN9A; (+) strand; PAM type: YTN; PAM sequence: TTG
agattatatatatattatat

SEQ ID NO: 109163 - DNA, 20 bp, Artificial Sequence
  Description of Artificial Sequence: Synthetic oligonucleotide
  Target: SCN9A; (+) strand; PAM type: YTN; PAM sequence: TTA
tatatatattatatatctga

SEQ ID NO: 109164 - DNA, 20 bp, Artificial Sequence
  Description of Artificial Sequence: Synthetic oligonucleotide
  Target: SCN9A; (+) strand; PAM type: YTN; PAM sequence: TTA
tatatctgactatattattt

SEQ ID NO: 109165 - DNA, 20 bp, Artificial Sequence
  Description of Artificial Sequence: Synthetic oligonucleotide
  Target: SCN9A; (+) strand; PAM type: YTN; PAM sequence: CTG
actatattatttaatcaatt

SEQ ID NO: 109166 - DNA, 20 bp, Artificial Sequence
  Description of Artificial Sequence: Synthetic oligonucleotide
  Target: SCN9A; (+) strand; PAM type: YTN; PAM sequence: CTA
tattatttaatcaattattc

SEQ ID NO: 109167 - DNA, 20 bp, Artificial Sequence
  Description of Artificial Sequence: Synthetic oligonucleotide
  Target: SCN9A; (+) strand; PAM type: YTN; PAM sequence: TTA
tttaatcaattattctaaaa

SEQ ID NO: 109168 - DNA, 20 bp, Artificial Sequence
  Description of Artificial Sequence: Synthetic oligonucleotide
  Target: SCN9A; (+) strand; PAM type: YTN; PAM sequence: TTT
aatcaattattctaaaagat

SEQ ID NO: 109169 - DNA, 20 bp, Artificial Sequence
  Description of Artificial Sequence: Synthetic oligonucleotide
  Target: SCN9A; (+) strand; PAM type: YTN; PAM sequence: TTA
atcaattattctaaaagatt

SEQ ID NO: 109170 - DNA, 20 bp, Artificial Sequence
  Description of Artificial Sequence: Synthetic oligonucleotide
  Target: SCN9A; (+) strand; PAM type: YTN; PAM sequence: TTA
ttctaaaagatttttcctca

SEQ ID NO: 109171 - DNA, 20 bp, Artificial Sequence
  Description of Artificial Sequence: Synthetic oligonucleotide
  Target: SCN9A; (+) strand; PAM type: YTN; PAM sequence: TTC
taaaagatttttcctcatga

SEQ ID NO: 109172 - DNA, 20 bp, Artificial Sequence
  Description of Artificial Sequence: Synthetic oligonucleotide
  Target: SCN9A; (+) strand; PAM type: YTN; PAM sequence: CTA
aaagatttttcctcatgata

SEQ ID NO: 109173 - DNA, 20 bp, Artificial Sequence
  Description of Artificial Sequence: Synthetic oligonucleotide
  Target: SCN9A; (+) strand; PAM type: YTN; PAM sequence: TTT
ttcctcatgatataataatt

SEQ ID NO: 109174 - DNA, 20 bp, Artificial Sequence
  Description of Artificial Sequence: Synthetic oligonucleotide
  Target: SCN9A; (+) strand; PAM type: YTN; PAM sequence: TTT
tcctcatgatataataattt

SEQ ID NO: 109175 - DNA, 20 bp, Artificial Sequence
  Description of Artificial Sequence: Synthetic oligonucleotide
  Target: SCN9A; (+) strand; PAM type: YTN; PAM sequence: TTT
cctcatgatataataattta

SEQ ID NO: 109176 - DNA, 20 bp, Artificial Sequence
  Description of Artificial Sequence: Synthetic oligonucleotide
  Target: SCN9A; (+) strand; PAM type: YTN; PAM sequence: TTC
ctcatgatataataatttaa

SEQ ID NO: 109177 - DNA, 20 bp, Artificial Sequence
  Description of Artificial Sequence: Synthetic oligonucleotide
  Target: SCN9A; (+) strand; PAM type: YTN; PAM sequence: CTC
atgatataataatttaaaaa

SEQ ID NO: 109178 - DNA, 20 bp, Artificial Sequence
  Description of Artificial Sequence: Synthetic oligonucleotide
  Target: SCN9A; (+) strand; PAM type: YTN; PAM sequence: TTT
aaaaaaacacatagttccat

SEQ ID NO: 109179 - DNA, 20 bp, Artificial Sequence
  Description of Artificial Sequence: Synthetic oligonucleotide
  Target: SCN9A; (+) strand; PAM type: YTN; PAM sequence: TTA
aaaaaacacatagttccatg

SEQ ID NO: 109180 - DNA, 20 bp, Artificial Sequence
  Description of Artificial Sequence: Synthetic oligonucleotide
  Target: SCN9A; (+) strand; PAM type: YTN; PAM sequence: TTC
catgtgtttatatatatata

SEQ ID NO: 109181 - DNA, 20 bp, Artificial Sequence
  Description of Artificial Sequence: Synthetic oligonucleotide
  Target: SCN9A; (+) strand; PAM type: YTN; PAM sequence: TTT
atatatatatatatatatat

SEQ ID NO: 109182 - DNA, 20 bp, Artificial Sequence
  Description of Artificial Sequence: Synthetic oligonucleotide
  Target: SCN9A; (+) strand; PAM type: YTN; PAM sequence: TTA
tatatatatatatatatata

SEQ ID NO: 109183 - DNA, 20 bp, Artificial Sequence
  Description of Artificial Sequence: Synthetic oligonucleotide
  Target: SCN9A; (+) strand; PAM type: YTN; PAM sequence: TTT
atatgtatatgtgtatgtat

SEQ ID NO: 109184 - DNA, 20 bp, Artificial Sequence
  Description of Artificial Sequence: Synthetic oligonucleotide
  Target: SCN9A; (+) strand; PAM type: YTN; PAM sequence: TTA
tatgtatatgtgtatgtata

SEQ ID NO: 109185 - DNA, 20 bp, Artificial Sequence
  Description of Artificial Sequence: Synthetic oligonucleotide
  Target: SCN9A; (+) strand; PAM type: YTN; PAM sequence: CTA
agtcattgtaggtaaaaggt

SEQ ID NO: 109186 - DNA, 20 bp, Artificial Sequence
  Description of Artificial Sequence: Synthetic oligonucleotide
  Target: SCN9A; (+) strand; PAM type: YTN; PAM sequence: TTG
taggtaaaaggtttaagagg

SEQ ID NO: 109187 - DNA, 20 bp, Artificial Sequence
  Description of Artificial Sequence: Synthetic oligonucleotide
  Target: SCN9A; (+) strand; PAM type: YTN; PAM sequence: TTT
aagaggaacagccttagatc

SEQ ID NO: 109188 - DNA, 20 bp, Artificial Sequence
  Description of Artificial Sequence: Synthetic oligonucleotide
  Target: SCN9A; (+) strand; PAM type: YTN; PAM sequence: TTA
agaggaacagccttagatca

SEQ ID NO: 109189 - DNA, 20 bp, Artificial Sequence
  Description of Artificial Sequence: Synthetic oligonucleotide
  Target: SCN9A; (+) strand; PAM type: YTN; PAM sequence: CTT
agatcacttttcatgcagtg

SEQ ID NO: 109190 - DNA, 20 bp, Artificial Sequence
  Description of Artificial Sequence: Synthetic oligonucleotide
  Target: SCN9A; (+) strand; PAM type: YTN; PAM sequence: TTA
gatcacttttcatgcagtga

SEQ ID NO: 109191 - DNA, 20 bp, Artificial Sequence
  Description of Artificial Sequence: Synthetic oligonucleotide
  Target: SCN9A; (+) strand; PAM type: YTN; PAM sequence: CTT
ttcatgcagtgagatgatta

SEQ ID NO: 109192 - DNA, 20 bp, Artificial Sequence
  Description of Artificial Sequence: Synthetic oligonucleotide
  Target: SCN9A; (+) strand; PAM type: YTN; PAM sequence: TTT
tcatgcagtgagatgattat

SEQ ID NO: 109193 - DNA, 20 bp, Artificial Sequence
  Description of Artificial Sequence: Synthetic oligonucleotide
  Target: SCN9A; (+) strand; PAM type: YTN; PAM sequence: TTT
catgcagtgagatgattatg

SEQ ID NO: 109194 - DNA, 20 bp, Artificial Sequence
  Description of Artificial Sequence: Synthetic oligonucleotide
  Target: SCN9A; (+) strand; PAM type: YTN; PAM sequence: TTC
atgcagtgagatgattatgg

SEQ ID NO: 109195 - DNA, 20 bp, Artificial Sequence
  Description of Artificial Sequence: Synthetic oligonucleotide
  Target: SCN9A; (+) strand; PAM type: YTN; PAM sequence: TTA
tggggaaagtatcaattcta

SEQ ID NO: 109196 - DNA, 20 bp, Artificial Sequence
  Description of Artificial Sequence: Synthetic oligonucleotide
  Target: SCN9A; (+) strand; PAM type: YTN; PAM sequence: TTC
tagctcagcccagaattggt

SEQ ID NO: 109197 - DNA, 20 bp, Artificial Sequence
  Description of Artificial Sequence: Synthetic oligonucleotide
  Target: SCN9A; (+) strand; PAM type: YTN; PAM sequence: CTA
gctcagcccagaattggttc

SEQ ID NO: 109198 - DNA, 20 bp, Artificial Sequence
  Description of Artificial Sequence: Synthetic oligonucleotide
  Target: SCN9A; (+) strand; PAM type: YTN; PAM sequence: CTC
agcccagaattggttccttt

SEQ ID NO: 109199 - DNA, 20 bp, Artificial Sequence
  Description of Artificial Sequence: Synthetic oligonucleotide
  Target: SCN9A; (+) strand; PAM type: YTN; PAM sequence: TTG
gttcctttttccacaccaga

SEQ ID NO: 109200 - DNA, 20 bp, Artificial Sequence
  Description of Artificial Sequence: Synthetic oligonucleotide
  Target: SCN9A; (+) strand; PAM type: YTN; PAM sequence: TTC
ctttttccacaccagaaatg

SEQ ID NO: 109201 - DNA, 20 bp, Artificial Sequence
  Description of Artificial Sequence: Synthetic oligonucleotide
  Target: SCN9A; (+) strand; PAM type: YTN; PAM sequence: CTT
tttccacaccagaaatgagg

SEQ ID NO: 109202 - DNA, 20 bp, Artificial Sequence
  Description of Artificial Sequence: Synthetic oligonucleotide
  Target: SCN9A; (+) strand; PAM type: YTN; PAM sequence: TTT
ttccacaccagaaatgagga

SEQ ID NO: 109203 - DNA, 20 bp, Artificial Sequence
  Description of Artificial Sequence: Synthetic oligonucleotide
  Target: SCN9A; (+) strand; PAM type: YTN; PAM sequence: TTT
tccacaccagaaatgaggat

SEQ ID NO: 109204 - DNA, 20 bp, Artificial Sequence
  Description of Artificial Sequence: Synthetic oligonucleotide
  Target: SCN9A; (+) strand; PAM type: YTN; PAM sequence: TTT
ccacaccagaaatgaggata

SEQ ID NO: 109205 - DNA, 20 bp, Artificial Sequence
  Description of Artificial Sequence: Synthetic oligonucleotide
  Target: SCN9A; (+) strand; PAM type: YTN; PAM sequence: TTC
cacaccagaaatgaggatac

SEQ ID NO: 109206 - DNA, 20 bp, Artificial Sequence
  Description of Artificial Sequence: Synthetic oligonucleotide
  Target: SCN9A; (+) strand; PAM type: YTN; PAM sequence: TTT
atacacaaaaattcattaaa

SEQ ID NO: 109207 - DNA, 20 bp, Artificial Sequence
  Description of Artificial Sequence: Synthetic oligonucleotide
  Target: SCN9A; (+) strand; PAM type: YTN; PAM sequence: TTA
tacacaaaaattcattaaag

SEQ ID NO: 109208 - DNA, 20 bp, Artificial Sequence
  Description of Artificial Sequence: Synthetic oligonucleotide
  Target: SCN9A; (+) strand; PAM type: YTN; PAM sequence: TTC
attaaagaaaatctagctgg

SEQ ID NO: 109209 - DNA, 20 bp, Artificial Sequence
  Description of Artificial Sequence: Synthetic oligonucleotide
  Target: SCN9A; (+) strand; PAM type: YTN; PAM sequence: TTA
aagaaaatctagctggagaa

SEQ ID NO: 109210 - DNA, 20 bp, Artificial Sequence
  Description of Artificial Sequence: Synthetic oligonucleotide
  Target: SCN9A; (+) strand; PAM type: YTN; PAM sequence: CTA
gctggagaaggccaagcata

SEQ ID NO: 109211 - DNA, 20 bp, Artificial Sequence
  Description of Artificial Sequence: Synthetic oligonucleotide
  Target: SCN9A; (+) strand; PAM type: YTN; PAM sequence: CTG
gagaaggccaagcatatacc

SEQ ID NO: 109212 - DNA, 20 bp, Artificial Sequence
  Description of Artificial Sequence: Synthetic oligonucleotide
  Target: SCN9A; (+) strand; PAM type: YTN; PAM sequence: CTC
tgttgtaaccgtttgcattt

SEQ ID NO: 109213 - DNA, 20 bp, Artificial Sequence
  Description of Artificial Sequence: Synthetic oligonucleotide
  Target: SCN9A; (+) strand; PAM type: YTN; PAM sequence: CTG
ttgtaaccgtttgcatttct

SEQ ID NO: 109214 - DNA, 20 bp, Artificial Sequence
  Description of Artificial Sequence: Synthetic oligonucleotide
  Target: SCN9A; (+) strand; PAM type: YTN; PAM sequence: TTG
taaccgtttgcatttctacc

SEQ ID NO: 109215 - DNA, 20 bp, Artificial Sequence
  Description of Artificial Sequence: Synthetic oligonucleotide
  Target: SCN9A; (+) strand; PAM type: YTN; PAM sequence: TTT
gcatttctacctctaggaag

SEQ ID NO: 109216 - DNA, 20 bp, Artificial Sequence
  Description of Artificial Sequence: Synthetic oligonucleotide
  Target: SCN9A; (+) strand; PAM type: YTN; PAM sequence: TTG
catttctacctctaggaaga

SEQ ID NO: 109217 - DNA, 20 bp, Artificial Sequence
  Description of Artificial Sequence: Synthetic oligonucleotide
  Target: SCN9A; (+) strand; PAM type: YTN; PAM sequence: TTT
ctacctctaggaagaatttt

SEQ ID NO: 109218 - DNA, 20 bp, Artificial Sequence
  Description of Artificial Sequence: Synthetic oligonucleotide
  Target: SCN9A; (+) strand; PAM type: YTN; PAM sequence: TTC
tacctctaggaagaatttta

SEQ ID NO: 109219 - DNA, 20 bp, Artificial Sequence
  Description of Artificial Sequence: Synthetic oligonucleotide
  Target: SCN9A; (+) strand; PAM type: YTN; PAM sequence: CTA
cctctaggaagaattttaaa

SEQ ID NO: 109220 - DNA, 20 bp, Artificial Sequence
  Description of Artificial Sequence: Synthetic oligonucleotide
  Target: SCN9A; (+) strand; PAM type: YTN; PAM sequence: CTC
taggaagaattttaaatcaa

SEQ ID NO: 109221 - DNA, 20 bp, Artificial Sequence
  Description of Artificial Sequence: Synthetic oligonucleotide
  Target: SCN9A; (+) strand; PAM type: YTN; PAM sequence: CTA
ggaagaattttaaatcaaat

SEQ ID NO: 109222 - DNA, 20 bp, Artificial Sequence
  Description of Artificial Sequence: Synthetic oligonucleotide
  Target: SCN9A; (+) strand; PAM type: YTN; PAM sequence: TTT
taaatcaaataacagtacct

SEQ ID NO: 109223 - DNA, 20 bp, Artificial Sequence
  Description of Artificial Sequence: Synthetic oligonucleotide
  Target: SCN9A; (+) strand; PAM type: YTN; PAM sequence: TTT
aaatcaaataacagtacctc

SEQ ID NO: 109224 - DNA, 20 bp, Artificial Sequence
  Description of Artificial Sequence: Synthetic oligonucleotide
  Target: SCN9A; (+) strand; PAM type: YTN; PAM sequence: TTA
aatcaaataacagtacctca

SEQ ID NO: 109225 - DNA, 20 bp, Artificial Sequence
  Description of Artificial Sequence: Synthetic oligonucleotide
  Target: SCN9A; (+) strand; PAM type: YTN; PAM sequence: CTC
agcttcttcttgctcttttt

SEQ ID NO: 109226 - DNA, 20 bp, Artificial Sequence
  Description of Artificial Sequence: Synthetic oligonucleotide
  Target: SCN9A; (+) strand; PAM type: YTN; PAM sequence: CTT
cttcttgctcttttttaaga

SEQ ID NO: 109227 - DNA, 20 bp, Artificial Sequence
  Description of Artificial Sequence: Synthetic oligonucleotide
  Target: SCN9A; (+) strand; PAM type: YTN; PAM sequence: TTC
ttcttgctcttttttaagac

SEQ ID NO: 109228 - DNA, 20 bp, Artificial Sequence
  Description of Artificial Sequence: Synthetic oligonucleotide
  Target: SCN9A; (+) strand; PAM type: YTN; PAM sequence: CTT
cttgctcttttttaagacgg

SEQ ID NO: 109229 - DNA, 20 bp, Artificial Sequence
  Description of Artificial Sequence: Synthetic oligonucleotide
  Target: SCN9A; (+) strand; PAM type: YTN; PAM sequence: TTC
ttgctcttttttaagacggt

SEQ ID NO: 109230 - DNA, 20 bp, Artificial Sequence
  Description of Artificial Sequence: Synthetic oligonucleotide
  Target: SCN9A; (+) strand; PAM type: YTN; PAM sequence: CTT
gctcttttttaagacggtct

SEQ ID NO: 109231 - DNA, 20 bp, Artificial Sequence
  Description of Artificial Sequence: Synthetic oligonucleotide
  Target: SCN9A; (+) strand; PAM type: YTN; PAM sequence: TTG
ctcttttttaagacggtcta

SEQ ID NO: 109232 - DNA, 20 bp, Artificial Sequence
  Description of Artificial Sequence: Synthetic oligonucleotide
  Target: SCN9A; (+) strand; PAM type: YTN; PAM sequence: CTC
ttttttaagacggtctaaca

SEQ ID NO: 109233 - DNA, 20 bp, Artificial Sequence
  Description of Artificial Sequence: Synthetic oligonucleotide
  Target: SCN9A; (+) strand; PAM type: YTN; PAM sequence: CTT
ttttaagacggtctaacatc

SEQ ID NO: 109234 - DNA, 20 bp, Artificial Sequence
  Description of Artificial Sequence: Synthetic oligonucleotide
  Target: SCN9A; (+) strand; PAM type: YTN; PAM sequence: TTT
tttaagacggtctaacatct

SEQ ID NO: 109235 - DNA, 20 bp, Artificial Sequence
  Description of Artificial Sequence: Synthetic oligonucleotide
  Target: SCN9A; (+) strand; PAM type: YTN; PAM sequence: TTT
ttaagacggtctaacatctg

SEQ ID NO: 109236 - DNA, 20 bp, Artificial Sequence
  Description of Artificial Sequence: Synthetic oligonucleotide
  Target: SCN9A; (+) strand; PAM type: YTN; PAM sequence: TTT
taagacggtctaacatctgt

SEQ ID NO: 109237 - DNA, 20 bp, Artificial Sequence
  Description of Artificial Sequence: Synthetic oligonucleotide
  Target: SCN9A; (+) strand; PAM type: YTN; PAM sequence: TTT
aagacggtctaacatctgtt

SEQ ID NO: 109238 - DNA, 20 bp, Artificial Sequence
  Description of Artificial Sequence: Synthetic oligonucleotide
  Target: SCN9A; (+) strand; PAM type: YTN; PAM sequence: TTA
agacggtctaacatctgttg

SEQ ID NO: 109239 - DNA, 20 bp, Artificial Sequence
  Description of Artificial Sequence: Synthetic oligonucleotide
  Target: SCN9A; (+) strand; PAM type: YTN; PAM sequence: CTA
acatctgttgaaattctaat

SEQ ID NO: 109240 - DNA, 20 bp, Artificial Sequence
  Description of Artificial Sequence: Synthetic oligonucleotide
  Target: SCN9A; (+) strand; PAM type: YTN; PAM sequence: CTG
ttgaaattctaattctttct

SEQ ID NO: 109241 - DNA, 20 bp, Artificial Sequence
  Description of Artificial Sequence: Synthetic oligonucleotide
  Target: SCN9A; (+) strand; PAM type: YTN; PAM sequence: TTG
aaattctaattctttctgtt

SEQ ID NO: 109242 - DNA, 20 bp, Artificial Sequence
  Description of Artificial Sequence: Synthetic oligonucleotide
  Target: SCN9A; (+) strand; PAM type: YTN; PAM sequence: TTC
taattctttctgtttagctt

SEQ ID NO: 109243 - DNA, 20 bp, Artificial Sequence
  Description of Artificial Sequence: Synthetic oligonucleotide
  Target: SCN9A; (+) strand; PAM type: YTN; PAM sequence: CTA
attctttctgtttagcttct

SEQ ID NO: 109244 - DNA, 20 bp, Artificial Sequence
  Description of Artificial Sequence: Synthetic oligonucleotide
  Target: SCN9A; (+) strand; PAM type: YTN; PAM sequence: TTC
tttctgtttagcttcttcaa

SEQ ID NO: 109245 - DNA, 20 bp, Artificial Sequence
  Description of Artificial Sequence: Synthetic oligonucleotide
  Target: SCN9A; (+) strand; PAM type: YTN; PAM sequence: CTT
tctgtttagcttcttcaatg

SEQ ID NO: 109246 - DNA, 20 bp, Artificial Sequence
  Description of Artificial Sequence: Synthetic oligonucleotide
  Target: SCN9A; (+) strand; PAM type: YTN; PAM sequence: TTT
ctgtttagcttcttcaatgt

SEQ ID NO: 109247 - DNA, 20 bp, Artificial Sequence
  Description of Artificial Sequence: Synthetic oligonucleotide
  Target: SCN9A; (+) strand; PAM type: YTN; PAM sequence: TTC
tgtttagcttcttcaatgtt

SEQ ID NO: 109248 - DNA, 20 bp, Artificial Sequence
  Description of Artificial Sequence: Synthetic oligonucleotide
  Target: SCN9A; (+) strand; PAM type: YTN; PAM sequence: CTG
tttagcttcttcaatgtttg

SEQ ID NO: 109249 - DNA, 20 bp, Artificial Sequence
  Description of Artificial Sequence: Synthetic oligonucleotide
  Target: SCN9A; (+) strand; PAM type: YTN; PAM sequence: TTT
agcttcttcaatgtttgcct

SEQ ID NO: 109250 - DNA, 20 bp, Artificial Sequence
  Description of Artificial Sequence: Synthetic oligonucleotide
  Target: SCN9A; (+) strand; PAM type: YTN; PAM sequence: TTA
gcttcttcaatgtttgcctg

SEQ ID NO: 109251 - DNA, 20 bp, Artificial Sequence
  Description of Artificial Sequence: Synthetic oligonucleotide
  Target: SCN9A; (+) strand; PAM type: YTN; PAM sequence: CTT
cttcaatgtttgcctggttc

SEQ ID NO: 109252 - DNA, 20 bp, Artificial Sequence
  Description of Artificial Sequence: Synthetic oligonucleotide
  Target: SCN9A; (+) strand; PAM type: YTN; PAM sequence: TTC
ttcaatgtttgcctggttct

SEQ ID NO: 109253 - DNA, 20 bp, Artificial Sequence
  Description of Artificial Sequence: Synthetic oligonucleotide
  Target: SCN9A; (+) strand; PAM type: YTN; PAM sequence: CTT
caatgtttgcctggttctgt

SEQ ID NO: 109254 - DNA, 20 bp, Artificial Sequence
  Description of Artificial Sequence: Synthetic oligonucleotide
  Target: SCN9A; (+) strand; PAM type: YTN; PAM sequence: TTC
aatgtttgcctggttctgtt

SEQ ID NO: 109255 - DNA, 20 bp, Artificial Sequence
  Description of Artificial Sequence: Synthetic oligonucleotide
  Target: SCN9A; (+) strand; PAM type: YTN; PAM sequence: TTT
gcctggttctgttcttcata

SEQ ID NO: 109256 - DNA, 20 bp, Artificial Sequence
  Description of Artificial Sequence: Synthetic oligonucleotide
  Target: SCN9A; (+) strand; PAM type: YTN; PAM sequence: TTG
cctggttctgttcttcatat

SEQ ID NO: 109257 - DNA, 20 bp, Artificial Sequence
  Description of Artificial Sequence: Synthetic oligonucleotide
  Target: SCN9A; (+) strand; PAM type: YTN; PAM sequence: CTG
gttctgttcttcatatgcca

SEQ ID NO: 109258 - DNA, 20 bp, Artificial Sequence
  Description of Artificial Sequence: Synthetic oligonucleotide
  Target: SCN9A; (+) strand; PAM type: YTN; PAM sequence: TTC
tgttcttcatatgccatggc

SEQ ID NO: 109259 - DNA, 20 bp, Artificial Sequence
  Description of Artificial Sequence: Synthetic oligonucleotide
  Target: SCN9A; (+) strand; PAM type: YTN; PAM sequence: CTG
ttcttcatatgccatggcaa

SEQ ID NO: 109260 - DNA, 20 bp, Artificial Sequence
  Description of Artificial Sequence: Synthetic oligonucleotide
  Target: SCN9A; (+) strand; PAM type: YTN; PAM sequence: TTC
ttcatatgccatggcaacca

SEQ ID NO: 109261 - DNA, 20 bp, Artificial Sequence
  Description of Artificial Sequence: Synthetic oligonucleotide
  Target: SCN9A; (+) strand; PAM type: YTN; PAM sequence: CTT
catatgccatggcaaccaca

SEQ ID NO: 109262 - DNA, 20 bp, Artificial Sequence
  Description of Artificial Sequence: Synthetic oligonucleotide
  Target: SCN9A; (+) strand; PAM type: YTN; PAM sequence: TTC
atatgccatggcaaccacag

SEQ ID NO: 109263 - DNA, 20 bp, Artificial Sequence
  Description of Artificial Sequence: Synthetic oligonucleotide
  Target: SCN9A; (+) strand; PAM type: YTN; PAM sequence: TTT
attagataaaaggagcccag

SEQ ID NO: 109264 - DNA, 20 bp, Artificial Sequence
  Description of Artificial Sequence: Synthetic oligonucleotide
  Target: SCN9A; (+) strand; PAM type: YTN; PAM sequence: TTA
ttagataaaaggagcccagg

SEQ ID NO: 109265 - DNA, 20 bp, Artificial Sequence
  Description of Artificial Sequence: Synthetic oligonucleotide
  Target: SCN9A; (+) strand; PAM type: YTN; PAM sequence: TTA
gataaaaggagcccaggaaa

SEQ ID NO: 109266 - DNA, 20 bp, Artificial Sequence
  Description of Artificial Sequence: Synthetic oligonucleotide
  Target: SCN9A; (+) strand; PAM type: YTN; PAM sequence: CTA
cgacaaagaagatcatgtag

SEQ ID NO: 109267 - DNA, 20 bp, Artificial Sequence
  Description of Artificial Sequence: Synthetic oligonucleotide
  Target: SCN9A; (+) strand; PAM type: YTN; PAM sequence: TTT
tgccagcagcacgcagcgtc

SEQ ID NO: 109268 - DNA, 20 bp, Artificial Sequence
  Description of Artificial Sequence: Synthetic oligonucleotide
  Target: SCN9A; (+) strand; PAM type: YTN; PAM sequence: TTT
gccagcagcacgcagcgtct

SEQ ID NO: 109269 - DNA, 20 bp, Artificial Sequence
  Description of Artificial Sequence: Synthetic oligonucleotide
  Target: SCN9A; (+) strand; PAM type: YTN; PAM sequence: TTG
ccagcagcacgcagcgtcta

SEQ ID NO: 109270 - DNA, 20 bp, Artificial Sequence
  Description of Artificial Sequence: Synthetic oligonucleotide
  Target: SCN9A; (+) strand; PAM type: YTN; PAM sequence: CTA
gggaaaaatggaaattgtca

SEQ ID NO: 109271 - DNA, 20 bp, Artificial Sequence
  Description of Artificial Sequence: Synthetic oligonucleotide
  Target: SCN9A; (+) strand; PAM type: YTN; PAM sequence: TTG
tcatttgaacaataaaaagt

SEQ ID NO: 109272 - DNA, 20 bp, Artificial Sequence
  Description of Artificial Sequence: Synthetic oligonucleotide
  Target: SCN9A; (+) strand; PAM type: YTN; PAM sequence: TTT
gaacaataaaaagttttttt

SEQ ID NO: 109273 - DNA, 20 bp, Artificial Sequence
  Description of Artificial Sequence: Synthetic oligonucleotide
  Target: SCN9A; (+) strand; PAM type: YTN; PAM sequence: TTG
aacaataaaaagttttttta

SEQ ID NO: 109274 - DNA, 20 bp, Artificial Sequence
  Description of Artificial Sequence: Synthetic oligonucleotide
  Target: SCN9A; (+) strand; PAM type: YTN; PAM sequence: TTT
ttttagtaaattatttcaat

SEQ ID NO: 109275 - DNA, 20 bp, Artificial Sequence
  Description of Artificial Sequence: Synthetic oligonucleotide
  Target: SCN9A; (+) strand; PAM type: YTN; PAM sequence: TTT
tttagtaaattatttcaatt

SEQ ID NO: 109276 - DNA, 20 bp, Artificial Sequence
  Description of Artificial Sequence: Synthetic oligonucleotide
  Target: SCN9A; (+) strand; PAM type: YTN; PAM sequence: TTT
ttagtaaattatttcaattt

SEQ ID NO: 109277 - DNA, 20 bp, Artificial Sequence
  Description of Artificial Sequence: Synthetic oligonucleotide
  Target: SCN9A; (+) strand; PAM type: YTN; PAM sequence: TTT
tagtaaattatttcaatttg

SEQ ID NO: 109278 - DNA, 20 bp, Artificial Sequence
  Description of Artificial Sequence: Synthetic oligonucleotide
  Target: SCN9A; (+) strand; PAM type: YTN; PAM sequence: TTT
agtaaattatttcaatttga

SEQ ID NO: 109279 - DNA, 20 bp, Artificial Sequence
  Description of Artificial Sequence: Synthetic oligonucleotide
  Target: SCN9A; (+) strand; PAM type: YTN; PAM sequence: TTA
gtaaattatttcaatttgac

SEQ ID NO: 109280 - DNA, 20 bp, Artificial Sequence
  Description of Artificial Sequence: Synthetic oligonucleotide
  Target: SCN9A; (+) strand; PAM type: YTN; PAM sequence: TTA
tttcaatttgacaggcatga

SEQ ID NO: 109281 - DNA, 20 bp, Artificial Sequence
  Description of Artificial Sequence: Synthetic oligonucleotide
  Target: SCN9A; (+) strand; PAM type: YTN; PAM sequence: TTT
caatttgacaggcatgagca

SEQ ID NO: 109282 - DNA, 20 bp, Artificial Sequence
  Description of Artificial Sequence: Synthetic oligonucleotide
  Target: SCN9A; (+) strand; PAM type: YTN; PAM sequence: TTC
aatttgacaggcatgagcaa

SEQ ID NO: 109283 - DNA, 20 bp, Artificial Sequence
  Description of Artificial Sequence: Synthetic oligonucleotide
  Target: SCN9A; (+) strand; PAM type: YTN; PAM sequence: TTT
gacaggcatgagcaaatctg

SEQ ID NO: 109284 - DNA, 20 bp, Artificial Sequence
  Description of Artificial Sequence: Synthetic oligonucleotide
  Target: SCN9A; (+) strand; PAM type: YTN; PAM sequence: TTG
acaggcatgagcaaatctga

SEQ ID NO: 109285 - DNA, 20 bp, Artificial Sequence
  Description of Artificial Sequence: Synthetic oligonucleotide
  Target: SCN9A; (+) strand; PAM type: YTN; PAM sequence: CTG
acagtttggtataatctcat

SEQ ID NO: 109286 - DNA, 20 bp, Artificial Sequence
  Description of Artificial Sequence: Synthetic oligonucleotide
  Target: SCN9A; (+) strand; PAM type: YTN; PAM sequence: TTT
ggtataatctcatgttatca

SEQ ID NO: 109287 - DNA, 20 bp, Artificial Sequence
  Description of Artificial Sequence: Synthetic oligonucleotide
  Target: SCN9A; (+) strand; PAM type: YTN; PAM sequence: TTG
gtataatctcatgttatcaa

SEQ ID NO: 109288 - DNA, 20 bp, Artificial Sequence
  Description of Artificial Sequence: Synthetic oligonucleotide
  Target: SCN9A; (+) strand; PAM type: YTN; PAM sequence: CTC
atgttatcaaaaatataaag

SEQ ID NO: 109289 - DNA, 20 bp, Artificial Sequence
  Description of Artificial Sequence: Synthetic oligonucleotide
  Target: SCN9A; (+) strand; PAM type: YTN; PAM sequence: TTA
tcaaaaatataaagagaaaa

SEQ ID NO: 109290 - DNA, 20 bp, Artificial Sequence
  Description of Artificial Sequence: Synthetic oligonucleotide
  Target: SCN9A; (+) strand; PAM type: YTN; PAM sequence: TTA
tatcttcatggaaaacaaat

SEQ ID NO: 109291 - DNA, 20 bp, Artificial Sequence
  Description of Artificial Sequence: Synthetic oligonucleotide
  Target: SCN9A; (+) strand; PAM type: YTN; PAM sequence: CTT
catggaaaacaaatattaaa

SEQ ID NO: 109292 - DNA, 20 bp, Artificial Sequence
  Description of Artificial Sequence: Synthetic oligonucleotide
  Target: SCN9A; (+) strand; PAM type: YTN; PAM sequence: TTC
atggaaaacaaatattaaac

SEQ ID NO: 109293 - DNA, 20 bp, Artificial Sequence
  Description of Artificial Sequence: Synthetic oligonucleotide
  Target: SCN9A; (+) strand; PAM type: YTN; PAM sequence: TTA
aacacattttcagtacgaag

SEQ ID NO: 109294 - DNA, 20 bp, Artificial Sequence
  Description of Artificial Sequence: Synthetic oligonucleotide
  Target: SCN9A; (+) strand; PAM type: YTN; PAM sequence: TTT
tcagtacgaagaatatagca

SEQ ID NO: 109295 - DNA, 20 bp, Artificial Sequence
  Description of Artificial Sequence: Synthetic oligonucleotide
  Target: SCN9A; (+) strand; PAM type: YTN; PAM sequence: TTT
cagtacgaagaatatagcaa

SEQ ID NO: 109296 - DNA, 20 bp, Artificial Sequence
  Description of Artificial Sequence: Synthetic oligonucleotide
  Target: SCN9A; (+) strand; PAM type: YTN; PAM sequence: TTC
agtacgaagaatatagcaat

SEQ ID NO: 109297 - DNA, 20 bp, Artificial Sequence
  Description of Artificial Sequence: Synthetic oligonucleotide
  Target: SCN9A; (+) strand; PAM type: YTN; PAM sequence: CTT
gtactaaagtcatgtaagat

SEQ ID NO: 109298 - DNA, 20 bp, Artificial Sequence
  Description of Artificial Sequence: Synthetic oligonucleotide
  Target: SCN9A; (+) strand; PAM type: YTN; PAM sequence: TTG
tactaaagtcatgtaagatt

SEQ ID NO: 109299 - DNA, 20 bp, Artificial Sequence
  Description of Artificial Sequence: Synthetic oligonucleotide
  Target: SCN9A; (+) strand; PAM type: YTN; PAM sequence: CTA
aagtcatgtaagattcttga

SEQ ID NO: 109300 - DNA, 20 bp, Artificial Sequence
  Description of Artificial Sequence: Synthetic oligonucleotide
  Target: SCN9A; (+) strand; PAM type: YTN; PAM sequence: TTC
ttgattattaagtgtagtag

SEQ ID NO: 109301 - DNA, 20 bp, Artificial Sequence
  Description of Artificial Sequence: Synthetic oligonucleotide
  Target: SCN9A; (+) strand; PAM type: YTN; PAM sequence: CTT
gattattaagtgtagtagta

SEQ ID NO: 109302 - DNA, 20 bp, Artificial Sequence
  Description of Artificial Sequence: Synthetic oligonucleotide
  Target: SCN9A; (+) strand; PAM type: YTN; PAM sequence: TTG
attattaagtgtagtagtat

SEQ ID NO: 109303 - DNA, 20 bp, Artificial Sequence
  Description of Artificial Sequence: Synthetic oligonucleotide
  Target: SCN9A; (+) strand; PAM type: YTN; PAM sequence: TTA
ttaagtgtagtagtataaaa

SEQ ID NO: 109304 - DNA, 20 bp, Artificial Sequence
  Description of Artificial Sequence: Synthetic oligonucleotide
  Target: SCN9A; (+) strand; PAM type: YTN; PAM sequence: TTA
agtgtagtagtataaaaatc

SEQ ID NO: 109305 - DNA, 20 bp, Artificial Sequence
  Description of Artificial Sequence: Synthetic oligonucleotide
  Target: SCN9A; (+) strand; PAM type: YTN; PAM sequence: TTT
tttcctacagtctgaaaatt

SEQ ID NO: 109306 - DNA, 20 bp, Artificial Sequence
  Description of Artificial Sequence: Synthetic oligonucleotide
  Target: SCN9A; (+) strand; PAM type: YTN; PAM sequence: TTT
ttcctacagtctgaaaatta

SEQ ID NO: 109307 - DNA, 20 bp, Artificial Sequence
  Description of Artificial Sequence: Synthetic oligonucleotide
  Target: SCN9A; (+) strand; PAM type: YTN; PAM sequence: TTT
tcctacagtctgaaaattac

SEQ ID NO: 109308 - DNA, 20 bp, Artificial Sequence
  Description of Artificial Sequence: Synthetic oligonucleotide
  Target: SCN9A; (+) strand; PAM type: YTN; PAM sequence: TTT
cctacagtctgaaaattact

SEQ ID NO: 109309 - DNA, 20 bp, Artificial Sequence
  Description of Artificial Sequence: Synthetic oligonucleotide
  Target: SCN9A; (+) strand; PAM type: YTN; PAM sequence: TTC
ctacagtctgaaaattactc

SEQ ID NO: 109310 - DNA, 20 bp, Artificial Sequence
  Description of Artificial Sequence: Synthetic oligonucleotide
  Target: SCN9A; (+) strand; PAM type: YTN; PAM sequence: CTA
cagtctgaaaattactcata

SEQ ID NO: 109311 - DNA, 20 bp, Artificial Sequence
  Description of Artificial Sequence: Synthetic oligonucleotide
  Target: SCN9A; (+) strand; PAM type: YTN; PAM sequence: CTG
aaaattactcataaaattaa

SEQ ID NO: 109312 - DNA, 20 bp, Artificial Sequence
  Description of Artificial Sequence: Synthetic oligonucleotide
  Target: SCN9A; (+) strand; PAM type: YTN; PAM sequence: TTA
ctcataaaattaaatccttt

SEQ ID NO: 109313 - DNA, 20 bp, Artificial Sequence
  Description of Artificial Sequence: Synthetic oligonucleotide
  Target: SCN9A; (+) strand; PAM type: YTN; PAM sequence: CTC
ataaaattaaatcctttgct

SEQ ID NO: 109314 - DNA, 20 bp, Artificial Sequence
  Description of Artificial Sequence: Synthetic oligonucleotide
  Target: SCN9A; (+) strand; PAM type: YTN; PAM sequence: TTA
aatcctttgctcactttcaa

SEQ ID NO: 109315 - DNA, 20 bp, Artificial Sequence
  Description of Artificial Sequence: Synthetic oligonucleotide
  Target: SCN9A; (+) strand; PAM type: YTN; PAM sequence: CTT
tgctcactttcaaattttag

SEQ ID NO: 109316 - DNA, 20 bp, Artificial Sequence
  Description of Artificial Sequence: Synthetic oligonucleotide
  Target: SCN9A; (+) strand; PAM type: YTN; PAM sequence: TTT
gctcactttcaaattttagg

SEQ ID NO: 109317 - DNA, 20 bp, Artificial Sequence
  Description of Artificial Sequence: Synthetic oligonucleotide
  Target: SCN9A; (+) strand; PAM type: YTN; PAM sequence: TTG
ctcactttcaaattttagga

SEQ ID NO: 109318 - DNA, 20 bp, Artificial Sequence
  Description of Artificial Sequence: Synthetic oligonucleotide
  Target: SCN9A; (+) strand; PAM type: YTN; PAM sequence: CTC
actttcaaattttaggaaca

SEQ ID NO: 109319 - DNA, 20 bp, Artificial Sequence
  Description of Artificial Sequence: Synthetic oligonucleotide
  Target: SCN9A; (+) strand; PAM type: YTN; PAM sequence: CTT
tcaaattttaggaacaggtg

SEQ ID NO: 109320 - DNA, 20 bp, Artificial Sequence
  Description of Artificial Sequence: Synthetic oligonucleotide
  Target: SCN9A; (+) strand; PAM type: YTN; PAM sequence: TTT
caaattttaggaacaggtga

SEQ ID NO: 109321 - DNA, 20 bp, Artificial Sequence
  Description of Artificial Sequence: Synthetic oligonucleotide
  Target: SCN9A; (+) strand; PAM type: YTN; PAM sequence: TTC
aaattttaggaacaggtgat

SEQ ID NO: 109322 - DNA, 20 bp, Artificial Sequence
  Description of Artificial Sequence: Synthetic oligonucleotide
  Target: SCN9A; (+) strand; PAM type: YTN; PAM sequence: TTT
taggaacaggtgatatccat

SEQ ID NO: 109323 - DNA, 20 bp, Artificial Sequence
  Description of Artificial Sequence: Synthetic oligonucleotide
  Target: SCN9A; (+) strand; PAM type: YTN; PAM sequence: TTT
aggaacaggtgatatccata

SEQ ID NO: 109324 - DNA, 20 bp, Artificial Sequence
  Description of Artificial Sequence: Synthetic oligonucleotide
  Target: SCN9A; (+) strand; PAM type: YTN; PAM sequence: TTA
ggaacaggtgatatccatag

SEQ ID NO: 109325 - DNA, 20 bp, Artificial Sequence
  Description of Artificial Sequence: Synthetic oligonucleotide
  Target: SCN9A; (+) strand; PAM type: YTN; PAM sequence: CTT
ttactgttaaaattctatct

SEQ ID NO: 109326 - DNA, 20 bp, Artificial Sequence
  Description of Artificial Sequence: Synthetic oligonucleotide
  Target: SCN9A; (+) strand; PAM type: YTN; PAM sequence: TTT
tactgttaaaattctatctt

SEQ ID NO: 109327 - DNA, 20 bp, Artificial Sequence
  Description of Artificial Sequence: Synthetic oligonucleotide
  Target: SCN9A; (+) strand; PAM type: YTN; PAM sequence: TTT
actgttaaaattctatcttt

SEQ ID NO: 109328 - DNA, 20 bp, Artificial Sequence
  Description of Artificial Sequence: Synthetic oligonucleotide
  Target: SCN9A; (+) strand; PAM type: YTN; PAM sequence: TTA
ctgttaaaattctatctttt

SEQ ID NO: 109329 - DNA, 20 bp, Artificial Sequence
  Description of Artificial Sequence: Synthetic oligonucleotide
  Target: SCN9A; (+) strand; PAM type: YTN; PAM sequence: CTG
ttaaaattctatcttttctt

SEQ ID NO: 109330 - DNA, 20 bp, Artificial Sequence
  Description of Artificial Sequence: Synthetic oligonucleotide
  Target: SCN9A; (+) strand; PAM type: YTN; PAM sequence: TTA
aaattctatcttttctttct

SEQ ID NO: 109331 - DNA, 20 bp, Artificial Sequence
  Description of Artificial Sequence: Synthetic oligonucleotide
  Target: SCN9A; (+) strand; PAM type: YTN; PAM sequence: TTC
tatcttttctttctttatca

SEQ ID NO: 109332 - DNA, 20 bp, Artificial Sequence
  Description of Artificial Sequence: Synthetic oligonucleotide
  Target: SCN9A; (+) strand; PAM type: YTN; PAM sequence: CTA
tcttttctttctttatcatc

SEQ ID NO: 109333 - DNA, 20 bp, Artificial Sequence
  Description of Artificial Sequence: Synthetic oligonucleotide
  Target: SCN9A; (+) strand; PAM type: YTN; PAM sequence: CTT
ttctttctttatcatcaaat

SEQ ID NO: 109334 - DNA, 20 bp, Artificial Sequence
  Description of Artificial Sequence: Synthetic oligonucleotide
  Target: SCN9A; (+) strand; PAM type: YTN; PAM sequence: TTT
tctttctttatcatcaaata

SEQ ID NO: 109335 - DNA, 20 bp, Artificial Sequence
  Description of Artificial Sequence: Synthetic oligonucleotide
  Target: SCN9A; (+) strand; PAM type: YTN; PAM sequence: TTT
ctttctttatcatcaaatat

SEQ ID NO: 109336 - DNA, 20 bp, Artificial Sequence
  Description of Artificial Sequence: Synthetic oligonucleotide
  Target: SCN9A; (+) strand; PAM type: YTN; PAM sequence: TTC
tttctttatcatcaaatatt

SEQ ID NO: 109337 - DNA, 20 bp, Artificial Sequence
  Description of Artificial Sequence: Synthetic oligonucleotide
  Target: SCN9A; (+) strand; PAM type: YTN; PAM sequence: CTT
tctttatcatcaaatattaa

SEQ ID NO: 109338 - DNA, 20 bp, Artificial Sequence
  Description of Artificial Sequence: Synthetic oligonucleotide
  Target: SCN9A; (+) strand; PAM type: YTN; PAM sequence: TTT
ctttatcatcaaatattaat

SEQ ID NO: 109339 - DNA, 20 bp, Artificial Sequence
  Description of Artificial Sequence: Synthetic oligonucleotide
  Target: SCN9A; (+) strand; PAM type: YTN; PAM sequence: TTC
tttatcatcaaatattaata

SEQ ID NO: 109340 - DNA, 20 bp, Artificial Sequence
  Description of Artificial Sequence: Synthetic oligonucleotide
  Target: SCN9A; (+) strand; PAM type: YTN; PAM sequence: CTT
tatcatcaaatattaataat

SEQ ID NO: 109341 - DNA, 20 bp, Artificial Sequence
  Description of Artificial Sequence: Synthetic oligonucleotide
  Target: SCN9A; (+) strand; PAM type: YTN; PAM sequence: TTT
atcatcaaatattaataata

SEQ ID NO: 109342 - DNA, 20 bp, Artificial Sequence
  Description of Artificial Sequence: Synthetic oligonucleotide
  Target: SCN9A; (+) strand; PAM type: YTN; PAM sequence: TTA
tcatcaaatattaataatat

SEQ ID NO: 109343 - DNA, 20 bp, Artificial Sequence
  Description of Artificial Sequence: Synthetic oligonucleotide
  Target: SCN9A; (+) strand; PAM type: YTN; PAM sequence: TTA
ataatatcattgaatgttaa

SEQ ID NO: 109344 - DNA, 20 bp, Artificial Sequence
  Description of Artificial Sequence: Synthetic oligonucleotide
  Target: SCN9A; (+) strand; PAM type: YTN; PAM sequence: TTG
aatgttaacactaggcagat

SEQ ID NO: 109345 - DNA, 20 bp, Artificial Sequence
  Description of Artificial Sequence: Synthetic oligonucleotide
  Target: SCN9A; (+) strand; PAM type: YTN; PAM sequence: TTA
acactaggcagatggtctta

SEQ ID NO: 109346 - DNA, 20 bp, Artificial Sequence
  Description of Artificial Sequence: Synthetic oligonucleotide
  Target: SCN9A; (+) strand; PAM type: YTN; PAM sequence: CTA
ggcagatggtcttatttaat

SEQ ID NO: 109347 - DNA, 20 bp, Artificial Sequence
  Description of Artificial Sequence: Synthetic oligonucleotide
  Target: SCN9A; (+) strand; PAM type: YTN; PAM sequence: CTT
atttaattactttattcatc

SEQ ID NO: 109348 - DNA, 20 bp, Artificial Sequence
  Description of Artificial Sequence: Synthetic oligonucleotide
  Target: SCN9A; (+) strand; PAM type: YTN; PAM sequence: TTA
tttaattactttattcatct

SEQ ID NO: 109349 - DNA, 20 bp, Artificial Sequence
  Description of Artificial Sequence: Synthetic oligonucleotide
  Target: SCN9A; (+) strand; PAM type: YTN; PAM sequence: TTT
aattactttattcatctcat

SEQ ID NO: 109350 - DNA, 20 bp, Artificial Sequence
  Description of Artificial Sequence: Synthetic oligonucleotide
  Target: SCN9A; (+) strand; PAM type: YTN; PAM sequence: TTA
attactttattcatctcata

SEQ ID NO: 109351 - DNA, 20 bp, Artificial Sequence
  Description of Artificial Sequence: Synthetic oligonucleotide
  Target: SCN9A; (+) strand; PAM type: YTN; PAM sequence: TTA
ctttattcatctcataggta

SEQ ID NO: 109352 - DNA, 20 bp, Artificial Sequence
  Description of Artificial Sequence: Synthetic oligonucleotide
  Target: SCN9A; (+) strand; PAM type: YTN; PAM sequence: CTT
tattcatctcataggtattt

SEQ ID NO: 109353 - DNA, 20 bp, Artificial Sequence
  Description of Artificial Sequence: Synthetic oligonucleotide
  Target: SCN9A; (+) strand; PAM type: YTN; PAM sequence: TTT
attcatctcataggtatttt

SEQ ID NO: 109354 - DNA, 20 bp, Artificial Sequence
  Description of Artificial Sequence: Synthetic oligonucleotide
  Target: SCN9A; (+) strand; PAM type: YTN; PAM sequence: TTA
ttcatctcataggtattttc

SEQ ID NO: 109355 - DNA, 20 bp, Artificial Sequence
  Description of Artificial Sequence: Synthetic oligonucleotide
  Target: SCN9A; (+) strand; PAM type: YTN; PAM sequence: TTC
atctcataggtattttcaat

SEQ ID NO: 109356 - DNA, 20 bp, Artificial Sequence
  Description of Artificial Sequence: Synthetic oligonucleotide
  Target: SCN9A; (+) strand; PAM type: YTN; PAM sequence: CTC
ataggtattttcaattaact

SEQ ID NO: 109357 - DNA, 20 bp, Artificial Sequence
  Description of Artificial Sequence: Synthetic oligonucleotide
  Target: SCN9A; (+) strand; PAM type: YTN; PAM sequence: TTT
tcaattaactttttttttcg

SEQ ID NO: 109358 - DNA, 20 bp, Artificial Sequence
  Description of Artificial Sequence: Synthetic oligonucleotide
  Target: SCN9A; (+) strand; PAM type: YTN; PAM sequence: TTT
caattaactttttttttcgc

SEQ ID NO: 109359 - DNA, 20 bp, Artificial Sequence
  Description of Artificial Sequence: Synthetic oligonucleotide
  Target: SCN9A; (+) strand; PAM type: YTN; PAM sequence: TTC
aattaactttttttttcgct

SEQ ID NO: 109360 - DNA, 20 bp, Artificial Sequence
  Description of Artificial Sequence: Synthetic oligonucleotide
  Target: SCN9A; (+) strand; PAM type: YTN; PAM sequence: TTA
actttttttttcgctttctt

SEQ ID NO: 109361 - DNA, 20 bp, Artificial Sequence
  Description of Artificial Sequence: Synthetic oligonucleotide
  Target: SCN9A; (+) strand; PAM type: YTN; PAM sequence: CTT
tttttttcgctttctttgct

SEQ ID NO: 109362 - DNA, 20 bp, Artificial Sequence
  Description of Artificial Sequence: Synthetic oligonucleotide
  Target: SCN9A; (+) strand; PAM type: YTN; PAM sequence: TTT
ttttttcgctttctttgctt

SEQ ID NO: 109363 - DNA, 20 bp, Artificial Sequence
  Description of Artificial Sequence: Synthetic oligonucleotide
  Target: SCN9A; (+) strand; PAM type: YTN; PAM sequence: TTT
tttttcgctttctttgcttt

SEQ ID NO: 109364 - DNA, 20 bp, Artificial Sequence
  Description of Artificial Sequence: Synthetic oligonucleotide
  Target: SCN9A; (+) strand; PAM type: YTN; PAM sequence: TTT
ttttcgctttctttgctttt

SEQ ID NO: 109365 - DNA, 20 bp, Artificial Sequence
  Description of Artificial Sequence: Synthetic oligonucleotide
  Target: SCN9A; (+) strand; PAM type: YTN; PAM sequence: TTT
tttcgctttctttgcttttt

SEQ ID NO: 109366 - DNA, 20 bp, Artificial Sequence
  Description of Artificial Sequence: Synthetic oligonucleotide
  Target: SCN9A; (+) strand; PAM type: YTN; PAM sequence: TTT
ttcgctttctttgcttttta

SEQ ID NO: 109367 - DNA, 20 bp, Artificial Sequence
  Description of Artificial Sequence: Synthetic oligonucleotide
  Target: SCN9A; (+) strand; PAM type: YTN; PAM sequence: TTT
tcgctttctttgctttttaa

SEQ ID NO: 109368 - DNA, 20 bp, Artificial Sequence
  Description of Artificial Sequence: Synthetic oligonucleotide
  Target: SCN9A; (+) strand; PAM type: YTN; PAM sequence: TTT
cgctttctttgctttttaaa

SEQ ID NO: 109369 - DNA, 20 bp, Artificial Sequence
  Description of Artificial Sequence: Synthetic oligonucleotide
  Target: SCN9A; (+) strand; PAM type: YTN; PAM sequence: TTC
gctttctttgctttttaaaa

SEQ ID NO: 109370 - DNA, 20 bp, Artificial Sequence
  Description of Artificial Sequence: Synthetic oligonucleotide
  Target: SCN9A; (+) strand; PAM type: YTN; PAM sequence: CTT
tctttgctttttaaaataga

SEQ ID NO: 109371 - DNA, 20 bp, Artificial Sequence
  Description of Artificial Sequence: Synthetic oligonucleotide
  Target: SCN9A; (+) strand; PAM type: YTN; PAM sequence: TTT
ctttgctttttaaaatagaa

SEQ ID NO: 109372 - DNA, 20 bp, Artificial Sequence
  Description of Artificial Sequence: Synthetic oligonucleotide
  Target: SCN9A; (+) strand; PAM type: YTN; PAM sequence: TTC
tttgctttttaaaatagaat

SEQ ID NO: 109373 - DNA, 20 bp, Artificial Sequence
  Description of Artificial Sequence: Synthetic oligonucleotide
  Target: SCN9A; (+) strand; PAM type: YTN; PAM sequence: CTT
tgctttttaaaatagaattt

SEQ ID NO: 109374 - DNA, 20 bp, Artificial Sequence
  Description of Artificial Sequence: Synthetic oligonucleotide
  Target: SCN9A; (+) strand; PAM type: YTN; PAM sequence: TTT
gctttttaaaatagaatttt

SEQ ID NO: 109375 - DNA, 20 bp, Artificial Sequence
  Description of Artificial Sequence: Synthetic oligonucleotide
  Target: SCN9A; (+) strand; PAM type: YTN; PAM sequence: TTG
ctttttaaaatagaattttt

SEQ ID NO: 109376 - DNA, 20 bp, Artificial Sequence
  Description of Artificial Sequence: Synthetic oligonucleotide
  Target: SCN9A; (+) strand; PAM type: YTN; PAM sequence: CTT
tttaaaatagaatttttttt

SEQ ID NO: 109377 - DNA, 20 bp, Artificial Sequence
  Description of Artificial Sequence: Synthetic oligonucleotide
  Target: SCN9A; (+) strand; PAM type: YTN; PAM sequence: TTT
ttaaaatagaattttttttc

SEQ ID NO: 109378 - DNA, 20 bp, Artificial Sequence
  Description of Artificial Sequence: Synthetic oligonucleotide
  Target: SCN9A; (+) strand; PAM type: YTN; PAM sequence: TTT
taaaatagaattttttttca

SEQ ID NO: 109379 - DNA, 20 bp, Artificial Sequence
  Description of Artificial Sequence: Synthetic oligonucleotide
  Target: SCN9A; (+) strand; PAM type: YTN; PAM sequence: TTT
aaaatagaattttttttcaa

SEQ ID NO: 109380 - DNA, 20 bp, Artificial Sequence
  Description of Artificial Sequence: Synthetic oligonucleotide
  Target: SCN9A; (+) strand; PAM type: YTN; PAM sequence: TTA
aaatagaattttttttcaaa

SEQ ID NO: 109381 - DNA, 20 bp, Artificial Sequence
  Description of Artificial Sequence: Synthetic oligonucleotide
  Target: SCN9A; (+) strand; PAM type: YTN; PAM sequence: TTT
tttttcaaaatagttttagg

SEQ ID NO: 109382 - DNA, 20 bp, Artificial Sequence
  Description of Artificial Sequence: Synthetic oligonucleotide
  Target: SCN9A; (+) strand; PAM type: YTN; PAM sequence: TTT
ttttcaaaatagttttagga

SEQ ID NO: 109383 - DNA, 20 bp, Artificial Sequence
  Description of Artificial Sequence: Synthetic oligonucleotide
  Target: SCN9A; (+) strand; PAM type: YTN; PAM sequence: TTT
tttcaaaatagttttaggat

SEQ ID NO: 109384 - DNA, 20 bp, Artificial Sequence
  Description of Artificial Sequence: Synthetic oligonucleotide
  Target: SCN9A; (+) strand; PAM type: YTN; PAM sequence: TTT
ttcaaaatagttttaggatt

SEQ ID NO: 109385 - DNA, 20 bp, Artificial Sequence
  Description of Artificial Sequence: Synthetic oligonucleotide
  Target: SCN9A; (+) strand; PAM type: YTN; PAM sequence: TTT
tcaaaatagttttaggatta

SEQ ID NO: 109386 - DNA, 20 bp, Artificial Sequence
  Description of Artificial Sequence: Synthetic oligonucleotide
  Target: SCN9A; (+) strand; PAM type: YTN; PAM sequence: TTT
caaaatagttttaggattag

SEQ ID NO: 109387 - DNA, 20 bp, Artificial Sequence
  Description of Artificial Sequence: Synthetic oligonucleotide
  Target: SCN9A; (+) strand; PAM type: YTN; PAM sequence: TTC
aaaatagttttaggattaga

SEQ ID NO: 109388 - DNA, 20 bp, Artificial Sequence
  Description of Artificial Sequence: Synthetic oligonucleotide
  Target: SCN9A; (+) strand; PAM type: YTN; PAM sequence: TTT
taggattagaggaaaattaa

SEQ ID NO: 109389 - DNA, 20 bp, Artificial Sequence
  Description of Artificial Sequence: Synthetic oligonucleotide
  Target: SCN9A; (+) strand; PAM type: YTN; PAM sequence: TTT
aggattagaggaaaattaaa

SEQ ID NO: 109390 - DNA, 20 bp, Artificial Sequence
  Description of Artificial Sequence: Synthetic oligonucleotide
  Target: SCN9A; (+) strand; PAM type: YTN; PAM sequence: TTA
ggattagaggaaaattaaac

SEQ ID NO: 109391 - DNA, 20 bp, Artificial Sequence
  Description of Artificial Sequence: Synthetic oligonucleotide
  Target: SCN9A; (+) strand; PAM type: YTN; PAM sequence: TTA
gaggaaaattaaactgaagg

SEQ ID NO: 109392 - DNA, 20 bp, Artificial Sequence
  Description of Artificial Sequence: Synthetic oligonucleotide
  Target: SCN9A; (+) strand; PAM type: YTN; PAM sequence: TTA
aactgaaggtacagagattt

SEQ ID NO: 109393 - DNA, 20 bp, Artificial Sequence
  Description of Artificial Sequence: Synthetic oligonucleotide
  Target: SCN9A; (+) strand; PAM type: YTN; PAM sequence: CTG
aaggtacagagatttttttt

SEQ ID NO: 109394 - DNA, 20 bp, Artificial Sequence
  Description of Artificial Sequence: Synthetic oligonucleotide
  Target: SCN9A; (+) strand; PAM type: YTN; PAM sequence: TTT
ttttttctttttttcttttt

SEQ ID NO: 109395 - DNA, 20 bp, Artificial Sequence
  Description of Artificial Sequence: Synthetic oligonucleotide
  Target: SCN9A; (+) strand; PAM type: YTN; PAM sequence: TTT
tttttctttttttctttttt

SEQ ID NO: 109396 - DNA, 20 bp, Artificial Sequence
  Description of Artificial Sequence: Synthetic oligonucleotide
  Target: SCN9A; (+) strand; PAM type: YTN; PAM sequence: TTT
ttttctttttttcttttttt

SEQ ID NO: 109397 - DNA, 20 bp, Artificial Sequence
  Description of Artificial Sequence: Synthetic oligonucleotide
  Target: SCN9A; (+) strand; PAM type: YTN; PAM sequence: TTT
tttctttttttctttttttt

SEQ ID NO: 109398 - DNA, 20 bp, Artificial Sequence
  Description of Artificial Sequence: Synthetic oligonucleotide
  Target: SCN9A; (+) strand; PAM type: YTN; PAM sequence: TTT
ttctttttttcttttttttg

SEQ ID NO: 109399 - DNA, 20 bp, Artificial Sequence
  Description of Artificial Sequence: Synthetic oligonucleotide
  Target: SCN9A; (+) strand; PAM type: YTN; PAM sequence: TTT
tctttttttcttttttttgg

SEQ ID NO: 109400 - DNA, 20 bp, Artificial Sequence
  Description of Artificial Sequence: Synthetic oligonucleotide
  Target: SCN9A; (+) strand; PAM type: YTN; PAM sequence: TTT
ctttttttcttttttttggc

SEQ ID NO: 109401 - DNA, 20 bp, Artificial Sequence
  Description of Artificial Sequence: Synthetic oligonucleotide
  Target: SCN9A; (+) strand; PAM type: YTN; PAM sequence: TTC
tttttttcttttttttggca

SEQ ID NO: 109402 - DNA, 20 bp, Artificial Sequence
  Description of Artificial Sequence: Synthetic oligonucleotide
  Target: SCN9A; (+) strand; PAM type: YTN; PAM sequence: CTT
tttttcttttttttggcata

SEQ ID NO: 109403 - DNA, 20 bp, Artificial Sequence
  Description of Artificial Sequence: Synthetic oligonucleotide
  Target: SCN9A; (+) strand; PAM type: YTN; PAM sequence: TTT
ttttcttttttttggcataa

SEQ ID NO: 109404 - DNA, 20 bp, Artificial Sequence
  Description of Artificial Sequence: Synthetic oligonucleotide
  Target: SCN9A; (+) strand; PAM type: YTN; PAM sequence: TTT
tttcttttttttggcataac

SEQ ID NO: 109405 - DNA, 20 bp, Artificial Sequence
  Description of Artificial Sequence: Synthetic oligonucleotide
  Target: SCN9A; (+) strand; PAM type: YTN; PAM sequence: TTT
ttcttttttttggcataacg

SEQ ID NO: 109406 - DNA, 20 bp, Artificial Sequence
  Description of Artificial Sequence: Synthetic oligonucleotide
  Target: SCN9A; (+) strand; PAM type: YTN; PAM sequence: TTT
tcttttttttggcataacgt

SEQ ID NO: 109407 - DNA, 20 bp, Artificial Sequence
  Description of Artificial Sequence: Synthetic oligonucleotide
  Target: SCN9A; (+) strand; PAM type: YTN; PAM sequence: TTT
cttttttttggcataacgtg

SEQ ID NO: 109408 - DNA, 20 bp, Artificial Sequence
  Description of Artificial Sequence: Synthetic oligonucleotide
  Target: SCN9A; (+) strand; PAM type: YTN; PAM sequence: TTC
ttttttttggcataacgtgc

SEQ ID NO: 109409 - DNA, 20 bp, Artificial Sequence
  Description of Artificial Sequence: Synthetic oligonucleotide
  Target: SCN9A; (+) strand; PAM type: YTN; PAM sequence: CTT
ttttttggcataacgtgcag

SEQ ID NO: 109410 - DNA, 20 bp, Artificial Sequence
  Description of Artificial Sequence: Synthetic oligonucleotide
  Target: SCN9A; (+) strand; PAM type: YTN; PAM sequence: TTT
tttttggcataacgtgcagg

SEQ ID NO: 109411 - DNA, 20 bp, Artificial Sequence
  Description of Artificial Sequence: Synthetic oligonucleotide
  Target: SCN9A; (+) strand; PAM type: YTN; PAM sequence: TTT
ttttggcataacgtgcaggt

SEQ ID NO: 109412 - DNA, 20 bp, Artificial Sequence
  Description of Artificial Sequence: Synthetic oligonucleotide
  Target: SCN9A; (+) strand; PAM type: YTN; PAM sequence: TTT
tttggcataacgtgcaggtt

SEQ ID NO: 109413 - DNA, 20 bp, Artificial Sequence
  Description of Artificial Sequence: Synthetic oligonucleotide
  Target: SCN9A; (+) strand; PAM type: YTN; PAM sequence: TTT
ttggcataacgtgcaggttt

SEQ ID NO: 109414 - DNA, 20 bp, Artificial Sequence
  Description of Artificial Sequence: Synthetic oligonucleotide
  Target: SCN9A; (+) strand; PAM type: YTN; PAM sequence: TTT
tggcataacgtgcaggtttg

SEQ ID NO: 109415 - DNA, 20 bp, Artificial Sequence
  Description of Artificial Sequence: Synthetic oligonucleotide
  Target: SCN9A; (+) strand; PAM type: YTN; PAM sequence: TTT
ggcataacgtgcaggtttgt

SEQ ID NO: 109416 - DNA, 20 bp, Artificial Sequence
  Description of Artificial Sequence: Synthetic oligonucleotide
  Target: SCN9A; (+) strand; PAM type: YTN; PAM sequence: TTG
gcataacgtgcaggtttgtt

SEQ ID NO: 109417 - DNA, 20 bp, Artificial Sequence
  Description of Artificial Sequence: Synthetic oligonucleotide
  Target: SCN9A; (+) strand; PAM type: YTN; PAM sequence: TTT
gttacatgggtagacacgtg

SEQ ID NO: 109418 - DNA, 20 bp, Artificial Sequence
  Description of Artificial Sequence: Synthetic oligonucleotide
  Target: SCN9A; (+) strand; PAM type: YTN; PAM sequence: TTG
ttacatgggtagacacgtgc

SEQ ID NO: 109419 - DNA, 20 bp, Artificial Sequence
  Description of Artificial Sequence: Synthetic oligonucleotide
  Target: SCN9A; (+) strand; PAM type: YTN; PAM sequence: TTA
catgggtagacacgtgccat

SEQ ID NO: 109420 - DNA, 20 bp, Artificial Sequence
  Description of Artificial Sequence: Synthetic oligonucleotide
  Target: SCN9A; (+) strand; PAM type: YTN; PAM sequence: TTT
gctgcacccatcaacctgtt

SEQ ID NO: 109421 - DNA, 20 bp, Artificial Sequence
  Description of Artificial Sequence: Synthetic oligonucleotide
  Target: SCN9A; (+) strand; PAM type: YTN; PAM sequence: TTG
ctgcacccatcaacctgtta

SEQ ID NO: 109422 - DNA, 20 bp, Artificial Sequence
  Description of Artificial Sequence: Synthetic oligonucleotide
  Target: SCN9A; (+) strand; PAM type: YTN; PAM sequence: CTG
cacccatcaacctgttacct

SEQ ID NO: 109423 - DNA, 20 bp, Artificial Sequence
  Description of Artificial Sequence: Synthetic oligonucleotide
  Target: SCN9A; (+) strand; PAM type: YTN; PAM sequence: CTG
ttacctacattaggtatgtc

SEQ ID NO: 109424 - DNA, 20 bp, Artificial Sequence
  Description of Artificial Sequence: Synthetic oligonucleotide
  Target: SCN9A; (+) strand; PAM type: YTN; PAM sequence: TTA
cctacattaggtatgtctcc

SEQ ID NO: 109425 - DNA, 20 bp, Artificial Sequence
  Description of Artificial Sequence: Synthetic oligonucleotide
  Target: SCN9A; (+) strand; PAM type: YTN; PAM sequence: CTA
cattaggtatgtctcctaat

SEQ ID NO: 109426 - DNA, 20 bp, Artificial Sequence
  Description of Artificial Sequence: Synthetic oligonucleotide
  Target: SCN9A; (+) strand; PAM type: YTN; PAM sequence: TTA
ggtatgtctcctaatgctat

SEQ ID NO: 109427 - DNA, 20 bp, Artificial Sequence
  Description of Artificial Sequence: Synthetic oligonucleotide
  Target: SCN9A; (+) strand; PAM type: YTN; PAM sequence: CTC
ctaatgctattcctcccttt

SEQ ID NO: 109428 - DNA, 20 bp, Artificial Sequence
  Description of Artificial Sequence: Synthetic oligonucleotide
  Target: SCN9A; (+) strand; PAM type: YTN; PAM sequence: CTA
atgctattcctccctttgcc

SEQ ID NO: 109429 - DNA, 20 bp, Artificial Sequence
  Description of Artificial Sequence: Synthetic oligonucleotide
  Target: SCN9A; (+) strand; PAM type: YTN; PAM sequence: CTA
ttcctccctttgccccccac

SEQ ID NO: 109430 - DNA, 20 bp, Artificial Sequence
  Description of Artificial Sequence: Synthetic oligonucleotide
  Target: SCN9A; (+) strand; PAM type: YTN; PAM sequence: TTC
ctccctttgccccccaccac

SEQ ID NO: 109431 - DNA, 20 bp, Artificial Sequence
  Description of Artificial Sequence: Synthetic oligonucleotide
  Target: SCN9A; (+) strand; PAM type: YTN; PAM sequence: CTC
cctttgccccccaccaccga

SEQ ID NO: 109432 - DNA, 20 bp, Artificial Sequence
  Description of Artificial Sequence: Synthetic oligonucleotide
  Target: SCN9A; (+) strand; PAM type: YTN; PAM sequence: CTT
tgccccccaccaccgacagg

SEQ ID NO: 109433 - DNA, 20 bp, Artificial Sequence
  Description of Artificial Sequence: Synthetic oligonucleotide
  Target: SCN9A; (+) strand; PAM type: YTN; PAM sequence: TTT
gccccccaccaccgacaggc

SEQ ID NO: 109434 - DNA, 20 bp, Artificial Sequence
  Description of Artificial Sequence: Synthetic oligonucleotide
  Target: SCN9A; (+) strand; PAM type: YTN; PAM sequence: TTG
ccccccaccaccgacaggcc

SEQ ID NO: 109435 - DNA, 20 bp, Artificial Sequence
  Description of Artificial Sequence: Synthetic oligonucleotide
  Target: SCN9A; (+) strand; PAM type: YTN; PAM sequence: CTT
ctcattgcccatgtgttctc

SEQ ID NO: 109436 - DNA, 20 bp, Artificial Sequence
  Description of Artificial Sequence: Synthetic oligonucleotide
  Target: SCN9A; (+) strand; PAM type: YTN; PAM sequence: TTC
tcattgcccatgtgttctca

SEQ ID NO: 109437 - DNA, 20 bp, Artificial Sequence
  Description of Artificial Sequence: Synthetic oligonucleotide
  Target: SCN9A; (+) strand; PAM type: YTN; PAM sequence: CTC
attgcccatgtgttctcatt

SEQ ID NO: 109438 - DNA, 20 bp, Artificial Sequence
  Description of Artificial Sequence: Synthetic oligonucleotide
  Target: SCN9A; (+) strand; PAM type: YTN; PAM sequence: TTG
cccatgtgttctcattgccc

SEQ ID NO: 109439 - DNA, 20 bp, Artificial Sequence
  Description of Artificial Sequence: Synthetic oligonucleotide
  Target: SCN9A; (+) strand; PAM type: YTN; PAM sequence: TTC
tcattgcccacctctcactc

SEQ ID NO: 109440 - DNA, 20 bp, Artificial Sequence
  Description of Artificial Sequence: Synthetic oligonucleotide
  Target: SCN9A; (+) strand; PAM type: YTN; PAM sequence: CTC
attgcccacctctcactcat

SEQ ID NO: 109441 - DNA, 20 bp, Artificial Sequence
  Description of Artificial Sequence: Synthetic oligonucleotide
  Target: SCN9A; (+) strand; PAM type: YTN; PAM sequence: TTG
cccacctctcactcatgagt

SEQ ID NO: 109442 - DNA, 20 bp, Artificial Sequence
  Description of Artificial Sequence: Synthetic oligonucleotide
  Target: SCN9A; (+) strand; PAM type: YTN; PAM sequence: CTC
tcactcatgagtgagaacat

SEQ ID NO: 109443 - DNA, 20 bp, Artificial Sequence
  Description of Artificial Sequence: Synthetic oligonucleotide
  Target: SCN9A; (+) strand; PAM type: YTN; PAM sequence: CTC
actcatgagtgagaacatgc

SEQ ID NO: 109444 - DNA, 20 bp, Artificial Sequence
  Description of Artificial Sequence: Synthetic oligonucleotide
  Target: SCN9A; (+) strand; PAM type: YTN; PAM sequence: CTC
atgagtgagaacatgcgttg

SEQ ID NO: 109445 - DNA, 20 bp, Artificial Sequence
  Description of Artificial Sequence: Synthetic oligonucleotide
  Target: SCN9A; (+) strand; PAM type: YTN; PAM sequence: TTG
tttggttttctgttcctgtt

SEQ ID NO: 109446 - DNA, 20 bp, Artificial Sequence
  Description of Artificial Sequence: Synthetic oligonucleotide
  Target: SCN9A; (+) strand; PAM type: YTN; PAM sequence: TTT
ggttttctgttcctgtttta

SEQ ID NO: 109447 - DNA, 20 bp, Artificial Sequence
  Description of Artificial Sequence: Synthetic oligonucleotide
  Target: SCN9A; (+) strand; PAM type: YTN; PAM sequence: TTG
gttttctgttcctgttttag

SEQ ID NO: 109448 - DNA, 20 bp, Artificial Sequence
  Description of Artificial Sequence: Synthetic oligonucleotide
  Target: SCN9A; (+) strand; PAM type: YTN; PAM sequence: TTT
tctgttcctgttttagtttg

SEQ ID NO: 109449 - DNA, 20 bp, Artificial Sequence
  Description of Artificial Sequence: Synthetic oligonucleotide
  Target: SCN9A; (+) strand; PAM type: YTN; PAM sequence: TTT
ctgttcctgttttagtttgc

SEQ ID NO: 109450 - DNA, 20 bp, Artificial Sequence
  Description of Artificial Sequence: Synthetic oligonucleotide
  Target: SCN9A; (+) strand; PAM type: YTN; PAM sequence: TTC
tgttcctgttttagtttgct

SEQ ID NO: 109451 - DNA, 20 bp, Artificial Sequence
  Description of Artificial Sequence: Synthetic oligonucleotide
  Target: SCN9A; (+) strand; PAM type: YTN; PAM sequence: CTG
ttcctgttttagtttgctga

SEQ ID NO: 109452 - DNA, 20 bp, Artificial Sequence
  Description of Artificial Sequence: Synthetic oligonucleotide
  Target: SCN9A; (+) strand; PAM type: YTN; PAM sequence: TTC
ctgttttagtttgctgagaa

SEQ ID NO: 109453 - DNA, 20 bp, Artificial Sequence
  Description of Artificial Sequence: Synthetic oligonucleotide
  Target: SCN9A; (+) strand; PAM type: YTN; PAM sequence: CTG
ttttagtttgctgagaatga

SEQ ID NO: 109454 - DNA, 20 bp, Artificial Sequence
  Description of Artificial Sequence: Synthetic oligonucleotide
  Target: SCN9A; (+) strand; PAM type: YTN; PAM sequence: TTT
tagtttgctgagaatgatgg

SEQ ID NO: 109455 - DNA, 20 bp, Artificial Sequence
  Description of Artificial Sequence: Synthetic oligonucleotide
  Target: SCN9A; (+) strand; PAM type: YTN; PAM sequence: TTT
agtttgctgagaatgatggt

SEQ ID NO: 109456 - DNA, 20 bp, Artificial Sequence
  Description of Artificial Sequence: Synthetic oligonucleotide
  Target: SCN9A; (+) strand; PAM type: YTN; PAM sequence: TTA
gtttgctgagaatgatggtt

SEQ ID NO: 109457 - DNA, 20 bp, Artificial Sequence
  Description of Artificial Sequence: Synthetic oligonucleotide
  Target: SCN9A; (+) strand; PAM type: YTN; PAM sequence: TTT
gctgagaatgatggtttcta

SEQ ID NO: 109458 - DNA, 20 bp, Artificial Sequence
  Description of Artificial Sequence: Synthetic oligonucleotide
  Target: SCN9A; (+) strand; PAM type: YTN; PAM sequence: TTG
ctgagaatgatggtttctag

SEQ ID NO: 109459 - DNA, 20 bp, Artificial Sequence
  Description of Artificial Sequence: Synthetic oligonucleotide
  Target: SCN9A; (+) strand; PAM type: YTN; PAM sequence: CTG
agaatgatggtttctagctt

SEQ ID NO: 109460 - DNA, 20 bp, Artificial Sequence
  Description of Artificial Sequence: Synthetic oligonucleotide
  Target: SCN9A; (+) strand; PAM type: YTN; PAM sequence: TTT
ctagcttcatccatgtccct

SEQ ID NO: 109461 - DNA, 20 bp, Artificial Sequence
  Description of Artificial Sequence: Synthetic oligonucleotide
  Target: SCN9A; (+) strand; PAM type: YTN; PAM sequence: TTC
tagcttcatccatgtccctg

SEQ ID NO: 109462 - DNA, 20 bp, Artificial Sequence
  Description of Artificial Sequence: Synthetic oligonucleotide
  Target: SCN9A; (+) strand; PAM type: YTN; PAM sequence: CTA
gcttcatccatgtccctgca

SEQ ID NO: 109463 - DNA, 20 bp, Artificial Sequence
  Description of Artificial Sequence: Synthetic oligonucleotide
  Target: SCN9A; (+) strand; PAM type: YTN; PAM sequence: CTT
catccatgtccctgcaaagg

SEQ ID NO: 109464 - DNA, 20 bp, Artificial Sequence
  Description of Artificial Sequence: Synthetic oligonucleotide
  Target: SCN9A; (+) strand; PAM type: YTN; PAM sequence: TTC
atccatgtccctgcaaagga

SEQ ID NO: 109465 - DNA, 20 bp, Artificial Sequence
  Description of Artificial Sequence: Synthetic oligonucleotide
  Target: SCN9A; (+) strand; PAM type: YTN; PAM sequence: CTG
caaaggacatgaacttattc

SEQ ID NO: 109466 - DNA, 20 bp, Artificial Sequence
  Description of Artificial Sequence: Synthetic oligonucleotide
  Target: SCN9A; (+) strand; PAM type: YTN; PAM sequence: CTT
attcttttttatggctgcat

SEQ ID NO: 109467 - DNA, 20 bp, Artificial Sequence
  Description of Artificial Sequence: Synthetic oligonucleotide
  Target: SCN9A; (+) strand; PAM type: YTN; PAM sequence: TTA
ttcttttttatggctgcata

SEQ ID NO: 109468 - DNA, 20 bp, Artificial Sequence
  Description of Artificial Sequence: Synthetic oligonucleotide
  Target: SCN9A; (+) strand; PAM type: YTN; PAM sequence: TTC
ttttttatggctgcatagta

SEQ ID NO: 109469 - DNA, 20 bp, Artificial Sequence
  Description of Artificial Sequence: Synthetic oligonucleotide
  Target: SCN9A; (+) strand; PAM type: YTN; PAM sequence: CTT
ttttatggctgcatagtatt

SEQ ID NO: 109470 - DNA, 20 bp, Artificial Sequence
  Description of Artificial Sequence: Synthetic oligonucleotide
  Target: SCN9A; (+) strand; PAM type: YTN; PAM sequence: TTT
tttatggctgcatagtattc

SEQ ID NO: 109471 - DNA, 20 bp, Artificial Sequence
  Description of Artificial Sequence: Synthetic oligonucleotide
  Target: SCN9A; (+) strand; PAM type: YTN; PAM sequence: TTT
ttatggctgcatagtattcc

SEQ ID NO: 109472 - DNA, 20 bp, Artificial Sequence
  Description of Artificial Sequence: Synthetic oligonucleotide
  Target: SCN9A; (+) strand; PAM type: YTN; PAM sequence: TTT
tatggctgcatagtattcca

SEQ ID NO: 109473 - DNA, 20 bp, Artificial Sequence
  Description of Artificial Sequence: Synthetic oligonucleotide
  Target: SCN9A; (+) strand; PAM type: YTN; PAM sequence: TTT
atggctgcatagtattccat

SEQ ID NO: 109474 - DNA, 20 bp, Artificial Sequence
  Description of Artificial Sequence: Synthetic oligonucleotide
  Target: SCN9A; (+) strand; PAM type: YTN; PAM sequence: TTA
tggctgcatagtattccatg

SEQ ID NO: 109475 - DNA, 20 bp, Artificial Sequence
  Description of Artificial Sequence: Synthetic oligonucleotide
  Target: SCN9A; (+) strand; PAM type: YTN; PAM sequence: CTG
catagtattccatggtgtat

SEQ ID NO: 109476 - DNA, 20 bp, Artificial Sequence
  Description of Artificial Sequence: Synthetic oligonucleotide
  Target: SCN9A; (+) strand; PAM type: YTN; PAM sequence: TTC
catggtgtatatgtgccaca

SEQ ID NO: 109477 - DNA, 20 bp, Artificial Sequence
  Description of Artificial Sequence: Synthetic oligonucleotide
  Target: SCN9A; (+) strand; PAM type: YTN; PAM sequence: TTT
tctttatccagtctatcatt

SEQ ID NO: 109478 - DNA, 20 bp, Artificial Sequence
  Description of Artificial Sequence: Synthetic oligonucleotide
  Target: SCN9A; (+) strand; PAM type: YTN; PAM sequence: TTT
ctttatccagtctatcattg

SEQ ID NO: 109479 - DNA, 20 bp, Artificial Sequence
  Description of Artificial Sequence: Synthetic oligonucleotide
  Target: SCN9A; (+) strand; PAM type: YTN; PAM sequence: TTC
tttatccagtctatcattga

SEQ ID NO: 109480 - DNA, 20 bp, Artificial Sequence
  Description of Artificial Sequence: Synthetic oligonucleotide
  Target: SCN9A; (+) strand; PAM type: YTN; PAM sequence: CTT
tatccagtctatcattgatg

SEQ ID NO: 109481 - DNA, 20 bp, Artificial Sequence
  Description of Artificial Sequence: Synthetic oligonucleotide
  Target: SCN9A; (+) strand; PAM type: YTN; PAM sequence: TTT
atccagtctatcattgatgg

SEQ ID NO: 109482 - DNA, 20 bp, Artificial Sequence
  Description of Artificial Sequence: Synthetic oligonucleotide
  Target: SCN9A; (+) strand; PAM type: YTN; PAM sequence: TTA
tccagtctatcattgatggg

SEQ ID NO: 109483 - DNA, 20 bp, Artificial Sequence
  Description of Artificial Sequence: Synthetic oligonucleotide
  Target: SCN9A; (+) strand; PAM type: YTN; PAM sequence: CTA
tcattgatgggcatttgggt

SEQ ID NO: 109484 - DNA, 20 bp, Artificial Sequence
  Description of Artificial Sequence: Synthetic oligonucleotide
  Target: SCN9A; (+) strand; PAM type: YTN; PAM sequence: TTG
atgggcatttgggttggttc

SEQ ID NO: 109485 - DNA, 20 bp, Artificial Sequence
  Description of Artificial Sequence: Synthetic oligonucleotide
  Target: SCN9A; (+) strand; PAM type: YTN; PAM sequence: TTT
gggttggttcccagtctttg

SEQ ID NO: 109486 - DNA, 20 bp, Artificial Sequence
  Description of Artificial Sequence: Synthetic oligonucleotide
  Target: SCN9A; (+) strand; PAM type: YTN; PAM sequence: TTG
ggttggttcccagtctttgc

SEQ ID NO: 109487 - DNA, 20 bp, Artificial Sequence
  Description of Artificial Sequence: Synthetic oligonucleotide
  Target: SCN9A; (+) strand; PAM type: YTN; PAM sequence: TTG
gttcccagtctttgctattg

SEQ ID NO: 109488 - DNA, 20 bp, Artificial Sequence
  Description of Artificial Sequence: Synthetic oligonucleotide
  Target: SCN9A; (+) strand; PAM type: YTN; PAM sequence: TTC
ccagtctttgctattgtgaa

SEQ ID NO: 109489 - DNA, 20 bp, Artificial Sequence
  Description of Artificial Sequence: Synthetic oligonucleotide
  Target: SCN9A; (+) strand; PAM type: YTN; PAM sequence: CTT
tgctattgtgaatagtgcca

SEQ ID NO: 109490 - DNA, 20 bp, Artificial Sequence
  Description of Artificial Sequence: Synthetic oligonucleotide
  Target: SCN9A; (+) strand; PAM type: YTN; PAM sequence: TTT
gctattgtgaatagtgccac

SEQ ID NO: 109491 - DNA, 20 bp, Artificial Sequence
  Description of Artificial Sequence: Synthetic oligonucleotide
  Target: SCN9A; (+) strand; PAM type: YTN; PAM sequence: TTG
ctattgtgaatagtgccaca

SEQ ID NO: 109492 - DNA, 20 bp, Artificial Sequence
  Description of Artificial Sequence: Synthetic oligonucleotide
  Target: SCN9A; (+) strand; PAM type: YTN; PAM sequence: CTA
ttgtgaatagtgccacaata

SEQ ID NO: 109493 - DNA, 20 bp, Artificial Sequence
  Description of Artificial Sequence: Synthetic oligonucleotide
  Target: SCN9A; (+) strand; PAM type: YTN; PAM sequence: TTG
tgaatagtgccacaataaac

SEQ ID NO: 109494 - DNA, 20 bp, Artificial Sequence
  Description of Artificial Sequence: Synthetic oligonucleotide
  Target: SCN9A; (+) strand; PAM type: YTN; PAM sequence: CTT
taccatagaatgatatgtaa

SEQ ID NO: 109495 - DNA, 20 bp, Artificial Sequence
  Description of Artificial Sequence: Synthetic oligonucleotide
  Target: SCN9A; (+) strand; PAM type: YTN; PAM sequence: TTT
accatagaatgatatgtaat

SEQ ID NO: 109496 - DNA, 20 bp, Artificial Sequence
  Description of Artificial Sequence: Synthetic oligonucleotide
  Target: SCN9A; (+) strand; PAM type: YTN; PAM sequence: TTA
ccatagaatgatatgtaatc

SEQ ID NO: 109497 - DNA, 20 bp, Artificial Sequence
  Description of Artificial Sequence: Synthetic oligonucleotide
  Target: SCN9A; (+) strand; PAM type: YTN; PAM sequence: CTT
ttgggtatatacccagtaat

SEQ ID NO: 109498 - DNA, 20 bp, Artificial Sequence
  Description of Artificial Sequence: Synthetic oligonucleotide
  Target: SCN9A; (+) strand; PAM type: YTN; PAM sequence: TTT
tgggtatatacccagtaatg

SEQ ID NO: 109499 - DNA, 20 bp, Artificial Sequence
  Description of Artificial Sequence: Synthetic oligonucleotide
  Target: SCN9A; (+) strand; PAM type: YTN; PAM sequence: TTT
gggtatatacccagtaatgg

SEQ ID NO: 109500 - DNA, 20 bp, Artificial Sequence
  Description of Artificial Sequence: Synthetic oligonucleotide
  Target: SCN9A; (+) strand; PAM type: YTN; PAM sequence: TTG
ggtatatacccagtaatggg

SEQ ID NO: 109501 - DNA, 20 bp, Artificial Sequence
  Description of Artificial Sequence: Synthetic oligonucleotide
  Target: SCN9A; (+) strand; PAM type: YTN; PAM sequence: TTG
ctgggtcactgtcttccaca

SEQ ID NO: 109502 - DNA, 20 bp, Artificial Sequence
  Description of Artificial Sequence: Synthetic oligonucleotide
  Target: SCN9A; (+) strand; PAM type: YTN; PAM sequence: CTG
ggtcactgtcttccacactg

SEQ ID NO: 109503 - DNA, 20 bp, Artificial Sequence
  Description of Artificial Sequence: Synthetic oligonucleotide
  Target: SCN9A; (+) strand; PAM type: YTN; PAM sequence: CTG
tcttccacactggttgaact

SEQ ID NO: 109504 - DNA, 20 bp, Artificial Sequence
  Description of Artificial Sequence: Synthetic oligonucleotide
  Target: SCN9A; (+) strand; PAM type: YTN; PAM sequence: CTT
ccacactggttgaactaatt

SEQ ID NO: 109505 - DNA, 20 bp, Artificial Sequence
  Description of Artificial Sequence: Synthetic oligonucleotide
  Target: SCN9A; (+) strand; PAM type: YTN; PAM sequence: TTC
cacactggttgaactaattt

SEQ ID NO: 109506 - DNA, 20 bp, Artificial Sequence
  Description of Artificial Sequence: Synthetic oligonucleotide
  Target: SCN9A; (+) strand; PAM type: YTN; PAM sequence: CTG
gttgaactaatttacactcc

SEQ ID NO: 109507 - DNA, 20 bp, Artificial Sequence
  Description of Artificial Sequence: Synthetic oligonucleotide
  Target: SCN9A; (+) strand; PAM type: YTN; PAM sequence: TTG
aactaatttacactcctacc

SEQ ID NO: 109508 - DNA, 20 bp, Artificial Sequence
  Description of Artificial Sequence: Synthetic oligonucleotide
  Target: SCN9A; (+) strand; PAM type: YTN; PAM sequence: CTA
atttacactcctaccaacag

SEQ ID NO: 109509 - DNA, 20 bp, Artificial Sequence
  Description of Artificial Sequence: Synthetic oligonucleotide
  Target: SCN9A; (+) strand; PAM type: YTN; PAM sequence: TTT
acactcctaccaacagttta

SEQ ID NO: 109510 - DNA, 20 bp, Artificial Sequence
  Description of Artificial Sequence: Synthetic oligonucleotide
  Target: SCN9A; (+) strand; PAM type: YTN; PAM sequence: TTA
cactcctaccaacagtttaa

SEQ ID NO: 109511 - DNA, 20 bp, Artificial Sequence
  Description of Artificial Sequence: Synthetic oligonucleotide
  Target: SCN9A; (+) strand; PAM type: YTN; PAM sequence: CTC
ctaccaacagtttaaaagca

SEQ ID NO: 109512 - DNA, 20 bp, Artificial Sequence
  Description of Artificial Sequence: Synthetic oligonucleotide
  Target: SCN9A; (+) strand; PAM type: YTN; PAM sequence: CTA
ccaacagtttaaaagcattc

SEQ ID NO: 109513 - DNA, 20 bp, Artificial Sequence
  Description of Artificial Sequence: Synthetic oligonucleotide
  Target: SCN9A; (+) strand; PAM type: YTN; PAM sequence: TTT
aaaagcattcctatttctcc

SEQ ID NO: 109514 - DNA, 20 bp, Artificial Sequence
  Description of Artificial Sequence: Synthetic oligonucleotide
  Target: SCN9A; (+) strand; PAM type: YTN; PAM sequence: TTA
aaagcattcctatttctcca

SEQ ID NO: 109515 - DNA, 20 bp, Artificial Sequence
  Description of Artificial Sequence: Synthetic oligonucleotide
  Target: SCN9A; (+) strand; PAM type: YTN; PAM sequence: TTC
ctatttctccacattttctc

SEQ ID NO: 109516 - DNA, 20 bp, Artificial Sequence
  Description of Artificial Sequence: Synthetic oligonucleotide
  Target: SCN9A; (+) strand; PAM type: YTN; PAM sequence: CTA
tttctccacattttctccag

SEQ ID NO: 109517 - DNA, 20 bp, Artificial Sequence
  Description of Artificial Sequence: Synthetic oligonucleotide
  Target: SCN9A; (+) strand; PAM type: YTN; PAM sequence: TTT
ctccacattttctccagcat

SEQ ID NO: 109518 - DNA, 20 bp, Artificial Sequence
  Description of Artificial Sequence: Synthetic oligonucleotide
  Target: SCN9A; (+) strand; PAM type: YTN; PAM sequence: TTC
tccacattttctccagcatc

SEQ ID NO: 109519 - DNA, 20 bp, Artificial Sequence
  Description of Artificial Sequence: Synthetic oligonucleotide
  Target: SCN9A; (+) strand; PAM type: YTN; PAM sequence: CTC
cacattttctccagcatctg

SEQ ID NO: 109520 - DNA, 20 bp, Artificial Sequence
  Description of Artificial Sequence: Synthetic oligonucleotide
  Target: SCN9A; (+) strand; PAM type: YTN; PAM sequence: TTT
tctccagcatctgttatttt

SEQ ID NO: 109521 - DNA, 20 bp, Artificial Sequence
  Description of Artificial Sequence: Synthetic oligonucleotide
  Target: SCN9A; (+) strand; PAM type: YTN; PAM sequence: TTT
ctccagcatctgttattttc

SEQ ID NO: 109522 - DNA, 20 bp, Artificial Sequence
  Description of Artificial Sequence: Synthetic oligonucleotide
  Target: SCN9A; (+) strand; PAM type: YTN; PAM sequence: TTC
tccagcatctgttattttct

SEQ ID NO: 109523 - DNA, 20 bp, Artificial Sequence
  Description of Artificial Sequence: Synthetic oligonucleotide
  Target: SCN9A; (+) strand; PAM type: YTN; PAM sequence: CTC
cagcatctgttattttctga

SEQ ID NO: 109524 - DNA, 20 bp, Artificial Sequence
  Description of Artificial Sequence: Synthetic oligonucleotide
  Target: SCN9A; (+) strand; PAM type: YTN; PAM sequence: CTG
ttattttctgactttttaat

SEQ ID NO: 109525 - DNA, 20 bp, Artificial Sequence
  Description of Artificial Sequence: Synthetic oligonucleotide
  Target: SCN9A; (+) strand; PAM type: YTN; PAM sequence: TTA
ttttctgactttttaattat

SEQ ID NO: 109526 - DNA, 20 bp, Artificial Sequence
  Description of Artificial Sequence: Synthetic oligonucleotide
  Target: SCN9A; (+) strand; PAM type: YTN; PAM sequence: TTT
tctgactttttaattatcac

SEQ ID NO: 109527 - DNA, 20 bp, Artificial Sequence
  Description of Artificial Sequence: Synthetic oligonucleotide
  Target: SCN9A; (+) strand; PAM type: YTN; PAM sequence: TTT
ctgactttttaattatcacc

SEQ ID NO: 109528 - DNA, 20 bp, Artificial Sequence
  Description of Artificial Sequence: Synthetic oligonucleotide
  Target: SCN9A; (+) strand; PAM type: YTN; PAM sequence: TTC
tgactttttaattatcacca

SEQ ID NO: 109529 - DNA, 20 bp, Artificial Sequence
  Description of Artificial Sequence: Synthetic oligonucleotide
  Target: SCN9A; (+) strand; PAM type: YTN; PAM sequence: CTG
actttttaattatcaccatt

SEQ ID NO: 109530 - DNA, 20 bp, Artificial Sequence
  Description of Artificial Sequence: Synthetic oligonucleotide
  Target: SCN9A; (+) strand; PAM type: YTN; PAM sequence: CTT
tttaattatcaccattctaa

SEQ ID NO: 109531 - DNA, 20 bp, Artificial Sequence
  Description of Artificial Sequence: Synthetic oligonucleotide
  Target: SCN9A; (+) strand; PAM type: YTN; PAM sequence: TTT
ttaattatcaccattctaac

SEQ ID NO: 109532 - DNA, 20 bp, Artificial Sequence
  Description of Artificial Sequence: Synthetic oligonucleotide
  Target: SCN9A; (+) strand; PAM type: YTN; PAM sequence: TTT
taattatcaccattctaact

SEQ ID NO: 109533 - DNA, 20 bp, Artificial Sequence
  Description of Artificial Sequence: Synthetic oligonucleotide
  Target: SCN9A; (+) strand; PAM type: YTN; PAM sequence: TTT
aattatcaccattctaactg

SEQ ID NO: 109534 - DNA, 20 bp, Artificial Sequence
  Description of Artificial Sequence: Synthetic oligonucleotide
  Target: SCN9A; (+) strand; PAM type: YTN; PAM sequence: TTA
attatcaccattctaactgg

SEQ ID NO: 109535 - DNA, 20 bp, Artificial Sequence
  Description of Artificial Sequence: Synthetic oligonucleotide
  Target: SCN9A; (+) strand; PAM type: YTN; PAM sequence: TTA
tcaccattctaactggcatg

SEQ ID NO: 109536 - DNA, 20 bp, Artificial Sequence
  Description of Artificial Sequence: Synthetic oligonucleotide
  Target: SCN9A; (+) strand; PAM type: YTN; PAM sequence: TTC
taactggcatgagatggtat

SEQ ID NO: 109537 - DNA, 20 bp, Artificial Sequence
  Description of Artificial Sequence: Synthetic oligonucleotide
  Target: SCN9A; (+) strand; PAM type: YTN; PAM sequence: CTA
actggcatgagatggtatct

SEQ ID NO: 109538 - DNA, 20 bp, Artificial Sequence
  Description of Artificial Sequence: Synthetic oligonucleotide
  Target: SCN9A; (+) strand; PAM type: YTN; PAM sequence: CTG
gcatgagatggtatctcatt

SEQ ID NO: 109539 - DNA, 20 bp, Artificial Sequence
  Description of Artificial Sequence: Synthetic oligonucleotide
  Target: SCN9A; (+) strand; PAM type: YTN; PAM sequence: CTC
attgtggttttgaattgcat

SEQ ID NO: 109540 - DNA, 20 bp, Artificial Sequence
  Description of Artificial Sequence: Synthetic oligonucleotide
  Target: SCN9A; (+) strand; PAM type: YTN; PAM sequence: TTG
tggttttgaattgcatttct

SEQ ID NO: 109541 - DNA, 20 bp, Artificial Sequence
  Description of Artificial Sequence: Synthetic oligonucleotide
  Target: SCN9A; (+) strand; PAM type: YTN; PAM sequence: TTT
tgaattgcatttctctaatg

SEQ ID NO: 109542 - DNA, 20 bp, Artificial Sequence
  Description of Artificial Sequence: Synthetic oligonucleotide
  Target: SCN9A; (+) strand; PAM type: YTN; PAM sequence: TTT
gaattgcatttctctaatgg

SEQ ID NO: 109543 - DNA, 20 bp, Artificial Sequence
  Description of Artificial Sequence: Synthetic oligonucleotide
  Target: SCN9A; (+) strand; PAM type: YTN; PAM sequence: TTG
aattgcatttctctaatggc

SEQ ID NO: 109544 - DNA, 20 bp, Artificial Sequence
  Description of Artificial Sequence: Synthetic oligonucleotide
  Target: SCN9A; (+) strand; PAM type: YTN; PAM sequence: TTG
catttctctaatggccagtg

SEQ ID NO: 109545 - DNA, 20 bp, Artificial Sequence
  Description of Artificial Sequence: Synthetic oligonucleotide
  Target: SCN9A; (+) strand; PAM type: YTN; PAM sequence: TTT
ctctaatggccagtgatgat

SEQ ID NO: 109546 - DNA, 20 bp, Artificial Sequence
  Description of Artificial Sequence: Synthetic oligonucleotide
  Target: SCN9A; (+) strand; PAM type: YTN; PAM sequence: TTC
tctaatggccagtgatgatg

SEQ ID NO: 109547 - DNA, 20 bp, Artificial Sequence
  Description of Artificial Sequence: Synthetic oligonucleotide
  Target: SCN9A; (+) strand; PAM type: YTN; PAM sequence: CTC
taatggccagtgatgatgag

SEQ ID NO: 109548 - DNA, 20 bp, Artificial Sequence
  Description of Artificial Sequence: Synthetic oligonucleotide
  Target: SCN9A; (+) strand; PAM type: YTN; PAM sequence: CTA
atggccagtgatgatgagct

SEQ ID NO: 109549 - DNA, 20 bp, Artificial Sequence
  Description of Artificial Sequence: Synthetic oligonucleotide
  Target: SCN9A; (+) strand; PAM type: YTN; PAM sequence: CTT
tttttcatatgtttaagtta

SEQ ID NO: 109550 - DNA, 20 bp, Artificial Sequence
  Description of Artificial Sequence: Synthetic oligonucleotide
  Target: SCN9A; (+) strand; PAM type: YTN; PAM sequence: TTT
ttttcatatgtttaagttat

SEQ ID NO: 109551 - DNA, 20 bp, Artificial Sequence
  Description of Artificial Sequence: Synthetic oligonucleotide
  Target: SCN9A; (+) strand; PAM type: YTN; PAM sequence: TTT
tttcatatgtttaagttatg

SEQ ID NO: 109552 - DNA, 20 bp, Artificial Sequence
  Description of Artificial Sequence: Synthetic oligonucleotide
  Target: SCN9A; (+) strand; PAM type: YTN; PAM sequence: TTT
ttcatatgtttaagttatgg

SEQ ID NO: 109553 - DNA, 20 bp, Artificial Sequence
  Description of Artificial Sequence: Synthetic oligonucleotide
  Target: SCN9A; (+) strand; PAM type: YTN; PAM sequence: TTT
tcatatgtttaagttatggg

SEQ ID NO: 109554 - DNA, 20 bp, Artificial Sequence
  Description of Artificial Sequence: Synthetic oligonucleotide
  Target: SCN9A; (+) strand; PAM type: YTN; PAM sequence: TTT
catatgtttaagttatggga

SEQ ID NO: 109555 - DNA, 20 bp, Artificial Sequence
  Description of Artificial Sequence: Synthetic oligonucleotide
  Target: SCN9A; (+) strand; PAM type: YTN; PAM sequence: TTC
atatgtttaagttatgggat

SEQ ID NO: 109556 - DNA, 20 bp, Artificial Sequence
  Description of Artificial Sequence: Synthetic oligonucleotide
  Target: SCN9A; (+) strand; PAM type: YTN; PAM sequence: TTT
aagttatgggatacatgtga

SEQ ID NO: 109557 - DNA, 20 bp, Artificial Sequence
  Description of Artificial Sequence: Synthetic oligonucleotide
  Target: SCN9A; (+) strand; PAM type: YTN; PAM sequence: TTA
agttatgggatacatgtgaa

SEQ ID NO: 109558 - DNA, 20 bp, Artificial Sequence
  Description of Artificial Sequence: Synthetic oligonucleotide
  Target: SCN9A; (+) strand; PAM type: YTN; PAM sequence: TTA
tgggatacatgtgaagaaca

SEQ ID NO: 109559 - DNA, 20 bp, Artificial Sequence
  Description of Artificial Sequence: Synthetic oligonucleotide
  Target: SCN9A; (+) strand; PAM type: YTN; PAM sequence: TTG
gttacacaggtatacatgtg

SEQ ID NO: 109560 - DNA, 20 bp, Artificial Sequence
  Description of Artificial Sequence: Synthetic oligonucleotide
  Target: SCN9A; (+) strand; PAM type: YTN; PAM sequence: TTA
cacaggtatacatgtgctat

SEQ ID NO: 109561 - DNA, 20 bp, Artificial Sequence
  Description of Artificial Sequence: Synthetic oligonucleotide
  Target: SCN9A; (+) strand; PAM type: YTN; PAM sequence: CTA
tggtggtttgctccacctat

SEQ ID NO: 109562 - DNA, 20 bp, Artificial Sequence
  Description of Artificial Sequence: Synthetic oligonucleotide
  Target: SCN9A; (+) strand; PAM type: YTN; PAM sequence: TTT
gctccacctatcaacccatt

SEQ ID NO: 109563 - DNA, 20 bp, Artificial Sequence
  Description of Artificial Sequence: Synthetic oligonucleotide
  Target: SCN9A; (+) strand; PAM type: YTN; PAM sequence: TTG
ctccacctatcaacccatta

SEQ ID NO: 109564 - DNA, 20 bp, Artificial Sequence
  Description of Artificial Sequence: Synthetic oligonucleotide
  Target: SCN9A; (+) strand; PAM type: YTN; PAM sequence: CTC
cacctatcaacccattatct

SEQ ID NO: 109565 - DNA, 20 bp, Artificial Sequence
  Description of Artificial Sequence: Synthetic oligonucleotide
  Target: SCN9A; (+) strand; PAM type: YTN; PAM sequence: CTA
tcaacccattatctaggttt

SEQ ID NO: 109566 - DNA, 20 bp, Artificial Sequence
  Description of Artificial Sequence: Synthetic oligonucleotide
  Target: SCN9A; (+) strand; PAM type: YTN; PAM sequence: TTA
tctaggttttaagacctgca

SEQ ID NO: 109567 - DNA, 20 bp, Artificial Sequence
  Description of Artificial Sequence: Synthetic oligonucleotide
  Target: SCN9A; (+) strand; PAM type: YTN; PAM sequence: CTA
ggttttaagacctgcatgca

SEQ ID NO: 109568 - DNA, 20 bp, Artificial Sequence
  Description of Artificial Sequence: Synthetic oligonucleotide
  Target: SCN9A; (+) strand; PAM type: YTN; PAM sequence: TTT
taagacctgcatgcattagg

SEQ ID NO: 109569 - DNA, 20 bp, Artificial Sequence
  Description of Artificial Sequence: Synthetic oligonucleotide
  Target: SCN9A; (+) strand; PAM type: YTN; PAM sequence: TTT
aagacctgcatgcattaggt

SEQ ID NO: 109570 - DNA, 20 bp, Artificial Sequence
  Description of Artificial Sequence: Synthetic oligonucleotide
  Target: SCN9A; (+) strand; PAM type: YTN; PAM sequence: TTA
agacctgcatgcattaggta

SEQ ID NO: 109571 - DNA, 20 bp, Artificial Sequence
  Description of Artificial Sequence: Synthetic oligonucleotide
  Target: SCN9A; (+) strand; PAM type: YTN; PAM sequence: CTG
catgcattaggtagttgtcc

SEQ ID NO: 109572 - DNA, 20 bp, Artificial Sequence
  Description of Artificial Sequence: Synthetic oligonucleotide
  Target: SCN9A; (+) strand; PAM type: YTN; PAM sequence: TTA
ggtagttgtcctaacgttct

SEQ ID NO: 109573 - DNA, 20 bp, Artificial Sequence
  Description of Artificial Sequence: Synthetic oligonucleotide
  Target: SCN9A; (+) strand; PAM type: YTN; PAM sequence: TTG
tcctaacgttctccctcccc

SEQ ID NO: 109574 - DNA, 20 bp, Artificial Sequence
  Description of Artificial Sequence: Synthetic oligonucleotide
  Target: SCN9A; (+) strand; PAM type: YTN; PAM sequence: CTA
acgttctccctccccttgcc

SEQ ID NO: 109575 - DNA, 20 bp, Artificial Sequence
  Description of Artificial Sequence: Synthetic oligonucleotide
  Target: SCN9A; (+) strand; PAM type: YTN; PAM sequence: TTC
tccctccccttgcctcccac

SEQ ID NO: 109576 - DNA, 20 bp, Artificial Sequence
  Description of Artificial Sequence: Synthetic oligonucleotide
  Target: SCN9A; (+) strand; PAM type: YTN; PAM sequence: CTC
cctccccttgcctcccaccc

SEQ ID NO: 109577 - DNA, 20 bp, Artificial Sequence
  Description of Artificial Sequence: Synthetic oligonucleotide
  Target: SCN9A; (+) strand; PAM type: YTN; PAM sequence: CTC
cccttgcctcccacccccca

SEQ ID NO: 109578 - DNA, 20 bp, Artificial Sequence
  Description of Artificial Sequence: Synthetic oligonucleotide
  Target: SCN9A; (+) strand; PAM type: YTN; PAM sequence: CTT
gcctcccaccccccaacagg

SEQ ID NO: 109579 - DNA, 20 bp, Artificial Sequence
  Description of Artificial Sequence: Synthetic oligonucleotide
  Target: SCN9A; (+) strand; PAM type: YTN; PAM sequence: TTG
cctcccaccccccaacaggc

SEQ ID NO: 109580 - DNA, 20 bp, Artificial Sequence
  Description of Artificial Sequence: Synthetic oligonucleotide
  Target: SCN9A; (+) strand; PAM type: YTN; PAM sequence: CTC
ccaccccccaacaggccccg

SEQ ID NO: 109581 - DNA, 20 bp, Artificial Sequence
  Description of Artificial Sequence: Synthetic oligonucleotide
  Target: SCN9A; (+) strand; PAM type: YTN; PAM sequence: TTG
ttcccctccctgtgtccatg

SEQ ID NO: 109582 - DNA, 20 bp, Artificial Sequence
  Description of Artificial Sequence: Synthetic oligonucleotide
  Target: SCN9A; (+) strand; PAM type: YTN; PAM sequence: TTC
ccctccctgtgtccatgtgt

SEQ ID NO: 109583 - DNA, 20 bp, Artificial Sequence
  Description of Artificial Sequence: Synthetic oligonucleotide
  Target: SCN9A; (+) strand; PAM type: YTN; PAM sequence: CTC
cctgtgtccatgtgttcaaa

SEQ ID NO: 109584 - DNA, 20 bp, Artificial Sequence
  Description of Artificial Sequence: Synthetic oligonucleotide
  Target: SCN9A; (+) strand; PAM type: YTN; PAM sequence: CTG
tgtccatgtgttcaaattgt

SEQ ID NO: 109585 - DNA, 20 bp, Artificial Sequence
  Description of Artificial Sequence: Synthetic oligonucleotide
  Target: SCN9A; (+) strand; PAM type: YTN; PAM sequence: TTC
aaattgttcaactcccactt

SEQ ID NO: 109586 - DNA, 20 bp, Artificial Sequence
  Description of Artificial Sequence: Synthetic oligonucleotide
  Target: SCN9A; (+) strand; PAM type: YTN; PAM sequence: TTG
ttcaactcccacttatgagt

SEQ ID NO: 109587 - DNA, 20 bp, Artificial Sequence
  Description of Artificial Sequence: Synthetic oligonucleotide
  Target: SCN9A; (+) strand; PAM type: YTN; PAM sequence: TTC
aactcccacttatgagtgag

SEQ ID NO: 109588 - DNA, 20 bp, Artificial Sequence
  Description of Artificial Sequence: Synthetic oligonucleotide
  Target: SCN9A; (+) strand; PAM type: YTN; PAM sequence: CTC
ccacttatgagtgagaacat

SEQ ID NO: 109589 - DNA, 20 bp, Artificial Sequence
  Description of Artificial Sequence: Synthetic oligonucleotide
  Target: SCN9A; (+) strand; PAM type: YTN; PAM sequence: CTT
atgagtgagaacatgcagtg

SEQ ID NO: 109590 - DNA, 20 bp, Artificial Sequence
  Description of Artificial Sequence: Synthetic oligonucleotide
  Target: SCN9A; (+) strand; PAM type: YTN; PAM sequence: TTA
tgagtgagaacatgcagtgt

SEQ ID NO: 109591 - DNA, 20 bp, Artificial Sequence
  Description of Artificial Sequence: Synthetic oligonucleotide
  Target: SCN9A; (+) strand; PAM type: YTN; PAM sequence: TTT
ggttttctcttcctgtatta

SEQ ID NO: 109592 - DNA, 20 bp, Artificial Sequence
  Description of Artificial Sequence: Synthetic oligonucleotide
  Target: SCN9A; (+) strand; PAM type: YTN; PAM sequence: TTG
gttttctcttcctgtattag

SEQ ID NO: 109593 - DNA, 20 bp, Artificial Sequence
  Description of Artificial Sequence: Synthetic oligonucleotide
  Target: SCN9A; (+) strand; PAM type: YTN; PAM sequence: TTT
tctcttcctgtattagtttg

SEQ ID NO: 109594 - DNA, 20 bp, Artificial Sequence
  Description of Artificial Sequence: Synthetic oligonucleotide
  Target: SCN9A; (+) strand; PAM type: YTN; PAM sequence: TTT
ctcttcctgtattagtttgc

SEQ ID NO: 109595 - DNA, 20 bp, Artificial Sequence
  Description of Artificial Sequence: Synthetic oligonucleotide
  Target: SCN9A; (+) strand; PAM type: YTN; PAM sequence: TTC
tcttcctgtattagtttgct

SEQ ID NO: 109596 - DNA, 20 bp, Artificial Sequence
  Description of Artificial Sequence: Synthetic oligonucleotide
  Target: SCN9A; (+) strand; PAM type: YTN; PAM sequence: CTC
ttcctgtattagtttgctga

SEQ ID NO: 109597 - DNA, 20 bp, Artificial Sequence
  Description of Artificial Sequence: Synthetic oligonucleotide
  Target: SCN9A; (+) strand; PAM type: YTN; PAM sequence: CTT
cctgtattagtttgctgagg

SEQ ID NO: 109598 - DNA, 20 bp, Artificial Sequence
  Description of Artificial Sequence: Synthetic oligonucleotide
  Target: SCN9A; (+) strand; PAM type: YTN; PAM sequence: TTC
ctgtattagtttgctgagga

SEQ ID NO: 109599 - DNA, 20 bp, Artificial Sequence
  Description of Artificial Sequence: Synthetic oligonucleotide
  Target: SCN9A; (+) strand; PAM type: YTN; PAM sequence: CTG
tattagtttgctgaggatga

SEQ ID NO: 109600 - DNA, 20 bp, Artificial Sequence
  Description of Artificial Sequence: Synthetic oligonucleotide
  Target: SCN9A; (+) strand; PAM type: YTN; PAM sequence: TTA
gtttgctgaggatgatggct

SEQ ID NO: 109601 - DNA, 20 bp, Artificial Sequence
  Description of Artificial Sequence: Synthetic oligonucleotide
  Target: SCN9A; (+) strand; PAM type: YTN; PAM sequence: TTT
gctgaggatgatggcttcca

SEQ ID NO: 109602 - DNA, 20 bp, Artificial Sequence
  Description of Artificial Sequence: Synthetic oligonucleotide
  Target: SCN9A; (+) strand; PAM type: YTN; PAM sequence: TTG
ctgaggatgatggcttccag

SEQ ID NO: 109603 - DNA, 20 bp, Artificial Sequence
  Description of Artificial Sequence: Synthetic oligonucleotide
  Target: SCN9A; (+) strand; PAM type: YTN; PAM sequence: CTG
aggatgatggcttccagctt

SEQ ID NO: 109604 - DNA, 20 bp, Artificial Sequence
  Description of Artificial Sequence: Synthetic oligonucleotide
  Target: SCN9A; (+) strand; PAM type: YTN; PAM sequence: CTT
ccagcttcatccatgtccct

SEQ ID NO: 109605 - DNA, 20 bp, Artificial Sequence
  Description of Artificial Sequence: Synthetic oligonucleotide
  Target: SCN9A; (+) strand; PAM type: YTN; PAM sequence: TTC
cagcttcatccatgtccctg

SEQ ID NO: 109606 - DNA, 20 bp, Artificial Sequence
  Description of Artificial Sequence: Synthetic oligonucleotide
  Target: SCN9A; (+) strand; PAM type: YTN; PAM sequence: CTT
catccatgtccctgtaaagg

SEQ ID NO: 109607 - DNA, 20 bp, Artificial Sequence
  Description of Artificial Sequence: Synthetic oligonucleotide
  Target: SCN9A; (+) strand; PAM type: YTN; PAM sequence: TTC
atccatgtccctgtaaagga

SEQ ID NO: 109608 - DNA, 20 bp, Artificial Sequence
  Description of Artificial Sequence: Synthetic oligonucleotide
  Target: SCN9A; (+) strand; PAM type: YTN; PAM sequence: CTG
taaaggacatgatctcattc

SEQ ID NO: 109609 - DNA, 20 bp, Artificial Sequence
  Description of Artificial Sequence: Synthetic oligonucleotide
  Target: SCN9A; (+) strand; PAM type: YTN; PAM sequence: CTC
attcttttttaatggctgca

SEQ ID NO: 109610 - DNA, 20 bp, Artificial Sequence
  Description of Artificial Sequence: Synthetic oligonucleotide
  Target: SCN9A; (+) strand; PAM type: YTN; PAM sequence: TTC
ttttttaatggctgcatagt

SEQ ID NO: 109611 - DNA, 20 bp, Artificial Sequence
  Description of Artificial Sequence: Synthetic oligonucleotide
  Target: SCN9A; (+) strand; PAM type: YTN; PAM sequence: CTT
ttttaatggctgcatagtat

SEQ ID NO: 109612 - DNA, 20 bp, Artificial Sequence
  Description of Artificial Sequence: Synthetic oligonucleotide
  Target: SCN9A; (+) strand; PAM type: YTN; PAM sequence: TTT
tttaatggctgcatagtatt

SEQ ID NO: 109613 - DNA, 20 bp, Artificial Sequence
  Description of Artificial Sequence: Synthetic oligonucleotide
  Target: SCN9A; (+) strand; PAM type: YTN; PAM sequence: TTT
ttaatggctgcatagtattc

SEQ ID NO: 109614 - DNA, 20 bp, Artificial Sequence
  Description of Artificial Sequence: Synthetic oligonucleotide
  Target: SCN9A; (+) strand; PAM type: YTN; PAM sequence: TTT
taatggctgcatagtattcc

SEQ ID NO: 109615 - DNA, 20 bp, Artificial Sequence
  Description of Artificial Sequence: Synthetic oligonucleotide
  Target: SCN9A; (+) strand; PAM type: YTN; PAM sequence: TTT
aatggctgcatagtattcca

SEQ ID NO: 109616 - DNA, 20 bp, Artificial Sequence
  Description of Artificial Sequence: Synthetic oligonucleotide
  Target: SCN9A; (+) strand; PAM type: YTN; PAM sequence: TTA
atggctgcatagtattccat

SEQ ID NO: 109617 - DNA, 20 bp, Artificial Sequence
  Description of Artificial Sequence: Synthetic oligonucleotide
  Target: SCN9A; (+) strand; PAM type: YTN; PAM sequence: CTG
catagtattccatggtgtat

SEQ ID NO: 109618 - DNA, 20 bp, Artificial Sequence
  Description of Artificial Sequence: Synthetic oligonucleotide
  Target: SCN9A; (+) strand; PAM type: YTN; PAM sequence: TTC
catggtgtatatgtaccaca

SEQ ID NO: 109619 - DNA, 20 bp, Artificial Sequence
  Description of Artificial Sequence: Synthetic oligonucleotide
  Target: SCN9A; (+) strand; PAM type: YTN; PAM sequence: TTT
tctttatacaatttaacatt

SEQ ID NO: 109620 - DNA, 20 bp, Artificial Sequence
  Description of Artificial Sequence: Synthetic oligonucleotide
  Target: SCN9A; (+) strand; PAM type: YTN; PAM sequence: TTT
ctttatacaatttaacattg

SEQ ID NO: 109621 - DNA, 20 bp, Artificial Sequence
  Description of Artificial Sequence: Synthetic oligonucleotide
  Target: SCN9A; (+) strand; PAM type: YTN; PAM sequence: TTC
tttatacaatttaacattga

SEQ ID NO: 109622 - DNA, 20 bp, Artificial Sequence
  Description of Artificial Sequence: Synthetic oligonucleotide
  Target: SCN9A; (+) strand; PAM type: YTN; PAM sequence: CTT
tatacaatttaacattgatg

SEQ ID NO: 109623 - DNA, 20 bp, Artificial Sequence
  Description of Artificial Sequence: Synthetic oligonucleotide
  Target: SCN9A; (+) strand; PAM type: YTN; PAM sequence: TTT
atacaatttaacattgatgg

SEQ ID NO: 109624 - DNA, 20 bp, Artificial Sequence
  Description of Artificial Sequence: Synthetic oligonucleotide
  Target: SCN9A; (+) strand; PAM type: YTN; PAM sequence: TTA
tacaatttaacattgatggg

SEQ ID NO: 109625 - DNA, 20 bp, Artificial Sequence
  Description of Artificial Sequence: Synthetic oligonucleotide
  Target: SCN9A; (+) strand; PAM type: YTN; PAM sequence: TTT
aacattgatgggcatttgag

SEQ ID NO: 109626 - DNA, 20 bp, Artificial Sequence
  Description of Artificial Sequence: Synthetic oligonucleotide
  Target: SCN9A; (+) strand; PAM type: YTN; PAM sequence: TTA
acattgatgggcatttgagt

SEQ ID NO: 109627 - DNA, 20 bp, Artificial Sequence
  Description of Artificial Sequence: Synthetic oligonucleotide
  Target: SCN9A; (+) strand; PAM type: YTN; PAM sequence: TTG
atgggcatttgagttgattc

SEQ ID NO: 109628 - DNA, 20 bp, Artificial Sequence
  Description of Artificial Sequence: Synthetic oligonucleotide
  Target: SCN9A; (+) strand; PAM type: YTN; PAM sequence: TTT
gagttgattccatctctttg

SEQ ID NO: 109629 - DNA, 20 bp, Artificial Sequence
  Description of Artificial Sequence: Synthetic oligonucleotide
  Target: SCN9A; (+) strand; PAM type: YTN; PAM sequence: TTG
agttgattccatctctttgc

SEQ ID NO: 109630 - DNA, 20 bp, Artificial Sequence
  Description of Artificial Sequence: Synthetic oligonucleotide
  Target: SCN9A; (+) strand; PAM type: YTN; PAM sequence: TTG
attccatctctttgctattg

SEQ ID NO: 109631 - DNA, 20 bp, Artificial Sequence
  Description of Artificial Sequence: Synthetic oligonucleotide
  Target: SCN9A; (+) strand; PAM type: YTN; PAM sequence: TTC
catctctttgctattgtaaa

SEQ ID NO: 109632 - DNA, 20 bp, Artificial Sequence
  Description of Artificial Sequence: Synthetic oligonucleotide
  Target: SCN9A; (+) strand; PAM type: YTN; PAM sequence: CTC
tttgctattgtaaatagtac

SEQ ID NO: 109633 - DNA, 20 bp, Artificial Sequence
  Description of Artificial Sequence: Synthetic oligonucleotide
  Target: SCN9A; (+) strand; PAM type: YTN; PAM sequence: CTT
tgctattgtaaatagtactg

SEQ ID NO: 109634 - DNA, 20 bp, Artificial Sequence
  Description of Artificial Sequence: Synthetic oligonucleotide
  Target: SCN9A; (+) strand; PAM type: YTN; PAM sequence: TTT
gctattgtaaatagtactgc

SEQ ID NO: 109635 - DNA, 20 bp, Artificial Sequence
  Description of Artificial Sequence: Synthetic oligonucleotide
  Target: SCN9A; (+) strand; PAM type: YTN; PAM sequence: TTG
ctattgtaaatagtactgca

SEQ ID NO: 109636 - DNA, 20 bp, Artificial Sequence
  Description of Artificial Sequence: Synthetic oligonucleotide
  Target: SCN9A; (+) strand; PAM type: YTN; PAM sequence: CTA
ttgtaaatagtactgcaata

SEQ ID NO: 109637 - DNA, 20 bp, Artificial Sequence
  Description of Artificial Sequence: Synthetic oligonucleotide
  Target: SCN9A; (+) strand; PAM type: YTN; PAM sequence: TTG
taaatagtactgcaataaac

SEQ ID NO: 109638 - DNA, 20 bp, Artificial Sequence
  Description of Artificial Sequence: Synthetic oligonucleotide
  Target: SCN9A; (+) strand; PAM type: YTN; PAM sequence: CTG
caataaacatatgtgtgcat

SEQ ID NO: 109639 - DNA, 20 bp, Artificial Sequence
  Description of Artificial Sequence: Synthetic oligonucleotide
  Target: SCN9A; (+) strand; PAM type: YTN; PAM sequence: CTT
tgtagtagaatgatttatat

SEQ ID NO: 109640 - DNA, 20 bp, Artificial Sequence
  Description of Artificial Sequence: Synthetic oligonucleotide
  Target: SCN9A; (+) strand; PAM type: YTN; PAM sequence: TTT
gtagtagaatgatttatatt

SEQ ID NO: 109641 - DNA, 20 bp, Artificial Sequence
  Description of Artificial Sequence: Synthetic oligonucleotide
  Target: SCN9A; (+) strand; PAM type: YTN; PAM sequence: TTG
tagtagaatgatttatattc

SEQ ID NO: 109642 - DNA, 20 bp, Artificial Sequence
  Description of Artificial Sequence: Synthetic oligonucleotide
  Target: SCN9A; (+) strand; PAM type: YTN; PAM sequence: TTT
atattcgtttcggtatatac

SEQ ID NO: 109643 - DNA, 20 bp, Artificial Sequence
  Description of Artificial Sequence: Synthetic oligonucleotide
  Target: SCN9A; (+) strand; PAM type: YTN; PAM sequence: TTA
tattcgtttcggtatatacc

SEQ ID NO: 109644 - DNA, 20 bp, Artificial Sequence
  Description of Artificial Sequence: Synthetic oligonucleotide
  Target: SCN9A; (+) strand; PAM type: YTN; PAM sequence: TTC
gtttcggtatatacccagta

SEQ ID NO: 109645 - DNA, 20 bp, Artificial Sequence
  Description of Artificial Sequence: Synthetic oligonucleotide
  Target: SCN9A; (+) strand; PAM type: YTN; PAM sequence: TTT
cggtatatacccagtaatgg

SEQ ID NO: 109646 - DNA, 20 bp, Artificial Sequence
  Description of Artificial Sequence: Synthetic oligonucleotide
  Target: SCN9A; (+) strand; PAM type: YTN; PAM sequence: TTC
ggtatatacccagtaatggg

SEQ ID NO: 109647 - DNA, 20 bp, Artificial Sequence
  Description of Artificial Sequence: Synthetic oligonucleotide
  Target: SCN9A; (+) strand; PAM type: YTN; PAM sequence: TTG
ctaggtcaaatggtatttct

SEQ ID NO: 109648 - DNA, 20 bp, Artificial Sequence
  Description of Artificial Sequence: Synthetic oligonucleotide
  Target: SCN9A; (+) strand; PAM type: YTN; PAM sequence: CTA
ggtcaaatggtatttctggt

SEQ ID NO: 109649 - DNA, 20 bp, Artificial Sequence
  Description of Artificial Sequence: Synthetic oligonucleotide
  Target: SCN9A; (+) strand; PAM type: YTN; PAM sequence: TTT
ctggttctaggtccttaagg

SEQ ID NO: 109650 - DNA, 20 bp, Artificial Sequence
  Description of Artificial Sequence: Synthetic oligonucleotide
  Target: SCN9A; (+) strand; PAM type: YTN; PAM sequence: TTC
tggttctaggtccttaagga

SEQ ID NO: 109651 - DNA, 20 bp, Artificial Sequence
  Description of Artificial Sequence: Synthetic oligonucleotide
  Target: SCN9A; (+) strand; PAM type: YTN; PAM sequence: CTG
gttctaggtccttaaggaat

SEQ ID NO: 109652 - DNA, 20 bp, Artificial Sequence
  Description of Artificial Sequence: Synthetic oligonucleotide
  Target: SCN9A; (+) strand; PAM type: YTN; PAM sequence: TTC
taggtccttaaggaattgcc

SEQ ID NO: 109653 - DNA, 20 bp, Artificial Sequence
  Description of Artificial Sequence: Synthetic oligonucleotide
  Target: SCN9A; (+) strand; PAM type: YTN; PAM sequence: CTA
ggtccttaaggaattgcctc

SEQ ID NO: 109654 - DNA, 20 bp, Artificial Sequence
  Description of Artificial Sequence: Synthetic oligonucleotide
  Target: SCN9A; (+) strand; PAM type: YTN; PAM sequence: CTT
aaggaattgcctcactgtct

SEQ ID NO: 109655 - DNA, 20 bp, Artificial Sequence
  Description of Artificial Sequence: Synthetic oligonucleotide
  Target: SCN9A; (+) strand; PAM type: YTN; PAM sequence: TTA
aggaattgcctcactgtctt

SEQ ID NO: 109656 - DNA, 20 bp, Artificial Sequence
  Description of Artificial Sequence: Synthetic oligonucleotide
  Target: SCN9A; (+) strand; PAM type: YTN; PAM sequence: TTG
cctcactgtcttcaaaattg

SEQ ID NO: 109657 - DNA, 20 bp, Artificial Sequence
  Description of Artificial Sequence: Synthetic oligonucleotide
  Target: SCN9A; (+) strand; PAM type: YTN; PAM sequence: CTC
actgtcttcaaaattgttga

SEQ ID NO: 109658 - DNA, 20 bp, Artificial Sequence
  Description of Artificial Sequence: Synthetic oligonucleotide
  Target: SCN9A; (+) strand; PAM type: YTN; PAM sequence: CTG
tcttcaaaattgttgaacta

SEQ ID NO: 109659 - DNA, 20 bp, Artificial Sequence
  Description of Artificial Sequence: Synthetic oligonucleotide
  Target: SCN9A; (+) strand; PAM type: YTN; PAM sequence: CTT
caaaattgttgaactaattt

SEQ ID NO: 109660 - DNA, 20 bp, Artificial Sequence
  Description of Artificial Sequence: Synthetic oligonucleotide
  Target: SCN9A; (+) strand; PAM type: YTN; PAM sequence: TTC
aaaattgttgaactaattta

SEQ ID NO: 109661 - DNA, 20 bp, Artificial Sequence
  Description of Artificial Sequence: Synthetic oligonucleotide
  Target: SCN9A; (+) strand; PAM type: YTN; PAM sequence: TTG
ttgaactaatttacactccc

SEQ ID NO: 109662 - DNA, 20 bp, Artificial Sequence
  Description of Artificial Sequence: Synthetic oligonucleotide
  Target: SCN9A; (+) strand; PAM type: YTN; PAM sequence: TTG
aactaatttacactcccacc

SEQ ID NO: 109663 - DNA, 20 bp, Artificial Sequence
  Description of Artificial Sequence: Synthetic oligonucleotide
  Target: SCN9A; (+) strand; PAM type: YTN; PAM sequence: CTA
atttacactcccaccaacag

SEQ ID NO: 109664 - DNA, 20 bp, Artificial Sequence
  Description of Artificial Sequence: Synthetic oligonucleotide
  Target: SCN9A; (+) strand; PAM type: YTN; PAM sequence: TTT
acactcccaccaacagtgta

SEQ ID NO: 109665 - DNA, 20 bp, Artificial Sequence
  Description of Artificial Sequence: Synthetic oligonucleotide
  Target: SCN9A; (+) strand; PAM type: YTN; PAM sequence: TTA
cactcccaccaacagtgtaa

SEQ ID NO: 109666 - DNA, 20 bp, Artificial Sequence
  Description of Artificial Sequence: Synthetic oligonucleotide
  Target: SCN9A; (+) strand; PAM type: YTN; PAM sequence: CTC
ccaccaacagtgtaaaagtg

SEQ ID NO: 109667 - DNA, 20 bp, Artificial Sequence
  Description of Artificial Sequence: Synthetic oligonucleotide
  Target: SCN9A; (+) strand; PAM type: YTN; PAM sequence: CTA
ctatttcttcatagcctcac

SEQ ID NO: 109668 - DNA, 20 bp, Artificial Sequence
  Description of Artificial Sequence: Synthetic oligonucleotide
  Target: SCN9A; (+) strand; PAM type: YTN; PAM sequence: CTA
tttcttcatagcctcaccag

SEQ ID NO: 109669 - DNA, 20 bp, Artificial Sequence
  Description of Artificial Sequence: Synthetic oligonucleotide
  Target: SCN9A; (+) strand; PAM type: YTN; PAM sequence: TTT
cttcatagcctcaccagaat

SEQ ID NO: 109670 - DNA, 20 bp, Artificial Sequence
  Description of Artificial Sequence: Synthetic oligonucleotide
  Target: SCN9A; (+) strand; PAM type: YTN; PAM sequence: TTC
ttcatagcctcaccagaatc

SEQ ID NO: 109671 - DNA, 20 bp, Artificial Sequence
  Description of Artificial Sequence: Synthetic oligonucleotide
  Target: SCN9A; (+) strand; PAM type: YTN; PAM sequence: CTT
catagcctcaccagaatcta

SEQ ID NO: 109672 - DNA, 20 bp, Artificial Sequence
  Description of Artificial Sequence: Synthetic oligonucleotide
  Target: SCN9A; (+) strand; PAM type: YTN; PAM sequence: TTC
atagcctcaccagaatctat

SEQ ID NO: 109673 - DNA, 20 bp, Artificial Sequence
  Description of Artificial Sequence: Synthetic oligonucleotide
  Target: SCN9A; (+) strand; PAM type: YTN; PAM sequence: CTC
accagaatctattgtttctc

SEQ ID NO: 109674 - DNA, 20 bp, Artificial Sequence
  Description of Artificial Sequence: Synthetic oligonucleotide
  Target: SCN9A; (+) strand; PAM type: YTN; PAM sequence: CTA
ttgtttctcaactttttaat

SEQ ID NO: 109675 - DNA, 20 bp, Artificial Sequence
  Description of Artificial Sequence: Synthetic oligonucleotide
  Target: SCN9A; (+) strand; PAM type: YTN; PAM sequence: TTG
tttctcaactttttaataat

SEQ ID NO: 109676 - DNA, 20 bp, Artificial Sequence
  Description of Artificial Sequence: Synthetic oligonucleotide
  Target: SCN9A; (+) strand; PAM type: YTN; PAM sequence: TTT
ctcaactttttaataatcac

SEQ ID NO: 109677 - DNA, 20 bp, Artificial Sequence
  Description of Artificial Sequence: Synthetic oligonucleotide
  Target: SCN9A; (+) strand; PAM type: YTN; PAM sequence: TTC
tcaactttttaataatcacc

SEQ ID NO: 109678 - DNA, 20 bp, Artificial Sequence
  Description of Artificial Sequence: Synthetic oligonucleotide
  Target: SCN9A; (+) strand; PAM type: YTN; PAM sequence: CTC
aactttttaataatcaccat

SEQ ID NO: 109679 - DNA, 20 bp, Artificial Sequence
  Description of Artificial Sequence: Synthetic oligonucleotide
  Target: SCN9A; (+) strand; PAM type: YTN; PAM sequence: CTT
tttaataatcaccattctga

SEQ ID NO: 109680 - DNA, 20 bp, Artificial Sequence
  Description of Artificial Sequence: Synthetic oligonucleotide
  Target: SCN9A; (+) strand; PAM type: YTN; PAM sequence: TTT
ttaataatcaccattctgac

SEQ ID NO: 109681 - DNA, 20 bp, Artificial Sequence
  Description of Artificial Sequence: Synthetic oligonucleotide
  Target: SCN9A; (+) strand; PAM type: YTN; PAM sequence: TTT
taataatcaccattctgact

SEQ ID NO: 109682 - DNA, 20 bp, Artificial Sequence
  Description of Artificial Sequence: Synthetic oligonucleotide
  Target: SCN9A; (+) strand; PAM type: YTN; PAM sequence: TTT
aataatcaccattctgactg

SEQ ID NO: 109683 - DNA, 20 bp, Artificial Sequence
  Description of Artificial Sequence: Synthetic oligonucleotide
  Target: SCN9A; (+) strand; PAM type: YTN; PAM sequence: TTA
ataatcaccattctgactga

SEQ ID NO: 109684 - DNA, 20 bp, Artificial Sequence
  Description of Artificial Sequence: Synthetic oligonucleotide
  Target: SCN9A; (+) strand; PAM type: YTN; PAM sequence: TTC
tgactgacttgagatggtat

SEQ ID NO: 109685 - DNA, 20 bp, Artificial Sequence
  Description of Artificial Sequence: Synthetic oligonucleotide
  Target: SCN9A; (+) strand; PAM type: YTN; PAM sequence: CTG
actgacttgagatggtatct

SEQ ID NO: 109686 - DNA, 20 bp, Artificial Sequence
  Description of Artificial Sequence: Synthetic oligonucleotide
  Target: SCN9A; (+) strand; PAM type: YTN; PAM sequence: CTG
acttgagatggtatctcatt

SEQ ID NO: 109687 - DNA, 20 bp, Artificial Sequence
  Description of Artificial Sequence: Synthetic oligonucleotide
  Target: SCN9A; (+) strand; PAM type: YTN; PAM sequence: CTT
gagatggtatctcattgtgg

SEQ ID NO: 109688 - DNA, 20 bp, Artificial Sequence
  Description of Artificial Sequence: Synthetic oligonucleotide
  Target: SCN9A; (+) strand; PAM type: YTN; PAM sequence: TTG
agatggtatctcattgtggt

SEQ ID NO: 109689 - DNA, 20 bp, Artificial Sequence
  Description of Artificial Sequence: Synthetic oligonucleotide
  Target: SCN9A; (+) strand; PAM type: YTN; PAM sequence: CTC
attgtggttttgatttgcgt

SEQ ID NO: 109690 - DNA, 20 bp, Artificial Sequence
  Description of Artificial Sequence: Synthetic oligonucleotide
  Target: SCN9A; (+) strand; PAM type: YTN; PAM sequence: TTG
tggttttgatttgcgtttct

SEQ ID NO: 109691 - DNA, 20 bp, Artificial Sequence
  Description of Artificial Sequence: Synthetic oligonucleotide
  Target: SCN9A; (+) strand; PAM type: YTN; PAM sequence: TTT
tgatttgcgtttcttaatga

SEQ ID NO: 109692 - DNA, 20 bp, Artificial Sequence
  Description of Artificial Sequence: Synthetic oligonucleotide
  Target: SCN9A; (+) strand; PAM type: YTN; PAM sequence: TTT
gatttgcgtttcttaatgat

SEQ ID NO: 109693 - DNA, 20 bp, Artificial Sequence
  Description of Artificial Sequence: Synthetic oligonucleotide
  Target: SCN9A; (+) strand; PAM type: YTN; PAM sequence: TTG
atttgcgtttcttaatgatc

SEQ ID NO: 109694 - DNA, 20 bp, Artificial Sequence
  Description of Artificial Sequence: Synthetic oligonucleotide
  Target: SCN9A; (+) strand; PAM type: YTN; PAM sequence: TTT
gcgtttcttaatgatcactg

SEQ ID NO: 109695 - DNA, 20 bp, Artificial Sequence
  Description of Artificial Sequence: Synthetic oligonucleotide
  Target: SCN9A; (+) strand; PAM type: YTN; PAM sequence: TTG
cgtttcttaatgatcactga

SEQ ID NO: 109696 - DNA, 20 bp, Artificial Sequence
  Description of Artificial Sequence: Synthetic oligonucleotide
  Target: SCN9A; (+) strand; PAM type: YTN; PAM sequence: TTT
cttaatgatcactgatgttg

SEQ ID NO: 109697 - DNA, 20 bp, Artificial Sequence
  Description of Artificial Sequence: Synthetic oligonucleotide
  Target: SCN9A; (+) strand; PAM type: YTN; PAM sequence: TTC
ttaatgatcactgatgttga

SEQ ID NO: 109698 - DNA, 20 bp, Artificial Sequence
  Description of Artificial Sequence: Synthetic oligonucleotide
  Target: SCN9A; (+) strand; PAM type: YTN; PAM sequence: CTT
aatgatcactgatgttgagc

SEQ ID NO: 109699 - DNA, 20 bp, Artificial Sequence
  Description of Artificial Sequence: Synthetic oligonucleotide
  Target: SCN9A; (+) strand; PAM type: YTN; PAM sequence: TTA
atgatcactgatgttgagct

SEQ ID NO: 109700 - DNA, 20 bp, Artificial Sequence
  Description of Artificial Sequence: Synthetic oligonucleotide
  Target: SCN9A; (+) strand; PAM type: YTN; PAM sequence: CTG
atgttgagctttttttcatg

SEQ ID NO: 109701 - DNA, 20 bp, Artificial Sequence
  Description of Artificial Sequence: Synthetic oligonucleotide
  Target: SCN9A; (+) strand; PAM type: YTN; PAM sequence: TTG
agctttttttcatgtttttt

SEQ ID NO: 109702 - DNA, 20 bp, Artificial Sequence
  Description of Artificial Sequence: Synthetic oligonucleotide
  Target: SCN9A; (+) strand; PAM type: YTN; PAM sequence: CTT
tttttcatgttttttggccg

SEQ ID NO: 109703 - DNA, 20 bp, Artificial Sequence
  Description of Artificial Sequence: Synthetic oligonucleotide
  Target: SCN9A; (+) strand; PAM type: YTN; PAM sequence: TTT
ttttcatgttttttggccgc

SEQ ID NO: 109704 - DNA, 20 bp, Artificial Sequence
  Description of Artificial Sequence: Synthetic oligonucleotide
  Target: SCN9A; (+) strand; PAM type: YTN; PAM sequence: TTT
tttcatgttttttggccgca

SEQ ID NO: 109705 - DNA, 20 bp, Artificial Sequence
  Description of Artificial Sequence: Synthetic oligonucleotide
  Target: SCN9A; (+) strand; PAM type: YTN; PAM sequence: TTT
ttcatgttttttggccgcat

SEQ ID NO: 109706 - DNA, 20 bp, Artificial Sequence
  Description of Artificial Sequence: Synthetic oligonucleotide
  Target: SCN9A; (+) strand; PAM type: YTN; PAM sequence: TTT
tcatgttttttggccgcata

SEQ ID NO: 109707 - DNA, 20 bp, Artificial Sequence
  Description of Artificial Sequence: Synthetic oligonucleotide
  Target: SCN9A; (+) strand; PAM type: YTN; PAM sequence: TTT
catgttttttggccgcataa

SEQ ID NO: 109708 - DNA, 20 bp, Artificial Sequence
  Description of Artificial Sequence: Synthetic oligonucleotide
  Target: SCN9A; (+) strand; PAM type: YTN; PAM sequence: TTC
atgttttttggccgcataaa

SEQ ID NO: 109709 - DNA, 20 bp, Artificial Sequence
  Description of Artificial Sequence: Synthetic oligonucleotide
  Target: SCN9A; (+) strand; PAM type: YTN; PAM sequence: TTT
tttggccgcataaatgtctt

SEQ ID NO: 109710 - DNA, 20 bp, Artificial Sequence
  Description of Artificial Sequence: Synthetic oligonucleotide
  Target: SCN9A; (+) strand; PAM type: YTN; PAM sequence: TTT
ttggccgcataaatgtcttc

SEQ ID NO: 109711 - DNA, 20 bp, Artificial Sequence
  Description of Artificial Sequence: Synthetic oligonucleotide
  Target: SCN9A; (+) strand; PAM type: YTN; PAM sequence: TTT
tggccgcataaatgtcttct

SEQ ID NO: 109712 - DNA, 20 bp, Artificial Sequence
  Description of Artificial Sequence: Synthetic oligonucleotide
  Target: SCN9A; (+) strand; PAM type: YTN; PAM sequence: TTT
ggccgcataaatgtcttctt

SEQ ID NO: 109713 - DNA, 20 bp, Artificial Sequence
  Description of Artificial Sequence: Synthetic oligonucleotide
  Target: SCN9A; (+) strand; PAM type: YTN; PAM sequence: TTG
gccgcataaatgtcttcttt

SEQ ID NO: 109714 - DNA, 20 bp, Artificial Sequence
  Description of Artificial Sequence: Synthetic oligonucleotide
  Target: SCN9A; (+) strand; PAM type: YTN; PAM sequence: CTT
cttttgagaagtctctgttc

SEQ ID NO: 109715 - DNA, 20 bp, Artificial Sequence
  Description of Artificial Sequence: Synthetic oligonucleotide
  Target: SCN9A; (+) strand; PAM type: YTN; PAM sequence: TTC
ttttgagaagtctctgttca

SEQ ID NO: 109716 - DNA, 20 bp, Artificial Sequence
  Description of Artificial Sequence: Synthetic oligonucleotide
  Target: SCN9A; (+) strand; PAM type: YTN; PAM sequence: CTT
ttgagaagtctctgttcata

SEQ ID NO: 109717 - DNA, 20 bp, Artificial Sequence
  Description of Artificial Sequence: Synthetic oligonucleotide
  Target: SCN9A; (+) strand; PAM type: YTN; PAM sequence: TTT
tgagaagtctctgttcatat

SEQ ID NO: 109718 - DNA, 20 bp, Artificial Sequence
  Description of Artificial Sequence: Synthetic oligonucleotide
  Target: SCN9A; (+) strand; PAM type: YTN; PAM sequence: TTT
gagaagtctctgttcatatc

SEQ ID NO: 109719 - DNA, 20 bp, Artificial Sequence
  Description of Artificial Sequence: Synthetic oligonucleotide
  Target: SCN9A; (+) strand; PAM type: YTN; PAM sequence: TTG
agaagtctctgttcatatcc

SEQ ID NO: 109720 - DNA, 20 bp, Artificial Sequence
  Description of Artificial Sequence: Synthetic oligonucleotide
  Target: SCN9A; (+) strand; PAM type: YTN; PAM sequence: CTC
tgttcatatcctttgcccac

SEQ ID NO: 109721 - DNA, 20 bp, Artificial Sequence
  Description of Artificial Sequence: Synthetic oligonucleotide
  Target: SCN9A; (+) strand; PAM type: YTN; PAM sequence: CTG
ttcatatcctttgcccactt

SEQ ID NO: 109722 - DNA, 20 bp, Artificial Sequence
  Description of Artificial Sequence: Synthetic oligonucleotide
  Target: SCN9A; (+) strand; PAM type: YTN; PAM sequence: TTC
atatcctttgcccacttttt

SEQ ID NO: 109723 - DNA, 20 bp, Artificial Sequence
  Description of Artificial Sequence: Synthetic oligonucleotide
  Target: SCN9A; (+) strand; PAM type: YTN; PAM sequence: CTT
tgcccactttttgatgggat

SEQ ID NO: 109724 - DNA, 20 bp, Artificial Sequence
  Description of Artificial Sequence: Synthetic oligonucleotide
  Target: SCN9A; (+) strand; PAM type: YTN; PAM sequence: TTT
gcccactttttgatgggatg

SEQ ID NO: 109725 - DNA, 20 bp, Artificial Sequence
  Description of Artificial Sequence: Synthetic oligonucleotide
  Target: SCN9A; (+) strand; PAM type: YTN; PAM sequence: TTG
cccactttttgatgggatgc

SEQ ID NO: 109726 - DNA, 20 bp, Artificial Sequence
  Description of Artificial Sequence: Synthetic oligonucleotide
  Target: SCN9A; (+) strand; PAM type: YTN; PAM sequence: CTT
tttgatgggatgcaaggctg

SEQ ID NO: 109727 - DNA, 20 bp, Artificial Sequence
  Description of Artificial Sequence: Synthetic oligonucleotide
  Target: SCN9A; (+) strand; PAM type: YTN; PAM sequence: TTT
ttgatgggatgcaaggctgg

SEQ ID NO: 109728 - DNA, 20 bp, Artificial Sequence
  Description of Artificial Sequence: Synthetic oligonucleotide
  Target: SCN9A; (+) strand; PAM type: YTN; PAM sequence: TTT
tgatgggatgcaaggctggt

SEQ ID NO: 109729 - DNA, 20 bp, Artificial Sequence
  Description of Artificial Sequence: Synthetic oligonucleotide
  Target: SCN9A; (+) strand; PAM type: YTN; PAM sequence: TTT
gatgggatgcaaggctggtt

SEQ ID NO: 109730 - DNA, 20 bp, Artificial Sequence
  Description of Artificial Sequence: Synthetic oligonucleotide
  Target: SCN9A; (+) strand; PAM type: YTN; PAM sequence: TTG
atgggatgcaaggctggttc

SEQ ID NO: 109731 - DNA, 20 bp, Artificial Sequence
  Description of Artificial Sequence: Synthetic oligonucleotide
  Target: SCN9A; (+) strand; PAM type: YTN; PAM sequence: CTG
gttcaatatatgcaaatcaa

SEQ ID NO: 109732 - DNA, 20 bp, Artificial Sequence
  Description of Artificial Sequence: Synthetic oligonucleotide
  Target: SCN9A; (+) strand; PAM type: YTN; PAM sequence: TTC
aatatatgcaaatcaataaa

SEQ ID NO: 109733 - DNA, 20 bp, Artificial Sequence
  Description of Artificial Sequence: Synthetic oligonucleotide
  Target: SCN9A; (+) strand; PAM type: YTN; PAM sequence: TTA
tctcaatagatgcagagaag

SEQ ID NO: 109734 - DNA, 20 bp, Artificial Sequence
  Description of Artificial Sequence: Synthetic oligonucleotide
  Target: SCN9A; (+) strand; PAM type: YTN; PAM sequence: CTC
aatagatgcagagaaggtct

SEQ ID NO: 109735 - DNA, 20 bp, Artificial Sequence
  Description of Artificial Sequence: Synthetic oligonucleotide
  Target: SCN9A; (+) strand; PAM type: YTN; PAM sequence: CTT
caataaaatgcaacatccat

SEQ ID NO: 109736 - DNA, 20 bp, Artificial Sequence
  Description of Artificial Sequence: Synthetic oligonucleotide
  Target: SCN9A; (+) strand; PAM type: YTN; PAM sequence: TTC
aataaaatgcaacatccatt

SEQ ID NO: 109737 - DNA, 20 bp, Artificial Sequence
  Description of Artificial Sequence: Synthetic oligonucleotide
  Target: SCN9A; (+) strand; PAM type: YTN; PAM sequence: TTC
atgttaaaaactatcaataa

SEQ ID NO: 109738 - DNA, 20 bp, Artificial Sequence
  Description of Artificial Sequence: Synthetic oligonucleotide
  Target: SCN9A; (+) strand; PAM type: YTN; PAM sequence: TTA
aaaactatcaataaactagg

SEQ ID NO: 109739 - DNA, 20 bp, Artificial Sequence
  Description of Artificial Sequence: Synthetic oligonucleotide
  Target: SCN9A; (+) strand; PAM type: YTN; PAM sequence: CTA
tcaataaactaggtattgat

SEQ ID NO: 109740 - DNA, 20 bp, Artificial Sequence
  Description of Artificial Sequence: Synthetic oligonucleotide
  Target: SCN9A; (+) strand; PAM type: YTN; PAM sequence: CTA
ggtattgatggaacatatct

SEQ ID NO: 109741 - DNA, 20 bp, Artificial Sequence
  Description of Artificial Sequence: Synthetic oligonucleotide
  Target: SCN9A; (+) strand; PAM type: YTN; PAM sequence: TTG
atggaacatatctcaaaata

SEQ ID NO: 109742 - DNA, 20 bp, Artificial Sequence
  Description of Artificial Sequence: Synthetic oligonucleotide
  Target: SCN9A; (+) strand; PAM type: YTN; PAM sequence: CTC
aaaataataagagctattta

SEQ ID NO: 109743 - DNA, 20 bp, Artificial Sequence
  Description of Artificial Sequence: Synthetic oligonucleotide
  Target: SCN9A; (+) strand; PAM type: YTN; PAM sequence: CTA
tttatgaaaactccatagcc

SEQ ID NO: 109744 - DNA, 20 bp, Artificial Sequence
  Description of Artificial Sequence: Synthetic oligonucleotide
  Target: SCN9A; (+) strand; PAM type: YTN; PAM sequence: TTT
atgaaaactccatagccaat

SEQ ID NO: 109745 - DNA, 20 bp, Artificial Sequence
  Description of Artificial Sequence: Synthetic oligonucleotide
  Target: SCN9A; (+) strand; PAM type: YTN; PAM sequence: TTA
tgaaaactccatagccaata

SEQ ID NO: 109746 - DNA, 20 bp, Artificial Sequence
  Description of Artificial Sequence: Synthetic oligonucleotide
  Target: SCN9A; (+) strand; PAM type: YTN; PAM sequence: CTC
catagccaatatcatactga

SEQ ID NO: 109747 - DNA, 20 bp, Artificial Sequence
  Description of Artificial Sequence: Synthetic oligonucleotide
  Target: SCN9A; (+) strand; PAM type: YTN; PAM sequence: CTG
aatgggaaaaagctggaagc

SEQ ID NO: 109748 - DNA, 20 bp, Artificial Sequence
  Description of Artificial Sequence: Synthetic oligonucleotide
  Target: SCN9A; (+) strand; PAM type: YTN; PAM sequence: CTG
gaagcattccctttaaaaac

SEQ ID NO: 109749 - DNA, 20 bp, Artificial Sequence
  Description of Artificial Sequence: Synthetic oligonucleotide
  Target: SCN9A; (+) strand; PAM type: YTN; PAM sequence: TTC
cctttaaaaactggcacaag

SEQ ID NO: 109750 - DNA, 20 bp, Artificial Sequence
  Description of Artificial Sequence: Synthetic oligonucleotide
  Target: SCN9A; (+) strand; PAM type: YTN; PAM sequence: CTT
taaaaactggcacaagacaa

SEQ ID NO: 109751 - DNA, 20 bp, Artificial Sequence
  Description of Artificial Sequence: Synthetic oligonucleotide
  Target: SCN9A; (+) strand; PAM type: YTN; PAM sequence: TTT
aaaaactggcacaagacaag

SEQ ID NO: 109752 - DNA, 20 bp, Artificial Sequence
  Description of Artificial Sequence: Synthetic oligonucleotide
  Target: SCN9A; (+) strand; PAM type: YTN; PAM sequence: TTA
aaaactggcacaagacaagg

SEQ ID NO: 109753 - DNA, 20 bp, Artificial Sequence
  Description of Artificial Sequence: Synthetic oligonucleotide
  Target: SCN9A; (+) strand; PAM type: YTN; PAM sequence: CTG
gcacaagacaaggatgccct

SEQ ID NO: 109754 - DNA, 20 bp, Artificial Sequence
  Description of Artificial Sequence: Synthetic oligonucleotide
  Target: SCN9A; (+) strand; PAM type: YTN; PAM sequence: CTC
tctcaccactgctattcaat

SEQ ID NO: 109755 - DNA, 20 bp, Artificial Sequence
  Description of Artificial Sequence: Synthetic oligonucleotide
  Target: SCN9A; (+) strand; PAM type: YTN; PAM sequence: CTC
tcaccactgctattcaatat

SEQ ID NO: 109756 - DNA, 20 bp, Artificial Sequence
  Description of Artificial Sequence: Synthetic oligonucleotide
  Target: SCN9A; (+) strand; PAM type: YTN; PAM sequence: CTC
accactgctattcaatatag

SEQ ID NO: 109757 - DNA, 20 bp, Artificial Sequence
  Description of Artificial Sequence: Synthetic oligonucleotide
  Target: SCN9A; (+) strand; PAM type: YTN; PAM sequence: CTG
ctattcaatatagtgttgga

SEQ ID NO: 109758 - DNA, 20 bp, Artificial Sequence
  Description of Artificial Sequence: Synthetic oligonucleotide
  Target: SCN9A; (+) strand; PAM type: YTN; PAM sequence: CTA
ttcaatatagtgttggaatt

SEQ ID NO: 109759 - DNA, 20 bp, Artificial Sequence
  Description of Artificial Sequence: Synthetic oligonucleotide
  Target: SCN9A; (+) strand; PAM type: YTN; PAM sequence: TTC
aatatagtgttggaatttct

SEQ ID NO: 109760 - DNA, 20 bp, Artificial Sequence
  Description of Artificial Sequence: Synthetic oligonucleotide
  Target: SCN9A; (+) strand; PAM type: YTN; PAM sequence: TTG
gaatttctggccagggcaat

SEQ ID NO: 109761 - DNA, 20 bp, Artificial Sequence
  Description of Artificial Sequence: Synthetic oligonucleotide
  Target: SCN9A; (+) strand; PAM type: YTN; PAM sequence: TTT
ctggccagggcaatcagaca

SEQ ID NO: 109762 - DNA, 20 bp, Artificial Sequence
  Description of Artificial Sequence: Synthetic oligonucleotide
  Target: SCN9A; (+) strand; PAM type: YTN; PAM sequence: TTC
tggccagggcaatcagacaa

SEQ ID NO: 109763 - DNA, 20 bp, Artificial Sequence
  Description of Artificial Sequence: Synthetic oligonucleotide
  Target: SCN9A; (+) strand; PAM type: YTN; PAM sequence: CTG
gccagggcaatcagacaaga

SEQ ID NO: 109764 - DNA, 20 bp, Artificial Sequence
  Description of Artificial Sequence: Synthetic oligonucleotide
  Target: SCN9A; (+) strand; PAM type: YTN; PAM sequence: TTC
aaataggaagaccggaagtc

SEQ ID NO: 109765 - DNA, 20 bp, Artificial Sequence
  Description of Artificial Sequence: Synthetic oligonucleotide
  Target: SCN9A; (+) strand; PAM type: YTN; PAM sequence: TTG
tctctgcaaatgacatgatt

SEQ ID NO: 109766 - DNA, 20 bp, Artificial Sequence
  Description of Artificial Sequence: Synthetic oligonucleotide
  Target: SCN9A; (+) strand; PAM type: YTN; PAM sequence: CTC
tgcaaatgacatgattctat

SEQ ID NO: 109767 - DNA, 20 bp, Artificial Sequence
  Description of Artificial Sequence: Synthetic oligonucleotide
  Target: SCN9A; (+) strand; PAM type: YTN; PAM sequence: CTG
caaatgacatgattctatat

SEQ ID NO: 109768 - DNA, 20 bp, Artificial Sequence
  Description of Artificial Sequence: Synthetic oligonucleotide
  Target: SCN9A; (+) strand; PAM type: YTN; PAM sequence: TTC
tatatttagaaaacccgatc

SEQ ID NO: 109769 - DNA, 20 bp, Artificial Sequence
  Description of Artificial Sequence: Synthetic oligonucleotide
  Target: SCN9A; (+) strand; PAM type: YTN; PAM sequence: CTA
tatttagaaaacccgatcat

SEQ ID NO: 109770 - DNA, 20 bp, Artificial Sequence
  Description of Artificial Sequence: Synthetic oligonucleotide
  Target: SCN9A; (+) strand; PAM type: YTN; PAM sequence: TTT
agaaaacccgatcatctcag

SEQ ID NO: 109771 - DNA, 20 bp, Artificial Sequence
  Description of Artificial Sequence: Synthetic oligonucleotide
  Target: SCN9A; (+) strand; PAM type: YTN; PAM sequence: TTA
gaaaacccgatcatctcagc

SEQ ID NO: 109772 - DNA, 20 bp, Artificial Sequence
  Description of Artificial Sequence: Synthetic oligonucleotide
  Target: SCN9A; (+) strand; PAM type: YTN; PAM sequence: CTC
agccccaaaactctttaaac

SEQ ID NO: 109773 - DNA, 20 bp, Artificial Sequence
  Description of Artificial Sequence: Synthetic oligonucleotide
  Target: SCN9A; (+) strand; PAM type: YTN; PAM sequence: CTC
tttaaactgataagcaactt

SEQ ID NO: 109774 - DNA, 20 bp, Artificial Sequence
  Description of Artificial Sequence: Synthetic oligonucleotide
  Target: SCN9A; (+) strand; PAM type: YTN; PAM sequence: CTT
taaactgataagcaacttca

SEQ ID NO: 109775 - DNA, 20 bp, Artificial Sequence
  Description of Artificial Sequence: Synthetic oligonucleotide
  Target: SCN9A; (+) strand; PAM type: YTN; PAM sequence: TTT
aaactgataagcaacttcag

SEQ ID NO: 109776 - DNA, 20 bp, Artificial Sequence
  Description of Artificial Sequence: Synthetic oligonucleotide
  Target: SCN9A; (+) strand; PAM type: YTN; PAM sequence: TTA
aactgataagcaacttcagc

SEQ ID NO: 109777 - DNA, 20 bp, Artificial Sequence
  Description of Artificial Sequence: Synthetic oligonucleotide
  Target: SCN9A; (+) strand; PAM type: YTN; PAM sequence: CTG
ataagcaacttcagcaaggt

SEQ ID NO: 109778 - DNA, 20 bp, Artificial Sequence
  Description of Artificial Sequence: Synthetic oligonucleotide
  Target: SCN9A; (+) strand; PAM type: YTN; PAM sequence: CTT
cagcaaggtatcaggataca

SEQ ID NO: 109779 - DNA, 20 bp, Artificial Sequence
  Description of Artificial Sequence: Synthetic oligonucleotide
  Target: SCN9A; (+) strand; PAM type: YTN; PAM sequence: TTC
agcaaggtatcaggatacaa

SEQ ID NO: 109780 - DNA, 20 bp, Artificial Sequence
  Description of Artificial Sequence: Synthetic oligonucleotide
  Target: SCN9A; (+) strand; PAM type: YTN; PAM sequence: TTC
ctatacaccaacaatagaca

SEQ ID NO: 109781 - DNA, 20 bp, Artificial Sequence
  Description of Artificial Sequence: Synthetic oligonucleotide
  Target: SCN9A; (+) strand; PAM type: YTN; PAM sequence: CTA
tacaccaacaatagacaagc

SEQ ID NO: 109782 - DNA, 20 bp, Artificial Sequence
  Description of Artificial Sequence: Synthetic oligonucleotide
  Target: SCN9A; (+) strand; PAM type: YTN; PAM sequence: CTC
ccatttgcaattgctataaa

SEQ ID NO: 109783 - DNA, 20 bp, Artificial Sequence
  Description of Artificial Sequence: Synthetic oligonucleotide
  Target: SCN9A; (+) strand; PAM type: YTN; PAM sequence: TTT
gcaattgctataaagagaat

SEQ ID NO: 109784 - DNA, 20 bp, Artificial Sequence
  Description of Artificial Sequence: Synthetic oligonucleotide
  Target: SCN9A; (+) strand; PAM type: YTN; PAM sequence: TTG
caattgctataaagagaata

SEQ ID NO: 109785 - DNA, 20 bp, Artificial Sequence
  Description of Artificial Sequence: Synthetic oligonucleotide
  Target: SCN9A; (+) strand; PAM type: YTN; PAM sequence: TTG
ctataaagagaataaaatac

SEQ ID NO: 109786 - DNA, 20 bp, Artificial Sequence
  Description of Artificial Sequence: Synthetic oligonucleotide
  Target: SCN9A; (+) strand; PAM type: YTN; PAM sequence: CTA
taaagagaataaaataccta

SEQ ID NO: 109787 - DNA, 20 bp, Artificial Sequence
  Description of Artificial Sequence: Synthetic oligonucleotide
  Target: SCN9A; (+) strand; PAM type: YTN; PAM sequence: CTA
ggaatacagcttacaaagga

SEQ ID NO: 109788 - DNA, 20 bp, Artificial Sequence
  Description of Artificial Sequence: Synthetic oligonucleotide
  Target: SCN9A; (+) strand; PAM type: YTN; PAM sequence: CTT
acaaaggatatgaaagacct

SEQ ID NO: 109789 - DNA, 20 bp, Artificial Sequence
  Description of Artificial Sequence: Synthetic oligonucleotide
  Target: SCN9A; (+) strand; PAM type: YTN; PAM sequence: TTA
caaaggatatgaaagacctc

SEQ ID NO: 109790 - DNA, 20 bp, Artificial Sequence
  Description of Artificial Sequence: Synthetic oligonucleotide
  Target: SCN9A; (+) strand; PAM type: YTN; PAM sequence: CTC
ttcaagaactacaagccact

SEQ ID NO: 109791 - DNA, 20 bp, Artificial Sequence
  Description of Artificial Sequence: Synthetic oligonucleotide
  Target: SCN9A; (+) strand; PAM type: YTN; PAM sequence: CTT
caagaactacaagccactac

SEQ ID NO: 109792 - DNA, 20 bp, Artificial Sequence
  Description of Artificial Sequence: Synthetic oligonucleotide
  Target: SCN9A; (+) strand; PAM type: YTN; PAM sequence: TTC
aagaactacaagccactact

SEQ ID NO: 109793 - DNA, 20 bp, Artificial Sequence
  Description of Artificial Sequence: Synthetic oligonucleotide
  Target: SCN9A; (+) strand; PAM type: YTN; PAM sequence: CTA
caagccactactcaaggaaa

SEQ ID NO: 109794 - DNA, 20 bp, Artificial Sequence
  Description of Artificial Sequence: Synthetic oligonucleotide
  Target: SCN9A; (+) strand; PAM type: YTN; PAM sequence: CTA
ctcaaggaaacaagagagga

SEQ ID NO: 109795 - DNA, 20 bp, Artificial Sequence
  Description of Artificial Sequence: Synthetic oligonucleotide
  Target: SCN9A; (+) strand; PAM type: YTN; PAM sequence: CTC
aaggaaacaagagaggacac

SEQ ID NO: 109796 - DNA, 20 bp, Artificial Sequence
  Description of Artificial Sequence: Synthetic oligonucleotide
  Target: SCN9A; (+) strand; PAM type: YTN; PAM sequence: TTC
catactcatggataggaaga

SEQ ID NO: 109797 - DNA, 20 bp, Artificial Sequence
  Description of Artificial Sequence: Synthetic oligonucleotide
  Target: SCN9A; (+) strand; PAM type: YTN; PAM sequence: CTC
atggataggaagaatcaatg

SEQ ID NO: 109798 - DNA, 20 bp, Artificial Sequence
  Description of Artificial Sequence: Synthetic oligonucleotide
  Target: SCN9A; (+) strand; PAM type: YTN; PAM sequence: CTG
ccgaaagtaatttatagatt

SEQ ID NO: 109799 - DNA, 20 bp, Artificial Sequence
  Description of Artificial Sequence: Synthetic oligonucleotide
  Target: SCN9A; (+) strand; PAM type: YTN; PAM sequence: TTT
atagattcaatgctagtccc

SEQ ID NO: 109800 - DNA, 20 bp, Artificial Sequence
  Description of Artificial Sequence: Synthetic oligonucleotide
  Target: SCN9A; (+) strand; PAM type: YTN; PAM sequence: TTA
tagattcaatgctagtccca

SEQ ID NO: 109801 - DNA, 20 bp, Artificial Sequence
  Description of Artificial Sequence: Synthetic oligonucleotide
  Target: SCN9A; (+) strand; PAM type: YTN; PAM sequence: TTC
aatgctagtcccatcaaatt

SEQ ID NO: 109802 - DNA, 20 bp, Artificial Sequence
  Description of Artificial Sequence: Synthetic oligonucleotide
  Target: SCN9A; (+) strand; PAM type: YTN; PAM sequence: CTA
gtcccatcaaattaccattg

SEQ ID NO: 109803 - DNA, 20 bp, Artificial Sequence
  Description of Artificial Sequence: Synthetic oligonucleotide
  Target: SCN9A; (+) strand; PAM type: YTN; PAM sequence: TTA
ccattgacatcttcacagaa

SEQ ID NO: 109804 - DNA, 20 bp, Artificial Sequence
  Description of Artificial Sequence: Synthetic oligonucleotide
  Target: SCN9A; (+) strand; PAM type: YTN; PAM sequence: TTG
acatcttcacagaattagaa

SEQ ID NO: 109805 - DNA, 20 bp, Artificial Sequence
  Description of Artificial Sequence: Synthetic oligonucleotide
  Target: SCN9A; (+) strand; PAM type: YTN; PAM sequence: CTT
cacagaattagaaaactact

SEQ ID NO: 109806 - DNA, 20 bp, Artificial Sequence
  Description of Artificial Sequence: Synthetic oligonucleotide
  Target: SCN9A; (+) strand; PAM type: YTN; PAM sequence: TTC
acagaattagaaaactactt

SEQ ID NO: 109807 - DNA, 20 bp, Artificial Sequence
  Description of Artificial Sequence: Synthetic oligonucleotide
  Target: SCN9A; (+) strand; PAM type: YTN; PAM sequence: TTA
gaaaactactttaaatttca

SEQ ID NO: 109808 - DNA, 20 bp, Artificial Sequence
  Description of Artificial Sequence: Synthetic oligonucleotide
  Target: SCN9A; (+) strand; PAM type: YTN; PAM sequence: CTA
ctttaaatttcatatgaaac

SEQ ID NO: 109809 - DNA, 20 bp, Artificial Sequence
  Description of Artificial Sequence: Synthetic oligonucleotide
  Target: SCN9A; (+) strand; PAM type: YTN; PAM sequence: CTT
taaatttcatatgaaaccag

SEQ ID NO: 109810 - DNA, 20 bp, Artificial Sequence
  Description of Artificial Sequence: Synthetic oligonucleotide
  Target: SCN9A; (+) strand; PAM type: YTN; PAM sequence: TTT
aaatttcatatgaaaccagg

SEQ ID NO: 109811 - DNA, 20 bp, Artificial Sequence
  Description of Artificial Sequence: Synthetic oligonucleotide
  Target: SCN9A; (+) strand; PAM type: YTN; PAM sequence: TTA
aatttcatatgaaaccagga

SEQ ID NO: 109812 - DNA, 20 bp, Artificial Sequence
  Description of Artificial Sequence: Synthetic oligonucleotide
  Target: SCN9A; (+) strand; PAM type: YTN; PAM sequence: TTT
catatgaaaccaggaaagag

SEQ ID NO: 109813 - DNA, 20 bp, Artificial Sequence
  Description of Artificial Sequence: Synthetic oligonucleotide
  Target: SCN9A; (+) strand; PAM type: YTN; PAM sequence: TTC
atatgaaaccaggaaagagc

SEQ ID NO: 109814 - DNA, 20 bp, Artificial Sequence
  Description of Artificial Sequence: Synthetic oligonucleotide
  Target: SCN9A; (+) strand; PAM type: YTN; PAM sequence: TTC
taagcaaaaagaacaaagct

SEQ ID NO: 109815 - DNA, 20 bp, Artificial Sequence
  Description of Artificial Sequence: Synthetic oligonucleotide
  Target: SCN9A; (+) strand; PAM type: YTN; PAM sequence: CTA
agcaaaaagaacaaagctgg

SEQ ID NO: 109816 - DNA, 20 bp, Artificial Sequence
  Description of Artificial Sequence: Synthetic oligonucleotide
  Target: SCN9A; (+) strand; PAM type: YTN; PAM sequence: CTG
gaggcatcagcctacctgac

SEQ ID NO: 109817 - DNA, 20 bp, Artificial Sequence
  Description of Artificial Sequence: Synthetic oligonucleotide
  Target: SCN9A; (+) strand; PAM type: YTN; PAM sequence: CTA
cctgacttcaaactatacta

SEQ ID NO: 109818 - DNA, 20 bp, Artificial Sequence
  Description of Artificial Sequence: Synthetic oligonucleotide
  Target: SCN9A; (+) strand; PAM type: YTN; PAM sequence: CTG
acttcaaactatactatgag

SEQ ID NO: 109819 - DNA, 20 bp, Artificial Sequence
  Description of Artificial Sequence: Synthetic oligonucleotide
  Target: SCN9A; (+) strand; PAM type: YTN; PAM sequence: CTT
caaactatactatgaggtta

SEQ ID NO: 109820 - DNA, 20 bp, Artificial Sequence
  Description of Artificial Sequence: Synthetic oligonucleotide
  Target: SCN9A; (+) strand; PAM type: YTN; PAM sequence: TTC
aaactatactatgaggttac

SEQ ID NO: 109821 - DNA, 20 bp, Artificial Sequence
  Description of Artificial Sequence: Synthetic oligonucleotide
  Target: SCN9A; (+) strand; PAM type: YTN; PAM sequence: CTA
tactatgaggttacagtaac

SEQ ID NO: 109822 - DNA, 20 bp, Artificial Sequence
  Description of Artificial Sequence: Synthetic oligonucleotide
  Target: SCN9A; (+) strand; PAM type: YTN; PAM sequence: CTA
tgaggttacagtaaccaaaa

SEQ ID NO: 109823 - DNA, 20 bp, Artificial Sequence
  Description of Artificial Sequence: Synthetic oligonucleotide
  Target: SCN9A; (+) strand; PAM type: YTN; PAM sequence: TTA
cagtaaccaaaacagcatgg

SEQ ID NO: 109824 - DNA, 20 bp, Artificial Sequence
  Description of Artificial Sequence: Synthetic oligonucleotide
  Target: SCN9A; (+) strand; PAM type: YTN; PAM sequence: CTC
agaaataacaccacacttct

SEQ ID NO: 109825 - DNA, 20 bp, Artificial Sequence
  Description of Artificial Sequence: Synthetic oligonucleotide
  Target: SCN9A; (+) strand; PAM type: YTN; PAM sequence: CTT
ctacaagcatctgatcttcg

SEQ ID NO: 109826 - DNA, 20 bp, Artificial Sequence
  Description of Artificial Sequence: Synthetic oligonucleotide
  Target: SCN9A; (+) strand; PAM type: YTN; PAM sequence: TTC
tacaagcatctgatcttcga

SEQ ID NO: 109827 - DNA, 20 bp, Artificial Sequence
  Description of Artificial Sequence: Synthetic oligonucleotide
  Target: SCN9A; (+) strand; PAM type: YTN; PAM sequence: CTA
caagcatctgatcttcgaca

SEQ ID NO: 109828 - DNA, 20 bp, Artificial Sequence
  Description of Artificial Sequence: Synthetic oligonucleotide
  Target: SCN9A; (+) strand; PAM type: YTN; PAM sequence: CTG
atcttcgacaaacctgacaa

SEQ ID NO: 109829 - DNA, 20 bp, Artificial Sequence
  Description of Artificial Sequence: Synthetic oligonucleotide
  Target: SCN9A; (+) strand; PAM type: YTN; PAM sequence: CTT
cgacaaacctgacaaaaaca

SEQ ID NO: 109830 - DNA, 20 bp, Artificial Sequence
  Description of Artificial Sequence: Synthetic oligonucleotide
  Target: SCN9A; (+) strand; PAM type: YTN; PAM sequence: TTC
gacaaacctgacaaaaacaa

SEQ ID NO: 109831 - DNA, 20 bp, Artificial Sequence
  Description of Artificial Sequence: Synthetic oligonucleotide
  Target: SCN9A; (+) strand; PAM type: YTN; PAM sequence: CTG
acaaaaacaagcaatgtgga

SEQ ID NO: 109832 - DNA, 20 bp, Artificial Sequence
  Description of Artificial Sequence: Synthetic oligonucleotide
  Target: SCN9A; (+) strand; PAM type: YTN; PAM sequence: TTC
cctatataataaatggtgct

SEQ ID NO: 109833 - DNA, 20 bp, Artificial Sequence
  Description of Artificial Sequence: Synthetic oligonucleotide
  Target: SCN9A; (+) strand; PAM type: YTN; PAM sequence: CTA
tataataaatggtgctgggg

SEQ ID NO: 109834 - DNA, 20 bp, Artificial Sequence
  Description of Artificial Sequence: Synthetic oligonucleotide
  Target: SCN9A; (+) strand; PAM type: YTN; PAM sequence: CTG
gggaagctggctagccatat

SEQ ID NO: 109835 - DNA, 20 bp, Artificial Sequence
  Description of Artificial Sequence: Synthetic oligonucleotide
  Target: SCN9A; (+) strand; PAM type: YTN; PAM sequence: CTG
gctagccatatgcagaaaac

SEQ ID NO: 109836 - DNA, 20 bp, Artificial Sequence
  Description of Artificial Sequence: Synthetic oligonucleotide
  Target: SCN9A; (+) strand; PAM type: YTN; PAM sequence: CTA
gccatatgcagaaaactgaa

SEQ ID NO: 109837 - DNA, 20 bp, Artificial Sequence
  Description of Artificial Sequence: Synthetic oligonucleotide
  Target: SCN9A; (+) strand; PAM type: YTN; PAM sequence: CTG
aaactgggctccttccttac

SEQ ID NO: 109838 - DNA, 20 bp, Artificial Sequence
  Description of Artificial Sequence: Synthetic oligonucleotide
  Target: SCN9A; (+) strand; PAM type: YTN; PAM sequence: CTG
ggctccttccttacacctta

SEQ ID NO: 109839 - DNA, 20 bp, Artificial Sequence
  Description of Artificial Sequence: Synthetic oligonucleotide
  Target: SCN9A; (+) strand; PAM type: YTN; PAM sequence: CTC
cttccttacaccttatacaa

SEQ ID NO: 109840 - DNA, 20 bp, Artificial Sequence
  Description of Artificial Sequence: Synthetic oligonucleotide
  Target: SCN9A; (+) strand; PAM type: YTN; PAM sequence: CTT
ccttacaccttatacaaaaa

SEQ ID NO: 109841 - DNA, 20 bp, Artificial Sequence
  Description of Artificial Sequence: Synthetic oligonucleotide
  Target: SCN9A; (+) strand; PAM type: YTN; PAM sequence: TTC
cttacaccttatacaaaaat

SEQ ID NO: 109842 - DNA, 20 bp, Artificial Sequence
  Description of Artificial Sequence: Synthetic oligonucleotide
  Target: SCN9A; (+) strand; PAM type: YTN; PAM sequence: CTT
acaccttatacaaaaattaa

SEQ ID NO: 109843 - DNA, 20 bp, Artificial Sequence
  Description of Artificial Sequence: Synthetic oligonucleotide
  Target: SCN9A; (+) strand; PAM type: YTN; PAM sequence: TTA
caccttatacaaaaattaac

SEQ ID NO: 109844 - DNA, 20 bp, Artificial Sequence
  Description of Artificial Sequence: Synthetic oligonucleotide
  Target: SCN9A; (+) strand; PAM type: YTN; PAM sequence: CTT
atacaaaaattaactcaaga

SEQ ID NO: 109845 - DNA, 20 bp, Artificial Sequence
  Description of Artificial Sequence: Synthetic oligonucleotide
  Target: SCN9A; (+) strand; PAM type: YTN; PAM sequence: TTA
tacaaaaattaactcaagat

SEQ ID NO: 109846 - DNA, 20 bp, Artificial Sequence
  Description of Artificial Sequence: Synthetic oligonucleotide
  Target: SCN9A; (+) strand; PAM type: YTN; PAM sequence: TTA
actcaagatggattaaagac

SEQ ID NO: 109847 - DNA, 20 bp, Artificial Sequence
  Description of Artificial Sequence: Synthetic oligonucleotide
  Target: SCN9A; (+) strand; PAM type: YTN; PAM sequence: CTC
aagatggattaaagacttaa

SEQ ID NO: 109848 - DNA, 20 bp, Artificial Sequence
  Description of Artificial Sequence: Synthetic oligonucleotide
  Target: SCN9A; (+) strand; PAM type: YTN; PAM sequence: TTA
aagacttaatgtaaaacccc

SEQ ID NO: 109849 - DNA, 20 bp, Artificial Sequence
  Description of Artificial Sequence: Synthetic oligonucleotide
  Target: SCN9A; (+) strand; PAM type: YTN; PAM sequence: CTT
aatgtaaaaccccaaaccat

SEQ ID NO: 109850 - DNA, 20 bp, Artificial Sequence
  Description of Artificial Sequence: Synthetic oligonucleotide
  Target: SCN9A; (+) strand; PAM type: YTN; PAM sequence: TTA
atgtaaaaccccaaaccatg

SEQ ID NO: 109851 - DNA, 20 bp, Artificial Sequence
  Description of Artificial Sequence: Synthetic oligonucleotide
  Target: SCN9A; (+) strand; PAM type: YTN; PAM sequence: CTA
gaagaaaacctaggcaacac

SEQ ID NO: 109852 - DNA, 20 bp, Artificial Sequence
  Description of Artificial Sequence: Synthetic oligonucleotide
  Target: SCN9A; (+) strand; PAM type: YTN; PAM sequence: CTA
ggcaacaccattcaggaaat

SEQ ID NO: 109853 - DNA, 20 bp, Artificial Sequence
  Description of Artificial Sequence: Synthetic oligonucleotide
  Target: SCN9A; (+) strand; PAM type: YTN; PAM sequence: TTC
aggaaataggcatgggcaaa

SEQ ID NO: 109854 - DNA, 20 bp, Artificial Sequence
  Description of Artificial Sequence: Synthetic oligonucleotide
  Target: SCN9A; (+) strand; PAM type: YTN; PAM sequence: CTT
catgacaaaaataccaaaag

SEQ ID NO: 109855 - DNA, 20 bp, Artificial Sequence
  Description of Artificial Sequence: Synthetic oligonucleotide
  Target: SCN9A; (+) strand; PAM type: YTN; PAM sequence: TTC
atgacaaaaataccaaaagc

SEQ ID NO: 109856 - DNA, 20 bp, Artificial Sequence
  Description of Artificial Sequence: Synthetic oligonucleotide
  Target: SCN9A; (+) strand; PAM type: YTN; PAM sequence: TTG
caaccaaagccaaaattgac

SEQ ID NO: 109857 - DNA, 20 bp, Artificial Sequence
  Description of Artificial Sequence: Synthetic oligonucleotide
  Target: SCN9A; (+) strand; PAM type: YTN; PAM sequence: TTG
acaaatgggatataactaaa

SEQ ID NO: 109858 - DNA, 20 bp, Artificial Sequence
  Description of Artificial Sequence: Synthetic oligonucleotide
  Target: SCN9A; (+) strand; PAM type: YTN; PAM sequence: CTA
aactaaagagcttctgcaca

SEQ ID NO: 109859 - DNA, 20 bp, Artificial Sequence
  Description of Artificial Sequence: Synthetic oligonucleotide
  Target: SCN9A; (+) strand; PAM type: YTN; PAM sequence: CTA
aagagcttctgcacagcaaa

SEQ ID NO: 109860 - DNA, 20 bp, Artificial Sequence
  Description of Artificial Sequence: Synthetic oligonucleotide
  Target: SCN9A; (+) strand; PAM type: YTN; PAM sequence: CTT
ctgcacagcaaaagaaacta

SEQ ID NO: 109861 - DNA, 20 bp, Artificial Sequence
  Description of Artificial Sequence: Synthetic oligonucleotide
  Target: SCN9A; (+) strand; PAM type: YTN; PAM sequence: TTC
tgcacagcaaaagaaactaa

SEQ ID NO: 109862 - DNA, 20 bp, Artificial Sequence
  Description of Artificial Sequence: Synthetic oligonucleotide
  Target: SCN9A; (+) strand; PAM type: YTN; PAM sequence: CTG
cacagcaaaagaaactaaca

SEQ ID NO: 109863 - DNA, 20 bp, Artificial Sequence
  Description of Artificial Sequence: Synthetic oligonucleotide
  Target: SCN9A; (+) strand; PAM type: YTN; PAM sequence: CTA
acatcagagtgaacaggcaa

SEQ ID NO: 109864 - DNA, 20 bp, Artificial Sequence
  Description of Artificial Sequence: Synthetic oligonucleotide
  Target: SCN9A; (+) strand; PAM type: YTN; PAM sequence: CTA
tagaatgggagaaaaatttg

SEQ ID NO: 109865 - DNA, 20 bp, Artificial Sequence
  Description of Artificial Sequence: Synthetic oligonucleotide
  Target: SCN9A; (+) strand; PAM type: YTN; PAM sequence: TTT
ggcaatctacccatctgaca

SEQ ID NO: 109866 - DNA, 20 bp, Artificial Sequence
  Description of Artificial Sequence: Synthetic oligonucleotide
  Target: SCN9A; (+) strand; PAM type: YTN; PAM sequence: TTG
gcaatctacccatctgacaa

SEQ ID NO: 109867 - DNA, 20 bp, Artificial Sequence
  Description of Artificial Sequence: Synthetic oligonucleotide
  Target: SCN9A; (+) strand; PAM type: YTN; PAM sequence: CTA
cccatctgacaaaggtctaa

SEQ ID NO: 109868 - DNA, 20 bp, Artificial Sequence
  Description of Artificial Sequence: Synthetic oligonucleotide
  Target: SCN9A; (+) strand; PAM type: YTN; PAM sequence: CTG
acaaaggtctaatattaaga

SEQ ID NO: 109869 - DNA, 20 bp, Artificial Sequence
  Description of Artificial Sequence: Synthetic oligonucleotide
  Target: SCN9A; (+) strand; PAM type: YTN; PAM sequence: CTA
atattaagaatctacaagta

SEQ ID NO: 109870 - DNA, 20 bp, Artificial Sequence
  Description of Artificial Sequence: Synthetic oligonucleotide
  Target: SCN9A; (+) strand; PAM type: YTN; PAM sequence: TTA
agaatctacaagtaacttaa

SEQ ID NO: 109871 - DNA, 20 bp, Artificial Sequence
  Description of Artificial Sequence: Synthetic oligonucleotide
  Target: SCN9A; (+) strand; PAM type: YTN; PAM sequence: CTA
caagtaacttaaacaaattt

SEQ ID NO: 109872 - DNA, 20 bp, Artificial Sequence
  Description of Artificial Sequence: Synthetic oligonucleotide
  Target: SCN9A; (+) strand; PAM type: YTN; PAM sequence: CTT
aaacaaatttataagataat

SEQ ID NO: 109873 - DNA, 20 bp, Artificial Sequence
  Description of Artificial Sequence: Synthetic oligonucleotide
  Target: SCN9A; (+) strand; PAM type: YTN; PAM sequence: TTA
aacaaatttataagataatt

SEQ ID NO: 109874 - DNA, 20 bp, Artificial Sequence
  Description of Artificial Sequence: Synthetic oligonucleotide
  Target: SCN9A; (+) strand; PAM type: YTN; PAM sequence: TTT
ataagataattaacatttct

SEQ ID NO: 109875 - DNA, 20 bp, Artificial Sequence
  Description of Artificial Sequence: Synthetic oligonucleotide
  Target: SCN9A; (+) strand; PAM type: YTN; PAM sequence: TTA
taagataattaacatttcta

SEQ ID NO: 109876 - DNA, 20 bp, Artificial Sequence
  Description of Artificial Sequence: Synthetic oligonucleotide
  Target: SCN9A; (+) strand; PAM type: YTN; PAM sequence: TTA
acatttctattaataattgt

SEQ ID NO: 109877 - DNA, 20 bp, Artificial Sequence
  Description of Artificial Sequence: Synthetic oligonucleotide
  Target: SCN9A; (+) strand; PAM type: YTN; PAM sequence: TTT
ctattaataattgtataatg

SEQ ID NO: 109878 - DNA, 20 bp, Artificial Sequence
  Description of Artificial Sequence: Synthetic oligonucleotide
  Target: SCN9A; (+) strand; PAM type: YTN; PAM sequence: TTC
tattaataattgtataatgt

SEQ ID NO: 109879 - DNA, 20 bp, Artificial Sequence
  Description of Artificial Sequence: Synthetic oligonucleotide
  Target: SCN9A; (+) strand; PAM type: YTN; PAM sequence: CTA
ttaataattgtataatgtaa

SEQ ID NO: 109880 - DNA, 20 bp, Artificial Sequence
  Description of Artificial Sequence: Synthetic oligonucleotide
  Target: SCN9A; (+) strand; PAM type: YTN; PAM sequence: TTA
ataattgtataatgtaatat

SEQ ID NO: 109881 - DNA, 20 bp, Artificial Sequence
  Description of Artificial Sequence: Synthetic oligonucleotide
  Target: SCN9A; (+) strand; PAM type: YTN; PAM sequence: TTG
tataatgtaatatactttta

SEQ ID NO: 109882 - DNA, 20 bp, Artificial Sequence
  Description of Artificial Sequence: Synthetic oligonucleotide
  Target: SCN9A; (+) strand; PAM type: YTN; PAM sequence: CTT
ttatcatacaaagcatttta

SEQ ID NO: 109883 - DNA, 20 bp, Artificial Sequence
  Description of Artificial Sequence: Synthetic oligonucleotide
  Target: SCN9A; (+) strand; PAM type: YTN; PAM sequence: TTT
tatcatacaaagcattttaa

SEQ ID NO: 109884 - DNA, 20 bp, Artificial Sequence
  Description of Artificial Sequence: Synthetic oligonucleotide
  Target: SCN9A; (+) strand; PAM type: YTN; PAM sequence: TTT
atcatacaaagcattttaaa

SEQ ID NO: 109885 - DNA, 20 bp, Artificial Sequence
  Description of Artificial Sequence: Synthetic oligonucleotide
  Target: SCN9A; (+) strand; PAM type: YTN; PAM sequence: TTA
tcatacaaagcattttaaag

SEQ ID NO: 109886 - DNA, 20 bp, Artificial Sequence
  Description of Artificial Sequence: Synthetic oligonucleotide
  Target: SCN9A; (+) strand; PAM type: YTN; PAM sequence: TTT
taaagtgaatttaggatagt

SEQ ID NO: 109887 - DNA, 20 bp, Artificial Sequence
  Description of Artificial Sequence: Synthetic oligonucleotide
  Target: SCN9A; (+) strand; PAM type: YTN; PAM sequence: TTT
aaagtgaatttaggatagta

SEQ ID NO: 109888 - DNA, 20 bp, Artificial Sequence
  Description of Artificial Sequence: Synthetic oligonucleotide
  Target: SCN9A; (+) strand; PAM type: YTN; PAM sequence: TTA
aagtgaatttaggatagtat

SEQ ID NO: 109889 - DNA, 20 bp, Artificial Sequence
  Description of Artificial Sequence: Synthetic oligonucleotide
  Target: SCN9A; (+) strand; PAM type: YTN; PAM sequence: TTT
aggatagtatcaactgatat

SEQ ID NO: 109890 - DNA, 20 bp, Artificial Sequence
  Description of Artificial Sequence: Synthetic oligonucleotide
  Target: SCN9A; (+) strand; PAM type: YTN; PAM sequence: TTA
ggatagtatcaactgatatt

SEQ ID NO: 109891 - DNA, 20 bp, Artificial Sequence
  Description of Artificial Sequence: Synthetic oligonucleotide
  Target: SCN9A; (+) strand; PAM type: YTN; PAM sequence: CTG
atattaaatgaaaaataagt

SEQ ID NO: 109892 - DNA, 20 bp, Artificial Sequence
  Description of Artificial Sequence: Synthetic oligonucleotide
  Target: SCN9A; (+) strand; PAM type: YTN; PAM sequence: TTA
aatgaaaaataagtcttacc

SEQ ID NO: 109893 - DNA, 20 bp, Artificial Sequence
  Description of Artificial Sequence: Synthetic oligonucleotide
  Target: SCN9A; (+) strand; PAM type: YTN; PAM sequence: CTT
acctctgatgaaaaattatt

SEQ ID NO: 109894 - DNA, 20 bp, Artificial Sequence
  Description of Artificial Sequence: Synthetic oligonucleotide
  Target: SCN9A; (+) strand; PAM type: YTN; PAM sequence: TTA
cctctgatgaaaaattattt

SEQ ID NO: 109895 - DNA, 20 bp, Artificial Sequence
  Description of Artificial Sequence: Synthetic oligonucleotide
  Target: SCN9A; (+) strand; PAM type: YTN; PAM sequence: CTC
tgatgaaaaattattttaat

SEQ ID NO: 109896 - DNA, 20 bp, Artificial Sequence
  Description of Artificial Sequence: Synthetic oligonucleotide
  Target: SCN9A; (+) strand; PAM type: YTN; PAM sequence: CTG
atgaaaaattattttaattt

SEQ ID NO: 109897 - DNA, 20 bp, Artificial Sequence
  Description of Artificial Sequence: Synthetic oligonucleotide
  Target: SCN9A; (+) strand; PAM type: YTN; PAM sequence: TTA
ttttaatttttttatttgtg

SEQ ID NO: 109898 - DNA, 20 bp, Artificial Sequence
  Description of Artificial Sequence: Synthetic oligonucleotide
  Target: SCN9A; (+) strand; PAM type: YTN; PAM sequence: TTT
taatttttttatttgtgttt

SEQ ID NO: 109899 - DNA, 20 bp, Artificial Sequence
  Description of Artificial Sequence: Synthetic oligonucleotide
  Target: SCN9A; (+) strand; PAM type: YTN; PAM sequence: TTT
aatttttttatttgtgtttc

SEQ ID NO: 109900 - DNA, 20 bp, Artificial Sequence
  Description of Artificial Sequence: Synthetic oligonucleotide
  Target: SCN9A; (+) strand; PAM type: YTN; PAM sequence: TTA
atttttttatttgtgtttct

SEQ ID NO: 109901 - DNA, 20 bp, Artificial Sequence
  Description of Artificial Sequence: Synthetic oligonucleotide
  Target: SCN9A; (+) strand; PAM type: YTN; PAM sequence: TTT
ttttatttgtgtttctttaa

SEQ ID NO: 109902 - DNA, 20 bp, Artificial Sequence
  Description of Artificial Sequence: Synthetic oligonucleotide
  Target: SCN9A; (+) strand; PAM type: YTN; PAM sequence: TTT
tttatttgtgtttctttaat

SEQ ID NO: 109903 - DNA, 20 bp, Artificial Sequence
  Description of Artificial Sequence: Synthetic oligonucleotide
  Target: SCN9A; (+) strand; PAM type: YTN; PAM sequence: TTT
ttatttgtgtttctttaatt

SEQ ID NO: 109904 - DNA, 20 bp, Artificial Sequence
  Description of Artificial Sequence: Synthetic oligonucleotide
  Target: SCN9A; (+) strand; PAM type: YTN; PAM sequence: TTT
tatttgtgtttctttaattt

SEQ ID NO: 109905 - DNA, 20 bp, Artificial Sequence
  Description of Artificial Sequence: Synthetic oligonucleotide
  Target: SCN9A; (+) strand; PAM type: YTN; PAM sequence: TTT
atttgtgtttctttaatttt

SEQ ID NO: 109906 - DNA, 20 bp, Artificial Sequence
  Description of Artificial Sequence: Synthetic oligonucleotide
  Target: SCN9A; (+) strand; PAM type: YTN; PAM sequence: TTA
tttgtgtttctttaattttg

SEQ ID NO: 109907 - DNA, 20 bp, Artificial Sequence
  Description of Artificial Sequence: Synthetic oligonucleotide
  Target: SCN9A; (+) strand; PAM type: YTN; PAM sequence: TTT
gtgtttctttaattttgagt

SEQ ID NO: 109908 - DNA, 20 bp, Artificial Sequence
  Description of Artificial Sequence: Synthetic oligonucleotide
  Target: SCN9A; (+) strand; PAM type: YTN; PAM sequence: TTG
tgtttctttaattttgagta

SEQ ID NO: 109909 - DNA, 20 bp, Artificial Sequence
  Description of Artificial Sequence: Synthetic oligonucleotide
  Target: SCN9A; (+) strand; PAM type: YTN; PAM sequence: TTT
ctttaattttgagtaaaggt

SEQ ID NO: 109910 - DNA, 20 bp, Artificial Sequence
  Description of Artificial Sequence: Synthetic oligonucleotide
  Target: SCN9A; (+) strand; PAM type: YTN; PAM sequence: TTC
tttaattttgagtaaaggtg

SEQ ID NO: 109911 - DNA, 20 bp, Artificial Sequence
  Description of Artificial Sequence: Synthetic oligonucleotide
  Target: SCN9A; (+) strand; PAM type: YTN; PAM sequence: CTT
taattttgagtaaaggtgac

SEQ ID NO: 109912 - DNA, 20 bp, Artificial Sequence
  Description of Artificial Sequence: Synthetic oligonucleotide
  Target: SCN9A; (+) strand; PAM type: YTN; PAM sequence: TTT
aattttgagtaaaggtgacc

SEQ ID NO: 109913 - DNA, 20 bp, Artificial Sequence
  Description of Artificial Sequence: Synthetic oligonucleotide
  Target: SCN9A; (+) strand; PAM type: YTN; PAM sequence: TTA
attttgagtaaaggtgacca

SEQ ID NO: 109914 - DNA, 20 bp, Artificial Sequence
  Description of Artificial Sequence: Synthetic oligonucleotide
  Target: SCN9A; (+) strand; PAM type: YTN; PAM sequence: TTT
tgagtaaaggtgaccacttc

SEQ ID NO: 109915 - DNA, 20 bp, Artificial Sequence
  Description of Artificial Sequence: Synthetic oligonucleotide
  Target: SCN9A; (+) strand; PAM type: YTN; PAM sequence: TTT
gagtaaaggtgaccacttct

SEQ ID NO: 109916 - DNA, 20 bp, Artificial Sequence
  Description of Artificial Sequence: Synthetic oligonucleotide
  Target: SCN9A; (+) strand; PAM type: YTN; PAM sequence: TTG
agtaaaggtgaccacttctt

SEQ ID NO: 109917 - DNA, 20 bp, Artificial Sequence
  Description of Artificial Sequence: Synthetic oligonucleotide
  Target: SCN9A; (+) strand; PAM type: YTN; PAM sequence: CTT
cttgcatatttaaaaaatat

SEQ ID NO: 109918 - DNA, 20 bp, Artificial Sequence
  Description of Artificial Sequence: Synthetic oligonucleotide
  Target: SCN9A; (+) strand; PAM type: YTN; PAM sequence: TTC
ttgcatatttaaaaaatatt

SEQ ID NO: 109919 - DNA, 20 bp, Artificial Sequence
  Description of Artificial Sequence: Synthetic oligonucleotide
  Target: SCN9A; (+) strand; PAM type: YTN; PAM sequence: CTT
gcatatttaaaaaatatttg

SEQ ID NO: 109920 - DNA, 20 bp, Artificial Sequence
  Description of Artificial Sequence: Synthetic oligonucleotide
  Target: SCN9A; (+) strand; PAM type: YTN; PAM sequence: TTG
catatttaaaaaatatttgc

SEQ ID NO: 109921 - DNA, 20 bp, Artificial Sequence
  Description of Artificial Sequence: Synthetic oligonucleotide
  Target: SCN9A; (+) strand; PAM type: YTN; PAM sequence: TTT
aaaaaatatttgcattccca

SEQ ID NO: 109922 - DNA, 20 bp, Artificial Sequence
  Description of Artificial Sequence: Synthetic oligonucleotide
  Target: SCN9A; (+) strand; PAM type: YTN; PAM sequence: TTA
aaaaatatttgcattcccat

SEQ ID NO: 109923 - DNA, 20 bp, Artificial Sequence
  Description of Artificial Sequence: Synthetic oligonucleotide
  Target: SCN9A; (+) strand; PAM type: YTN; PAM sequence: TTT
gcattcccatttttgctgta

SEQ ID NO: 109924 - DNA, 20 bp, Artificial Sequence
  Description of Artificial Sequence: Synthetic oligonucleotide
  Target: SCN9A; (+) strand; PAM type: YTN; PAM sequence: TTG
cattcccatttttgctgtaa

SEQ ID NO: 109925 - DNA, 20 bp, Artificial Sequence
  Description of Artificial Sequence: Synthetic oligonucleotide
  Target: SCN9A; (+) strand; PAM type: YTN; PAM sequence: TTC
ccatttttgctgtaaagtgc

SEQ ID NO: 109926 - DNA, 20 bp, Artificial Sequence
  Description of Artificial Sequence: Synthetic oligonucleotide
  Target: SCN9A; (+) strand; PAM type: YTN; PAM sequence: TTT
ttgctgtaaagtgcatctta

SEQ ID NO: 109927 - DNA, 20 bp, Artificial Sequence
  Description of Artificial Sequence: Synthetic oligonucleotide
  Target: SCN9A; (+) strand; PAM type: YTN; PAM sequence: TTT
tgctgtaaagtgcatcttac

SEQ ID NO: 109928 - DNA, 20 bp, Artificial Sequence
  Description of Artificial Sequence: Synthetic oligonucleotide
  Target: SCN9A; (+) strand; PAM type: YTN; PAM sequence: TTT
gctgtaaagtgcatcttaca

SEQ ID NO: 109929 - DNA, 20 bp, Artificial Sequence
  Description of Artificial Sequence: Synthetic oligonucleotide
  Target: SCN9A; (+) strand; PAM type: YTN; PAM sequence: TTG
ctgtaaagtgcatcttacat

SEQ ID NO: 109930 - DNA, 20 bp, Artificial Sequence
  Description of Artificial Sequence: Synthetic oligonucleotide
  Target: SCN9A; (+) strand; PAM type: YTN; PAM sequence: CTG
taaagtgcatcttacataat

SEQ ID NO: 109931 - DNA, 20 bp, Artificial Sequence
  Description of Artificial Sequence: Synthetic oligonucleotide
  Target: SCN9A; (+) strand; PAM type: YTN; PAM sequence: CTT
acataatttccgaattcatt

SEQ ID NO: 109932 - DNA, 20 bp, Artificial Sequence
  Description of Artificial Sequence: Synthetic oligonucleotide
  Target: SCN9A; (+) strand; PAM type: YTN; PAM sequence: TTA
cataatttccgaattcattt

SEQ ID NO: 109933 - DNA, 20 bp, Artificial Sequence
  Description of Artificial Sequence: Synthetic oligonucleotide
  Target: SCN9A; (+) strand; PAM type: YTN; PAM sequence: TTT
ccgaattcatttataatatt

SEQ ID NO: 109934 - DNA, 20 bp, Artificial Sequence
  Description of Artificial Sequence: Synthetic oligonucleotide
  Target: SCN9A; (+) strand; PAM type: YTN; PAM sequence: TTC
cgaattcatttataatattc

SEQ ID NO: 109935 - DNA, 20 bp, Artificial Sequence
  Description of Artificial Sequence: Synthetic oligonucleotide
  Target: SCN9A; (+) strand; PAM type: YTN; PAM sequence: TTC
atttataatattctcggaaa

SEQ ID NO: 109936 - DNA, 20 bp, Artificial Sequence
  Description of Artificial Sequence: Synthetic oligonucleotide
  Target: SCN9A; (+) strand; PAM type: YTN; PAM sequence: TTT
ataatattctcggaaataaa

SEQ ID NO: 109937 - DNA, 20 bp, Artificial Sequence
  Description of Artificial Sequence: Synthetic oligonucleotide
  Target: SCN9A; (+) strand; PAM type: YTN; PAM sequence: TTA
taatattctcggaaataaag

SEQ ID NO: 109938 - DNA, 20 bp, Artificial Sequence
  Description of Artificial Sequence: Synthetic oligonucleotide
  Target: SCN9A; (+) strand; PAM type: YTN; PAM sequence: TTC
tcggaaataaagtaaatata

SEQ ID NO: 109939 - DNA, 20 bp, Artificial Sequence
  Description of Artificial Sequence: Synthetic oligonucleotide
  Target: SCN9A; (+) strand; PAM type: YTN; PAM sequence: CTC
ggaaataaagtaaatataaa

SEQ ID NO: 109940 - DNA, 20 bp, Artificial Sequence
  Description of Artificial Sequence: Synthetic oligonucleotide
  Target: SCN9A; (+) strand; PAM type: YTN; PAM sequence: CTG
cagctattctgagaaaagtg

SEQ ID NO: 109941 - DNA, 20 bp, Artificial Sequence
  Description of Artificial Sequence: Synthetic oligonucleotide
  Target: SCN9A; (+) strand; PAM type: YTN; PAM sequence: CTA
ttctgagaaaagtgaatcat

SEQ ID NO: 109942 - DNA, 20 bp, Artificial Sequence
  Description of Artificial Sequence: Synthetic oligonucleotide
  Target: SCN9A; (+) strand; PAM type: YTN; PAM sequence: TTC
tgagaaaagtgaatcattgt

SEQ ID NO: 109943 - DNA, 20 bp, Artificial Sequence
  Description of Artificial Sequence: Synthetic oligonucleotide
  Target: SCN9A; (+) strand; PAM type: YTN; PAM sequence: CTG
agaaaagtgaatcattgtta

SEQ ID NO: 109944 - DNA, 20 bp, Artificial Sequence
  Description of Artificial Sequence: Synthetic oligonucleotide
  Target: SCN9A; (+) strand; PAM type: YTN; PAM sequence: TTG
ttatgtgtactatagaataa

SEQ ID NO: 109945 - DNA, 20 bp, Artificial Sequence
  Description of Artificial Sequence: Synthetic oligonucleotide
  Target: SCN9A; (+) strand; PAM type: YTN; PAM sequence: TTA
tgtgtactatagaataatca

SEQ ID NO: 109946 - DNA, 20 bp, Artificial Sequence
  Description of Artificial Sequence: Synthetic oligonucleotide
  Target: SCN9A; (+) strand; PAM type: YTN; PAM sequence: CTA
tagaataatcattttggtct

SEQ ID NO: 109947 - DNA, 20 bp, Artificial Sequence
  Description of Artificial Sequence: Synthetic oligonucleotide
  Target: SCN9A; (+) strand; PAM type: YTN; PAM sequence: TTT
tggtctccttccttttggct

SEQ ID NO: 109948 - DNA, 20 bp, Artificial Sequence
  Description of Artificial Sequence: Synthetic oligonucleotide
  Target: SCN9A; (+) strand; PAM type: YTN; PAM sequence: TTT
ggtctccttccttttggctt

SEQ ID NO: 109949 - DNA, 20 bp, Artificial Sequence
  Description of Artificial Sequence: Synthetic oligonucleotide
  Target: SCN9A; (+) strand; PAM type: YTN; PAM sequence: TTG
gtctccttccttttggcttg

SEQ ID NO: 109950 - DNA, 20 bp, Artificial Sequence
  Description of Artificial Sequence: Synthetic oligonucleotide
  Target: SCN9A; (+) strand; PAM type: YTN; PAM sequence: CTC
cttccttttggcttggctgc

SEQ ID NO: 109951 - DNA, 20 bp, Artificial Sequence
  Description of Artificial Sequence: Synthetic oligonucleotide
  Target: SCN9A; (+) strand; PAM type: YTN; PAM sequence: CTT
ccttttggcttggctgctga

SEQ ID NO: 109952 - DNA, 20 bp, Artificial Sequence
  Description of Artificial Sequence: Synthetic oligonucleotide
  Target: SCN9A; (+) strand; PAM type: YTN; PAM sequence: TTC
cttttggcttggctgctgag

SEQ ID NO: 109953 - DNA, 20 bp, Artificial Sequence
  Description of Artificial Sequence: Synthetic oligonucleotide
  Target: SCN9A; (+) strand; PAM type: YTN; PAM sequence: CTT
ttggcttggctgctgagact

SEQ ID NO: 109954 - DNA, 20 bp, Artificial Sequence
  Description of Artificial Sequence: Synthetic oligonucleotide
  Target: SCN9A; (+) strand; PAM type: YTN; PAM sequence: TTT
tggcttggctgctgagacta

SEQ ID NO: 109955 - DNA, 20 bp, Artificial Sequence
  Description of Artificial Sequence: Synthetic oligonucleotide
  Target: SCN9A; (+) strand; PAM type: YTN; PAM sequence: TTT
ggcttggctgctgagactat

SEQ ID NO: 109956 - DNA, 20 bp, Artificial Sequence
  Description of Artificial Sequence: Synthetic oligonucleotide
  Target: SCN9A; (+) strand; PAM type: YTN; PAM sequence: TTG
gcttggctgctgagactata

SEQ ID NO: 109957 - DNA, 20 bp, Artificial Sequence
  Description of Artificial Sequence: Synthetic oligonucleotide
  Target: SCN9A; (+) strand; PAM type: YTN; PAM sequence: CTT
ggctgctgagactatacaag

SEQ ID NO: 109958 - DNA, 20 bp, Artificial Sequence
  Description of Artificial Sequence: Synthetic oligonucleotide
  Target: SCN9A; (+) strand; PAM type: YTN; PAM sequence: TTG
gctgctgagactatacaagt

SEQ ID NO: 109959 - DNA, 20 bp, Artificial Sequence
  Description of Artificial Sequence: Synthetic oligonucleotide
  Target: SCN9A; (+) strand; PAM type: YTN; PAM sequence: CTG
ctgagactatacaagtaaat

SEQ ID NO: 109960 - DNA, 20 bp, Artificial Sequence
  Description of Artificial Sequence: Synthetic oligonucleotide
  Target: SCN9A; (+) strand; PAM type: YTN; PAM sequence: CTG
agactatacaagtaaatgga

SEQ ID NO: 109961 - DNA, 20 bp, Artificial Sequence
  Description of Artificial Sequence: Synthetic oligonucleotide
  Target: SCN9A; (+) strand; PAM type: YTN; PAM sequence: CTA
tacaagtaaatggagaccac

SEQ ID NO: 109962 - DNA, 20 bp, Artificial Sequence
  Description of Artificial Sequence: Synthetic oligonucleotide
  Target: SCN9A; (+) strand; PAM type: YTN; PAM sequence: TTC
acattcaagttagaggaaat

SEQ ID NO: 109963 - DNA, 20 bp, Artificial Sequence
  Description of Artificial Sequence: Synthetic oligonucleotide
  Target: SCN9A; (+) strand; PAM type: YTN; PAM sequence: TTC
aagttagaggaaatagccac

SEQ ID NO: 109964 - DNA, 20 bp, Artificial Sequence
  Description of Artificial Sequence: Synthetic oligonucleotide
  Target: SCN9A; (+) strand; PAM type: YTN; PAM sequence: TTA
gaggaaatagccacatgaat

SEQ ID NO: 109965 - DNA, 20 bp, Artificial Sequence
  Description of Artificial Sequence: Synthetic oligonucleotide
  Target: SCN9A; (+) strand; PAM type: YTN; PAM sequence: TTA
ccacttgcaatacaagagat

SEQ ID NO: 109966 - DNA, 20 bp, Artificial Sequence
  Description of Artificial Sequence: Synthetic oligonucleotide
  Target: SCN9A; (+) strand; PAM type: YTN; PAM sequence: CTT
gcaatacaagagatcaatga

SEQ ID NO: 109967 - DNA, 20 bp, Artificial Sequence
  Description of Artificial Sequence: Synthetic oligonucleotide
  Target: SCN9A; (+) strand; PAM type: YTN; PAM sequence: TTG
caatacaagagatcaatgat

SEQ ID NO: 109968 - DNA, 20 bp, Artificial Sequence
  Description of Artificial Sequence: Synthetic oligonucleotide
  Target: SCN9A; (+) strand; PAM type: YTN; PAM sequence: CTA
cagttgggagcaattgattt

SEQ ID NO: 109969 - DNA, 20 bp, Artificial Sequence
  Description of Artificial Sequence: Synthetic oligonucleotide
  Target: SCN9A; (+) strand; PAM type: YTN; PAM sequence: TTG
ggagcaattgatttgggaga

SEQ ID NO: 109970 - DNA, 20 bp, Artificial Sequence
  Description of Artificial Sequence: Synthetic oligonucleotide
  Target: SCN9A; (+) strand; PAM type: YTN; PAM sequence: TTG
atttgggagagaaaaactta

SEQ ID NO: 109971 - DNA, 20 bp, Artificial Sequence
  Description of Artificial Sequence: Synthetic oligonucleotide
  Target: SCN9A; (+) strand; PAM type: YTN; PAM sequence: TTT
gggagagaaaaacttagaga

SEQ ID NO: 109972 - DNA, 20 bp, Artificial Sequence
  Description of Artificial Sequence: Synthetic oligonucleotide
  Target: SCN9A; (+) strand; PAM type: YTN; PAM sequence: TTG
ggagagaaaaacttagagaa

SEQ ID NO: 109973 - DNA, 20 bp, Artificial Sequence
  Description of Artificial Sequence: Synthetic oligonucleotide
  Target: SCN9A; (+) strand; PAM type: YTN; PAM sequence: CTT
agagaaatgaattgcatctt

SEQ ID NO: 109974 - DNA, 20 bp, Artificial Sequence
  Description of Artificial Sequence: Synthetic oligonucleotide
  Target: SCN9A; (+) strand; PAM type: YTN; PAM sequence: TTA
gagaaatgaattgcatcttt

SEQ ID NO: 109975 - DNA, 20 bp, Artificial Sequence
  Description of Artificial Sequence: Synthetic oligonucleotide
  Target: SCN9A; (+) strand; PAM type: YTN; PAM sequence: TTG
catctttaactttaaatagg

SEQ ID NO: 109976 - DNA, 20 bp, Artificial Sequence
  Description of Artificial Sequence: Synthetic oligonucleotide
  Target: SCN9A; (+) strand; PAM type: YTN; PAM sequence: CTT
taactttaaataggagttca

SEQ ID NO: 109977 - DNA, 20 bp, Artificial Sequence
  Description of Artificial Sequence: Synthetic oligonucleotide
  Target: SCN9A; (+) strand; PAM type: YTN; PAM sequence: TTT
aactttaaataggagttcaa

SEQ ID NO: 109978 - DNA, 20 bp, Artificial Sequence
  Description of Artificial Sequence: Synthetic oligonucleotide
  Target: SCN9A; (+) strand; PAM type: YTN; PAM sequence: TTA
actttaaataggagttcaaa

SEQ ID NO: 109979 - DNA, 20 bp, Artificial Sequence
  Description of Artificial Sequence: Synthetic oligonucleotide
  Target: SCN9A; (+) strand; PAM type: YTN; PAM sequence: CTT
taaataggagttcaaaaata

SEQ ID NO: 109980 - DNA, 20 bp, Artificial Sequence
  Description of Artificial Sequence: Synthetic oligonucleotide
  Target: SCN9A; (+) strand; PAM type: YTN; PAM sequence: TTT
aaataggagttcaaaaataa

SEQ ID NO: 109981 - DNA, 20 bp, Artificial Sequence
  Description of Artificial Sequence: Synthetic oligonucleotide
  Target: SCN9A; (+) strand; PAM type: YTN; PAM sequence: TTA
aataggagttcaaaaataaa

SEQ ID NO: 109982 - DNA, 20 bp, Artificial Sequence
  Description of Artificial Sequence: Synthetic oligonucleotide
  Target: SCN9A; (+) strand; PAM type: YTN; PAM sequence: TTC
aaaaataaaacatggtgagc

SEQ ID NO: 109983 - DNA, 20 bp, Artificial Sequence
  Description of Artificial Sequence: Synthetic oligonucleotide
  Target: SCN9A; (+) strand; PAM type: YTN; PAM sequence: CTC
ttctcttcaggccatcccaa

SEQ ID NO: 109984 - DNA, 20 bp, Artificial Sequence
  Description of Artificial Sequence: Synthetic oligonucleotide
  Target: SCN9A; (+) strand; PAM type: YTN; PAM sequence: CTT
ctcttcaggccatcccaagc

SEQ ID NO: 109985 - DNA, 20 bp, Artificial Sequence
  Description of Artificial Sequence: Synthetic oligonucleotide
  Target: SCN9A; (+) strand; PAM type: YTN; PAM sequence: TTC
tcttcaggccatcccaagca

SEQ ID NO: 109986 - DNA, 20 bp, Artificial Sequence
  Description of Artificial Sequence: Synthetic oligonucleotide
  Target: SCN9A; (+) strand; PAM type: YTN; PAM sequence: CTC
ttcaggccatcccaagcacg

SEQ ID NO: 109987 - DNA, 20 bp, Artificial Sequence
  Description of Artificial Sequence: Synthetic oligonucleotide
  Target: SCN9A; (+) strand; PAM type: YTN; PAM sequence: CTT
caggccatcccaagcacgca

SEQ ID NO: 109988 - DNA, 20 bp, Artificial Sequence
  Description of Artificial Sequence: Synthetic oligonucleotide
  Target: SCN9A; (+) strand; PAM type: YTN; PAM sequence: TTC
aggccatcccaagcacgcat

SEQ ID NO: 109989 - DNA, 20 bp, Artificial Sequence
  Description of Artificial Sequence: Synthetic oligonucleotide
  Target: SCN9A; (+) strand; PAM type: YTN; PAM sequence: CTT
gagaaaacattacagtatgt

SEQ ID NO: 109990 - DNA, 20 bp, Artificial Sequence
  Description of Artificial Sequence: Synthetic oligonucleotide
  Target: SCN9A; (+) strand; PAM type: YTN; PAM sequence: TTG
agaaaacattacagtatgtc

SEQ ID NO: 109991 - DNA, 20 bp, Artificial Sequence
  Description of Artificial Sequence: Synthetic oligonucleotide
  Target: SCN9A; (+) strand; PAM type: YTN; PAM sequence: TTA
cagtatgtcctggtacttaa

SEQ ID NO: 109992 - DNA, 20 bp, Artificial Sequence
  Description of Artificial Sequence: Synthetic oligonucleotide
  Target: SCN9A; (+) strand; PAM type: YTN; PAM sequence: CTG
gtacttaactaggaccccat

SEQ ID NO: 109993 - DNA, 20 bp, Artificial Sequence
  Description of Artificial Sequence: Synthetic oligonucleotide
  Target: SCN9A; (+) strand; PAM type: YTN; PAM sequence: CTT
aactaggaccccatgggatg

SEQ ID NO: 109994 - DNA, 20 bp, Artificial Sequence
  Description of Artificial Sequence: Synthetic oligonucleotide
  Target: SCN9A; (+) strand; PAM type: YTN; PAM sequence: TTA
actaggaccccatgggatga

SEQ ID NO: 109995 - DNA, 20 bp, Artificial Sequence
  Description of Artificial Sequence: Synthetic oligonucleotide
  Target: SCN9A; (+) strand; PAM type: YTN; PAM sequence: CTA
ggaccccatgggatgatata

SEQ ID NO: 109996 - DNA, 20 bp, Artificial Sequence
  Description of Artificial Sequence: Synthetic oligonucleotide
  Target: SCN9A; (+) strand; PAM type: YTN; PAM sequence: CTC
aggaaggcgagagatctaga

SEQ ID NO: 109997 - DNA, 20 bp, Artificial Sequence
  Description of Artificial Sequence: Synthetic oligonucleotide
  Target: SCN9A; (+) strand; PAM type: YTN; PAM sequence: CTA
gagattaaatatgcccagaa

SEQ ID NO: 109998 - DNA, 20 bp, Artificial Sequence
  Description of Artificial Sequence: Synthetic oligonucleotide
  Target: SCN9A; (+) strand; PAM type: YTN; PAM sequence: TTA
aatatgcccagaaaagataa

SEQ ID NO: 109999 - DNA, 20 bp, Artificial Sequence
  Description of Artificial Sequence: Synthetic oligonucleotide
  Target: SCN9A; (+) strand; PAM type: YTN; PAM sequence: TTA
tttatgattcgagaactacc

SEQ ID NO: 110000 - DNA, 20 bp, Artificial Sequence
  Description of Artificial Sequence: Synthetic oligonucleotide
  Target: SCN9A; (+) strand; PAM type: YTN; PAM sequence: TTT
atgattcgagaactacccat

SEQ ID NO: 110001 - DNA, 20 bp, Artificial Sequence
  Description of Artificial Sequence: Synthetic oligonucleotide
  Target: SCN9A; (+) strand; PAM type: YTN; PAM sequence: TTA
tgattcgagaactacccata

SEQ ID NO: 110002 - DNA, 20 bp, Artificial Sequence
  Description of Artificial Sequence: Synthetic oligonucleotide
  Target: SCN9A; (+) strand; PAM type: YTN; PAM sequence: TTC
gagaactacccatattatta

SEQ ID NO: 110003 - DNA, 20 bp, Artificial Sequence
  Description of Artificial Sequence: Synthetic oligonucleotide
  Target: SCN9A; (+) strand; PAM type: YTN; PAM sequence: CTA
cccatattattagtgatggg

SEQ ID NO: 110004 - DNA, 20 bp, Artificial Sequence
  Description of Artificial Sequence: Synthetic oligonucleotide
  Target: SCN9A; (+) strand; PAM type: YTN; PAM sequence: TTA
ttagtgatgggagtaaaaca

SEQ ID NO: 110005 - DNA, 20 bp, Artificial Sequence
  Description of Artificial Sequence: Synthetic oligonucleotide
  Target: SCN9A; (+) strand; PAM type: YTN; PAM sequence: TTA
gtgatgggagtaaaacactt

SEQ ID NO: 110006 - DNA, 20 bp, Artificial Sequence
  Description of Artificial Sequence: Synthetic oligonucleotide
  Target: SCN9A; (+) strand; PAM type: YTN; PAM sequence: CTT
ataattttggtaataagata

SEQ ID NO: 110007 - DNA, 20 bp, Artificial Sequence
  Description of Artificial Sequence: Synthetic oligonucleotide
  Target: SCN9A; (+) strand; PAM type: YTN; PAM sequence: TTA
taattttggtaataagataa

SEQ ID NO: 110008 - DNA, 20 bp, Artificial Sequence
  Description of Artificial Sequence: Synthetic oligonucleotide
  Target: SCN9A; (+) strand; PAM type: YTN; PAM sequence: TTT
tggtaataagataatagagt

SEQ ID NO: 110009 - DNA, 20 bp, Artificial Sequence
  Description of Artificial Sequence: Synthetic oligonucleotide
  Target: SCN9A; (+) strand; PAM type: YTN; PAM sequence: TTT
ggtaataagataatagagtt

SEQ ID NO: 110010 - DNA, 20 bp, Artificial Sequence
  Description of Artificial Sequence: Synthetic oligonucleotide
  Target: SCN9A; (+) strand; PAM type: YTN; PAM sequence: TTG
gtaataagataatagagttt

SEQ ID NO: 110011 - DNA, 20 bp, Artificial Sequence
  Description of Artificial Sequence: Synthetic oligonucleotide
  Target: SCN9A; (+) strand; PAM type: YTN; PAM sequence: TTT
cctccattctcaaataaata

SEQ ID NO: 110012 - DNA, 20 bp, Artificial Sequence
  Description of Artificial Sequence: Synthetic oligonucleotide
  Target: SCN9A; (+) strand; PAM type: YTN; PAM sequence: TTC
ctccattctcaaataaataa

SEQ ID NO: 110013 - DNA, 20 bp, Artificial Sequence
  Description of Artificial Sequence: Synthetic oligonucleotide
  Target: SCN9A; (+) strand; PAM type: YTN; PAM sequence: CTC
cattctcaaataaataaaaa

SEQ ID NO: 110014 - DNA, 20 bp, Artificial Sequence
  Description of Artificial Sequence: Synthetic oligonucleotide
  Target: SCN9A; (+) strand; PAM type: YTN; PAM sequence: TTC
tcaaataaataaaaaacctc

SEQ ID NO: 110015 - DNA, 20 bp, Artificial Sequence
  Description of Artificial Sequence: Synthetic oligonucleotide
  Target: SCN9A; (+) strand; PAM type: YTN; PAM sequence: CTC
aaataaataaaaaacctcct

SEQ ID NO: 110016 - DNA, 20 bp, Artificial Sequence
  Description of Artificial Sequence: Synthetic oligonucleotide
  Target: SCN9A; (+) strand; PAM type: YTN; PAM sequence: CTC
ctaatacaggctcttaacat

SEQ ID NO: 110017 - DNA, 20 bp, Artificial Sequence
  Description of Artificial Sequence: Synthetic oligonucleotide
  Target: SCN9A; (+) strand; PAM type: YTN; PAM sequence: CTA
atacaggctcttaacataca

SEQ ID NO: 110018 - DNA, 20 bp, Artificial Sequence
  Description of Artificial Sequence: Synthetic oligonucleotide
  Target: SCN9A; (+) strand; PAM type: YTN; PAM sequence: CTC
ttaacatacaccaggtacat

SEQ ID NO: 110019 - DNA, 20 bp, Artificial Sequence
  Description of Artificial Sequence: Synthetic oligonucleotide
  Target: SCN9A; (+) strand; PAM type: YTN; PAM sequence: CTT
aacatacaccaggtacatat

SEQ ID NO: 110020 - DNA, 20 bp, Artificial Sequence
  Description of Artificial Sequence: Synthetic oligonucleotide
  Target: SCN9A; (+) strand; PAM type: YTN; PAM sequence: TTA
acatacaccaggtacatatg

SEQ ID NO: 110021 - DNA, 20 bp, Artificial Sequence
  Description of Artificial Sequence: Synthetic oligonucleotide
  Target: SCN9A; (+) strand; PAM type: YTN; PAM sequence: TTC
aaaaatacaatgcatgtttc

SEQ ID NO: 110022 - DNA, 20 bp, Artificial Sequence
  Description of Artificial Sequence: Synthetic oligonucleotide
  Target: SCN9A; (+) strand; PAM type: YTN; PAM sequence: TTT
ctcttggtactcacctgttg

SEQ ID NO: 110023 - DNA, 20 bp, Artificial Sequence
  Description of Artificial Sequence: Synthetic oligonucleotide
  Target: SCN9A; (+) strand; PAM type: YTN; PAM sequence: TTC
tcttggtactcacctgttgg

SEQ ID NO: 110024 - DNA, 20 bp, Artificial Sequence
  Description of Artificial Sequence: Synthetic oligonucleotide
  Target: SCN9A; (+) strand; PAM type: YTN; PAM sequence: CTC
ttggtactcacctgttggta

SEQ ID NO: 110025 - DNA, 20 bp, Artificial Sequence
  Description of Artificial Sequence: Synthetic oligonucleotide
  Target: SCN9A; (+) strand; PAM type: YTN; PAM sequence: CTT
ggtactcacctgttggtaaa

SEQ ID NO: 110026 - DNA, 20 bp, Artificial Sequence
  Description of Artificial Sequence: Synthetic oligonucleotide
  Target: SCN9A; (+) strand; PAM type: YTN; PAM sequence: TTG
gtactcacctgttggtaaag

SEQ ID NO: 110027 - DNA, 20 bp, Artificial Sequence
  Description of Artificial Sequence: Synthetic oligonucleotide
  Target: SCN9A; (+) strand; PAM type: YTN; PAM sequence: CTC
acctgttggtaaaggttttc

SEQ ID NO: 110028 - DNA, 20 bp, Artificial Sequence
  Description of Artificial Sequence: Synthetic oligonucleotide
  Target: SCN9A; (+) strand; PAM type: YTN; PAM sequence: CTG
ttggtaaaggttttcccagt

SEQ ID NO: 110029 - DNA, 20 bp, Artificial Sequence
  Description of Artificial Sequence: Synthetic oligonucleotide
  Target: SCN9A; (+) strand; PAM type: YTN; PAM sequence: TTG
gtaaaggttttcccagtaat

SEQ ID NO: 110030 - DNA, 20 bp, Artificial Sequence
  Description of Artificial Sequence: Synthetic oligonucleotide
  Target: SCN9A; (+) strand; PAM type: YTN; PAM sequence: TTT
tcccagtaatcttgggtcat

SEQ ID NO: 110031 - DNA, 20 bp, Artificial Sequence
  Description of Artificial Sequence: Synthetic oligonucleotide
  Target: SCN9A; (+) strand; PAM type: YTN; PAM sequence: TTT
cccagtaatcttgggtcatt

SEQ ID NO: 110032 - DNA, 20 bp, Artificial Sequence
  Description of Artificial Sequence: Synthetic oligonucleotide
  Target: SCN9A; (+) strand; PAM type: YTN; PAM sequence: TTC
ccagtaatcttgggtcatta

SEQ ID NO: 110033 - DNA, 20 bp, Artificial Sequence
  Description of Artificial Sequence: Synthetic oligonucleotide
  Target: SCN9A; (+) strand; PAM type: YTN; PAM sequence: CTT
gggtcattagcctaaacaag

SEQ ID NO: 110034 - DNA, 20 bp, Artificial Sequence
  Description of Artificial Sequence: Synthetic oligonucleotide
  Target: SCN9A; (+) strand; PAM type: YTN; PAM sequence: TTG
ggtcattagcctaaacaagg

SEQ ID NO: 110035 - DNA, 20 bp, Artificial Sequence
  Description of Artificial Sequence: Synthetic oligonucleotide
  Target: SCN9A; (+) strand; PAM type: YTN; PAM sequence: TTA
gcctaaacaaggctaagaag

SEQ ID NO: 110036 - DNA, 20 bp, Artificial Sequence
  Description of Artificial Sequence: Synthetic oligonucleotide
  Target: SCN9A; (+) strand; PAM type: YTN; PAM sequence: CTA
aacaaggctaagaaggccca

SEQ ID NO: 110037 - DNA, 20 bp, Artificial Sequence
  Description of Artificial Sequence: Synthetic oligonucleotide
  Target: SCN9A; (+) strand; PAM type: YTN; PAM sequence: CTA
agaaggcccagctgaaagtg

SEQ ID NO: 110038 - DNA, 20 bp, Artificial Sequence
  Description of Artificial Sequence: Synthetic oligonucleotide
  Target: SCN9A; (+) strand; PAM type: YTN; PAM sequence: CTG
aaagtgtcaaagctcgtgta

SEQ ID NO: 110039 - DNA, 20 bp, Artificial Sequence
  Description of Artificial Sequence: Synthetic oligonucleotide
  Target: SCN9A; (+) strand; PAM type: YTN; PAM sequence: CTC
gtgtagccataatcagggtt

SEQ ID NO: 110040 - DNA, 20 bp, Artificial Sequence
  Description of Artificial Sequence: Synthetic oligonucleotide
  Target: SCN9A; (+) strand; PAM type: YTN; PAM sequence: TTT
ctgccaattttcacacaggt

SEQ ID NO: 110041 - DNA, 20 bp, Artificial Sequence
  Description of Artificial Sequence: Synthetic oligonucleotide
  Target: SCN9A; (+) strand; PAM type: YTN; PAM sequence: TTC
tgccaattttcacacaggtg

SEQ ID NO: 110042 - DNA, 20 bp, Artificial Sequence
  Description of Artificial Sequence: Synthetic oligonucleotide
  Target: SCN9A; (+) strand; PAM type: YTN; PAM sequence: CTG
ccaattttcacacaggtgta

SEQ ID NO: 110043 - DNA, 20 bp, Artificial Sequence
  Description of Artificial Sequence: Synthetic oligonucleotide
  Target: SCN9A; (+) strand; PAM type: YTN; PAM sequence: TTT
tcacacaggtgtacccctct

SEQ ID NO: 110044 - DNA, 20 bp, Artificial Sequence
  Description of Artificial Sequence: Synthetic oligonucleotide
  Target: SCN9A; (+) strand; PAM type: YTN; PAM sequence: TTT
cacacaggtgtacccctctg

SEQ ID NO: 110045 - DNA, 20 bp, Artificial Sequence
  Description of Artificial Sequence: Synthetic oligonucleotide
  Target: SCN9A; (+) strand; PAM type: YTN; PAM sequence: TTC
acacaggtgtacccctctgg

SEQ ID NO: 110046 - DNA, 20 bp, Artificial Sequence
  Description of Artificial Sequence: Synthetic oligonucleotide
  Target: SCN9A; (+) strand; PAM type: YTN; PAM sequence: CTC
tggacactgactacacacga

SEQ ID NO: 110047 - DNA, 20 bp, Artificial Sequence
  Description of Artificial Sequence: Synthetic oligonucleotide
  Target: SCN9A; (+) strand; PAM type: YTN; PAM sequence: CTG
gacactgactacacacgaga

SEQ ID NO: 110048 - DNA, 20 bp, Artificial Sequence
  Description of Artificial Sequence: Synthetic oligonucleotide
  Target: SCN9A; (+) strand; PAM type: YTN; PAM sequence: CTG
actacacacgagaaagaaca

SEQ ID NO: 110049 - DNA, 20 bp, Artificial Sequence
  Description of Artificial Sequence: Synthetic oligonucleotide
  Target: SCN9A; (+) strand; PAM type: YTN; PAM sequence: CTA
cacacgagaaagaacattat

SEQ ID NO: 110050 - DNA, 20 bp, Artificial Sequence
  Description of Artificial Sequence: Synthetic oligonucleotide
  Target: SCN9A; (+) strand; PAM type: YTN; PAM sequence: TTA
taggtgagagtgtcttcagg

SEQ ID NO: 110051 - DNA, 20 bp, Artificial Sequence
  Description of Artificial Sequence: Synthetic oligonucleotide
  Target: SCN9A; (+) strand; PAM type: YTN; PAM sequence: CTT
caggacacaagctaaatagc

SEQ ID NO: 110052 - DNA, 20 bp, Artificial Sequence
  Description of Artificial Sequence: Synthetic oligonucleotide
  Target: SCN9A; (+) strand; PAM type: YTN; PAM sequence: TTC
aggacacaagctaaatagcc

SEQ ID NO: 110053 - DNA, 20 bp, Artificial Sequence
  Description of Artificial Sequence: Synthetic oligonucleotide
  Target: SCN9A; (+) strand; PAM type: YTN; PAM sequence: CTA
aatagccttactgaaaagtt

SEQ ID NO: 110054 - DNA, 20 bp, Artificial Sequence
  Description of Artificial Sequence: Synthetic oligonucleotide
  Target: SCN9A; (+) strand; PAM type: YTN; PAM sequence: CTT
actgaaaagttacaaactca

SEQ ID NO: 110055 - DNA, 20 bp, Artificial Sequence
  Description of Artificial Sequence: Synthetic oligonucleotide
  Target: SCN9A; (+) strand; PAM type: YTN; PAM sequence: TTA
ctgaaaagttacaaactcaa

SEQ ID NO: 110056 - DNA, 20 bp, Artificial Sequence
  Description of Artificial Sequence: Synthetic oligonucleotide
  Target: SCN9A; (+) strand; PAM type: YTN; PAM sequence: CTG
aaaagttacaaactcaaggt

SEQ ID NO: 110057 - DNA, 20 bp, Artificial Sequence
  Description of Artificial Sequence: Synthetic oligonucleotide
  Target: SCN9A; (+) strand; PAM type: YTN; PAM sequence: TTA
caaactcaaggtttcttcta

SEQ ID NO: 110058 - DNA, 20 bp, Artificial Sequence
  Description of Artificial Sequence: Synthetic oligonucleotide
  Target: SCN9A; (+) strand; PAM type: YTN; PAM sequence: CTC
aaggtttcttctataggggg

SEQ ID NO: 110059 - DNA, 20 bp, Artificial Sequence
  Description of Artificial Sequence: Synthetic oligonucleotide
  Target: SCN9A; (+) strand; PAM type: YTN; PAM sequence: TTT
cttctatagggggacaatat

SEQ ID NO: 110060 - DNA, 20 bp, Artificial Sequence
  Description of Artificial Sequence: Synthetic oligonucleotide
  Target: SCN9A; (+) strand; PAM type: YTN; PAM sequence: TTC
ttctatagggggacaatatt

SEQ ID NO: 110061 - DNA, 20 bp, Artificial Sequence
  Description of Artificial Sequence: Synthetic oligonucleotide
  Target: SCN9A; (+) strand; PAM type: YTN; PAM sequence: CTT
ctatagggggacaatattga

SEQ ID NO: 110062 - DNA, 20 bp, Artificial Sequence
  Description of Artificial Sequence: Synthetic oligonucleotide
  Target: SCN9A; (+) strand; PAM type: YTN; PAM sequence: TTC
tatagggggacaatattgaa

SEQ ID NO: 110063 - DNA, 20 bp, Artificial Sequence
  Description of Artificial Sequence: Synthetic oligonucleotide
  Target: SCN9A; (+) strand; PAM type: YTN; PAM sequence: CTA
tagggggacaatattgaata

SEQ ID NO: 110064 - DNA, 20 bp, Artificial Sequence
  Description of Artificial Sequence: Synthetic oligonucleotide
  Target: SCN9A; (+) strand; PAM type: YTN; PAM sequence: TTG
aataaggattaagaatacat

SEQ ID NO: 110065 - DNA, 20 bp, Artificial Sequence
  Description of Artificial Sequence: Synthetic oligonucleotide
  Target: SCN9A; (+) strand; PAM type: YTN; PAM sequence: TTA
agaatacatgatttggctac

SEQ ID NO: 110066 - DNA, 20 bp, Artificial Sequence
  Description of Artificial Sequence: Synthetic oligonucleotide
  Target: SCN9A; (+) strand; PAM type: YTN; PAM sequence: TTT
ggctactgactacttagtga

SEQ ID NO: 110067 - DNA, 20 bp, Artificial Sequence
  Description of Artificial Sequence: Synthetic oligonucleotide
  Target: SCN9A; (+) strand; PAM type: YTN; PAM sequence: TTG
gctactgactacttagtgac

SEQ ID NO: 110068 - DNA, 20 bp, Artificial Sequence
  Description of Artificial Sequence: Synthetic oligonucleotide
  Target: SCN9A; (+) strand; PAM type: YTN; PAM sequence: CTA
ctgactacttagtgacttta

SEQ ID NO: 110069 - DNA, 20 bp, Artificial Sequence
  Description of Artificial Sequence: Synthetic oligonucleotide
  Target: SCN9A; (+) strand; PAM type: YTN; PAM sequence: CTG
actacttagtgactttacca

SEQ ID NO: 110070 - DNA, 20 bp, Artificial Sequence
  Description of Artificial Sequence: Synthetic oligonucleotide
  Target: SCN9A; (+) strand; PAM type: YTN; PAM sequence: CTA
cttagtgactttaccaaatt

SEQ ID NO: 110071 - DNA, 20 bp, Artificial Sequence
  Description of Artificial Sequence: Synthetic oligonucleotide
  Target: SCN9A; (+) strand; PAM type: YTN; PAM sequence: CTT
agtgactttaccaaattctt

SEQ ID NO: 110072 - DNA, 20 bp, Artificial Sequence
  Description of Artificial Sequence: Synthetic oligonucleotide
  Target: SCN9A; (+) strand; PAM type: YTN; PAM sequence: TTA
gtgactttaccaaattcttc

SEQ ID NO: 110073 - DNA, 20 bp, Artificial Sequence
  Description of Artificial Sequence: Synthetic oligonucleotide
  Target: SCN9A; (+) strand; PAM type: YTN; PAM sequence: CTT
taccaaattcttcaaggcat

SEQ ID NO: 110074 - DNA, 20 bp, Artificial Sequence
  Description of Artificial Sequence: Synthetic oligonucleotide
  Target: SCN9A; (+) strand; PAM type: YTN; PAM sequence: TTT
accaaattcttcaaggcata

SEQ ID NO: 110075 - DNA, 20 bp, Artificial Sequence
  Description of Artificial Sequence: Synthetic oligonucleotide
  Target: SCN9A; (+) strand; PAM type: YTN; PAM sequence: TTA
ccaaattcttcaaggcataa

SEQ ID NO: 110076 - DNA, 20 bp, Artificial Sequence
  Description of Artificial Sequence: Synthetic oligonucleotide
  Target: SCN9A; (+) strand; PAM type: YTN; PAM sequence: TTC
ttcaaggcataagtctgtct

SEQ ID NO: 110077 - DNA, 20 bp, Artificial Sequence
  Description of Artificial Sequence: Synthetic oligonucleotide
  Target: SCN9A; (+) strand; PAM type: YTN; PAM sequence: CTT
caaggcataagtctgtctgt

SEQ ID NO: 110078 - DNA, 20 bp, Artificial Sequence
  Description of Artificial Sequence: Synthetic oligonucleotide
  Target: SCN9A; (+) strand; PAM type: YTN; PAM sequence: TTC
aaggcataagtctgtctgtg

SEQ ID NO: 110079 - DNA, 20 bp, Artificial Sequence
  Description of Artificial Sequence: Synthetic oligonucleotide
  Target: SCN9A; (+) strand; PAM type: YTN; PAM sequence: CTG
tctgtgaaaataggataata

SEQ ID NO: 110080 - DNA, 20 bp, Artificial Sequence
  Description of Artificial Sequence: Synthetic oligonucleotide
  Target: SCN9A; (+) strand; PAM type: YTN; PAM sequence: CTG
tgaaaataggataataacat

SEQ ID NO: 110081 - DNA, 20 bp, Artificial Sequence
  Description of Artificial Sequence: Synthetic oligonucleotide
  Target: SCN9A; (+) strand; PAM type: YTN; PAM sequence: CTA
cctcaagaaaataagacttg

SEQ ID NO: 110082 - DNA, 20 bp, Artificial Sequence
  Description of Artificial Sequence: Synthetic oligonucleotide
  Target: SCN9A; (+) strand; PAM type: YTN; PAM sequence: CTC
aagaaaataagacttgtaat

SEQ ID NO: 110083 - DNA, 20 bp, Artificial Sequence
  Description of Artificial Sequence: Synthetic oligonucleotide
  Target: SCN9A; (+) strand; PAM type: YTN; PAM sequence: CTT
gtaataagtttaaataagat

SEQ ID NO: 110084 - DNA, 20 bp, Artificial Sequence
  Description of Artificial Sequence: Synthetic oligonucleotide
  Target: SCN9A; (+) strand; PAM type: YTN; PAM sequence: TTG
taataagtttaaataagata

SEQ ID NO: 110085 - DNA, 20 bp, Artificial Sequence
  Description of Artificial Sequence: Synthetic oligonucleotide
  Target: SCN9A; (+) strand; PAM type: YTN; PAM sequence: TTT
aaataagataatgtgtacaa

SEQ ID NO: 110086 - DNA, 20 bp, Artificial Sequence
  Description of Artificial Sequence: Synthetic oligonucleotide
  Target: SCN9A; (+) strand; PAM type: YTN; PAM sequence: TTA
aataagataatgtgtacaaa

SEQ ID NO: 110087 - DNA, 20 bp, Artificial Sequence
  Description of Artificial Sequence: Synthetic oligonucleotide
  Target: SCN9A; (+) strand; PAM type: YTN; PAM sequence: TTA
cttagcttacatcctgcaca

SEQ ID NO: 110088 - DNA, 20 bp, Artificial Sequence
  Description of Artificial Sequence: Synthetic oligonucleotide
  Target: SCN9A; (+) strand; PAM type: YTN; PAM sequence: CTT
agcttacatcctgcacatag

SEQ ID NO: 110089 - DNA, 20 bp, Artificial Sequence
  Description of Artificial Sequence: Synthetic oligonucleotide
  Target: SCN9A; (+) strand; PAM type: YTN; PAM sequence: TTA
gcttacatcctgcacataga

SEQ ID NO: 110090 - DNA, 20 bp, Artificial Sequence
  Description of Artificial Sequence: Synthetic oligonucleotide
  Target: SCN9A; (+) strand; PAM type: YTN; PAM sequence: CTT
acatcctgcacatagaaagt

SEQ ID NO: 110091 - DNA, 20 bp, Artificial Sequence
  Description of Artificial Sequence: Synthetic oligonucleotide
  Target: SCN9A; (+) strand; PAM type: YTN; PAM sequence: TTA
catcctgcacatagaaagtg

SEQ ID NO: 110092 - DNA, 20 bp, Artificial Sequence
  Description of Artificial Sequence: Synthetic oligonucleotide
  Target: SCN9A; (+) strand; PAM type: YTN; PAM sequence: CTG
cacatagaaagtgtttaata

SEQ ID NO: 110093 - DNA, 20 bp, Artificial Sequence
  Description of Artificial Sequence: Synthetic oligonucleotide
  Target: SCN9A; (+) strand; PAM type: YTN; PAM sequence: TTT
aataaatcatagctgccatt

SEQ ID NO: 110094 - DNA, 20 bp, Artificial Sequence
  Description of Artificial Sequence: Synthetic oligonucleotide
  Target: SCN9A; (+) strand; PAM type: YTN; PAM sequence: TTA
ataaatcatagctgccatta

SEQ ID NO: 110095 - DNA, 20 bp, Artificial Sequence
  Description of Artificial Sequence: Synthetic oligonucleotide
  Target: SCN9A; (+) strand; PAM type: YTN; PAM sequence: CTG
ccattagcatcatcatcatt

SEQ ID NO: 110096 - DNA, 20 bp, Artificial Sequence
  Description of Artificial Sequence: Synthetic oligonucleotide
  Target: SCN9A; (+) strand; PAM type: YTN; PAM sequence: TTA
gcatcatcatcattaaaaca

SEQ ID NO: 110097 - DNA, 20 bp, Artificial Sequence
  Description of Artificial Sequence: Synthetic oligonucleotide
  Target: SCN9A; (+) strand; PAM type: YTN; PAM sequence: TTA
aaacatggaaattttcaaca

SEQ ID NO: 110098 - DNA, 20 bp, Artificial Sequence
  Description of Artificial Sequence: Synthetic oligonucleotide
  Target: SCN9A; (+) strand; PAM type: YTN; PAM sequence: TTT
tcaacagacgttttgtgata

SEQ ID NO: 110099 - DNA, 20 bp, Artificial Sequence
  Description of Artificial Sequence: Synthetic oligonucleotide
  Target: SCN9A; (+) strand; PAM type: YTN; PAM sequence: TTT
caacagacgttttgtgatag

SEQ ID NO: 110100 - DNA, 20 bp, Artificial Sequence
  Description of Artificial Sequence: Synthetic oligonucleotide
  Target: SCN9A; (+) strand; PAM type: YTN; PAM sequence: TTC
aacagacgttttgtgatagt

SEQ ID NO: 110101 - DNA, 20 bp, Artificial Sequence
  Description of Artificial Sequence: Synthetic oligonucleotide
  Target: SCN9A; (+) strand; PAM type: YTN; PAM sequence: TTT
tgtgatagttcttggttcag

SEQ ID NO: 110102 - DNA, 20 bp, Artificial Sequence
  Description of Artificial Sequence: Synthetic oligonucleotide
  Target: SCN9A; (+) strand; PAM type: YTN; PAM sequence: TTT
gtgatagttcttggttcagt

SEQ ID NO: 110103 - DNA, 20 bp, Artificial Sequence
  Description of Artificial Sequence: Synthetic oligonucleotide
  Target: SCN9A; (+) strand; PAM type: YTN; PAM sequence: TTG
tgatagttcttggttcagta

SEQ ID NO: 110104 - DNA, 20 bp, Artificial Sequence
  Description of Artificial Sequence: Synthetic oligonucleotide
  Target: SCN9A; (+) strand; PAM type: YTN; PAM sequence: TTC
ttggttcagtaaatattgat

SEQ ID NO: 110105 - DNA, 20 bp, Artificial Sequence
  Description of Artificial Sequence: Synthetic oligonucleotide
  Target: SCN9A; (+) strand; PAM type: YTN; PAM sequence: CTT
ggttcagtaaatattgatat

SEQ ID NO: 110106 - DNA, 20 bp, Artificial Sequence
  Description of Artificial Sequence: Synthetic oligonucleotide
  Target: SCN9A; (+) strand; PAM type: YTN; PAM sequence: TTG
gttcagtaaatattgatatg

SEQ ID NO: 110107 - DNA, 20 bp, Artificial Sequence
  Description of Artificial Sequence: Synthetic oligonucleotide
  Target: SCN9A; (+) strand; PAM type: YTN; PAM sequence: TTC
agtaaatattgatatgtagg

SEQ ID NO: 110108 - DNA, 20 bp, Artificial Sequence
  Description of Artificial Sequence: Synthetic oligonucleotide
  Target: SCN9A; (+) strand; PAM type: YTN; PAM sequence: TTG
atatgtaggctgttaccaaa

SEQ ID NO: 110109 - DNA, 20 bp, Artificial Sequence
  Description of Artificial Sequence: Synthetic oligonucleotide
  Target: SCN9A; (+) strand; PAM type: YTN; PAM sequence: CTG
ttaccaaagctctttctgtc

SEQ ID NO: 110110 - DNA, 20 bp, Artificial Sequence
  Description of Artificial Sequence: Synthetic oligonucleotide
  Target: SCN9A; (+) strand; PAM type: YTN; PAM sequence: TTA
ccaaagctctttctgtctgt

SEQ ID NO: 110111 - DNA, 20 bp, Artificial Sequence
  Description of Artificial Sequence: Synthetic oligonucleotide
  Target: SCN9A; (+) strand; PAM type: YTN; PAM sequence: CTC
tttctgtctgtataattctt

SEQ ID NO: 110112 - DNA, 20 bp, Artificial Sequence
  Description of Artificial Sequence: Synthetic oligonucleotide
  Target: SCN9A; (+) strand; PAM type: YTN; PAM sequence: CTT
tctgtctgtataattcttgg

SEQ ID NO: 110113 - DNA, 20 bp, Artificial Sequence
  Description of Artificial Sequence: Synthetic oligonucleotide
  Target: SCN9A; (+) strand; PAM type: YTN; PAM sequence: TTT
ctgtctgtataattcttgga

SEQ ID NO: 110114 - DNA, 20 bp, Artificial Sequence
  Description of Artificial Sequence: Synthetic oligonucleotide
  Target: SCN9A; (+) strand; PAM type: YTN; PAM sequence: TTC
tgtctgtataattcttggaa

SEQ ID NO: 110115 - DNA, 20 bp, Artificial Sequence
  Description of Artificial Sequence: Synthetic oligonucleotide
  Target: SCN9A; (+) strand; PAM type: YTN; PAM sequence: CTG
tctgtataattcttggaata

SEQ ID NO: 110116 - DNA, 20 bp, Artificial Sequence
  Description of Artificial Sequence: Synthetic oligonucleotide
  Target: SCN9A; (+) strand; PAM type: YTN; PAM sequence: CTG
tataattcttggaatagatt

SEQ ID NO: 110117 - DNA, 20 bp, Artificial Sequence
  Description of Artificial Sequence: Synthetic oligonucleotide
  Target: SCN9A; (+) strand; PAM type: YTN; PAM sequence: TTC
ttggaatagattagagtcaa

SEQ ID NO: 110118 - DNA, 20 bp, Artificial Sequence
  Description of Artificial Sequence: Synthetic oligonucleotide
  Target: SCN9A; (+) strand; PAM type: YTN; PAM sequence: CTT
ggaatagattagagtcaata

SEQ ID NO: 110119 - DNA, 20 bp, Artificial Sequence
  Description of Artificial Sequence: Synthetic oligonucleotide
  Target: SCN9A; (+) strand; PAM type: YTN; PAM sequence: TTG
gaatagattagagtcaataa

SEQ ID NO: 110120 - DNA, 20 bp, Artificial Sequence
  Description of Artificial Sequence: Synthetic oligonucleotide
  Target: SCN9A; (+) strand; PAM type: YTN; PAM sequence: TTA
gagtcaataatagtcaaaat

SEQ ID NO: 110121 - DNA, 20 bp, Artificial Sequence
  Description of Artificial Sequence: Synthetic oligonucleotide
  Target: SCN9A; (+) strand; PAM type: YTN; PAM sequence: TTG
tctaagttcataaaaatgtg

SEQ ID NO: 110122 - DNA, 20 bp, Artificial Sequence
  Description of Artificial Sequence: Synthetic oligonucleotide
  Target: SCN9A; (+) strand; PAM type: YTN; PAM sequence: CTA
agttcataaaaatgtgcagc

SEQ ID NO: 110123 - DNA, 20 bp, Artificial Sequence
  Description of Artificial Sequence: Synthetic oligonucleotide
  Target: SCN9A; (+) strand; PAM type: YTN; PAM sequence: TTC
ataaaaatgtgcagctttaa

SEQ ID NO: 110124 - DNA, 20 bp, Artificial Sequence
  Description of Artificial Sequence: Synthetic oligonucleotide
  Target: SCN9A; (+) strand; PAM type: YTN; PAM sequence: CTT
taagacttttttctttctaa

SEQ ID NO: 110125 - DNA, 20 bp, Artificial Sequence
  Description of Artificial Sequence: Synthetic oligonucleotide
  Target: SCN9A; (+) strand; PAM type: YTN; PAM sequence: TTT
aagacttttttctttctaaa

SEQ ID NO: 110126 - DNA, 20 bp, Artificial Sequence
  Description of Artificial Sequence: Synthetic oligonucleotide
  Target: SCN9A; (+) strand; PAM type: YTN; PAM sequence: TTA
agacttttttctttctaaaa

SEQ ID NO: 110127 - DNA, 20 bp, Artificial Sequence
  Description of Artificial Sequence: Synthetic oligonucleotide
  Target: SCN9A; (+) strand; PAM type: YTN; PAM sequence: CTT
ttttctttctaaaattggtg

SEQ ID NO: 110128 - DNA, 20 bp, Artificial Sequence
  Description of Artificial Sequence: Synthetic oligonucleotide
  Target: SCN9A; (+) strand; PAM type: YTN; PAM sequence: TTT
tttctttctaaaattggtgg

SEQ ID NO: 110129 - DNA, 20 bp, Artificial Sequence
  Description of Artificial Sequence: Synthetic oligonucleotide
  Target: SCN9A; (+) strand; PAM type: YTN; PAM sequence: TTT
ttctttctaaaattggtgga

SEQ ID NO: 110130 - DNA, 20 bp, Artificial Sequence
  Description of Artificial Sequence: Synthetic oligonucleotide
  Target: SCN9A; (+) strand; PAM type: YTN; PAM sequence: TTT
tctttctaaaattggtggac

SEQ ID NO: 110131 - DNA, 20 bp, Artificial Sequence
  Description of Artificial Sequence: Synthetic oligonucleotide
  Target: SCN9A; (+) strand; PAM type: YTN; PAM sequence: TTT
ctttctaaaattggtggact

SEQ ID NO: 110132 - DNA, 20 bp, Artificial Sequence
  Description of Artificial Sequence: Synthetic oligonucleotide
  Target: SCN9A; (+) strand; PAM type: YTN; PAM sequence: TTC
tttctaaaattggtggactg

SEQ ID NO: 110133 - DNA, 20 bp, Artificial Sequence
  Description of Artificial Sequence: Synthetic oligonucleotide
  Target: SCN9A; (+) strand; PAM type: YTN; PAM sequence: CTT
tctaaaattggtggactggt

SEQ ID NO: 110134 - DNA, 20 bp, Artificial Sequence
  Description of Artificial Sequence: Synthetic oligonucleotide
  Target: SCN9A; (+) strand; PAM type: YTN; PAM sequence: TTT
ctaaaattggtggactggtt

SEQ ID NO: 110135 - DNA, 20 bp, Artificial Sequence
  Description of Artificial Sequence: Synthetic oligonucleotide
  Target: SCN9A; (+) strand; PAM type: YTN; PAM sequence: TTC
taaaattggtggactggttt

SEQ ID NO: 110136 - DNA, 20 bp, Artificial Sequence
  Description of Artificial Sequence: Synthetic oligonucleotide
  Target: SCN9A; (+) strand; PAM type: YTN; PAM sequence: CTA
aaattggtggactggttttt

SEQ ID NO: 110137 - DNA, 20 bp, Artificial Sequence
  Description of Artificial Sequence: Synthetic oligonucleotide
  Target: SCN9A; (+) strand; PAM type: YTN; PAM sequence: TTG
gtggactggtttttcctgat

SEQ ID NO: 110138 - DNA, 20 bp, Artificial Sequence
  Description of Artificial Sequence: Synthetic oligonucleotide
  Target: SCN9A; (+) strand; PAM type: YTN; PAM sequence: CTG
gtttttcctgatgccattaa

SEQ ID NO: 110139 - DNA, 20 bp, Artificial Sequence
  Description of Artificial Sequence: Synthetic oligonucleotide
  Target: SCN9A; (+) strand; PAM type: YTN; PAM sequence: TTT
ttcctgatgccattaaataa

SEQ ID NO: 110140 - DNA, 20 bp, Artificial Sequence
  Description of Artificial Sequence: Synthetic oligonucleotide
  Target: SCN9A; (+) strand; PAM type: YTN; PAM sequence: TTT
tcctgatgccattaaataaa

SEQ ID NO: 110141 - DNA, 20 bp, Artificial Sequence
  Description of Artificial Sequence: Synthetic oligonucleotide
  Target: SCN9A; (+) strand; PAM type: YTN; PAM sequence: TTT
cctgatgccattaaataaat

SEQ ID NO: 110142 - DNA, 20 bp, Artificial Sequence
  Description of Artificial Sequence: Synthetic oligonucleotide
  Target: SCN9A; (+) strand; PAM type: YTN; PAM sequence: TTC
ctgatgccattaaataaata

SEQ ID NO: 110143 - DNA, 20 bp, Artificial Sequence
  Description of Artificial Sequence: Synthetic oligonucleotide
  Target: SCN9A; (+) strand; PAM type: YTN; PAM sequence: CTG
atgccattaaataaatacaa

SEQ ID NO: 110144 - DNA, 20 bp, Artificial Sequence
  Description of Artificial Sequence: Synthetic oligonucleotide
  Target: SCN9A; (+) strand; PAM type: YTN; PAM sequence: TTA
aataaatacaatattctgag

SEQ ID NO: 110145 - DNA, 20 bp, Artificial Sequence
  Description of Artificial Sequence: Synthetic oligonucleotide
  Target: SCN9A; (+) strand; PAM type: YTN; PAM sequence: TTC
tgagattcttctgggaacag

SEQ ID NO: 110146 - DNA, 20 bp, Artificial Sequence
  Description of Artificial Sequence: Synthetic oligonucleotide
  Target: SCN9A; (+) strand; PAM type: YTN; PAM sequence: CTG
agattcttctgggaacagca

SEQ ID NO: 110147 - DNA, 20 bp, Artificial Sequence
  Description of Artificial Sequence: Synthetic oligonucleotide
  Target: SCN9A; (+) strand; PAM type: YTN; PAM sequence: TTC
ttctgggaacagcaacctta

SEQ ID NO: 110148 - DNA, 20 bp, Artificial Sequence
  Description of Artificial Sequence: Synthetic oligonucleotide
  Target: SCN9A; (+) strand; PAM type: YTN; PAM sequence: CTT
ctgggaacagcaaccttatc

SEQ ID NO: 110149 - DNA, 20 bp, Artificial Sequence
  Description of Artificial Sequence: Synthetic oligonucleotide
  Target: SCN9A; (+) strand; PAM type: YTN; PAM sequence: TTC
tgggaacagcaaccttatcc

SEQ ID NO: 110150 - DNA, 20 bp, Artificial Sequence
  Description of Artificial Sequence: Synthetic oligonucleotide
  Target: SCN9A; (+) strand; PAM type: YTN; PAM sequence: CTG
ggaacagcaaccttatccag

SEQ ID NO: 110151 - DNA, 20 bp, Artificial Sequence
  Description of Artificial Sequence: Synthetic oligonucleotide
  Target: SCN9A; (+) strand; PAM type: YTN; PAM sequence: CTT
atccagtttattcctatgtt

SEQ ID NO: 110152 - DNA, 20 bp, Artificial Sequence
  Description of Artificial Sequence: Synthetic oligonucleotide
  Target: SCN9A; (+) strand; PAM type: YTN; PAM sequence: TTA
tccagtttattcctatgttg

SEQ ID NO: 110153 - DNA, 20 bp, Artificial Sequence
  Description of Artificial Sequence: Synthetic oligonucleotide
  Target: SCN9A; (+) strand; PAM type: YTN; PAM sequence: TTT
attcctatgttgccagtgta

SEQ ID NO: 110154 - DNA, 20 bp, Artificial Sequence
  Description of Artificial Sequence: Synthetic oligonucleotide
  Target: SCN9A; (+) strand; PAM type: YTN; PAM sequence: TTA
ttcctatgttgccagtgtac

SEQ ID NO: 110155 - DNA, 20 bp, Artificial Sequence
  Description of Artificial Sequence: Synthetic oligonucleotide
  Target: SCN9A; (+) strand; PAM type: YTN; PAM sequence: TTC
ctatgttgccagtgtacaca

SEQ ID NO: 110156 - DNA, 20 bp, Artificial Sequence
  Description of Artificial Sequence: Synthetic oligonucleotide
  Target: SCN9A; (+) strand; PAM type: YTN; PAM sequence: CTA
tgttgccagtgtacacagag

SEQ ID NO: 110157 - DNA, 20 bp, Artificial Sequence
  Description of Artificial Sequence: Synthetic oligonucleotide
  Target: SCN9A; (+) strand; PAM type: YTN; PAM sequence: TTG
ccagtgtacacagagcctga

SEQ ID NO: 110158 - DNA, 20 bp, Artificial Sequence
  Description of Artificial Sequence: Synthetic oligonucleotide
  Target: SCN9A; (+) strand; PAM type: YTN; PAM sequence: CTG
atgaatagatgtctgcatag

SEQ ID NO: 110159 - DNA, 20 bp, Artificial Sequence
  Description of Artificial Sequence: Synthetic oligonucleotide
  Target: SCN9A; (+) strand; PAM type: YTN; PAM sequence: CTG
catagggggaaaagcaagag

SEQ ID NO: 110160 - DNA, 20 bp, Artificial Sequence
  Description of Artificial Sequence: Synthetic oligonucleotide
  Target: SCN9A; (+) strand; PAM type: YTN; PAM sequence: CTT
atgcagctgatgctacaaaa

SEQ ID NO: 110161 - DNA, 20 bp, Artificial Sequence
  Description of Artificial Sequence: Synthetic oligonucleotide
  Target: SCN9A; (+) strand; PAM type: YTN; PAM sequence: TTA
tgcagctgatgctacaaaat

SEQ ID NO: 110162 - DNA, 20 bp, Artificial Sequence
  Description of Artificial Sequence: Synthetic oligonucleotide
  Target: SCN9A; (+) strand; PAM type: YTN; PAM sequence: CTG
atgctacaaaatgaagttgg

SEQ ID NO: 110163 - DNA, 20 bp, Artificial Sequence
  Description of Artificial Sequence: Synthetic oligonucleotide
  Target: SCN9A; (+) strand; PAM type: YTN; PAM sequence: CTA
caaaatgaagttggtgtaag

SEQ ID NO: 110164 - DNA, 20 bp, Artificial Sequence
  Description of Artificial Sequence: Synthetic oligonucleotide
  Target: SCN9A; (+) strand; PAM type: YTN; PAM sequence: TTG
gtgtaagagagaagcagcaa

SEQ ID NO: 110165 - DNA, 20 bp, Artificial Sequence
  Description of Artificial Sequence: Synthetic oligonucleotide
  Target: SCN9A; (+) strand; PAM type: YTN; PAM sequence: TTG
aatatatacaatattcttat

SEQ ID NO: 110166 - DNA, 20 bp, Artificial Sequence
  Description of Artificial Sequence: Synthetic oligonucleotide
  Target: SCN9A; (+) strand; PAM type: YTN; PAM sequence: TTC
ttatatatacaatattctta

SEQ ID NO: 110167 - DNA, 20 bp, Artificial Sequence
  Description of Artificial Sequence: Synthetic oligonucleotide
  Target: SCN9A; (+) strand; PAM type: YTN; PAM sequence: CTT
atatatacaatattcttaaa

SEQ ID NO: 110168 - DNA, 20 bp, Artificial Sequence
  Description of Artificial Sequence: Synthetic oligonucleotide
  Target: SCN9A; (+) strand; PAM type: YTN; PAM sequence: TTA
tatatacaatattcttaaaa

SEQ ID NO: 110169 - DNA, 20 bp, Artificial Sequence
  Description of Artificial Sequence: Synthetic oligonucleotide
  Target: SCN9A; (+) strand; PAM type: YTN; PAM sequence: TTC
ttaaaatatgtgtacccaag

SEQ ID NO: 110170 - DNA, 20 bp, Artificial Sequence
  Description of Artificial Sequence: Synthetic oligonucleotide
  Target: SCN9A; (+) strand; PAM type: YTN; PAM sequence: CTT
aaaatatgtgtacccaagtc

SEQ ID NO: 110171 - DNA, 20 bp, Artificial Sequence
  Description of Artificial Sequence: Synthetic oligonucleotide
  Target: SCN9A; (+) strand; PAM type: YTN; PAM sequence: TTA
aaatatgtgtacccaagtcc

SEQ ID NO: 110172 - DNA, 20 bp, Artificial Sequence
  Description of Artificial Sequence: Synthetic oligonucleotide
  Target: SCN9A; (+) strand; PAM type: YTN; PAM sequence: CTT
tgcttagagtggccaaaaca

SEQ ID NO: 110173 - DNA, 20 bp, Artificial Sequence
  Description of Artificial Sequence: Synthetic oligonucleotide
  Target: SCN9A; (+) strand; PAM type: YTN; PAM sequence: TTT
gcttagagtggccaaaacat

SEQ ID NO: 110174 - DNA, 20 bp, Artificial Sequence
  Description of Artificial Sequence: Synthetic oligonucleotide
  Target: SCN9A; (+) strand; PAM type: YTN; PAM sequence: TTG
cttagagtggccaaaacatg

SEQ ID NO: 110175 - DNA, 20 bp, Artificial Sequence
  Description of Artificial Sequence: Synthetic oligonucleotide
  Target: SCN9A; (+) strand; PAM type: YTN; PAM sequence: CTT
agagtggccaaaacatgaca

SEQ ID NO: 110176 - DNA, 20 bp, Artificial Sequence
  Description of Artificial Sequence: Synthetic oligonucleotide
  Target: SCN9A; (+) strand; PAM type: YTN; PAM sequence: TTA
gagtggccaaaacatgacat

SEQ ID NO: 110177 - DNA, 20 bp, Artificial Sequence
  Description of Artificial Sequence: Synthetic oligonucleotide
  Target: SCN9A; (+) strand; PAM type: YTN; PAM sequence: TTC
agtcacctatgagtcacatt

SEQ ID NO: 110178 - DNA, 20 bp, Artificial Sequence
  Description of Artificial Sequence: Synthetic oligonucleotide
  Target: SCN9A; (+) strand; PAM type: YTN; PAM sequence: CTA
tgagtcacatttaattggag

SEQ ID NO: 110179 - DNA, 20 bp, Artificial Sequence
  Description of Artificial Sequence: Synthetic oligonucleotide
  Target: SCN9A; (+) strand; PAM type: YTN; PAM sequence: TTT
aattggagaatgagtggaac

SEQ ID NO: 110180 - DNA, 20 bp, Artificial Sequence
  Description of Artificial Sequence: Synthetic oligonucleotide
  Target: SCN9A; (+) strand; PAM type: YTN; PAM sequence: TTA
attggagaatgagtggaact

SEQ ID NO: 110181 - DNA, 20 bp, Artificial Sequence
  Description of Artificial Sequence: Synthetic oligonucleotide
  Target: SCN9A; (+) strand; PAM type: YTN; PAM sequence: TTG
gagaatgagtggaacttggg

SEQ ID NO: 110182 - DNA, 20 bp, Artificial Sequence
  Description of Artificial Sequence: Synthetic oligonucleotide
  Target: SCN9A; (+) strand; PAM type: YTN; PAM sequence: CTT
gggagtagaaagaaaaatag

SEQ ID NO: 110183 - DNA, 20 bp, Artificial Sequence
  Description of Artificial Sequence: Synthetic oligonucleotide
  Target: SCN9A; (+) strand; PAM type: YTN; PAM sequence: TTG
ggagtagaaagaaaaataga

SEQ ID NO: 110184 - DNA, 20 bp, Artificial Sequence
  Description of Artificial Sequence: Synthetic oligonucleotide
  Target: SCN9A; (+) strand; PAM type: YTN; PAM sequence: CTT
tgtgactcttcgttttccag

SEQ ID NO: 110185 - DNA, 20 bp, Artificial Sequence
  Description of Artificial Sequence: Synthetic oligonucleotide
  Target: SCN9A; (+) strand; PAM type: YTN; PAM sequence: TTT
gtgactcttcgttttccaga

SEQ ID NO: 110186 - DNA, 20 bp, Artificial Sequence
  Description of Artificial Sequence: Synthetic oligonucleotide
  Target: SCN9A; (+) strand; PAM type: YTN; PAM sequence: TTG
tgactcttcgttttccagaa

SEQ ID NO: 110187 - DNA, 20 bp, Artificial Sequence
  Description of Artificial Sequence: Synthetic oligonucleotide
  Target: SCN9A; (+) strand; PAM type: YTN; PAM sequence: CTC
ttcgttttccagaaagaaga

SEQ ID NO: 110188 - DNA, 20 bp, Artificial Sequence
  Description of Artificial Sequence: Synthetic oligonucleotide
  Target: SCN9A; (+) strand; PAM type: YTN; PAM sequence: CTT
cgttttccagaaagaagacc

SEQ ID NO: 110189 - DNA, 20 bp, Artificial Sequence
  Description of Artificial Sequence: Synthetic oligonucleotide
  Target: SCN9A; (+) strand; PAM type: YTN; PAM sequence: TTC
gttttccagaaagaagacct

SEQ ID NO: 110190 - DNA, 20 bp, Artificial Sequence
  Description of Artificial Sequence: Synthetic oligonucleotide
  Target: SCN9A; (+) strand; PAM type: YTN; PAM sequence: TTT
tccagaaagaagacctgaaa

SEQ ID NO: 110191 - DNA, 20 bp, Artificial Sequence
  Description of Artificial Sequence: Synthetic oligonucleotide
  Target: SCN9A; (+) strand; PAM type: YTN; PAM sequence: TTT
ccagaaagaagacctgaaat

SEQ ID NO: 110192 - DNA, 20 bp, Artificial Sequence
  Description of Artificial Sequence: Synthetic oligonucleotide
  Target: SCN9A; (+) strand; PAM type: YTN; PAM sequence: TTC
cagaaagaagacctgaaatt

SEQ ID NO: 110193 - DNA, 20 bp, Artificial Sequence
  Description of Artificial Sequence: Synthetic oligonucleotide
  Target: SCN9A; (+) strand; PAM type: YTN; PAM sequence: CTG
aaattatccaaccaactttt

SEQ ID NO: 110194 - DNA, 20 bp, Artificial Sequence
  Description of Artificial Sequence: Synthetic oligonucleotide
  Target: SCN9A; (+) strand; PAM type: YTN; PAM sequence: TTA
tccaaccaacttttggtgga

SEQ ID NO: 110195 - DNA, 20 bp, Artificial Sequence
  Description of Artificial Sequence: Synthetic oligonucleotide
  Target: SCN9A; (+) strand; PAM type: YTN; PAM sequence: CTT
ttggtggagttttctagaag

SEQ ID NO: 110196 - DNA, 20 bp, Artificial Sequence
  Description of Artificial Sequence: Synthetic oligonucleotide
  Target: SCN9A; (+) strand; PAM type: YTN; PAM sequence: TTT
tggtggagttttctagaagt

SEQ ID NO: 110197 - DNA, 20 bp, Artificial Sequence
  Description of Artificial Sequence: Synthetic oligonucleotide
  Target: SCN9A; (+) strand; PAM type: YTN; PAM sequence: TTT
ggtggagttttctagaagta

SEQ ID NO: 110198 - DNA, 20 bp, Artificial Sequence
  Description of Artificial Sequence: Synthetic oligonucleotide
  Target: SCN9A; (+) strand; PAM type: YTN; PAM sequence: TTG
gtggagttttctagaagtaa

SEQ ID NO: 110199 - DNA, 20 bp, Artificial Sequence
  Description of Artificial Sequence: Synthetic oligonucleotide
  Target: SCN9A; (+) strand; PAM type: YTN; PAM sequence: TTT
tctagaagtaacattttcta

SEQ ID NO: 110200 - DNA, 20 bp, Artificial Sequence
  Description of Artificial Sequence: Synthetic oligonucleotide
  Target: SCN9A; (+) strand; PAM type: YTN; PAM sequence: TTT
ctagaagtaacattttctac

SEQ ID NO: 110201 - DNA, 20 bp, Artificial Sequence
  Description of Artificial Sequence: Synthetic oligonucleotide
  Target: SCN9A; (+) strand; PAM type: YTN; PAM sequence: TTC
tagaagtaacattttctacc

SEQ ID NO: 110202 - DNA, 20 bp, Artificial Sequence
  Description of Artificial Sequence: Synthetic oligonucleotide
  Target: SCN9A; (+) strand; PAM type: YTN; PAM sequence: CTA
gaagtaacattttctacctt

SEQ ID NO: 110203 - DNA, 20 bp, Artificial Sequence
  Description of Artificial Sequence: Synthetic oligonucleotide
  Target: SCN9A; (+) strand; PAM type: YTN; PAM sequence: TTT
tctaccttcttaagatttat

SEQ ID NO: 110204 - DNA, 20 bp, Artificial Sequence
  Description of Artificial Sequence: Synthetic oligonucleotide
  Target: SCN9A; (+) strand; PAM type: YTN; PAM sequence: TTT
ctaccttcttaagatttata

SEQ ID NO: 110205 - DNA, 20 bp, Artificial Sequence
  Description of Artificial Sequence: Synthetic oligonucleotide
  Target: SCN9A; (+) strand; PAM type: YTN; PAM sequence: TTC
taccttcttaagatttatat

SEQ ID NO: 110206 - DNA, 20 bp, Artificial Sequence
  Description of Artificial Sequence: Synthetic oligonucleotide
  Target: SCN9A; (+) strand; PAM type: YTN; PAM sequence: CTA
ccttcttaagatttatatga

SEQ ID NO: 110207 - DNA, 20 bp, Artificial Sequence
  Description of Artificial Sequence: Synthetic oligonucleotide
  Target: SCN9A; (+) strand; PAM type: YTN; PAM sequence: CTT
cttaagatttatatgacttc

SEQ ID NO: 110208 - DNA, 20 bp, Artificial Sequence
  Description of Artificial Sequence: Synthetic oligonucleotide
  Target: SCN9A; (+) strand; PAM type: YTN; PAM sequence: TTC
ttaagatttatatgacttct

SEQ ID NO: 110209 - DNA, 20 bp, Artificial Sequence
  Description of Artificial Sequence: Synthetic oligonucleotide
  Target: SCN9A; (+) strand; PAM type: YTN; PAM sequence: CTT
aagatttatatgacttctgt

SEQ ID NO: 110210 - DNA, 20 bp, Artificial Sequence
  Description of Artificial Sequence: Synthetic oligonucleotide
  Target: SCN9A; (+) strand; PAM type: YTN; PAM sequence: TTA
agatttatatgacttctgtc

SEQ ID NO: 110211 - DNA, 20 bp, Artificial Sequence
  Description of Artificial Sequence: Synthetic oligonucleotide
  Target: SCN9A; (+) strand; PAM type: YTN; PAM sequence: TTT
atatgacttctgtcttgtgt

SEQ ID NO: 110212 - DNA, 20 bp, Artificial Sequence
  Description of Artificial Sequence: Synthetic oligonucleotide
  Target: SCN9A; (+) strand; PAM type: YTN; PAM sequence: TTA
tatgacttctgtcttgtgtt

SEQ ID NO: 110213 - DNA, 20 bp, Artificial Sequence
  Description of Artificial Sequence: Synthetic oligonucleotide
  Target: SCN9A; (+) strand; PAM type: YTN; PAM sequence: CTT
ctgtcttgtgttaattcgag

SEQ ID NO: 110214 - DNA, 20 bp, Artificial Sequence
  Description of Artificial Sequence: Synthetic oligonucleotide
  Target: SCN9A; (+) strand; PAM type: YTN; PAM sequence: TTC
tgtcttgtgttaattcgagc

SEQ ID NO: 110215 - DNA, 20 bp, Artificial Sequence
  Description of Artificial Sequence: Synthetic oligonucleotide
  Target: SCN9A; (+) strand; PAM type: YTN; PAM sequence: CTG
tcttgtgttaattcgagcac

SEQ ID NO: 110216 - DNA, 20 bp, Artificial Sequence
  Description of Artificial Sequence: Synthetic oligonucleotide
  Target: SCN9A; (+) strand; PAM type: YTN; PAM sequence: CTT
gtgttaattcgagcactgtc

SEQ ID NO: 110217 - DNA, 20 bp, Artificial Sequence
  Description of Artificial Sequence: Synthetic oligonucleotide
  Target: SCN9A; (+) strand; PAM type: YTN; PAM sequence: TTG
tgttaattcgagcactgtct

SEQ ID NO: 110218 - DNA, 20 bp, Artificial Sequence
  Description of Artificial Sequence: Synthetic oligonucleotide
  Target: SCN9A; (+) strand; PAM type: YTN; PAM sequence: TTA
attcgagcactgtctcaaag

SEQ ID NO: 110219 - DNA, 20 bp, Artificial Sequence
  Description of Artificial Sequence: Synthetic oligonucleotide
  Target: SCN9A; (+) strand; PAM type: YTN; PAM sequence: TTC
gagcactgtctcaaagtctt

SEQ ID NO: 110220 - DNA, 20 bp, Artificial Sequence
  Description of Artificial Sequence: Synthetic oligonucleotide
  Target: SCN9A; (+) strand; PAM type: YTN; PAM sequence: CTG
tctcaaagtcttgctttcaa

SEQ ID NO: 110221 - DNA, 20 bp, Artificial Sequence
  Description of Artificial Sequence: Synthetic oligonucleotide
  Target: SCN9A; (+) strand; PAM type: YTN; PAM sequence: CTC
aaagtcttgctttcaagagt

SEQ ID NO: 110222 - DNA, 20 bp, Artificial Sequence
  Description of Artificial Sequence: Synthetic oligonucleotide
  Target: SCN9A; (+) strand; PAM type: YTN; PAM sequence: CTT
gctttcaagagtatgcatta

SEQ ID NO: 110223 - DNA, 20 bp, Artificial Sequence
  Description of Artificial Sequence: Synthetic oligonucleotide
  Target: SCN9A; (+) strand; PAM type: YTN; PAM sequence: TTG
ctttcaagagtatgcattaa

SEQ ID NO: 110224 - DNA, 20 bp, Artificial Sequence
  Description of Artificial Sequence: Synthetic oligonucleotide
  Target: SCN9A; (+) strand; PAM type: YTN; PAM sequence: CTT
tcaagagtatgcattaactg

SEQ ID NO: 110225 - DNA, 20 bp, Artificial Sequence
  Description of Artificial Sequence: Synthetic oligonucleotide
  Target: SCN9A; (+) strand; PAM type: YTN; PAM sequence: TTT
caagagtatgcattaactgt

SEQ ID NO: 110226 - DNA, 20 bp, Artificial Sequence
  Description of Artificial Sequence: Synthetic oligonucleotide
  Target: SCN9A; (+) strand; PAM type: YTN; PAM sequence: TTC
aagagtatgcattaactgtg

SEQ ID NO: 110227 - DNA, 20 bp, Artificial Sequence
  Description of Artificial Sequence: Synthetic oligonucleotide
  Target: SCN9A; (+) strand; PAM type: YTN; PAM sequence: TTA
actgtgaacattttaaagac

SEQ ID NO: 110228 - DNA, 20 bp, Artificial Sequence
  Description of Artificial Sequence: Synthetic oligonucleotide
  Target: SCN9A; (+) strand; PAM type: YTN; PAM sequence: CTG
tgaacattttaaagactgga

SEQ ID NO: 110229 - DNA, 20 bp, Artificial Sequence
  Description of Artificial Sequence: Synthetic oligonucleotide
  Target: SCN9A; (+) strand; PAM type: YTN; PAM sequence: TTT
taaagactggatttgctgtg

SEQ ID NO: 110230 - DNA, 20 bp, Artificial Sequence
  Description of Artificial Sequence: Synthetic oligonucleotide
  Target: SCN9A; (+) strand; PAM type: YTN; PAM sequence: TTT
aaagactggatttgctgtgg

SEQ ID NO: 110231 - DNA, 20 bp, Artificial Sequence
  Description of Artificial Sequence: Synthetic oligonucleotide
  Target: SCN9A; (+) strand; PAM type: YTN; PAM sequence: TTA
aagactggatttgctgtggg

SEQ ID NO: 110232 - DNA, 20 bp, Artificial Sequence
  Description of Artificial Sequence: Synthetic oligonucleotide
  Target: SCN9A; (+) strand; PAM type: YTN; PAM sequence: CTG
gatttgctgtgggacagaat

SEQ ID NO: 110233 - DNA, 20 bp, Artificial Sequence
  Description of Artificial Sequence: Synthetic oligonucleotide
  Target: SCN9A; (+) strand; PAM type: YTN; PAM sequence: TTT
gctgtgggacagaatgagtc

SEQ ID NO: 110234 - DNA, 20 bp, Artificial Sequence
  Description of Artificial Sequence: Synthetic oligonucleotide
  Target: SCN9A; (+) strand; PAM type: YTN; PAM sequence: TTG
ctgtgggacagaatgagtca

SEQ ID NO: 110235 - DNA, 20 bp, Artificial Sequence
  Description of Artificial Sequence: Synthetic oligonucleotide
  Target: SCN9A; (+) strand; PAM type: YTN; PAM sequence: CTG
tgggacagaatgagtcaaat

SEQ ID NO: 110236 - DNA, 20 bp, Artificial Sequence
  Description of Artificial Sequence: Synthetic oligonucleotide
  Target: SCN9A; (+) strand; PAM type: YTN; PAM sequence: CTA
atttgcaaactgactgaaca

SEQ ID NO: 110237 - DNA, 20 bp, Artificial Sequence
  Description of Artificial Sequence: Synthetic oligonucleotide
  Target: SCN9A; (+) strand; PAM type: YTN; PAM sequence: TTT
gcaaactgactgaacattct

SEQ ID NO: 110238 - DNA, 20 bp, Artificial Sequence
  Description of Artificial Sequence: Synthetic oligonucleotide
  Target: SCN9A; (+) strand; PAM type: YTN; PAM sequence: TTG
caaactgactgaacattctt

SEQ ID NO: 110239 - DNA, 20 bp, Artificial Sequence
  Description of Artificial Sequence: Synthetic oligonucleotide
  Target: SCN9A; (+) strand; PAM type: YTN; PAM sequence: CTG
actgaacattcttttccttc

SEQ ID NO: 110240 - DNA, 20 bp, Artificial Sequence
  Description of Artificial Sequence: Synthetic oligonucleotide
  Target: SCN9A; (+) strand; PAM type: YTN; PAM sequence: CTG
aacattcttttccttctctt

SEQ ID NO: 110241 - DNA, 20 bp, Artificial Sequence
  Description of Artificial Sequence: Synthetic oligonucleotide
  Target: SCN9A; (+) strand; PAM type: YTN; PAM sequence: TTC
ttttccttctctttcagcct

SEQ ID NO: 110242 - DNA, 20 bp, Artificial Sequence
  Description of Artificial Sequence: Synthetic oligonucleotide
  Target: SCN9A; (+) strand; PAM type: YTN; PAM sequence: CTT
ttccttctctttcagccttt

SEQ ID NO: 110243 - DNA, 20 bp, Artificial Sequence
  Description of Artificial Sequence: Synthetic oligonucleotide
  Target: SCN9A; (+) strand; PAM type: YTN; PAM sequence: TTT
tccttctctttcagccttta

SEQ ID NO: 110244 - DNA, 20 bp, Artificial Sequence
  Description of Artificial Sequence: Synthetic oligonucleotide
  Target: SCN9A; (+) strand; PAM type: YTN; PAM sequence: TTT
ccttctctttcagcctttag

SEQ ID NO: 110245 - DNA, 20 bp, Artificial Sequence
  Description of Artificial Sequence: Synthetic oligonucleotide
  Target: SCN9A; (+) strand; PAM type: YTN; PAM sequence: TTC
cttctctttcagcctttaga

SEQ ID NO: 110246 - DNA, 20 bp, Artificial Sequence
  Description of Artificial Sequence: Synthetic oligonucleotide
  Target: SCN9A; (+) strand; PAM type: YTN; PAM sequence: CTT
ctctttcagcctttagacta

SEQ ID NO: 110247 - DNA, 20 bp, Artificial Sequence
  Description of Artificial Sequence: Synthetic oligonucleotide
  Target: SCN9A; (+) strand; PAM type: YTN; PAM sequence: TTC
tctttcagcctttagactaa

SEQ ID NO: 110248 - DNA, 20 bp, Artificial Sequence
  Description of Artificial Sequence: Synthetic oligonucleotide
  Target: SCN9A; (+) strand; PAM type: YTN; PAM sequence: CTC
tttcagcctttagactaaaa

SEQ ID NO: 110249 - DNA, 20 bp, Artificial Sequence
  Description of Artificial Sequence: Synthetic oligonucleotide
  Target: SCN9A; (+) strand; PAM type: YTN; PAM sequence: CTT
tcagcctttagactaaaaag

SEQ ID NO: 110250 - DNA, 20 bp, Artificial Sequence
  Description of Artificial Sequence: Synthetic oligonucleotide
  Target: SCN9A; (+) strand; PAM type: YTN; PAM sequence: TTT
cagcctttagactaaaaaga

SEQ ID NO: 110251 - DNA, 20 bp, Artificial Sequence
  Description of Artificial Sequence: Synthetic oligonucleotide
  Target: SCN9A; (+) strand; PAM type: YTN; PAM sequence: TTC
agcctttagactaaaaagaa

SEQ ID NO: 110252 - DNA, 20 bp, Artificial Sequence
  Description of Artificial Sequence: Synthetic oligonucleotide
  Target: SCN9A; (+) strand; PAM type: YTN; PAM sequence: CTT
tagactaaaaagaaaacaaa

SEQ ID NO: 110253 - DNA, 20 bp, Artificial Sequence
  Description of Artificial Sequence: Synthetic oligonucleotide
  Target: SCN9A; (+) strand; PAM type: YTN; PAM sequence: TTT
agactaaaaagaaaacaaat

SEQ ID NO: 110254 - DNA, 20 bp, Artificial Sequence
  Description of Artificial Sequence: Synthetic oligonucleotide
  Target: SCN9A; (+) strand; PAM type: YTN; PAM sequence: TTA
gactaaaaagaaaacaaata

SEQ ID NO: 110255 - DNA, 20 bp, Artificial Sequence
  Description of Artificial Sequence: Synthetic oligonucleotide
  Target: SCN9A; (+) strand; PAM type: YTN; PAM sequence: CTA
aaaagaaaacaaatattaca

SEQ ID NO: 110256 - DNA, 20 bp, Artificial Sequence
  Description of Artificial Sequence: Synthetic oligonucleotide
  Target: SCN9A; (+) strand; PAM type: YTN; PAM sequence: TTA
cataccctgaatctgtgctg

SEQ ID NO: 110257 - DNA, 20 bp, Artificial Sequence
  Description of Artificial Sequence: Synthetic oligonucleotide
  Target: SCN9A; (+) strand; PAM type: YTN; PAM sequence: CTG
aatctgtgctgaaaccacaa

SEQ ID NO: 110258 - DNA, 20 bp, Artificial Sequence
  Description of Artificial Sequence: Synthetic oligonucleotide
  Target: SCN9A; (+) strand; PAM type: YTN; PAM sequence: CTG
tgctgaaaccacaaaggaga

SEQ ID NO: 110259 - DNA, 20 bp, Artificial Sequence
  Description of Artificial Sequence: Synthetic oligonucleotide
  Target: SCN9A; (+) strand; PAM type: YTN; PAM sequence: CTG
aaaccacaaaggagagcatc

SEQ ID NO: 110260 - DNA, 20 bp, Artificial Sequence
  Description of Artificial Sequence: Synthetic oligonucleotide
  Target: SCN9A; (+) strand; PAM type: YTN; PAM sequence: CTT
tggatccttccaagtaataa

SEQ ID NO: 110261 - DNA, 20 bp, Artificial Sequence
  Description of Artificial Sequence: Synthetic oligonucleotide
  Target: SCN9A; (+) strand; PAM type: YTN; PAM sequence: TTT
ggatccttccaagtaataaa

SEQ ID NO: 110262 - DNA, 20 bp, Artificial Sequence
  Description of Artificial Sequence: Synthetic oligonucleotide
  Target: SCN9A; (+) strand; PAM type: YTN; PAM sequence: TTG
gatccttccaagtaataaaa

SEQ ID NO: 110263 - DNA, 20 bp, Artificial Sequence
  Description of Artificial Sequence: Synthetic oligonucleotide
  Target: SCN9A; (+) strand; PAM type: YTN; PAM sequence: CTT
ccaagtaataaaaatattct

SEQ ID NO: 110264 - DNA, 20 bp, Artificial Sequence
  Description of Artificial Sequence: Synthetic oligonucleotide
  Target: SCN9A; (+) strand; PAM type: YTN; PAM sequence: TTC
caagtaataaaaatattctg

SEQ ID NO: 110265 - DNA, 20 bp, Artificial Sequence
  Description of Artificial Sequence: Synthetic oligonucleotide
  Target: SCN9A; (+) strand; PAM type: YTN; PAM sequence: TTC
tgttgaagaagaatttgaac

SEQ ID NO: 110266 - DNA, 20 bp, Artificial Sequence
  Description of Artificial Sequence: Synthetic oligonucleotide
  Target: SCN9A; (+) strand; PAM type: YTN; PAM sequence: CTG
ttgaagaagaatttgaacag

SEQ ID NO: 110267 - DNA, 20 bp, Artificial Sequence
  Description of Artificial Sequence: Synthetic oligonucleotide
  Target: SCN9A; (+) strand; PAM type: YTN; PAM sequence: TTG
aagaagaatttgaacagtta

SEQ ID NO: 110268 - DNA, 20 bp, Artificial Sequence
  Description of Artificial Sequence: Synthetic oligonucleotide
  Target: SCN9A; (+) strand; PAM type: YTN; PAM sequence: TTT
gaacagttataacatcacag

SEQ ID NO: 110269 - DNA, 20 bp, Artificial Sequence
  Description of Artificial Sequence: Synthetic oligonucleotide
  Target: SCN9A; (+) strand; PAM type: YTN; PAM sequence: TTG
aacagttataacatcacaga

SEQ ID NO: 110270 - DNA, 20 bp, Artificial Sequence
  Description of Artificial Sequence: Synthetic oligonucleotide
  Target: SCN9A; (+) strand; PAM type: YTN; PAM sequence: TTA
taacatcacagactttaatc

SEQ ID NO: 110271 - DNA, 20 bp, Artificial Sequence
  Description of Artificial Sequence: Synthetic oligonucleotide
  Target: SCN9A; (+) strand; PAM type: YTN; PAM sequence: CTT
taatctgtgattgtgataaa

SEQ ID NO: 110272 - DNA, 20 bp, Artificial Sequence
  Description of Artificial Sequence: Synthetic oligonucleotide
  Target: SCN9A; (+) strand; PAM type: YTN; PAM sequence: TTT
aatctgtgattgtgataaag

SEQ ID NO: 110273 - DNA, 20 bp, Artificial Sequence
  Description of Artificial Sequence: Synthetic oligonucleotide
  Target: SCN9A; (+) strand; PAM type: YTN; PAM sequence: TTA
atctgtgattgtgataaagg

SEQ ID NO: 110274 - DNA, 20 bp, Artificial Sequence
  Description of Artificial Sequence: Synthetic oligonucleotide
  Target: SCN9A; (+) strand; PAM type: YTN; PAM sequence: CTG
tgattgtgataaaggaggta

SEQ ID NO: 110275 - DNA, 20 bp, Artificial Sequence
  Description of Artificial Sequence: Synthetic oligonucleotide
  Target: SCN9A; (+) strand; PAM type: YTN; PAM sequence: TTG
tgataaaggaggtaaattaa

SEQ ID NO: 110276 - DNA, 20 bp, Artificial Sequence
  Description of Artificial Sequence: Synthetic oligonucleotide
  Target: SCN9A; (+) strand; PAM type: YTN; PAM sequence: TTA
attgatatagacatttatct

SEQ ID NO: 110277 - DNA, 20 bp, Artificial Sequence
  Description of Artificial Sequence: Synthetic oligonucleotide
  Target: SCN9A; (+) strand; PAM type: YTN; PAM sequence: TTG
atatagacatttatctacaa

SEQ ID NO: 110278 - DNA, 20 bp, Artificial Sequence
  Description of Artificial Sequence: Synthetic oligonucleotide
  Target: SCN9A; (+) strand; PAM type: YTN; PAM sequence: TTT
atctacaaattcaggcctgg

SEQ ID NO: 110279 - DNA, 20 bp, Artificial Sequence
  Description of Artificial Sequence: Synthetic oligonucleotide
  Target: SCN9A; (+) strand; PAM type: YTN; PAM sequence: TTA
tctacaaattcaggcctggt

SEQ ID NO: 110280 - DNA, 20 bp, Artificial Sequence
  Description of Artificial Sequence: Synthetic oligonucleotide
  Target: SCN9A; (+) strand; PAM type: YTN; PAM sequence: CTA
caaattcaggcctggtccca

SEQ ID NO: 110281 - DNA, 20 bp, Artificial Sequence
  Description of Artificial Sequence: Synthetic oligonucleotide
  Target: SCN9A; (+) strand; PAM type: YTN; PAM sequence: TTC
aggcctggtcccaggcaata

SEQ ID NO: 110282 - DNA, 20 bp, Artificial Sequence
  Description of Artificial Sequence: Synthetic oligonucleotide
  Target: SCN9A; (+) strand; PAM type: YTN; PAM sequence: CTG
gtcccaggcaatatgcatcc

SEQ ID NO: 110283 - DNA, 20 bp, Artificial Sequence
  Description of Artificial Sequence: Synthetic oligonucleotide
  Target: SCN9A; (+) strand; PAM type: YTN; PAM sequence: TTT
atttactattttctcatata

SEQ ID NO: 110284 - DNA, 20 bp, Artificial Sequence
  Description of Artificial Sequence: Synthetic oligonucleotide
  Target: SCN9A; (+) strand; PAM type: YTN; PAM sequence: TTA
tttactattttctcatatat

SEQ ID NO: 110285 - DNA, 20 bp, Artificial Sequence
  Description of Artificial Sequence: Synthetic oligonucleotide
  Target: SCN9A; (+) strand; PAM type: YTN; PAM sequence: TTT
actattttctcatatattct

SEQ ID NO: 110286 - DNA, 20 bp, Artificial Sequence
  Description of Artificial Sequence: Synthetic oligonucleotide
  Target: SCN9A; (+) strand; PAM type: YTN; PAM sequence: TTA
ctattttctcatatattctc

SEQ ID NO: 110287 - DNA, 20 bp, Artificial Sequence
  Description of Artificial Sequence: Synthetic oligonucleotide
  Target: SCN9A; (+) strand; PAM type: YTN; PAM sequence: CTA
ttttctcatatattctccct

SEQ ID NO: 110288 - DNA, 20 bp, Artificial Sequence
  Description of Artificial Sequence: Synthetic oligonucleotide
  Target: SCN9A; (+) strand; PAM type: YTN; PAM sequence: TTT
tctcatatattctccctcaa

SEQ ID NO: 110289 - DNA, 20 bp, Artificial Sequence
  Description of Artificial Sequence: Synthetic oligonucleotide
  Target: SCN9A; (+) strand; PAM type: YTN; PAM sequence: TTT
ctcatatattctccctcaaa

SEQ ID NO: 110290 - DNA, 20 bp, Artificial Sequence
  Description of Artificial Sequence: Synthetic oligonucleotide
  Target: SCN9A; (+) strand; PAM type: YTN; PAM sequence: TTC
tcatatattctccctcaaat

SEQ ID NO: 110291 - DNA, 20 bp, Artificial Sequence
  Description of Artificial Sequence: Synthetic oligonucleotide
  Target: SCN9A; (+) strand; PAM type: YTN; PAM sequence: CTC
atatattctccctcaaatat

SEQ ID NO: 110292 - DNA, 20 bp, Artificial Sequence
  Description of Artificial Sequence: Synthetic oligonucleotide
  Target: SCN9A; (+) strand; PAM type: YTN; PAM sequence: TTC
tccctcaaatatttattgat

SEQ ID NO: 110293 - DNA, 20 bp, Artificial Sequence
  Description of Artificial Sequence: Synthetic oligonucleotide
  Target: SCN9A; (+) strand; PAM type: YTN; PAM sequence: CTC
cctcaaatatttattgataa

SEQ ID NO: 110294 - DNA, 20 bp, Artificial Sequence
  Description of Artificial Sequence: Synthetic oligonucleotide
  Target: SCN9A; (+) strand; PAM type: YTN; PAM sequence: CTC
aaatatttattgataatctc

SEQ ID NO: 110295 - DNA, 20 bp, Artificial Sequence
  Description of Artificial Sequence: Synthetic oligonucleotide
  Target: SCN9A; (+) strand; PAM type: YTN; PAM sequence: TTT
attgataatctcttagaggc

SEQ ID NO: 110296 - DNA, 20 bp, Artificial Sequence
  Description of Artificial Sequence: Synthetic oligonucleotide
  Target: SCN9A; (+) strand; PAM type: YTN; PAM sequence: TTA
ttgataatctcttagaggct

SEQ ID NO: 110297 - DNA, 20 bp, Artificial Sequence
  Description of Artificial Sequence: Synthetic oligonucleotide
  Target: SCN9A; (+) strand; PAM type: YTN; PAM sequence: TTG
ataatctcttagaggctagg

SEQ ID NO: 110298 - DNA, 20 bp, Artificial Sequence
  Description of Artificial Sequence: Synthetic oligonucleotide
  Target: SCN9A; (+) strand; PAM type: YTN; PAM sequence: CTC
ttagaggctaggcaataaac

SEQ ID NO: 110299 - DNA, 20 bp, Artificial Sequence
  Description of Artificial Sequence: Synthetic oligonucleotide
  Target: SCN9A; (+) strand; PAM type: YTN; PAM sequence: CTT
agaggctaggcaataaacat

SEQ ID NO: 110300 - DNA, 20 bp, Artificial Sequence
  Description of Artificial Sequence: Synthetic oligonucleotide
  Target: SCN9A; (+) strand; PAM type: YTN; PAM sequence: TTA
gaggctaggcaataaacatg

SEQ ID NO: 110301 - DNA, 20 bp, Artificial Sequence
  Description of Artificial Sequence: Synthetic oligonucleotide
  Target: SCN9A; (+) strand; PAM type: YTN; PAM sequence: CTA
ggcaataaacatgacaataa

SEQ ID NO: 110302 - DNA, 20 bp, Artificial Sequence
  Description of Artificial Sequence: Synthetic oligonucleotide
  Target: SCN9A; (+) strand; PAM type: YTN; PAM sequence: TTA
gttttatgagacctccttta

SEQ ID NO: 110303 - DNA, 20 bp, Artificial Sequence
  Description of Artificial Sequence: Synthetic oligonucleotide
  Target: SCN9A; (+) strand; PAM type: YTN; PAM sequence: TTT
tatgagacctcctttatgtt

SEQ ID NO: 110304 - DNA, 20 bp, Artificial Sequence
  Description of Artificial Sequence: Synthetic oligonucleotide
  Target: SCN9A; (+) strand; PAM type: YTN; PAM sequence: TTT
atgagacctcctttatgttt

SEQ ID NO: 110305 - DNA, 20 bp, Artificial Sequence
  Description of Artificial Sequence: Synthetic oligonucleotide
  Target: SCN9A; (+) strand; PAM type: YTN; PAM sequence: TTA
tgagacctcctttatgttta

SEQ ID NO: 110306 - DNA, 20 bp, Artificial Sequence
  Description of Artificial Sequence: Synthetic oligonucleotide
  Target: SCN9A; (+) strand; PAM type: YTN; PAM sequence: CTC
ctttatgtttaggtgagggt

SEQ ID NO: 110307 - DNA, 20 bp, Artificial Sequence
  Description of Artificial Sequence: Synthetic oligonucleotide
  Target: SCN9A; (+) strand; PAM type: YTN; PAM sequence: CTT
tatgtttaggtgagggtgga

SEQ ID NO: 110308 - DNA, 20 bp, Artificial Sequence
  Description of Artificial Sequence: Synthetic oligonucleotide
  Target: SCN9A; (+) strand; PAM type: YTN; PAM sequence: TTT
atgtttaggtgagggtggag

SEQ ID NO: 110309 - DNA, 20 bp, Artificial Sequence
  Description of Artificial Sequence: Synthetic oligonucleotide
  Target: SCN9A; (+) strand; PAM type: YTN; PAM sequence: TTA
tgtttaggtgagggtggagg

SEQ ID NO: 110310 - DNA, 20 bp, Artificial Sequence
  Description of Artificial Sequence: Synthetic oligonucleotide
  Target: SCN9A; (+) strand; PAM type: YTN; PAM sequence: TTT
aggtgagggtggaggttgtg

SEQ ID NO: 110311 - DNA, 20 bp, Artificial Sequence
  Description of Artificial Sequence: Synthetic oligonucleotide
  Target: SCN9A; (+) strand; PAM type: YTN; PAM sequence: TTA
ggtgagggtggaggttgtgg

SEQ ID NO: 110312 - DNA, 20 bp, Artificial Sequence
  Description of Artificial Sequence: Synthetic oligonucleotide
  Target: SCN9A; (+) strand; PAM type: YTN; PAM sequence: TTG
tggttggataaaaatttaag

SEQ ID NO: 110313 - DNA, 20 bp, Artificial Sequence
  Description of Artificial Sequence: Synthetic oligonucleotide
  Target: SCN9A; (+) strand; PAM type: YTN; PAM sequence: TTG
gataaaaatttaagtaaata

SEQ ID NO: 110314 - DNA, 20 bp, Artificial Sequence
  Description of Artificial Sequence: Synthetic oligonucleotide
  Target: SCN9A; (+) strand; PAM type: YTN; PAM sequence: TTT
aagtaaataaataaatatac

SEQ ID NO: 110315 - DNA, 20 bp, Artificial Sequence
  Description of Artificial Sequence: Synthetic oligonucleotide
  Target: SCN9A; (+) strand; PAM type: YTN; PAM sequence: TTA
agtaaataaataaatataca

SEQ ID NO: 110316 - DNA, 20 bp, Artificial Sequence
  Description of Artificial Sequence: Synthetic oligonucleotide
  Target: SCN9A; (+) strand; PAM type: YTN; PAM sequence: TTT
tcagatagtgataaatgatc

SEQ ID NO: 110317 - DNA, 20 bp, Artificial Sequence
  Description of Artificial Sequence: Synthetic oligonucleotide
  Target: SCN9A; (+) strand; PAM type: YTN; PAM sequence: TTT
cagatagtgataaatgatct

SEQ ID NO: 110318 - DNA, 20 bp, Artificial Sequence
  Description of Artificial Sequence: Synthetic oligonucleotide
  Target: SCN9A; (+) strand; PAM type: YTN; PAM sequence: TTC
agatagtgataaatgatcta

SEQ ID NO: 110319 - DNA, 20 bp, Artificial Sequence
  Description of Artificial Sequence: Synthetic oligonucleotide
  Target: SCN9A; (+) strand; PAM type: YTN; PAM sequence: CTA
aagaaaataaattaaggcaa

SEQ ID NO: 110320 - DNA, 20 bp, Artificial Sequence
  Description of Artificial Sequence: Synthetic oligonucleotide
  Target: SCN9A; (+) strand; PAM type: YTN; PAM sequence: TTA
aggcaacgtggtaggctgca

SEQ ID NO: 110321 - DNA, 20 bp, Artificial Sequence
  Description of Artificial Sequence: Synthetic oligonucleotide
  Target: SCN9A; (+) strand; PAM type: YTN; PAM sequence: CTG
cagtcagggacggtctttct

SEQ ID NO: 110322 - DNA, 20 bp, Artificial Sequence
  Description of Artificial Sequence: Synthetic oligonucleotide
  Target: SCN9A; (+) strand; PAM type: YTN; PAM sequence: CTT
tctaaggagatgatatttaa

SEQ ID NO: 110323 - DNA, 20 bp, Artificial Sequence
  Description of Artificial Sequence: Synthetic oligonucleotide
  Target: SCN9A; (+) strand; PAM type: YTN; PAM sequence: TTT
ctaaggagatgatatttaaa

SEQ ID NO: 110324 - DNA, 20 bp, Artificial Sequence
  Description of Artificial Sequence: Synthetic oligonucleotide
  Target: SCN9A; (+) strand; PAM type: YTN; PAM sequence: TTC
taaggagatgatatttaaac

SEQ ID NO: 110325 - DNA, 20 bp, Artificial Sequence
  Description of Artificial Sequence: Synthetic oligonucleotide
  Target: SCN9A; (+) strand; PAM type: YTN; PAM sequence: CTA
aggagatgatatttaaacta

SEQ ID NO: 110326 - DNA, 20 bp, Artificial Sequence
  Description of Artificial Sequence: Synthetic oligonucleotide
  Target: SCN9A; (+) strand; PAM type: YTN; PAM sequence: TTT
aaactaagacctaagtgtga

SEQ ID NO: 110327 - DNA, 20 bp, Artificial Sequence
  Description of Artificial Sequence: Synthetic oligonucleotide
  Target: SCN9A; (+) strand; PAM type: YTN; PAM sequence: TTA
aactaagacctaagtgtgac

SEQ ID NO: 110328 - DNA, 20 bp, Artificial Sequence
  Description of Artificial Sequence: Synthetic oligonucleotide
  Target: SCN9A; (+) strand; PAM type: YTN; PAM sequence: CTA
agacctaagtgtgacaaaga

SEQ ID NO: 110329 - DNA, 20 bp, Artificial Sequence
  Description of Artificial Sequence: Synthetic oligonucleotide
  Target: SCN9A; (+) strand; PAM type: YTN; PAM sequence: CTA
agtgtgacaaagaagacagc

SEQ ID NO: 110330 - DNA, 20 bp, Artificial Sequence
  Description of Artificial Sequence: Synthetic oligonucleotide
  Target: SCN9A; (+) strand; PAM type: YTN; PAM sequence: CTG
gtgaagagatatttgggctg

SEQ ID NO: 110331 - DNA, 20 bp, Artificial Sequence
  Description of Artificial Sequence: Synthetic oligonucleotide
  Target: SCN9A; (+) strand; PAM type: YTN; PAM sequence: TTT
gggctgggggaagagaaaga

SEQ ID NO: 110332 - DNA, 20 bp, Artificial Sequence
  Description of Artificial Sequence: Synthetic oligonucleotide
  Target: SCN9A; (+) strand; PAM type: YTN; PAM sequence: TTG
ggctgggggaagagaaagaa

SEQ ID NO: 110333 - DNA, 20 bp, Artificial Sequence
  Description of Artificial Sequence: Synthetic oligonucleotide
  Target: SCN9A; (+) strand; PAM type: YTN; PAM sequence: CTG
ggggaagagaaagaactaaa

SEQ ID NO: 110334 - DNA, 20 bp, Artificial Sequence
  Description of Artificial Sequence: Synthetic oligonucleotide
  Target: SCN9A; (+) strand; PAM type: YTN; PAM sequence: CTA
aagccctaaggcagagatga

SEQ ID NO: 110335 - DNA, 20 bp, Artificial Sequence
  Description of Artificial Sequence: Synthetic oligonucleotide
  Target: SCN9A; (+) strand; PAM type: YTN; PAM sequence: CTA
aggcagagatgaagttggtg

SEQ ID NO: 110336 - DNA, 20 bp, Artificial Sequence
  Description of Artificial Sequence: Synthetic oligonucleotide
  Target: SCN9A; (+) strand; PAM type: YTN; PAM sequence: TTG
gtgtgtggaaaagccagcaa

SEQ ID NO: 110337 - DNA, 20 bp, Artificial Sequence
  Description of Artificial Sequence: Synthetic oligonucleotide
  Target: SCN9A; (+) strand; PAM type: YTN; PAM sequence: CTA
cagtgtggtgagagggagga

SEQ ID NO: 110338 - DNA, 20 bp, Artificial Sequence
  Description of Artificial Sequence: Synthetic oligonucleotide
  Target: SCN9A; (+) strand; PAM type: YTN; PAM sequence: TTG
tgatggcagaggtaggcagg

SEQ ID NO: 110339 - DNA, 20 bp, Artificial Sequence
  Description of Artificial Sequence: Synthetic oligonucleotide
  Target: SCN9A; (+) strand; PAM type: YTN; PAM sequence: TTT
gcatatcatagaaatgagtt

SEQ ID NO: 110340 - DNA, 20 bp, Artificial Sequence
  Description of Artificial Sequence: Synthetic oligonucleotide
  Target: SCN9A; (+) strand; PAM type: YTN; PAM sequence: TTG
catatcatagaaatgagttt

SEQ ID NO: 110341 - DNA, 20 bp, Artificial Sequence
  Description of Artificial Sequence: Synthetic oligonucleotide
  Target: SCN9A; (+) strand; PAM type: YTN; PAM sequence: TTT
ggattttaagtatgattaaa

SEQ ID NO: 110342 - DNA, 20 bp, Artificial Sequence
  Description of Artificial Sequence: Synthetic oligonucleotide
  Target: SCN9A; (+) strand; PAM type: YTN; PAM sequence: TTG
gattttaagtatgattaaag

SEQ ID NO: 110343 - DNA, 20 bp, Artificial Sequence
  Description of Artificial Sequence: Synthetic oligonucleotide
  Target: SCN9A; (+) strand; PAM type: YTN; PAM sequence: TTT
taagtatgattaaaggtacg

SEQ ID NO: 110344 - DNA, 20 bp, Artificial Sequence
  Description of Artificial Sequence: Synthetic oligonucleotide
  Target: SCN9A; (+) strand; PAM type: YTN; PAM sequence: TTT
aagtatgattaaaggtacgg

SEQ ID NO: 110345 - DNA, 20 bp, Artificial Sequence
  Description of Artificial Sequence: Synthetic oligonucleotide
  Target: SCN9A; (+) strand; PAM type: YTN; PAM sequence: TTA
agtatgattaaaggtacggt

SEQ ID NO: 110346 - DNA, 20 bp, Artificial Sequence
  Description of Artificial Sequence: Synthetic oligonucleotide
  Target: SCN9A; (+) strand; PAM type: YTN; PAM sequence: TTA
aaggtacggtcatgtgtcac

SEQ ID NO: 110347 - DNA, 20 bp, Artificial Sequence
  Description of Artificial Sequence: Synthetic oligonucleotide
  Target: SCN9A; (+) strand; PAM type: YTN; PAM sequence: CTT
aatgactgtgatacattctg

SEQ ID NO: 110348 - DNA, 20 bp, Artificial Sequence
  Description of Artificial Sequence: Synthetic oligonucleotide
  Target: SCN9A; (+) strand; PAM type: YTN; PAM sequence: TTA
atgactgtgatacattctga

SEQ ID NO: 110349 - DNA, 20 bp, Artificial Sequence
  Description of Artificial Sequence: Synthetic oligonucleotide
  Target: SCN9A; (+) strand; PAM type: YTN; PAM sequence: CTG
tgatacattctgagaaatgc

SEQ ID NO: 110350 - DNA, 20 bp, Artificial Sequence
  Description of Artificial Sequence: Synthetic oligonucleotide
  Target: SCN9A; (+) strand; PAM type: YTN; PAM sequence: TTC
tgagaaatgcatcattagga

SEQ ID NO: 110351 - DNA, 20 bp, Artificial Sequence
  Description of Artificial Sequence: Synthetic oligonucleotide
  Target: SCN9A; (+) strand; PAM type: YTN; PAM sequence: CTG
agaaatgcatcattaggacg

SEQ ID NO: 110352 - DNA, 20 bp, Artificial Sequence
  Description of Artificial Sequence: Synthetic oligonucleotide
  Target: SCN9A; (+) strand; PAM type: YTN; PAM sequence: TTA
ggacgtttcgtccttgtgca

SEQ ID NO: 110353 - DNA, 20 bp, Artificial Sequence
  Description of Artificial Sequence: Synthetic oligonucleotide
  Target: SCN9A; (+) strand; PAM type: YTN; PAM sequence: TTT
cgtccttgtgcaaacatcct

SEQ ID NO: 110354 - DNA, 20 bp, Artificial Sequence
  Description of Artificial Sequence: Synthetic oligonucleotide
  Target: SCN9A; (+) strand; PAM type: YTN; PAM sequence: TTC
gtccttgtgcaaacatccta

SEQ ID NO: 110355 - DNA, 20 bp, Artificial Sequence
  Description of Artificial Sequence: Synthetic oligonucleotide
  Target: SCN9A; (+) strand; PAM type: YTN; PAM sequence: CTT
gtgcaaacatcctagggtgc

SEQ ID NO: 110356 - DNA, 20 bp, Artificial Sequence
  Description of Artificial Sequence: Synthetic oligonucleotide
  Target: SCN9A; (+) strand; PAM type: YTN; PAM sequence: TTG
tgcaaacatcctagggtgca

SEQ ID NO: 110357 - DNA, 20 bp, Artificial Sequence
  Description of Artificial Sequence: Synthetic oligonucleotide
  Target: SCN9A; (+) strand; PAM type: YTN; PAM sequence: CTA
gggtgcacttatacaaacct

SEQ ID NO: 110358 - DNA, 20 bp, Artificial Sequence
  Description of Artificial Sequence: Synthetic oligonucleotide
  Target: SCN9A; (+) strand; PAM type: YTN; PAM sequence: CTT
atacaaacctagatggtata

SEQ ID NO: 110359 - DNA, 20 bp, Artificial Sequence
  Description of Artificial Sequence: Synthetic oligonucleotide
  Target: SCN9A; (+) strand; PAM type: YTN; PAM sequence: TTA
tacaaacctagatggtatag

SEQ ID NO: 110360 - DNA, 20 bp, Artificial Sequence
  Description of Artificial Sequence: Synthetic oligonucleotide
  Target: SCN9A; (+) strand; PAM type: YTN; PAM sequence: CTA
gatggtataggctaccatac

SEQ ID NO: 110361 - DNA, 20 bp, Artificial Sequence
  Description of Artificial Sequence: Synthetic oligonucleotide
  Target: SCN9A; (+) strand; PAM type: YTN; PAM sequence: CTA
ccatacacctaggctatgtg

SEQ ID NO: 110362 - DNA, 20 bp, Artificial Sequence
  Description of Artificial Sequence: Synthetic oligonucleotide
  Target: SCN9A; (+) strand; PAM type: YTN; PAM sequence: CTA
ggctatgtggtatagcctat

SEQ ID NO: 110363 - DNA, 20 bp, Artificial Sequence
  Description of Artificial Sequence: Synthetic oligonucleotide
  Target: SCN9A; (+) strand; PAM type: YTN; PAM sequence: CTA
tgtggtatagcctattgctc

SEQ ID NO: 110364 - DNA, 20 bp, Artificial Sequence
  Description of Artificial Sequence: Synthetic oligonucleotide
  Target: SCN9A; (+) strand; PAM type: YTN; PAM sequence: CTA
ttgctcctgggctgcaaacc

SEQ ID NO: 110365 - DNA, 20 bp, Artificial Sequence
  Description of Artificial Sequence: Synthetic oligonucleotide
  Target: SCN9A; (+) strand; PAM type: YTN; PAM sequence: TTG
ctcctgggctgcaaacctgt

SEQ ID NO: 110366 - DNA, 20 bp, Artificial Sequence
  Description of Artificial Sequence: Synthetic oligonucleotide
  Target: SCN9A; (+) strand; PAM type: YTN; PAM sequence: CTC
ctgggctgcaaacctgtaga

SEQ ID NO: 110367 - DNA, 20 bp, Artificial Sequence
  Description of Artificial Sequence: Synthetic oligonucleotide
  Target: SCN9A; (+) strand; PAM type: YTN; PAM sequence: CTG
ggctgcaaacctgtagagtg

SEQ ID NO: 110368 - DNA, 20 bp, Artificial Sequence
  Description of Artificial Sequence: Synthetic oligonucleotide
  Target: SCN9A; (+) strand; PAM type: YTN; PAM sequence: CTG
caaacctgtagagtgggcta

SEQ ID NO: 110369 - DNA, 20 bp, Artificial Sequence
  Description of Artificial Sequence: Synthetic oligonucleotide
  Target: SCN9A; (+) strand; PAM type: YTN; PAM sequence: CTG
tagagtgggctactgtactc

SEQ ID NO: 110370 - DNA, 20 bp, Artificial Sequence
  Description of Artificial Sequence: Synthetic oligonucleotide
  Target: SCN9A; (+) strand; PAM type: YTN; PAM sequence: CTA
ctgtactcaatattgtaggc

SEQ ID NO: 110371 - DNA, 20 bp, Artificial Sequence
  Description of Artificial Sequence: Synthetic oligonucleotide
  Target: SCN9A; (+) strand; PAM type: YTN; PAM sequence: CTG
tactcaatattgtaggcaac

SEQ ID NO: 110372 - DNA, 20 bp, Artificial Sequence
  Description of Artificial Sequence: Synthetic oligonucleotide
  Target: SCN9A; (+) strand; PAM type: YTN; PAM sequence: CTC
aatattgtaggcaactgtta

SEQ ID NO: 110373 - DNA, 20 bp, Artificial Sequence
  Description of Artificial Sequence: Synthetic oligonucleotide
  Target: SCN9A; (+) strand; PAM type: YTN; PAM sequence: TTG
taggcaactgttatacaatg

SEQ ID NO: 110374 - DNA, 20 bp, Artificial Sequence
  Description of Artificial Sequence: Synthetic oligonucleotide
  Target: SCN9A; (+) strand; PAM type: YTN; PAM sequence: CTG
ttatacaatggaaagtgtgt

SEQ ID NO: 110375 - DNA, 20 bp, Artificial Sequence
  Description of Artificial Sequence: Synthetic oligonucleotide
  Target: SCN9A; (+) strand; PAM type: YTN; PAM sequence: TTA
tacaatggaaagtgtgtatc

SEQ ID NO: 110376 - DNA, 20 bp, Artificial Sequence
  Description of Artificial Sequence: Synthetic oligonucleotide
  Target: SCN9A; (+) strand; PAM type: YTN; PAM sequence: CTA
aagacagaaaaggtacagta

SEQ ID NO: 110377 - DNA, 20 bp, Artificial Sequence
  Description of Artificial Sequence: Synthetic oligonucleotide
  Target: SCN9A; (+) strand; PAM type: YTN; PAM sequence: TTA
taatcttatgagatcaccat

SEQ ID NO: 110378 - DNA, 20 bp, Artificial Sequence
  Description of Artificial Sequence: Synthetic oligonucleotide
  Target: SCN9A; (+) strand; PAM type: YTN; PAM sequence: CTT
atgagatcaccattatatat

SEQ ID NO: 110379 - DNA, 20 bp, Artificial Sequence
  Description of Artificial Sequence: Synthetic oligonucleotide
  Target: SCN9A; (+) strand; PAM type: YTN; PAM sequence: TTA
tgagatcaccattatatata

SEQ ID NO: 110380 - DNA, 20 bp, Artificial Sequence
  Description of Artificial Sequence: Synthetic oligonucleotide
  Target: SCN9A; (+) strand; PAM type: YTN; PAM sequence: TTA
tatatatggtccgctattga

SEQ ID NO: 110381 - DNA, 20 bp, Artificial Sequence
  Description of Artificial Sequence: Synthetic oligonucleotide
  Target: SCN9A; (+) strand; PAM type: YTN; PAM sequence: CTA
ttgactaaaacatccttatg

SEQ ID NO: 110382 - DNA, 20 bp, Artificial Sequence
  Description of Artificial Sequence: Synthetic oligonucleotide
  Target: SCN9A; (+) strand; PAM type: YTN; PAM sequence: TTG
actaaaacatccttatgtgg

SEQ ID NO: 110383 - DNA, 20 bp, Artificial Sequence
  Description of Artificial Sequence: Synthetic oligonucleotide
  Target: SCN9A; (+) strand; PAM type: YTN; PAM sequence: CTA
aaacatccttatgtggtaca

SEQ ID NO: 110384 - DNA, 20 bp, Artificial Sequence
  Description of Artificial Sequence: Synthetic oligonucleotide
  Target: SCN9A; (+) strand; PAM type: YTN; PAM sequence: CTT
atgtggtacaatactccgga

SEQ ID NO: 110385 - DNA, 20 bp, Artificial Sequence
  Description of Artificial Sequence: Synthetic oligonucleotide
  Target: SCN9A; (+) strand; PAM type: YTN; PAM sequence: TTA
tgtggtacaatactccggaa

SEQ ID NO: 110386 - DNA, 20 bp, Artificial Sequence
  Description of Artificial Sequence: Synthetic oligonucleotide
  Target: SCN9A; (+) strand; PAM type: YTN; PAM sequence: CTC
cggaagaggcagactcagta

SEQ ID NO: 110387 - DNA, 20 bp, Artificial Sequence
  Description of Artificial Sequence: Synthetic oligonucleotide
  Target: SCN9A; (+) strand; PAM type: YTN; PAM sequence: CTC
agtaaggcagtaacataagt

SEQ ID NO: 110388 - DNA, 20 bp, Artificial Sequence
  Description of Artificial Sequence: Synthetic oligonucleotide
  Target: SCN9A; (+) strand; PAM type: YTN; PAM sequence: TTT
gttttctaaaattatcttac

SEQ ID NO: 110389 - DNA, 20 bp, Artificial Sequence
  Description of Artificial Sequence: Synthetic oligonucleotide
  Target: SCN9A; (+) strand; PAM type: YTN; PAM sequence: TTG
ttttctaaaattatcttact

SEQ ID NO: 110390 - DNA, 20 bp, Artificial Sequence
  Description of Artificial Sequence: Synthetic oligonucleotide
  Target: SCN9A; (+) strand; PAM type: YTN; PAM sequence: TTT
tctaaaattatcttactttt

SEQ ID NO: 110391 - DNA, 20 bp, Artificial Sequence
  Description of Artificial Sequence: Synthetic oligonucleotide
  Target: SCN9A; (+) strand; PAM type: YTN; PAM sequence: TTT
ctaaaattatcttacttttc

SEQ ID NO: 110392 - DNA, 20 bp, Artificial Sequence
  Description of Artificial Sequence: Synthetic oligonucleotide
  Target: SCN9A; (+) strand; PAM type: YTN; PAM sequence: TTC
taaaattatcttacttttca

SEQ ID NO: 110393 - DNA, 20 bp, Artificial Sequence
  Description of Artificial Sequence: Synthetic oligonucleotide
  Target: SCN9A; (+) strand; PAM type: YTN; PAM sequence: CTA
aaattatcttacttttcatt

SEQ ID NO: 110394 - DNA, 20 bp, Artificial Sequence
  Description of Artificial Sequence: Synthetic oligonucleotide
  Target: SCN9A; (+) strand; PAM type: YTN; PAM sequence: TTA
tcttacttttcattcaccag

SEQ ID NO: 110395 - DNA, 20 bp, Artificial Sequence
  Description of Artificial Sequence: Synthetic oligonucleotide
  Target: SCN9A; (+) strand; PAM type: YTN; PAM sequence: CTT
acttttcattcaccagtcca

SEQ ID NO: 110396 - DNA, 20 bp, Artificial Sequence
  Description of Artificial Sequence: Synthetic oligonucleotide
  Target: SCN9A; (+) strand; PAM type: YTN; PAM sequence: TTA
cttttcattcaccagtccat

SEQ ID NO: 110397 - DNA, 20 bp, Artificial Sequence
  Description of Artificial Sequence: Synthetic oligonucleotide
  Target: SCN9A; (+) strand; PAM type: YTN; PAM sequence: CTT
ttcattcaccagtccatact

SEQ ID NO: 110398 - DNA, 20 bp, Artificial Sequence
  Description of Artificial Sequence: Synthetic oligonucleotide
  Target: SCN9A; (+) strand; PAM type: YTN; PAM sequence: TTT
tcattcaccagtccatactt

SEQ ID NO: 110399 - DNA, 20 bp, Artificial Sequence
  Description of Artificial Sequence: Synthetic oligonucleotide
  Target: SCN9A; (+) strand; PAM type: YTN; PAM sequence: TTT
cattcaccagtccatactta

SEQ ID NO: 110400 - DNA, 20 bp, Artificial Sequence
  Description of Artificial Sequence: Synthetic oligonucleotide
  Target: SCN9A; (+) strand; PAM type: YTN; PAM sequence: TTC
attcaccagtccatacttac

SEQ ID NO: 110401 - DNA, 20 bp, Artificial Sequence
  Description of Artificial Sequence: Synthetic oligonucleotide
  Target: SCN9A; (+) strand; PAM type: YTN; PAM sequence: TTC
accagtccatacttacttag

SEQ ID NO: 110402 - DNA, 20 bp, Artificial Sequence
  Description of Artificial Sequence: Synthetic oligonucleotide
  Target: SCN9A; (+) strand; PAM type: YTN; PAM sequence: CTT
acttaggacctactaattct

SEQ ID NO: 110403 - DNA, 20 bp, Artificial Sequence
  Description of Artificial Sequence: Synthetic oligonucleotide
  Target: SCN9A; (+) strand; PAM type: YTN; PAM sequence: TTA
cttaggacctactaattcta

SEQ ID NO: 110404 - DNA, 20 bp, Artificial Sequence
  Description of Artificial Sequence: Synthetic oligonucleotide
  Target: SCN9A; (+) strand; PAM type: YTN; PAM sequence: CTT
aggacctactaattctaggt

SEQ ID NO: 110405 - DNA, 20 bp, Artificial Sequence
  Description of Artificial Sequence: Synthetic oligonucleotide
  Target: SCN9A; (+) strand; PAM type: YTN; PAM sequence: TTA
ggacctactaattctaggtg

SEQ ID NO: 110406 - DNA, 20 bp, Artificial Sequence
  Description of Artificial Sequence: Synthetic oligonucleotide
  Target: SCN9A; (+) strand; PAM type: YTN; PAM sequence: CTA
ctaattctaggtgttgagga

SEQ ID NO: 110407 - DNA, 20 bp, Artificial Sequence
  Description of Artificial Sequence: Synthetic oligonucleotide
  Target: SCN9A; (+) strand; PAM type: YTN; PAM sequence: CTA
attctaggtgttgaggagat

SEQ ID NO: 110408 - DNA, 20 bp, Artificial Sequence
  Description of Artificial Sequence: Synthetic oligonucleotide
  Target: SCN9A; (+) strand; PAM type: YTN; PAM sequence: TTC
taggtgttgaggagatgaca

SEQ ID NO: 110409 - DNA, 20 bp, Artificial Sequence
  Description of Artificial Sequence: Synthetic oligonucleotide
  Target: SCN9A; (+) strand; PAM type: YTN; PAM sequence: CTA
ggtgttgaggagatgacaat

SEQ ID NO: 110410 - DNA, 20 bp, Artificial Sequence
  Description of Artificial Sequence: Synthetic oligonucleotide
  Target: SCN9A; (+) strand; PAM type: YTN; PAM sequence: TTG
aggagatgacaatgtaatca

SEQ ID NO: 110411 - DNA, 20 bp, Artificial Sequence
  Description of Artificial Sequence: Synthetic oligonucleotide
  Target: SCN9A; (+) strand; PAM type: YTN; PAM sequence: TTT
tccatgtttcacctttcatg

SEQ ID NO: 110412 - DNA, 20 bp, Artificial Sequence
  Description of Artificial Sequence: Synthetic oligonucleotide
  Target: SCN9A; (+) strand; PAM type: YTN; PAM sequence: TTT
ccatgtttcacctttcatgg

SEQ ID NO: 110413 - DNA, 20 bp, Artificial Sequence
  Description of Artificial Sequence: Synthetic oligonucleotide
  Target: SCN9A; (+) strand; PAM type: YTN; PAM sequence: TTC
catgtttcacctttcatggt

SEQ ID NO: 110414 - DNA, 20 bp, Artificial Sequence
  Description of Artificial Sequence: Synthetic oligonucleotide
  Target: SCN9A; (+) strand; PAM type: YTN; PAM sequence: TTT
cacctttcatggtattcttt

SEQ ID NO: 110415 - DNA, 20 bp, Artificial Sequence
  Description of Artificial Sequence: Synthetic oligonucleotide
  Target: SCN9A; (+) strand; PAM type: YTN; PAM sequence: TTC
acctttcatggtattctttg

SEQ ID NO: 110416 - DNA, 20 bp, Artificial Sequence
  Description of Artificial Sequence: Synthetic oligonucleotide
  Target: SCN9A; (+) strand; PAM type: YTN; PAM sequence: CTT
tcatggtattctttgtgcta

SEQ ID NO: 110417 - DNA, 20 bp, Artificial Sequence
  Description of Artificial Sequence: Synthetic oligonucleotide
  Target: SCN9A; (+) strand; PAM type: YTN; PAM sequence: TTT
catggtattctttgtgctaa

SEQ ID NO: 110418 - DNA, 20 bp, Artificial Sequence
  Description of Artificial Sequence: Synthetic oligonucleotide
  Target: SCN9A; (+) strand; PAM type: YTN; PAM sequence: TTC
atggtattctttgtgctaat

SEQ ID NO: 110419 - DNA, 20 bp, Artificial Sequence
  Description of Artificial Sequence: Synthetic oligonucleotide
  Target: SCN9A; (+) strand; PAM type: YTN; PAM sequence: TTC
tttgtgctaatttttagtag

SEQ ID NO: 110420 - DNA, 20 bp, Artificial Sequence
  Description of Artificial Sequence: Synthetic oligonucleotide
  Target: SCN9A; (+) strand; PAM type: YTN; PAM sequence: CTT
tgtgctaatttttagtagta

SEQ ID NO: 110421 - DNA, 20 bp, Artificial Sequence
  Description of Artificial Sequence: Synthetic oligonucleotide
  Target: SCN9A; (+) strand; PAM type: YTN; PAM sequence: TTT
gtgctaatttttagtagtaa

SEQ ID NO: 110422 - DNA, 20 bp, Artificial Sequence
  Description of Artificial Sequence: Synthetic oligonucleotide
  Target: SCN9A; (+) strand; PAM type: YTN; PAM sequence: TTG
tgctaatttttagtagtaaa

SEQ ID NO: 110423 - DNA, 20 bp, Artificial Sequence
  Description of Artificial Sequence: Synthetic oligonucleotide
  Target: SCN9A; (+) strand; PAM type: YTN; PAM sequence: CTA
atttttagtagtaaaagttc

SEQ ID NO: 110424 - DNA, 20 bp, Artificial Sequence
  Description of Artificial Sequence: Synthetic oligonucleotide
  Target: SCN9A; (+) strand; PAM type: YTN; PAM sequence: TTT
ttagtagtaaaagttctcat

SEQ ID NO: 110425 - DNA, 20 bp, Artificial Sequence
  Description of Artificial Sequence: Synthetic oligonucleotide
  Target: SCN9A; (+) strand; PAM type: YTN; PAM sequence: TTT
tagtagtaaaagttctcatc

SEQ ID NO: 110426 - DNA, 20 bp, Artificial Sequence
  Description of Artificial Sequence: Synthetic oligonucleotide
  Target: SCN9A; (+) strand; PAM type: YTN; PAM sequence: TTT
agtagtaaaagttctcatca

SEQ ID NO: 110427 - DNA, 20 bp, Artificial Sequence
  Description of Artificial Sequence: Synthetic oligonucleotide
  Target: SCN9A; (+) strand; PAM type: YTN; PAM sequence: TTA
gtagtaaaagttctcatcaa

SEQ ID NO: 110428 - DNA, 20 bp, Artificial Sequence
  Description of Artificial Sequence: Synthetic oligonucleotide
  Target: SCN9A; (+) strand; PAM type: YTN; PAM sequence: TTC
tcatcaactcttctgtcatt

SEQ ID NO: 110429 - DNA, 20 bp, Artificial Sequence
  Description of Artificial Sequence: Synthetic oligonucleotide
  Target: SCN9A; (+) strand; PAM type: YTN; PAM sequence: CTC
atcaactcttctgtcatttg

SEQ ID NO: 110430 - DNA, 20 bp, Artificial Sequence
  Description of Artificial Sequence: Synthetic oligonucleotide
  Target: SCN9A; (+) strand; PAM type: YTN; PAM sequence: CTC
ttctgtcatttgctgttaag

SEQ ID NO: 110431 - DNA, 20 bp, Artificial Sequence
  Description of Artificial Sequence: Synthetic oligonucleotide
  Target: SCN9A; (+) strand; PAM type: YTN; PAM sequence: CTT
ctgtcatttgctgttaaggc

SEQ ID NO: 110432 - DNA, 20 bp, Artificial Sequence
  Description of Artificial Sequence: Synthetic oligonucleotide
  Target: SCN9A; (+) strand; PAM type: YTN; PAM sequence: TTC
tgtcatttgctgttaaggct

SEQ ID NO: 110433 - DNA, 20 bp, Artificial Sequence
  Description of Artificial Sequence: Synthetic oligonucleotide
  Target: SCN9A; (+) strand; PAM type: YTN; PAM sequence: CTG
tcatttgctgttaaggcttg

SEQ ID NO: 110434 - DNA, 20 bp, Artificial Sequence
  Description of Artificial Sequence: Synthetic oligonucleotide
  Target: SCN9A; (+) strand; PAM type: YTN; PAM sequence: TTT
gctgttaaggcttgttccta

SEQ ID NO: 110435 - DNA, 20 bp, Artificial Sequence
  Description of Artificial Sequence: Synthetic oligonucleotide
  Target: SCN9A; (+) strand; PAM type: YTN; PAM sequence: TTG
ctgttaaggcttgttcctaa

SEQ ID NO: 110436 - DNA, 20 bp, Artificial Sequence
  Description of Artificial Sequence: Synthetic oligonucleotide
  Target: SCN9A; (+) strand; PAM type: YTN; PAM sequence: CTG
ttaaggcttgttcctaagac

SEQ ID NO: 110437 - DNA, 20 bp, Artificial Sequence
  Description of Artificial Sequence: Synthetic oligonucleotide
  Target: SCN9A; (+) strand; PAM type: YTN; PAM sequence: TTA
aggcttgttcctaagactgg

SEQ ID NO: 110438 - DNA, 20 bp, Artificial Sequence
  Description of Artificial Sequence: Synthetic oligonucleotide
  Target: SCN9A; (+) strand; PAM type: YTN; PAM sequence: CTT
gttcctaagactgggggcag

SEQ ID NO: 110439 - DNA, 20 bp, Artificial Sequence
  Description of Artificial Sequence: Synthetic oligonucleotide
  Target: SCN9A; (+) strand; PAM type: YTN; PAM sequence: TTG
ttcctaagactgggggcaga

SEQ ID NO: 110440 - DNA, 20 bp, Artificial Sequence
  Description of Artificial Sequence: Synthetic oligonucleotide
  Target: SCN9A; (+) strand; PAM type: YTN; PAM sequence: TTC
ctaagactgggggcagatct

SEQ ID NO: 110441 - DNA, 20 bp, Artificial Sequence
  Description of Artificial Sequence: Synthetic oligonucleotide
  Target: SCN9A; (+) strand; PAM type: YTN; PAM sequence: CTA
agactgggggcagatctatc

SEQ ID NO: 110442 - DNA, 20 bp, Artificial Sequence
  Description of Artificial Sequence: Synthetic oligonucleotide
  Target: SCN9A; (+) strand; PAM type: YTN; PAM sequence: CTG
ggggcagatctatccttgta

SEQ ID NO: 110443 - DNA, 20 bp, Artificial Sequence
  Description of Artificial Sequence: Synthetic oligonucleotide
  Target: SCN9A; (+) strand; PAM type: YTN; PAM sequence: CTA
tccttgtatagtaaatgttt

SEQ ID NO: 110444 - DNA, 20 bp, Artificial Sequence
  Description of Artificial Sequence: Synthetic oligonucleotide
  Target: SCN9A; (+) strand; PAM type: YTN; PAM sequence: CTT
gtatagtaaatgtttaaatg

SEQ ID NO: 110445 - DNA, 20 bp, Artificial Sequence
  Description of Artificial Sequence: Synthetic oligonucleotide
  Target: SCN9A; (+) strand; PAM type: YTN; PAM sequence: TTG
tatagtaaatgtttaaatga

SEQ ID NO: 110446 - DNA, 20 bp, Artificial Sequence
  Description of Artificial Sequence: Synthetic oligonucleotide
  Target: SCN9A; (+) strand; PAM type: YTN; PAM sequence: TTT
aaatgactaaaaaacctttt

SEQ ID NO: 110447 - DNA, 20 bp, Artificial Sequence
  Description of Artificial Sequence: Synthetic oligonucleotide
  Target: SCN9A; (+) strand; PAM type: YTN; PAM sequence: TTA
aatgactaaaaaaccttttg

SEQ ID NO: 110448 - DNA, 20 bp, Artificial Sequence
  Description of Artificial Sequence: Synthetic oligonucleotide
  Target: SCN9A; (+) strand; PAM type: YTN; PAM sequence: CTA
aaaaaccttttgtcatctct

SEQ ID NO: 110449 - DNA, 20 bp, Artificial Sequence
  Description of Artificial Sequence: Synthetic oligonucleotide
  Target: SCN9A; (+) strand; PAM type: YTN; PAM sequence: CTT
ttgtcatctctcttaaatat

SEQ ID NO: 110450 - DNA, 20 bp, Artificial Sequence
  Description of Artificial Sequence: Synthetic oligonucleotide
  Target: SCN9A; (+) strand; PAM type: YTN; PAM sequence: TTT
tgtcatctctcttaaatatc

SEQ ID NO: 110451 - DNA, 20 bp, Artificial Sequence
  Description of Artificial Sequence: Synthetic oligonucleotide
  Target: SCN9A; (+) strand; PAM type: YTN; PAM sequence: TTT
gtcatctctcttaaatatct

SEQ ID NO: 110452 - DNA, 20 bp, Artificial Sequence
  Description of Artificial Sequence: Synthetic oligonucleotide
  Target: SCN9A; (+) strand; PAM type: YTN; PAM sequence: TTG
tcatctctcttaaatatcta

SEQ ID NO: 110453 - DNA, 20 bp, Artificial Sequence
  Description of Artificial Sequence: Synthetic oligonucleotide
  Target: SCN9A; (+) strand; PAM type: YTN; PAM sequence: CTC
tcttaaatatctattctact

SEQ ID NO: 110454 - DNA, 20 bp, Artificial Sequence
  Description of Artificial Sequence: Synthetic oligonucleotide
  Target: SCN9A; (+) strand; PAM type: YTN; PAM sequence: CTC
ttaaatatctattctactat

SEQ ID NO: 110455 - DNA, 20 bp, Artificial Sequence
  Description of Artificial Sequence: Synthetic oligonucleotide
  Target: SCN9A; (+) strand; PAM type: YTN; PAM sequence: CTT
aaatatctattctactataa

SEQ ID NO: 110456 - DNA, 20 bp, Artificial Sequence
  Description of Artificial Sequence: Synthetic oligonucleotide
  Target: SCN9A; (+) strand; PAM type: YTN; PAM sequence: TTA
aatatctattctactataag

SEQ ID NO: 110457 - DNA, 20 bp, Artificial Sequence
  Description of Artificial Sequence: Synthetic oligonucleotide
  Target: SCN9A; (+) strand; PAM type: YTN; PAM sequence: CTA
ttctactataagaacctgac

SEQ ID NO: 110458 - DNA, 20 bp, Artificial Sequence
  Description of Artificial Sequence: Synthetic oligonucleotide
  Target: SCN9A; (+) strand; PAM type: YTN; PAM sequence: TTC
tactataagaacctgacttc

SEQ ID NO: 110459 - DNA, 20 bp, Artificial Sequence
  Description of Artificial Sequence: Synthetic oligonucleotide
  Target: SCN9A; (+) strand; PAM type: YTN; PAM sequence: CTA
ctataagaacctgacttcct

SEQ ID NO: 110460 - DNA, 20 bp, Artificial Sequence
  Description of Artificial Sequence: Synthetic oligonucleotide
  Target: SCN9A; (+) strand; PAM type: YTN; PAM sequence: CTA
taagaacctgacttcctatt

SEQ ID NO: 110461 - DNA, 20 bp, Artificial Sequence
  Description of Artificial Sequence: Synthetic oligonucleotide
  Target: SCN9A; (+) strand; PAM type: YTN; PAM sequence: CTG
acttcctattttactcaggt

SEQ ID NO: 110462 - DNA, 20 bp, Artificial Sequence
  Description of Artificial Sequence: Synthetic oligonucleotide
  Target: SCN9A; (+) strand; PAM type: YTN; PAM sequence: CTT
cctattttactcaggtcaaa

SEQ ID NO: 110463 - DNA, 20 bp, Artificial Sequence
  Description of Artificial Sequence: Synthetic oligonucleotide
  Target: SCN9A; (+) strand; PAM type: YTN; PAM sequence: TTC
ctattttactcaggtcaaat

SEQ ID NO: 110464 - DNA, 20 bp, Artificial Sequence
  Description of Artificial Sequence: Synthetic oligonucleotide
  Target: SCN9A; (+) strand; PAM type: YTN; PAM sequence: CTA
ttttactcaggtcaaattaa

SEQ ID NO: 110465 - DNA, 20 bp, Artificial Sequence
  Description of Artificial Sequence: Synthetic oligonucleotide
  Target: SCN9A; (+) strand; PAM type: YTN; PAM sequence: TTT
tactcaggtcaaattaaaaa

SEQ ID NO: 110466 - DNA, 20 bp, Artificial Sequence
  Description of Artificial Sequence: Synthetic oligonucleotide
  Target: SCN9A; (+) strand; PAM type: YTN; PAM sequence: TTT
actcaggtcaaattaaaaaa

SEQ ID NO: 110467 - DNA, 20 bp, Artificial Sequence
  Description of Artificial Sequence: Synthetic oligonucleotide
  Target: SCN9A; (+) strand; PAM type: YTN; PAM sequence: TTA
ctcaggtcaaattaaaaaat

SEQ ID NO: 110468 - DNA, 20 bp, Artificial Sequence
  Description of Artificial Sequence: Synthetic oligonucleotide
  Target: SCN9A; (+) strand; PAM type: YTN; PAM sequence: CTC
aggtcaaattaaaaaatctg

SEQ ID NO: 110469 - DNA, 20 bp, Artificial Sequence
  Description of Artificial Sequence: Synthetic oligonucleotide
  Target: SCN9A; (+) strand; PAM type: YTN; PAM sequence: TTA
aaaaatctgattattgggag

SEQ ID NO: 110470 - DNA, 20 bp, Artificial Sequence
  Description of Artificial Sequence: Synthetic oligonucleotide
  Target: SCN9A; (+) strand; PAM type: YTN; PAM sequence: CTG
attattgggagacttttgga

SEQ ID NO: 110471 - DNA, 20 bp, Artificial Sequence
  Description of Artificial Sequence: Synthetic oligonucleotide
  Target: SCN9A; (+) strand; PAM type: YTN; PAM sequence: TTA
ttgggagacttttggagtaa

SEQ ID NO: 110472 - DNA, 20 bp, Artificial Sequence
  Description of Artificial Sequence: Synthetic oligonucleotide
  Target: SCN9A; (+) strand; PAM type: YTN; PAM sequence: TTG
ggagacttttggagtaatca

SEQ ID NO: 110473 - DNA, 20 bp, Artificial Sequence
  Description of Artificial Sequence: Synthetic oligonucleotide
  Target: SCN9A; (+) strand; PAM type: YTN; PAM sequence: CTT
ttggagtaatcatggaagaa

SEQ ID NO: 110474 - DNA, 20 bp, Artificial Sequence
  Description of Artificial Sequence: Synthetic oligonucleotide
  Target: SCN9A; (+) strand; PAM type: YTN; PAM sequence: TTT
tggagtaatcatggaagaaa

SEQ ID NO: 110475 - DNA, 20 bp, Artificial Sequence
  Description of Artificial Sequence: Synthetic oligonucleotide
  Target: SCN9A; (+) strand; PAM type: YTN; PAM sequence: TTT
ggagtaatcatggaagaaag

SEQ ID NO: 110476 - DNA, 20 bp, Artificial Sequence
  Description of Artificial Sequence: Synthetic oligonucleotide
  Target: SCN9A; (+) strand; PAM type: YTN; PAM sequence: TTG
gagtaatcatggaagaaaga

SEQ ID NO: 110477 - DNA, 20 bp, Artificial Sequence
  Description of Artificial Sequence: Synthetic oligonucleotide
  Target: SCN9A; (+) strand; PAM type: YTN; PAM sequence: CTA
tgaaatcagatattcttgga

SEQ ID NO: 110478 - DNA, 20 bp, Artificial Sequence
  Description of Artificial Sequence: Synthetic oligonucleotide
  Target: SCN9A; (+) strand; PAM type: YTN; PAM sequence: TTC
ttggatttgaatgttgcttc

SEQ ID NO: 110479 - DNA, 20 bp, Artificial Sequence
  Description of Artificial Sequence: Synthetic oligonucleotide
  Target: SCN9A; (+) strand; PAM type: YTN; PAM sequence: CTT
ggatttgaatgttgcttcta

SEQ ID NO: 110480 - DNA, 20 bp, Artificial Sequence
  Description of Artificial Sequence: Synthetic oligonucleotide
  Target: SCN9A; (+) strand; PAM type: YTN; PAM sequence: TTG
gatttgaatgttgcttctat

SEQ ID NO: 110481 - DNA, 20 bp, Artificial Sequence
  Description of Artificial Sequence: Synthetic oligonucleotide
  Target: SCN9A; (+) strand; PAM type: YTN; PAM sequence: TTT
gaatgttgcttctatccctt

SEQ ID NO: 110482 - DNA, 20 bp, Artificial Sequence
  Description of Artificial Sequence: Synthetic oligonucleotide
  Target: SCN9A; (+) strand; PAM type: YTN; PAM sequence: TTG
aatgttgcttctatcccttc

SEQ ID NO: 110483 - DNA, 20 bp, Artificial Sequence
  Description of Artificial Sequence: Synthetic oligonucleotide
  Target: SCN9A; (+) strand; PAM type: YTN; PAM sequence: TTG
cttctatcccttcttaagta

SEQ ID NO: 110484 - DNA, 20 bp, Artificial Sequence
  Description of Artificial Sequence: Synthetic oligonucleotide
  Target: SCN9A; (+) strand; PAM type: YTN; PAM sequence: CTT
ctatcccttcttaagtaagt

SEQ ID NO: 110485 - DNA, 20 bp, Artificial Sequence
  Description of Artificial Sequence: Synthetic oligonucleotide
  Target: SCN9A; (+) strand; PAM type: YTN; PAM sequence: TTC
tatcccttcttaagtaagtg

SEQ ID NO: 110486 - DNA, 20 bp, Artificial Sequence
  Description of Artificial Sequence: Synthetic oligonucleotide
  Target: SCN9A; (+) strand; PAM type: YTN; PAM sequence: CTA
tcccttcttaagtaagtgaa

SEQ ID NO: 110487 - DNA, 20 bp, Artificial Sequence
  Description of Artificial Sequence: Synthetic oligonucleotide
  Target: SCN9A; (+) strand; PAM type: YTN; PAM sequence: CTT
cttaagtaagtgaattatct

SEQ ID NO: 110488 - DNA, 20 bp, Artificial Sequence
  Description of Artificial Sequence: Synthetic oligonucleotide
  Target: SCN9A; (+) strand; PAM type: YTN; PAM sequence: TTC
ttaagtaagtgaattatctt

SEQ ID NO: 110489 - DNA, 20 bp, Artificial Sequence
  Description of Artificial Sequence: Synthetic oligonucleotide
  Target: SCN9A; (+) strand; PAM type: YTN; PAM sequence: CTT
aagtaagtgaattatcttta

SEQ ID NO: 110490 - DNA, 20 bp, Artificial Sequence
  Description of Artificial Sequence: Synthetic oligonucleotide
  Target: SCN9A; (+) strand; PAM type: YTN; PAM sequence: TTA
agtaagtgaattatctttaa

SEQ ID NO: 110491 - DNA, 20 bp, Artificial Sequence
  Description of Artificial Sequence: Synthetic oligonucleotide
  Target: SCN9A; (+) strand; PAM type: YTN; PAM sequence: TTA
tctttaagccattaagcctt

SEQ ID NO: 110492 - DNA, 20 bp, Artificial Sequence
  Description of Artificial Sequence: Synthetic oligonucleotide
  Target: SCN9A; (+) strand; PAM type: YTN; PAM sequence: CTT
taagccattaagccttagct

SEQ ID NO: 110493 - DNA, 20 bp, Artificial Sequence
  Description of Artificial Sequence: Synthetic oligonucleotide
  Target: SCN9A; (+) strand; PAM type: YTN; PAM sequence: TTT
aagccattaagccttagctg

SEQ ID NO: 110494 - DNA, 20 bp, Artificial Sequence
  Description of Artificial Sequence: Synthetic oligonucleotide
  Target: SCN9A; (+) strand; PAM type: YTN; PAM sequence: TTA
agccattaagccttagctgc

SEQ ID NO: 110495 - DNA, 20 bp, Artificial Sequence
  Description of Artificial Sequence: Synthetic oligonucleotide
  Target: SCN9A; (+) strand; PAM type: YTN; PAM sequence: TTA
agccttagctgctgcatctg

SEQ ID NO: 110496 - DNA, 20 bp, Artificial Sequence
  Description of Artificial Sequence: Synthetic oligonucleotide
  Target: SCN9A; (+) strand; PAM type: YTN; PAM sequence: CTT
agctgctgcatctgtaaaat

SEQ ID NO: 110497 - DNA, 20 bp, Artificial Sequence
  Description of Artificial Sequence: Synthetic oligonucleotide
  Target: SCN9A; (+) strand; PAM type: YTN; PAM sequence: TTA
gctgctgcatctgtaaaata

SEQ ID NO: 110498 - DNA, 20 bp, Artificial Sequence
  Description of Artificial Sequence: Synthetic oligonucleotide
  Target: SCN9A; (+) strand; PAM type: YTN; PAM sequence: CTG
ctgcatctgtaaaatacgta

SEQ ID NO: 110499 - DNA, 20 bp, Artificial Sequence
  Description of Artificial Sequence: Synthetic oligonucleotide
  Target: SCN9A; (+) strand; PAM type: YTN; PAM sequence: CTG
catctgtaaaatacgtataa

SEQ ID NO: 110500 - DNA, 20 bp, Artificial Sequence
  Description of Artificial Sequence: Synthetic oligonucleotide
  Target: SCN9A; (+) strand; PAM type: YTN; PAM sequence: CTG
taaaatacgtataagaatac

SEQ ID NO: 110501 - DNA, 20 bp, Artificial Sequence
  Description of Artificial Sequence: Synthetic oligonucleotide
  Target: SCN9A; (+) strand; PAM type: YTN; PAM sequence: CTA
ctttataaagttgttaaata

SEQ ID NO: 110502 - DNA, 20 bp, Artificial Sequence
  Description of Artificial Sequence: Synthetic oligonucleotide
  Target: SCN9A; (+) strand; PAM type: YTN; PAM sequence: CTT
tataaagttgttaaatagta

SEQ ID NO: 110503 - DNA, 20 bp, Artificial Sequence
  Description of Artificial Sequence: Synthetic oligonucleotide
  Target: SCN9A; (+) strand; PAM type: YTN; PAM sequence: TTT
ataaagttgttaaatagtat

SEQ ID NO: 110504 - DNA, 20 bp, Artificial Sequence
  Description of Artificial Sequence: Synthetic oligonucleotide
  Target: SCN9A; (+) strand; PAM type: YTN; PAM sequence: TTA
taaagttgttaaatagtata

SEQ ID NO: 110505 - DNA, 20 bp, Artificial Sequence
  Description of Artificial Sequence: Synthetic oligonucleotide
  Target: SCN9A; (+) strand; PAM type: YTN; PAM sequence: TTG
ttaaatagtataaataggat

SEQ ID NO: 110506 - DNA, 20 bp, Artificial Sequence
  Description of Artificial Sequence: Synthetic oligonucleotide
  Target: SCN9A; (+) strand; PAM type: YTN; PAM sequence: TTA
aatagtataaataggatatt

SEQ ID NO: 110507 - DNA, 20 bp, Artificial Sequence
  Description of Artificial Sequence: Synthetic oligonucleotide
  Target: SCN9A; (+) strand; PAM type: YTN; PAM sequence: TTG
catgtaaaccacttgatact

SEQ ID NO: 110508 - DNA, 20 bp, Artificial Sequence
  Description of Artificial Sequence: Synthetic oligonucleotide
  Target: SCN9A; (+) strand; PAM type: YTN; PAM sequence: CTT
gatactgtgatccacacatt

SEQ ID NO: 110509 - DNA, 20 bp, Artificial Sequence
  Description of Artificial Sequence: Synthetic oligonucleotide
  Target: SCN9A; (+) strand; PAM type: YTN; PAM sequence: TTG
atactgtgatccacacattc

SEQ ID NO: 110510 - DNA, 20 bp, Artificial Sequence
  Description of Artificial Sequence: Synthetic oligonucleotide
  Target: SCN9A; (+) strand; PAM type: YTN; PAM sequence: CTG
tgatccacacattctgtact

SEQ ID NO: 110511 - DNA, 20 bp, Artificial Sequence
  Description of Artificial Sequence: Synthetic oligonucleotide
  Target: SCN9A; (+) strand; PAM type: YTN; PAM sequence: TTC
tgtactagctgctcaaaaac

SEQ ID NO: 110512 - DNA, 20 bp, Artificial Sequence
  Description of Artificial Sequence: Synthetic oligonucleotide
  Target: SCN9A; (+) strand; PAM type: YTN; PAM sequence: CTG
tactagctgctcaaaaacag

SEQ ID NO: 110513 - DNA, 20 bp, Artificial Sequence
  Description of Artificial Sequence: Synthetic oligonucleotide
  Target: SCN9A; (+) strand; PAM type: YTN; PAM sequence: CTA
gctgctcaaaaacaggagtt

SEQ ID NO: 110514 - DNA, 20 bp, Artificial Sequence
  Description of Artificial Sequence: Synthetic oligonucleotide
  Target: SCN9A; (+) strand; PAM type: YTN; PAM sequence: CTG
ctcaaaaacaggagttatta

SEQ ID NO: 110515 - DNA, 20 bp, Artificial Sequence
  Description of Artificial Sequence: Synthetic oligonucleotide
  Target: SCN9A; (+) strand; PAM type: YTN; PAM sequence: CTC
aaaaacaggagttattataa

SEQ ID NO: 110516 - DNA, 20 bp, Artificial Sequence
  Description of Artificial Sequence: Synthetic oligonucleotide
  Target: SCN9A; (+) strand; PAM type: YTN; PAM sequence: TTA
ttataattagttaaactatt

SEQ ID NO: 110517 - DNA, 20 bp, Artificial Sequence
  Description of Artificial Sequence: Synthetic oligonucleotide
  Target: SCN9A; (+) strand; PAM type: YTN; PAM sequence: TTA
taattagttaaactattata

SEQ ID NO: 110518 - DNA, 20 bp, Artificial Sequence
  Description of Artificial Sequence: Synthetic oligonucleotide
  Target: SCN9A; (+) strand; PAM type: YTN; PAM sequence: TTA
gttaaactattatacaattt

SEQ ID NO: 110519 - DNA, 20 bp, Artificial Sequence
  Description of Artificial Sequence: Synthetic oligonucleotide
  Target: SCN9A; (+) strand; PAM type: YTN; PAM sequence: TTA
aactattatacaatttgaga

SEQ ID NO: 110520 - DNA, 20 bp, Artificial Sequence
  Description of Artificial Sequence: Synthetic oligonucleotide
  Target: SCN9A; (+) strand; PAM type: YTN; PAM sequence: CTA
ttatacaatttgagataaaa

SEQ ID NO: 110521 - DNA, 20 bp, Artificial Sequence
  Description of Artificial Sequence: Synthetic oligonucleotide
  Target: SCN9A; (+) strand; PAM type: YTN; PAM sequence: TTA
tacaatttgagataaaacta

SEQ ID NO: 110522 - DNA, 20 bp, Artificial Sequence
  Description of Artificial Sequence: Synthetic oligonucleotide
  Target: SCN9A; (+) strand; PAM type: YTN; PAM sequence: TTT
gagataaaactattgattga

SEQ ID NO: 110523 - DNA, 20 bp, Artificial Sequence
  Description of Artificial Sequence: Synthetic oligonucleotide
  Target: SCN9A; (+) strand; PAM type: YTN; PAM sequence: TTG
agataaaactattgattgaa

SEQ ID NO: 110524 - DNA, 20 bp, Artificial Sequence
  Description of Artificial Sequence: Synthetic oligonucleotide
  Target: SCN9A; (+) strand; PAM type: YTN; PAM sequence: CTA
ttgattgaattacacatcat

SEQ ID NO: 110525 - DNA, 20 bp, Artificial Sequence
  Description of Artificial Sequence: Synthetic oligonucleotide
  Target: SCN9A; (+) strand; PAM type: YTN; PAM sequence: TTG
attgaattacacatcatcat

SEQ ID NO: 110526 - DNA, 20 bp, Artificial Sequence
  Description of Artificial Sequence: Synthetic oligonucleotide
  Target: SCN9A; (+) strand; PAM type: YTN; PAM sequence: TTG
aattacacatcatcatttta

SEQ ID NO: 110527 - DNA, 20 bp, Artificial Sequence
  Description of Artificial Sequence: Synthetic oligonucleotide
  Target: SCN9A; (+) strand; PAM type: YTN; PAM sequence: TTA
cacatcatcattttatctta

SEQ ID NO: 110528 - DNA, 20 bp, Artificial Sequence
  Description of Artificial Sequence: Synthetic oligonucleotide
  Target: SCN9A; (+) strand; PAM type: YTN; PAM sequence: TTT
tatcttacttagaagacaca

SEQ ID NO: 110529 - DNA, 20 bp, Artificial Sequence
  Description of Artificial Sequence: Synthetic oligonucleotide
  Target: SCN9A; (+) strand; PAM type: YTN; PAM sequence: TTT
atcttacttagaagacacag

SEQ ID NO: 110530 - DNA, 20 bp, Artificial Sequence
  Description of Artificial Sequence: Synthetic oligonucleotide
  Target: SCN9A; (+) strand; PAM type: YTN; PAM sequence: TTA
tcttacttagaagacacaga

SEQ ID NO: 110531 - DNA, 20 bp, Artificial Sequence
  Description of Artificial Sequence: Synthetic oligonucleotide
  Target: SCN9A; (+) strand; PAM type: YTN; PAM sequence: CTT
acttagaagacacagataaa

SEQ ID NO: 110532 - DNA, 20 bp, Artificial Sequence
  Description of Artificial Sequence: Synthetic oligonucleotide
  Target: SCN9A; (+) strand; PAM type: YTN; PAM sequence: TTA
cttagaagacacagataaaa

SEQ ID NO: 110533 - DNA, 20 bp, Artificial Sequence
  Description of Artificial Sequence: Synthetic oligonucleotide
  Target: SCN9A; (+) strand; PAM type: YTN; PAM sequence: CTT
agaagacacagataaaacaa

SEQ ID NO: 110534 - DNA, 20 bp, Artificial Sequence
  Description of Artificial Sequence: Synthetic oligonucleotide
  Target: SCN9A; (+) strand; PAM type: YTN; PAM sequence: TTA
gaagacacagataaaacaat

SEQ ID NO: 110535 - DNA, 20 bp, Artificial Sequence
  Description of Artificial Sequence: Synthetic oligonucleotide
  Target: SCN9A; (+) strand; PAM type: YTN; PAM sequence: CTT
gcagtttgaggtgcaaatgt

SEQ ID NO: 110536 - DNA, 20 bp, Artificial Sequence
  Description of Artificial Sequence: Synthetic oligonucleotide
  Target: SCN9A; (+) strand; PAM type: YTN; PAM sequence: TTG
cagtttgaggtgcaaatgta

SEQ ID NO: 110537 - DNA, 20 bp, Artificial Sequence
  Description of Artificial Sequence: Synthetic oligonucleotide
  Target: SCN9A; (+) strand; PAM type: YTN; PAM sequence: TTT
gaggtgcaaatgtaggtgaa

SEQ ID NO: 110538 - DNA, 20 bp, Artificial Sequence
  Description of Artificial Sequence: Synthetic oligonucleotide
  Target: SCN9A; (+) strand; PAM type: YTN; PAM sequence: TTG
aggtgcaaatgtaggtgaaa

SEQ ID NO: 110539 - DNA, 20 bp, Artificial Sequence
  Description of Artificial Sequence: Synthetic oligonucleotide
  Target: SCN9A; (+) strand; PAM type: YTN; PAM sequence: CTT
tcctgaaaacactcctgaac

SEQ ID NO: 110540 - DNA, 20 bp, Artificial Sequence
  Description of Artificial Sequence: Synthetic oligonucleotide
  Target: SCN9A; (+) strand; PAM type: YTN; PAM sequence: TTT
cctgaaaacactcctgaacc

SEQ ID NO: 110541 - DNA, 20 bp, Artificial Sequence
  Description of Artificial Sequence: Synthetic oligonucleotide
  Target: SCN9A; (+) strand; PAM type: YTN; PAM sequence: TTC
ctgaaaacactcctgaacct

SEQ ID NO: 110542 - DNA, 20 bp, Artificial Sequence
  Description of Artificial Sequence: Synthetic oligonucleotide
  Target: SCN9A; (+) strand; PAM type: YTN; PAM sequence: CTG
aaaacactcctgaacctcgg

SEQ ID NO: 110543 - DNA, 20 bp, Artificial Sequence
  Description of Artificial Sequence: Synthetic oligonucleotide
  Target: SCN9A; (+) strand; PAM type: YTN; PAM sequence: CTC
ctgaacctcgggaaggatgg

SEQ ID NO: 110544 - DNA, 20 bp, Artificial Sequence
  Description of Artificial Sequence: Synthetic oligonucleotide
  Target: SCN9A; (+) strand; PAM type: YTN; PAM sequence: CTG
aacctcgggaaggatgggcc

SEQ ID NO: 110545 - DNA, 20 bp, Artificial Sequence
  Description of Artificial Sequence: Synthetic oligonucleotide
  Target: SCN9A; (+) strand; PAM type: YTN; PAM sequence: CTC
gggaaggatgggcctggtag

SEQ ID NO: 110546 - DNA, 20 bp, Artificial Sequence
  Description of Artificial Sequence: Synthetic oligonucleotide
  Target: SCN9A; (+) strand; PAM type: YTN; PAM sequence: CTG
gtagagtgagtatgggagag

SEQ ID NO: 110547 - DNA, 20 bp, Artificial Sequence
  Description of Artificial Sequence: Synthetic oligonucleotide
  Target: SCN9A; (+) strand; PAM type: YTN; PAM sequence: TTT
tgcatacataaacatccaaa

SEQ ID NO: 110548 - DNA, 20 bp, Artificial Sequence
  Description of Artificial Sequence: Synthetic oligonucleotide
  Target: SCN9A; (+) strand; PAM type: YTN; PAM sequence: TTT
gcatacataaacatccaaaa

SEQ ID NO: 110549 - DNA, 20 bp, Artificial Sequence
  Description of Artificial Sequence: Synthetic oligonucleotide
  Target: SCN9A; (+) strand; PAM type: YTN; PAM sequence: TTG
catacataaacatccaaaat

SEQ ID NO: 110550 - DNA, 20 bp, Artificial Sequence
  Description of Artificial Sequence: Synthetic oligonucleotide
  Target: SCN9A; (+) strand; PAM type: YTN; PAM sequence: TTT
taataaggatggattacttt

SEQ ID NO: 110551 - DNA, 20 bp, Artificial Sequence
  Description of Artificial Sequence: Synthetic oligonucleotide
  Target: SCN9A; (+) strand; PAM type: YTN; PAM sequence: TTT
aataaggatggattacttta

SEQ ID NO: 110552 - DNA, 20 bp, Artificial Sequence
  Description of Artificial Sequence: Synthetic oligonucleotide
  Target: SCN9A; (+) strand; PAM type: YTN; PAM sequence: TTA
ataaggatggattactttag

SEQ ID NO: 110553 - DNA, 20 bp, Artificial Sequence
  Description of Artificial Sequence: Synthetic oligonucleotide
  Target: SCN9A; (+) strand; PAM type: YTN; PAM sequence: TTA
ctttagaattatcctttaaa

SEQ ID NO: 110554 - DNA, 20 bp, Artificial Sequence
  Description of Artificial Sequence: Synthetic oligonucleotide
  Target: SCN9A; (+) strand; PAM type: YTN; PAM sequence: CTT
tagaattatcctttaaacta

SEQ ID NO: 110555 - DNA, 20 bp, Artificial Sequence
  Description of Artificial Sequence: Synthetic oligonucleotide
  Target: SCN9A; (+) strand; PAM type: YTN; PAM sequence: TTT
agaattatcctttaaactaa

SEQ ID NO: 110556 - DNA, 20 bp, Artificial Sequence
  Description of Artificial Sequence: Synthetic oligonucleotide
  Target: SCN9A; (+) strand; PAM type: YTN; PAM sequence: TTA
gaattatcctttaaactaat

SEQ ID NO: 110557 - DNA, 20 bp, Artificial Sequence
  Description of Artificial Sequence: Synthetic oligonucleotide
  Target: SCN9A; (+) strand; PAM type: YTN; PAM sequence: TTA
tcctttaaactaatgctggt

SEQ ID NO: 110558 - DNA, 20 bp, Artificial Sequence
  Description of Artificial Sequence: Synthetic oligonucleotide
  Target: SCN9A; (+) strand; PAM type: YTN; PAM sequence: CTT
taaactaatgctggttcaca

SEQ ID NO: 110559 - DNA, 20 bp, Artificial Sequence
  Description of Artificial Sequence: Synthetic oligonucleotide
  Target: SCN9A; (+) strand; PAM type: YTN; PAM sequence: TTT
aaactaatgctggttcacat

SEQ ID NO: 110560 - DNA, 20 bp, Artificial Sequence
  Description of Artificial Sequence: Synthetic oligonucleotide
  Target: SCN9A; (+) strand; PAM type: YTN; PAM sequence: TTA
aactaatgctggttcacatt

SEQ ID NO: 110561 - DNA, 20 bp, Artificial Sequence
  Description of Artificial Sequence: Synthetic oligonucleotide
  Target: SCN9A; (+) strand; PAM type: YTN; PAM sequence: CTA
atgctggttcacatttatca

SEQ ID NO: 110562 - DNA, 20 bp, Artificial Sequence
  Description of Artificial Sequence: Synthetic oligonucleotide
  Target: SCN9A; (+) strand; PAM type: YTN; PAM sequence: CTG
gttcacatttatcaaccact

SEQ ID NO: 110563 - DNA, 20 bp, Artificial Sequence
  Description of Artificial Sequence: Synthetic oligonucleotide
  Target: SCN9A; (+) strand; PAM type: YTN; PAM sequence: TTC
acatttatcaaccactgagg

SEQ ID NO: 110564 - DNA, 20 bp, Artificial Sequence
  Description of Artificial Sequence: Synthetic oligonucleotide
  Target: SCN9A; (+) strand; PAM type: YTN; PAM sequence: TTT
atcaaccactgaggagctga

SEQ ID NO: 110565 - DNA, 20 bp, Artificial Sequence
  Description of Artificial Sequence: Synthetic oligonucleotide
  Target: SCN9A; (+) strand; PAM type: YTN; PAM sequence: TTA
tcaaccactgaggagctgaa

SEQ ID NO: 110566 - DNA, 20 bp, Artificial Sequence
  Description of Artificial Sequence: Synthetic oligonucleotide
  Target: SCN9A; (+) strand; PAM type: YTN; PAM sequence: CTG
aggagctgaattatatgaat

SEQ ID NO: 110567 - DNA, 20 bp, Artificial Sequence
  Description of Artificial Sequence: Synthetic oligonucleotide
  Target: SCN9A; (+) strand; PAM type: YTN; PAM sequence: CTG
aattatatgaatgggctctg

SEQ ID NO: 110568 - DNA, 20 bp, Artificial Sequence
  Description of Artificial Sequence: Synthetic oligonucleotide
  Target: SCN9A; (+) strand; PAM type: YTN; PAM sequence: TTA
tatgaatgggctctggagct

SEQ ID NO: 110569 - DNA, 20 bp, Artificial Sequence
  Description of Artificial Sequence: Synthetic oligonucleotide
  Target: SCN9A; (+) strand; PAM type: YTN; PAM sequence: CTC
tggagctgtctattagcaca

SEQ ID NO: 110570 - DNA, 20 bp, Artificial Sequence
  Description of Artificial Sequence: Synthetic oligonucleotide
  Target: SCN9A; (+) strand; PAM type: YTN; PAM sequence: CTG
gagctgtctattagcacact

SEQ ID NO: 110571 - DNA, 20 bp, Artificial Sequence
  Description of Artificial Sequence: Synthetic oligonucleotide
  Target: SCN9A; (+) strand; PAM type: YTN; PAM sequence: CTG
tctattagcacactgctata

SEQ ID NO: 110572 - DNA, 20 bp, Artificial Sequence
  Description of Artificial Sequence: Synthetic oligonucleotide
  Target: SCN9A; (+) strand; PAM type: YTN; PAM sequence: CTA
ttagcacactgctatactac

SEQ ID NO: 110573 - DNA, 20 bp, Artificial Sequence
  Description of Artificial Sequence: Synthetic oligonucleotide
  Target: SCN9A; (+) strand; PAM type: YTN; PAM sequence: TTA
gcacactgctatactactgt

SEQ ID NO: 110574 - DNA, 20 bp, Artificial Sequence
  Description of Artificial Sequence: Synthetic oligonucleotide
  Target: SCN9A; (+) strand; PAM type: YTN; PAM sequence: CTG
ctatactactgtatttaaca

SEQ ID NO: 110575 - DNA, 20 bp, Artificial Sequence
  Description of Artificial Sequence: Synthetic oligonucleotide
  Target: SCN9A; (+) strand; PAM type: YTN; PAM sequence: CTA
tactactgtatttaacacag

SEQ ID NO: 110576 - DNA, 20 bp, Artificial Sequence
  Description of Artificial Sequence: Synthetic oligonucleotide
  Target: SCN9A; (+) strand; PAM type: YTN; PAM sequence: CTA
ctgtatttaacacagtataa

SEQ ID NO: 110577 - DNA, 20 bp, Artificial Sequence
  Description of Artificial Sequence: Synthetic oligonucleotide
  Target: SCN9A; (+) strand; PAM type: YTN; PAM sequence: CTG
tatttaacacagtataagaa

SEQ ID NO: 110578 - DNA, 20 bp, Artificial Sequence
  Description of Artificial Sequence: Synthetic oligonucleotide
  Target: SCN9A; (+) strand; PAM type: YTN; PAM sequence: TTT
aacacagtataagaatgatg

SEQ ID NO: 110579 - DNA, 20 bp, Artificial Sequence
  Description of Artificial Sequence: Synthetic oligonucleotide
  Target: SCN9A; (+) strand; PAM type: YTN; PAM sequence: TTA
acacagtataagaatgatga

SEQ ID NO: 110580 - DNA, 20 bp, Artificial Sequence
  Description of Artificial Sequence: Synthetic oligonucleotide
  Target: SCN9A; (+) strand; PAM type: YTN; PAM sequence: CTC
actctaggtttgtagaaaac

SEQ ID NO: 110581 - DNA, 20 bp, Artificial Sequence
  Description of Artificial Sequence: Synthetic oligonucleotide
  Target: SCN9A; (+) strand; PAM type: YTN; PAM sequence: CTC
taggtttgtagaaaacttta

SEQ ID NO: 110582 - DNA, 20 bp, Artificial Sequence
  Description of Artificial Sequence: Synthetic oligonucleotide
  Target: SCN9A; (+) strand; PAM type: YTN; PAM sequence: CTA
ggtttgtagaaaactttaca

SEQ ID NO: 110583 - DNA, 20 bp, Artificial Sequence
  Description of Artificial Sequence: Synthetic oligonucleotide
  Target: SCN9A; (+) strand; PAM type: YTN; PAM sequence: TTT
gtagaaaactttacaataat

SEQ ID NO: 110584 - DNA, 20 bp, Artificial Sequence
  Description of Artificial Sequence: Synthetic oligonucleotide
  Target: SCN9A; (+) strand; PAM type: YTN; PAM sequence: TTG
tagaaaactttacaataatt

SEQ ID NO: 110585 - DNA, 20 bp, Artificial Sequence
  Description of Artificial Sequence: Synthetic oligonucleotide
  Target: SCN9A; (+) strand; PAM type: YTN; PAM sequence: CTT
tacaataatttctaaacaac

SEQ ID NO: 110586 - DNA, 20 bp, Artificial Sequence
  Description of Artificial Sequence: Synthetic oligonucleotide
  Target: SCN9A; (+) strand; PAM type: YTN; PAM sequence: TTT
acaataatttctaaacaact

SEQ ID NO: 110587 - DNA, 20 bp, Artificial Sequence
  Description of Artificial Sequence: Synthetic oligonucleotide
  Target: SCN9A; (+) strand; PAM type: YTN; PAM sequence: TTA
caataatttctaaacaacta

SEQ ID NO: 110588 - DNA, 20 bp, Artificial Sequence
  Description of Artificial Sequence: Synthetic oligonucleotide
  Target: SCN9A; (+) strand; PAM type: YTN; PAM sequence: TTT
ctaaacaactagacattaaa

SEQ ID NO: 110589 - DNA, 20 bp, Artificial Sequence
  Description of Artificial Sequence: Synthetic oligonucleotide
  Target: SCN9A; (+) strand; PAM type: YTN; PAM sequence: TTC
taaacaactagacattaaat

SEQ ID NO: 110590 - DNA, 20 bp, Artificial Sequence
  Description of Artificial Sequence: Synthetic oligonucleotide
  Target: SCN9A; (+) strand; PAM type: YTN; PAM sequence: CTA
aacaactagacattaaatta

SEQ ID NO: 110591 - DNA, 20 bp, Artificial Sequence
  Description of Artificial Sequence: Synthetic oligonucleotide
  Target: SCN9A; (+) strand; PAM type: YTN; PAM sequence: CTA
gacattaaattattaagatg

SEQ ID NO: 110592 - DNA, 20 bp, Artificial Sequence
  Description of Artificial Sequence: Synthetic oligonucleotide
  Target: SCN9A; (+) strand; PAM type: YTN; PAM sequence: TTA
aattattaagatggttggct

SEQ ID NO: 110593 - DNA, 20 bp, Artificial Sequence
  Description of Artificial Sequence: Synthetic oligonucleotide
  Target: SCN9A; (+) strand; PAM type: YTN; PAM sequence: TTA
ttaagatggttggcttcaag

SEQ ID NO: 110594 - DNA, 20 bp, Artificial Sequence
  Description of Artificial Sequence: Synthetic oligonucleotide
  Target: SCN9A; (+) strand; PAM type: YTN; PAM sequence: TTA
agatggttggcttcaagaag

SEQ ID NO: 110595 - DNA, 20 bp, Artificial Sequence
  Description of Artificial Sequence: Synthetic oligonucleotide
  Target: SCN9A; (+) strand; PAM type: YTN; PAM sequence: TTG
gcttcaagaagatttaaggt

SEQ ID NO: 110596 - DNA, 20 bp, Artificial Sequence
  Description of Artificial Sequence: Synthetic oligonucleotide
  Target: SCN9A; (+) strand; PAM type: YTN; PAM sequence: CTT
caagaagatttaaggttaac

SEQ ID NO: 110597 - DNA, 20 bp, Artificial Sequence
  Description of Artificial Sequence: Synthetic oligonucleotide
  Target: SCN9A; (+) strand; PAM type: YTN; PAM sequence: TTC
aagaagatttaaggttaaca

SEQ ID NO: 110598 - DNA, 20 bp, Artificial Sequence
  Description of Artificial Sequence: Synthetic oligonucleotide
  Target: SCN9A; (+) strand; PAM type: YTN; PAM sequence: TTT
aaggttaacatctttaaaaa

SEQ ID NO: 110599 - DNA, 20 bp, Artificial Sequence
  Description of Artificial Sequence: Synthetic oligonucleotide
  Target: SCN9A; (+) strand; PAM type: YTN; PAM sequence: TTA
aggttaacatctttaaaaat

SEQ ID NO: 110600 - DNA, 20 bp, Artificial Sequence
  Description of Artificial Sequence: Synthetic oligonucleotide
  Target: SCN9A; (+) strand; PAM type: YTN; PAM sequence: TTA
acatctttaaaaatgggaaa

SEQ ID NO: 110601 - DNA, 20 bp, Artificial Sequence
  Description of Artificial Sequence: Synthetic oligonucleotide
  Target: SCN9A; (+) strand; PAM type: YTN; PAM sequence: CTT
taaaaatgggaaaaaattga

SEQ ID NO: 110602 - DNA, 20 bp, Artificial Sequence
  Description of Artificial Sequence: Synthetic oligonucleotide
  Target: SCN9A; (+) strand; PAM type: YTN; PAM sequence: TTT
aaaaatgggaaaaaattgaa

SEQ ID NO: 110603 - DNA, 20 bp, Artificial Sequence
  Description of Artificial Sequence: Synthetic oligonucleotide
  Target: SCN9A; (+) strand; PAM type: YTN; PAM sequence: TTA
aaaatgggaaaaaattgaat

SEQ ID NO: 110604 - DNA, 20 bp, Artificial Sequence
  Description of Artificial Sequence: Synthetic oligonucleotide
  Target: SCN9A; (+) strand; PAM type: YTN; PAM sequence: TTG
aatgcaaagaaaaatgaaat

SEQ ID NO: 110605 - DNA, 20 bp, Artificial Sequence
  Description of Artificial Sequence: Synthetic oligonucleotide
  Target: SCN9A; (+) strand; PAM type: YTN; PAM sequence: TTG
cttgtgcatattcaaaagtg

SEQ ID NO: 110606 - DNA, 20 bp, Artificial Sequence
  Description of Artificial Sequence: Synthetic oligonucleotide
  Target: SCN9A; (+) strand; PAM type: YTN; PAM sequence: CTT
gtgcatattcaaaagtggga

SEQ ID NO: 110607 - DNA, 20 bp, Artificial Sequence
  Description of Artificial Sequence: Synthetic oligonucleotide
  Target: SCN9A; (+) strand; PAM type: YTN; PAM sequence: TTG
tgcatattcaaaagtgggat

SEQ ID NO: 110608 - DNA, 20 bp, Artificial Sequence
  Description of Artificial Sequence: Synthetic oligonucleotide
  Target: SCN9A; (+) strand; PAM type: YTN; PAM sequence: TTC
aaaagtgggatgattctgaa

SEQ ID NO: 110609 - DNA, 20 bp, Artificial Sequence
  Description of Artificial Sequence: Synthetic oligonucleotide
  Target: SCN9A; (+) strand; PAM type: YTN; PAM sequence: TTC
tgaaagataaagaatgaatc

SEQ ID NO: 110610 - DNA, 20 bp, Artificial Sequence
  Description of Artificial Sequence: Synthetic oligonucleotide
  Target: SCN9A; (+) strand; PAM type: YTN; PAM sequence: CTG
aaagataaagaatgaatcac

SEQ ID NO: 110611 - DNA, 20 bp, Artificial Sequence
  Description of Artificial Sequence: Synthetic oligonucleotide
  Target: SCN9A; (+) strand; PAM type: YTN; PAM sequence: CTC
acgcctgtaatgccagcact

SEQ ID NO: 110612 - DNA, 20 bp, Artificial Sequence
  Description of Artificial Sequence: Synthetic oligonucleotide
  Target: SCN9A; (+) strand; PAM type: YTN; PAM sequence: CTG
taatgccagcactttgggag

SEQ ID NO: 110613 - DNA, 20 bp, Artificial Sequence
  Description of Artificial Sequence: Synthetic oligonucleotide
  Target: SCN9A; (+) strand; PAM type: YTN; PAM sequence: CTT
tgggaggtcgaggcgggcag

SEQ ID NO: 110614 - DNA, 20 bp, Artificial Sequence
  Description of Artificial Sequence: Synthetic oligonucleotide
  Target: SCN9A; (+) strand; PAM type: YTN; PAM sequence: TTT
gggaggtcgaggcgggcaga

SEQ ID NO: 110615 - DNA, 20 bp, Artificial Sequence
  Description of Artificial Sequence: Synthetic oligonucleotide
  Target: SCN9A; (+) strand; PAM type: YTN; PAM sequence: TTG
ggaggtcgaggcgggcagat

SEQ ID NO: 110616 - DNA, 20 bp, Artificial Sequence
  Description of Artificial Sequence: Synthetic oligonucleotide
  Target: SCN9A; (+) strand; PAM type: YTN; PAM sequence: CTG
gctaacacaatgaaaccccg

SEQ ID NO: 110617 - DNA, 20 bp, Artificial Sequence
  Description of Artificial Sequence: Synthetic oligonucleotide
  Target: SCN9A; (+) strand; PAM type: YTN; PAM sequence: CTA
acacaatgaaaccccgtctc

SEQ ID NO: 110618 - DNA, 20 bp, Artificial Sequence
  Description of Artificial Sequence: Synthetic oligonucleotide
  Target: SCN9A; (+) strand; PAM type: YTN; PAM sequence: CTC
tactaaaaatacaaaaaaat

SEQ ID NO: 110619 - DNA, 20 bp, Artificial Sequence
  Description of Artificial Sequence: Synthetic oligonucleotide
  Target: SCN9A; (+) strand; PAM type: YTN; PAM sequence: CTA
ctaaaaatacaaaaaaatag

SEQ ID NO: 110620 - DNA, 20 bp, Artificial Sequence
  Description of Artificial Sequence: Synthetic oligonucleotide
  Target: SCN9A; (+) strand; PAM type: YTN; PAM sequence: CTA
aaaatacaaaaaaatagctg

SEQ ID NO: 110621 - DNA, 20 bp, Artificial Sequence
  Description of Artificial Sequence: Synthetic oligonucleotide
  Target: SCN9A; (+) strand; PAM type: YTN; PAM sequence: CTG
ggcgtggtggcgggcacctg

SEQ ID NO: 110622 - DNA, 20 bp, Artificial Sequence
  Description of Artificial Sequence: Synthetic oligonucleotide
  Target: SCN9A; (+) strand; PAM type: YTN; PAM sequence: CTG
tagtcccagctacttggcag

SEQ ID NO: 110623 - DNA, 20 bp, Artificial Sequence
  Description of Artificial Sequence: Synthetic oligonucleotide
  Target: SCN9A; (+) strand; PAM type: YTN; PAM sequence: CTA
cttggcaggctgaggcagga

SEQ ID NO: 110624 - DNA, 20 bp, Artificial Sequence
  Description of Artificial Sequence: Synthetic oligonucleotide
  Target: SCN9A; (+) strand; PAM type: YTN; PAM sequence: CTT
ggcaggctgaggcaggagaa

SEQ ID NO: 110625 - DNA, 20 bp, Artificial Sequence
  Description of Artificial Sequence: Synthetic oligonucleotide
  Target: SCN9A; (+) strand; PAM type: YTN; PAM sequence: TTG
gcaggctgaggcaggagaat

SEQ ID NO: 110626 - DNA, 20 bp, Artificial Sequence
  Description of Artificial Sequence: Synthetic oligonucleotide
  Target: SCN9A; (+) strand; PAM type: YTN; PAM sequence: CTG
aggcaggagaatggtgtgaa

SEQ ID NO: 110627 - DNA, 20 bp, Artificial Sequence
  Description of Artificial Sequence: Synthetic oligonucleotide
  Target: SCN9A; (+) strand; PAM type: YTN; PAM sequence: CTT
acagtgagccgagatagcga

SEQ ID NO: 110628 - DNA, 20 bp, Artificial Sequence
  Description of Artificial Sequence: Synthetic oligonucleotide
  Target: SCN9A; (+) strand; PAM type: YTN; PAM sequence: TTA
cagtgagccgagatagcgac

SEQ ID NO: 110629 - DNA, 20 bp, Artificial Sequence
  Description of Artificial Sequence: Synthetic oligonucleotide
  Target: SCN9A; (+) strand; PAM type: YTN; PAM sequence: CTG
cattccagcctaggcgacag

SEQ ID NO: 110630 - DNA, 20 bp, Artificial Sequence
  Description of Artificial Sequence: Synthetic oligonucleotide
  Target: SCN9A; (+) strand; PAM type: YTN; PAM sequence: TTC
cagcctaggcgacagagtga

SEQ ID NO: 110631 - DNA, 20 bp, Artificial Sequence
  Description of Artificial Sequence: Synthetic oligonucleotide
  Target: SCN9A; (+) strand; PAM type: YTN; PAM sequence: CTA
ggcgacagagtgagactcca

SEQ ID NO: 110632 - DNA, 20 bp, Artificial Sequence
  Description of Artificial Sequence: Synthetic oligonucleotide
  Target: SCN9A; (+) strand; PAM type: YTN; PAM sequence: CTC
catctcaaaaaaaaaaaaaa

SEQ ID NO: 110633 - DNA, 20 bp, Artificial Sequence
  Description of Artificial Sequence: Synthetic oligonucleotide
  Target: SCN9A; (+) strand; PAM type: YTN; PAM sequence: CTC
aaaaaaaaaaaaaaaaaaaa

SEQ ID NO: 110634 - DNA, 20 bp, Artificial Sequence
  Description of Artificial Sequence: Synthetic oligonucleotide
  Target: SCN9A; (+) strand; PAM type: YTN; PAM sequence: CTC
agtaatcccactactaggta

SEQ ID NO: 110635 - DNA, 20 bp, Artificial Sequence
  Description of Artificial Sequence: Synthetic oligonucleotide
  Target: SCN9A; (+) strand; PAM type: YTN; PAM sequence: CTA
ctaggtatatactgagaact

SEQ ID NO: 110636 - DNA, 20 bp, Artificial Sequence
  Description of Artificial Sequence: Synthetic oligonucleotide
  Target: SCN9A; (+) strand; PAM type: YTN; PAM sequence: CTA
ggtatatactgagaactgaa

SEQ ID NO: 110637 - DNA, 20 bp, Artificial Sequence
  Description of Artificial Sequence: Synthetic oligonucleotide
  Target: SCN9A; (+) strand; PAM type: YTN; PAM sequence: CTG
agaactgaaaattgaaaatg

SEQ ID NO: 110638 - DNA, 20 bp, Artificial Sequence
  Description of Artificial Sequence: Synthetic oligonucleotide
  Target: SCN9A; (+) strand; PAM type: YTN; PAM sequence: CTG
aaaattgaaaatgtatttcc

SEQ ID NO: 110639 - DNA, 20 bp, Artificial Sequence
  Description of Artificial Sequence: Synthetic oligonucleotide
  Target: SCN9A; (+) strand; PAM type: YTN; PAM sequence: TTG
aaaatgtatttccacaaaaa

SEQ ID NO: 110640 - DNA, 20 bp, Artificial Sequence
  Description of Artificial Sequence: Synthetic oligonucleotide
  Target: SCN9A; (+) strand; PAM type: YTN; PAM sequence: TTT
ccacaaaaacttgtacatga

SEQ ID NO: 110641 - DNA, 20 bp, Artificial Sequence
  Description of Artificial Sequence: Synthetic oligonucleotide
  Target: SCN9A; (+) strand; PAM type: YTN; PAM sequence: TTC
cacaaaaacttgtacatgaa

SEQ ID NO: 110642 - DNA, 20 bp, Artificial Sequence
  Description of Artificial Sequence: Synthetic oligonucleotide
  Target: SCN9A; (+) strand; PAM type: YTN; PAM sequence: CTT
gtacatgaatgtttacagca

SEQ ID NO: 110643 - DNA, 20 bp, Artificial Sequence
  Description of Artificial Sequence: Synthetic oligonucleotide
  Target: SCN9A; (+) strand; PAM type: YTN; PAM sequence: TTG
tacatgaatgtttacagcaa

SEQ ID NO: 110644 - DNA, 20 bp, Artificial Sequence
  Description of Artificial Sequence: Synthetic oligonucleotide
  Target: SCN9A; (+) strand; PAM type: YTN; PAM sequence: TTT
acagcaacattatgcattat

SEQ ID NO: 110645 - DNA, 20 bp, Artificial Sequence
  Description of Artificial Sequence: Synthetic oligonucleotide
  Target: SCN9A; (+) strand; PAM type: YTN; PAM sequence: TTA
cagcaacattatgcattata

SEQ ID NO: 110646 - DNA, 20 bp, Artificial Sequence
  Description of Artificial Sequence: Synthetic oligonucleotide
  Target: SCN9A; (+) strand; PAM type: YTN; PAM sequence: TTA
tgcattataaccaaaagacg

SEQ ID NO: 110647 - DNA, 20 bp, Artificial Sequence
  Description of Artificial Sequence: Synthetic oligonucleotide
  Target: SCN9A; (+) strand; PAM type: YTN; PAM sequence: TTA
taaccaaaagacggaaataa

SEQ ID NO: 110648 - DNA, 20 bp, Artificial Sequence
  Description of Artificial Sequence: Synthetic oligonucleotide
  Target: SCN9A; (+) strand; PAM type: YTN; PAM sequence: CTG
atgaatgtataaacaaaata

SEQ ID NO: 110649 - DNA, 20 bp, Artificial Sequence
  Description of Artificial Sequence: Synthetic oligonucleotide
  Target: SCN9A; (+) strand; PAM type: YTN; PAM sequence: TTT
agcaataaaaagaaatgaag

SEQ ID NO: 110650 - DNA, 20 bp, Artificial Sequence
  Description of Artificial Sequence: Synthetic oligonucleotide
  Target: SCN9A; (+) strand; PAM type: YTN; PAM sequence: TTA
gcaataaaaagaaatgaagc

SEQ ID NO: 110651 - DNA, 20 bp, Artificial Sequence
  Description of Artificial Sequence: Synthetic oligonucleotide
  Target: SCN9A; (+) strand; PAM type: YTN; PAM sequence: CTA
taccatggataaattttgaa

SEQ ID NO: 110652 - DNA, 20 bp, Artificial Sequence
  Description of Artificial Sequence: Synthetic oligonucleotide
  Target: SCN9A; (+) strand; PAM type: YTN; PAM sequence: TTT
tgaaaacattatgctaggtg

SEQ ID NO: 110653 - DNA, 20 bp, Artificial Sequence
  Description of Artificial Sequence: Synthetic oligonucleotide
  Target: SCN9A; (+) strand; PAM type: YTN; PAM sequence: TTT
gaaaacattatgctaggtgt

SEQ ID NO: 110654 - DNA, 20 bp, Artificial Sequence
  Description of Artificial Sequence: Synthetic oligonucleotide
  Target: SCN9A; (+) strand; PAM type: YTN; PAM sequence: TTG
aaaacattatgctaggtgta

SEQ ID NO: 110655 - DNA, 20 bp, Artificial Sequence
  Description of Artificial Sequence: Synthetic oligonucleotide
  Target: SCN9A; (+) strand; PAM type: YTN; PAM sequence: TTA
tgctaggtgtaagaagccag

SEQ ID NO: 110656 - DNA, 20 bp, Artificial Sequence
  Description of Artificial Sequence: Synthetic oligonucleotide
  Target: SCN9A; (+) strand; PAM type: YTN; PAM sequence: CTA
ggtgtaagaagccagataca

SEQ ID NO: 110657 - DNA, 20 bp, Artificial Sequence
  Description of Artificial Sequence: Synthetic oligonucleotide
  Target: SCN9A; (+) strand; PAM type: YTN; PAM sequence: TTA
tatgcttccatgtatattaa

SEQ ID NO: 110658 - DNA, 20 bp, Artificial Sequence
  Description of Artificial Sequence: Synthetic oligonucleotide
  Target: SCN9A; (+) strand; PAM type: YTN; PAM sequence: CTT
ccatgtatattaaatctaca

SEQ ID NO: 110659 - DNA, 20 bp, Artificial Sequence
  Description of Artificial Sequence: Synthetic oligonucleotide
  Target: SCN9A; (+) strand; PAM type: YTN; PAM sequence: TTC
catgtatattaaatctacag

SEQ ID NO: 110660 - DNA, 20 bp, Artificial Sequence
  Description of Artificial Sequence: Synthetic oligonucleotide
  Target: SCN9A; (+) strand; PAM type: YTN; PAM sequence: TTA
aatctacagagtgggtaaat

SEQ ID NO: 110661 - DNA, 20 bp, Artificial Sequence
  Description of Artificial Sequence: Synthetic oligonucleotide
  Target: SCN9A; (+) strand; PAM type: YTN; PAM sequence: CTA
cagagtgggtaaatccctag

SEQ ID NO: 110662 - DNA, 20 bp, Artificial Sequence
  Description of Artificial Sequence: Synthetic oligonucleotide
  Target: SCN9A; (+) strand; PAM type: YTN; PAM sequence: CTA
gggacagaaagtagattagt

SEQ ID NO: 110663 - DNA, 20 bp, Artificial Sequence
  Description of Artificial Sequence: Synthetic oligonucleotide
  Target: SCN9A; (+) strand; PAM type: YTN; PAM sequence: TTA
gtggttgccaggggctggga

SEQ ID NO: 110664 - DNA, 20 bp, Artificial Sequence
  Description of Artificial Sequence: Synthetic oligonucleotide
  Target: SCN9A; (+) strand; PAM type: YTN; PAM sequence: TTG
ccaggggctgggagaaaagg

SEQ ID NO: 110665 - DNA, 20 bp, Artificial Sequence
  Description of Artificial Sequence: Synthetic oligonucleotide
  Target: SCN9A; (+) strand; PAM type: YTN; PAM sequence: CTG
ggagaaaagggaaatgggga

SEQ ID NO: 110666 - DNA, 20 bp, Artificial Sequence
  Description of Artificial Sequence: Synthetic oligonucleotide
  Target: SCN9A; (+) strand; PAM type: YTN; PAM sequence: CTA
ctaacgggccctgggtttct

SEQ ID NO: 110667 - DNA, 20 bp, Artificial Sequence
  Description of Artificial Sequence: Synthetic oligonucleotide
  Target: SCN9A; (+) strand; PAM type: YTN; PAM sequence: CTA
acgggccctgggtttcttgg

SEQ ID NO: 110668 - DNA, 20 bp, Artificial Sequence
  Description of Artificial Sequence: Synthetic oligonucleotide
  Target: SCN9A; (+) strand; PAM type: YTN; PAM sequence: CTG
ggtttcttggtgggaaagat

SEQ ID NO: 110669 - DNA, 20 bp, Artificial Sequence
  Description of Artificial Sequence: Synthetic oligonucleotide
  Target: SCN9A; (+) strand; PAM type: YTN; PAM sequence: TTT
cttggtgggaaagatgaaaa

SEQ ID NO: 110670 - DNA, 20 bp, Artificial Sequence
  Description of Artificial Sequence: Synthetic oligonucleotide
  Target: SCN9A; (+) strand; PAM type: YTN; PAM sequence: TTC
ttggtgggaaagatgaaaat

SEQ ID NO: 110671 - DNA, 20 bp, Artificial Sequence
  Description of Artificial Sequence: Synthetic oligonucleotide
  Target: SCN9A; (+) strand; PAM type: YTN; PAM sequence: CTT
ggtgggaaagatgaaaatat

SEQ ID NO: 110672 - DNA, 20 bp, Artificial Sequence
  Description of Artificial Sequence: Synthetic oligonucleotide
  Target: SCN9A; (+) strand; PAM type: YTN; PAM sequence: TTG
gtgggaaagatgaaaatatt

SEQ ID NO: 110673 - DNA, 20 bp, Artificial Sequence
  Description of Artificial Sequence: Synthetic oligonucleotide
  Target: SCN9A; (+) strand; PAM type: YTN; PAM sequence: TTT
taaattagatagtggcgatc

SEQ ID NO: 110674 - DNA, 20 bp, Artificial Sequence
  Description of Artificial Sequence: Synthetic oligonucleotide
  Target: SCN9A; (+) strand; PAM type: YTN; PAM sequence: TTT
aaattagatagtggcgatcg

SEQ ID NO: 110675 - DNA, 20 bp, Artificial Sequence
  Description of Artificial Sequence: Synthetic oligonucleotide
  Target: SCN9A; (+) strand; PAM type: YTN; PAM sequence: TTA
aattagatagtggcgatcgt

SEQ ID NO: 110676 - DNA, 20 bp, Artificial Sequence
  Description of Artificial Sequence: Synthetic oligonucleotide
  Target: SCN9A; (+) strand; PAM type: YTN; PAM sequence: TTA
gatagtggcgatcgttgcac

SEQ ID NO: 110677 - DNA, 20 bp, Artificial Sequence
  Description of Artificial Sequence: Synthetic oligonucleotide
  Target: SCN9A; (+) strand; PAM type: YTN; PAM sequence: TTG
cacaactctgagtatagttt

SEQ ID NO: 110678 - DNA, 20 bp, Artificial Sequence
  Description of Artificial Sequence: Synthetic oligonucleotide
  Target: SCN9A; (+) strand; PAM type: YTN; PAM sequence: CTC
tgagtatagtttaaaaaatg

SEQ ID NO: 110679 - DNA, 20 bp, Artificial Sequence
  Description of Artificial Sequence: Synthetic oligonucleotide
  Target: SCN9A; (+) strand; PAM type: YTN; PAM sequence: CTG
agtatagtttaaaaaatgag

SEQ ID NO: 110680 - DNA, 20 bp, Artificial Sequence
  Description of Artificial Sequence: Synthetic oligonucleotide
  Target: SCN9A; (+) strand; PAM type: YTN; PAM sequence: TTT
aaaaaatgagttatacagtt

SEQ ID NO: 110681 - DNA, 20 bp, Artificial Sequence
  Description of Artificial Sequence: Synthetic oligonucleotide
  Target: SCN9A; (+) strand; PAM type: YTN; PAM sequence: TTA
aaaaatgagttatacagttt

SEQ ID NO: 110682 - DNA, 20 bp, Artificial Sequence
  Description of Artificial Sequence: Synthetic oligonucleotide
  Target: SCN9A; (+) strand; PAM type: YTN; PAM sequence: TTA
tacagtttaaaaaaaggaat

SEQ ID NO: 110683 - DNA, 20 bp, Artificial Sequence
  Description of Artificial Sequence: Synthetic oligonucleotide
  Target: SCN9A; (+) strand; PAM type: YTN; PAM sequence: TTT
aaaaaaaggaattttgtggc

SEQ ID NO: 110684 - DNA, 20 bp, Artificial Sequence
  Description of Artificial Sequence: Synthetic oligonucleotide
  Target: SCN9A; (+) strand; PAM type: YTN; PAM sequence: TTA
aaaaaaggaattttgtggca

SEQ ID NO: 110685 - DNA, 20 bp, Artificial Sequence
  Description of Artificial Sequence: Synthetic oligonucleotide
  Target: SCN9A; (+) strand; PAM type: YTN; PAM sequence: TTT
tgtggcatataaattattcc

SEQ ID NO: 110686 - DNA, 20 bp, Artificial Sequence
  Description of Artificial Sequence: Synthetic oligonucleotide
  Target: SCN9A; (+) strand; PAM type: YTN; PAM sequence: TTT
gtggcatataaattattcct

SEQ ID NO: 110687 - DNA, 20 bp, Artificial Sequence
  Description of Artificial Sequence: Synthetic oligonucleotide
  Target: SCN9A; (+) strand; PAM type: YTN; PAM sequence: TTG
tggcatataaattattcctc

SEQ ID NO: 110688 - DNA, 20 bp, Artificial Sequence
  Description of Artificial Sequence: Synthetic oligonucleotide
  Target: SCN9A; (+) strand; PAM type: YTN; PAM sequence: TTA
ttcctcaataaacctatttt

SEQ ID NO: 110689 - DNA, 20 bp, Artificial Sequence
  Description of Artificial Sequence: Synthetic oligonucleotide
  Target: SCN9A; (+) strand; PAM type: YTN; PAM sequence: TTC
ctcaataaacctatttttaa

SEQ ID NO: 110690 - DNA, 20 bp, Artificial Sequence
  Description of Artificial Sequence: Synthetic oligonucleotide
  Target: SCN9A; (+) strand; PAM type: YTN; PAM sequence: CTC
aataaacctatttttaaaag

SEQ ID NO: 110691 - DNA, 20 bp, Artificial Sequence
  Description of Artificial Sequence: Synthetic oligonucleotide
  Target: SCN9A; (+) strand; PAM type: YTN; PAM sequence: CTA
tttttaaaagggaatgcagc

SEQ ID NO: 110692 - DNA, 20 bp, Artificial Sequence
  Description of Artificial Sequence: Synthetic oligonucleotide
  Target: SCN9A; (+) strand; PAM type: YTN; PAM sequence: TTT
ttaaaagggaatgcagcata

SEQ ID NO: 110693 - DNA, 20 bp, Artificial Sequence
  Description of Artificial Sequence: Synthetic oligonucleotide
  Target: SCN9A; (+) strand; PAM type: YTN; PAM sequence: TTT
taaaagggaatgcagcataa

SEQ ID NO: 110694 - DNA, 20 bp, Artificial Sequence
  Description of Artificial Sequence: Synthetic oligonucleotide
  Target: SCN9A; (+) strand; PAM type: YTN; PAM sequence: TTT
aaaagggaatgcagcataac

SEQ ID NO: 110695 - DNA, 20 bp, Artificial Sequence
  Description of Artificial Sequence: Synthetic oligonucleotide
  Target: SCN9A; (+) strand; PAM type: YTN; PAM sequence: TTA
aaagggaatgcagcataacg

SEQ ID NO: 110696 - DNA, 20 bp, Artificial Sequence
  Description of Artificial Sequence: Synthetic oligonucleotide
  Target: SCN9A; (+) strand; PAM type: YTN; PAM sequence: TTG
tgggtgggggtaaataaatg

SEQ ID NO: 110697 - DNA, 20 bp, Artificial Sequence
  Description of Artificial Sequence: Synthetic oligonucleotide
  Target: SCN9A; (+) strand; PAM type: YTN; PAM sequence: CTT
atcactaaaatacgtatggg

SEQ ID NO: 110698 - DNA, 20 bp, Artificial Sequence
  Description of Artificial Sequence: Synthetic oligonucleotide
  Target: SCN9A; (+) strand; PAM type: YTN; PAM sequence: TTA
tcactaaaatacgtatgggg

SEQ ID NO: 110699 - DNA, 20 bp, Artificial Sequence
  Description of Artificial Sequence: Synthetic oligonucleotide
  Target: SCN9A; (+) strand; PAM type: YTN; PAM sequence: CTA
aaatacgtatggggaaaatg

SEQ ID NO: 110700 - DNA, 20 bp, Artificial Sequence
  Description of Artificial Sequence: Synthetic oligonucleotide
  Target: SCN9A; (+) strand; PAM type: YTN; PAM sequence: TTG
atataacaaaaatacagaat

SEQ ID NO: 110701 - DNA, 20 bp, Artificial Sequence
  Description of Artificial Sequence: Synthetic oligonucleotide
  Target: SCN9A; (+) strand; PAM type: YTN; PAM sequence: TTG
atattaaatctaatgaagat

SEQ ID NO: 110702 - DNA, 20 bp, Artificial Sequence
  Description of Artificial Sequence: Synthetic oligonucleotide
  Target: SCN9A; (+) strand; PAM type: YTN; PAM sequence: TTA
aatctaatgaagattctggg

SEQ ID NO: 110703 - DNA, 20 bp, Artificial Sequence
  Description of Artificial Sequence: Synthetic oligonucleotide
  Target: SCN9A; (+) strand; PAM type: YTN; PAM sequence: CTA
atgaagattctgggtgaagt

SEQ ID NO: 110704 - DNA, 20 bp, Artificial Sequence
  Description of Artificial Sequence: Synthetic oligonucleotide
  Target: SCN9A; (+) strand; PAM type: YTN; PAM sequence: TTC
tgggtgaagtttttaaatta

SEQ ID NO: 110705 - DNA, 20 bp, Artificial Sequence
  Description of Artificial Sequence: Synthetic oligonucleotide
  Target: SCN9A; (+) strand; PAM type: YTN; PAM sequence: CTG
ggtgaagtttttaaattaat

SEQ ID NO: 110706 - DNA, 20 bp, Artificial Sequence
  Description of Artificial Sequence: Synthetic oligonucleotide
  Target: SCN9A; (+) strand; PAM type: YTN; PAM sequence: TTT
ttaaattaattttcaagatt

SEQ ID NO: 110707 - DNA, 20 bp, Artificial Sequence
  Description of Artificial Sequence: Synthetic oligonucleotide
  Target: SCN9A; (+) strand; PAM type: YTN; PAM sequence: TTT
taaattaattttcaagatta

SEQ ID NO: 110708 - DNA, 20 bp, Artificial Sequence
  Description of Artificial Sequence: Synthetic oligonucleotide
  Target: SCN9A; (+) strand; PAM type: YTN; PAM sequence: TTT
aaattaattttcaagattaa

SEQ ID NO: 110709 - DNA, 20 bp, Artificial Sequence
  Description of Artificial Sequence: Synthetic oligonucleotide
  Target: SCN9A; (+) strand; PAM type: YTN; PAM sequence: TTA
aattaattttcaagattaat

SEQ ID NO: 110710 - DNA, 20 bp, Artificial Sequence
  Description of Artificial Sequence: Synthetic oligonucleotide
  Target: SCN9A; (+) strand; PAM type: YTN; PAM sequence: TTA
attttcaagattaatgtagc

SEQ ID NO: 110711 - DNA, 20 bp, Artificial Sequence
  Description of Artificial Sequence: Synthetic oligonucleotide
  Target: SCN9A; (+) strand; PAM type: YTN; PAM sequence: TTT
tcaagattaatgtagcaaaa

SEQ ID NO: 110712 - DNA, 20 bp, Artificial Sequence
  Description of Artificial Sequence: Synthetic oligonucleotide
  Target: SCN9A; (+) strand; PAM type: YTN; PAM sequence: TTT
caagattaatgtagcaaaat

SEQ ID NO: 110713 - DNA, 20 bp, Artificial Sequence
  Description of Artificial Sequence: Synthetic oligonucleotide
  Target: SCN9A; (+) strand; PAM type: YTN; PAM sequence: TTC
aagattaatgtagcaaaata

SEQ ID NO: 110714 - DNA, 20 bp, Artificial Sequence
  Description of Artificial Sequence: Synthetic oligonucleotide
  Target: SCN9A; (+) strand; PAM type: YTN; PAM sequence: TTA
atgtagcaaaatagaaaaaa

SEQ ID NO: 110715 - DNA, 20 bp, Artificial Sequence
  Description of Artificial Sequence: Synthetic oligonucleotide
  Target: SCN9A; (+) strand; PAM type: YTN; PAM sequence: TTC
tgcccttgctcagaaagaca

SEQ ID NO: 110716 - DNA, 20 bp, Artificial Sequence
  Description of Artificial Sequence: Synthetic oligonucleotide
  Target: SCN9A; (+) strand; PAM type: YTN; PAM sequence: CTG
cccttgctcagaaagacaac

SEQ ID NO: 110717 - DNA, 20 bp, Artificial Sequence
  Description of Artificial Sequence: Synthetic oligonucleotide
  Target: SCN9A; (+) strand; PAM type: YTN; PAM sequence: CTT
gctcagaaagacaacttatg

SEQ ID NO: 110718 - DNA, 20 bp, Artificial Sequence
  Description of Artificial Sequence: Synthetic oligonucleotide
  Target: SCN9A; (+) strand; PAM type: YTN; PAM sequence: TTG
ctcagaaagacaacttatga

SEQ ID NO: 110719 - DNA, 20 bp, Artificial Sequence
  Description of Artificial Sequence: Synthetic oligonucleotide
  Target: SCN9A; (+) strand; PAM type: YTN; PAM sequence: CTC
agaaagacaacttatgacaa

SEQ ID NO: 110720 - DNA, 20 bp, Artificial Sequence
  Description of Artificial Sequence: Synthetic oligonucleotide
  Target: SCN9A; (+) strand; PAM type: YTN; PAM sequence: CTT
atgacaattgtgtatggctt

SEQ ID NO: 110721 - DNA, 20 bp, Artificial Sequence
  Description of Artificial Sequence: Synthetic oligonucleotide
  Target: SCN9A; (+) strand; PAM type: YTN; PAM sequence: TTA
tgacaattgtgtatggcttg

SEQ ID NO: 110722 - DNA, 20 bp, Artificial Sequence
  Description of Artificial Sequence: Synthetic oligonucleotide
  Target: SCN9A; (+) strand; PAM type: YTN; PAM sequence: TTG
tgtatggcttgggcctatgg

SEQ ID NO: 110723 - DNA, 20 bp, Artificial Sequence
  Description of Artificial Sequence: Synthetic oligonucleotide
  Target: SCN9A; (+) strand; PAM type: YTN; PAM sequence: CTT
gggcctatggaagtgaagag

SEQ ID NO: 110724 - DNA, 20 bp, Artificial Sequence
  Description of Artificial Sequence: Synthetic oligonucleotide
  Target: SCN9A; (+) strand; PAM type: YTN; PAM sequence: TTG
ggcctatggaagtgaagagt

SEQ ID NO: 110725 - DNA, 20 bp, Artificial Sequence
  Description of Artificial Sequence: Synthetic oligonucleotide
  Target: SCN9A; (+) strand; PAM type: YTN; PAM sequence: CTA
tggaagtgaagagtatatcc

SEQ ID NO: 110726 - DNA, 20 bp, Artificial Sequence
  Description of Artificial Sequence: Synthetic oligonucleotide
  Target: SCN9A; (+) strand; PAM type: YTN; PAM sequence: CTC
tgagaaaactagtgcagggg

SEQ ID NO: 110727 - DNA, 20 bp, Artificial Sequence
  Description of Artificial Sequence: Synthetic oligonucleotide
  Target: SCN9A; (+) strand; PAM type: YTN; PAM sequence: CTG
agaaaactagtgcaggggat

SEQ ID NO: 110728 - DNA, 20 bp, Artificial Sequence
  Description of Artificial Sequence: Synthetic oligonucleotide
  Target: SCN9A; (+) strand; PAM type: YTN; PAM sequence: CTA
gtgcaggggatcaggactgg

SEQ ID NO: 110729 - DNA, 20 bp, Artificial Sequence
  Description of Artificial Sequence: Synthetic oligonucleotide
  Target: SCN9A; (+) strand; PAM type: YTN; PAM sequence: CTG
ggcagagggcctgcacatga

SEQ ID NO: 110730 - DNA, 20 bp, Artificial Sequence
  Description of Artificial Sequence: Synthetic oligonucleotide
  Target: SCN9A; (+) strand; PAM type: YTN; PAM sequence: CTG
cacatgatactctacactct

SEQ ID NO: 110731 - DNA, 20 bp, Artificial Sequence
  Description of Artificial Sequence: Synthetic oligonucleotide
  Target: SCN9A; (+) strand; PAM type: YTN; PAM sequence: CTC
tacactctggcaaatgtagt

SEQ ID NO: 110732 - DNA, 20 bp, Artificial Sequence
  Description of Artificial Sequence: Synthetic oligonucleotide
  Target: SCN9A; (+) strand; PAM type: YTN; PAM sequence: CTA
cactctggcaaatgtagttc

SEQ ID NO: 110733 - DNA, 20 bp, Artificial Sequence
  Description of Artificial Sequence: Synthetic oligonucleotide
  Target: SCN9A; (+) strand; PAM type: YTN; PAM sequence: CTC
tggcaaatgtagttctcaca

SEQ ID NO: 110734 - DNA, 20 bp, Artificial Sequence
  Description of Artificial Sequence: Synthetic oligonucleotide
  Target: SCN9A; (+) strand; PAM type: YTN; PAM sequence: CTG
gcaaatgtagttctcacaag

SEQ ID NO: 110735 - DNA, 20 bp, Artificial Sequence
  Description of Artificial Sequence: Synthetic oligonucleotide
  Target: SCN9A; (+) strand; PAM type: YTN; PAM sequence: TTC
tcacaagaaaacagctgtag

SEQ ID NO: 110736 - DNA, 20 bp, Artificial Sequence
  Description of Artificial Sequence: Synthetic oligonucleotide
  Target: SCN9A; (+) strand; PAM type: YTN; PAM sequence: CTC
acaagaaaacagctgtagat

SEQ ID NO: 110737 - DNA, 20 bp, Artificial Sequence
  Description of Artificial Sequence: Synthetic oligonucleotide
  Target: SCN9A; (+) strand; PAM type: YTN; PAM sequence: CTG
tagatgaaggagataggaaa

SEQ ID NO: 110738 - DNA, 20 bp, Artificial Sequence
  Description of Artificial Sequence: Synthetic oligonucleotide
  Target: SCN9A; (+) strand; PAM type: YTN; PAM sequence: TTC
ctgttagtagtgaaggccaa

SEQ ID NO: 110739 - DNA, 20 bp, Artificial Sequence
  Description of Artificial Sequence: Synthetic oligonucleotide
  Target: SCN9A; (+) strand; PAM type: YTN; PAM sequence: CTG
ttagtagtgaaggccaatat

SEQ ID NO: 110740 - DNA, 20 bp, Artificial Sequence
  Description of Artificial Sequence: Synthetic oligonucleotide
  Target: SCN9A; (+) strand; PAM type: YTN; PAM sequence: TTA
gtagtgaaggccaatattgc

SEQ ID NO: 110741 - DNA, 20 bp, Artificial Sequence
  Description of Artificial Sequence: Synthetic oligonucleotide
  Target: SCN9A; (+) strand; PAM type: YTN; PAM sequence: TTG
cggttttttcaaaactttct

SEQ ID NO: 110742 - DNA, 20 bp, Artificial Sequence
  Description of Artificial Sequence: Synthetic oligonucleotide
  Target: SCN9A; (+) strand; PAM type: YTN; PAM sequence: TTT
tttcaaaactttctctatta

SEQ ID NO: 110743 - DNA, 20 bp, Artificial Sequence
  Description of Artificial Sequence: Synthetic oligonucleotide
  Target: SCN9A; (+) strand; PAM type: YTN; PAM sequence: TTT
ttcaaaactttctctattaa

SEQ ID NO: 110744 - DNA, 20 bp, Artificial Sequence
  Description of Artificial Sequence: Synthetic oligonucleotide
  Target: SCN9A; (+) strand; PAM type: YTN; PAM sequence: TTT
tcaaaactttctctattaaa

SEQ ID NO: 110745 - DNA, 20 bp, Artificial Sequence
  Description of Artificial Sequence: Synthetic oligonucleotide
  Target: SCN9A; (+) strand; PAM type: YTN; PAM sequence: TTT
caaaactttctctattaaat

SEQ ID NO: 110746 - DNA, 20 bp, Artificial Sequence
  Description of Artificial Sequence: Synthetic oligonucleotide
  Target: SCN9A; (+) strand; PAM type: YTN; PAM sequence: TTC
aaaactttctctattaaatg

SEQ ID NO: 110747 - DNA, 20 bp, Artificial Sequence
  Description of Artificial Sequence: Synthetic oligonucleotide
  Target: SCN9A; (+) strand; PAM type: YTN; PAM sequence: CTT
tctctattaaatgtcaaata

SEQ ID NO: 110748 - DNA, 20 bp, Artificial Sequence
  Description of Artificial Sequence: Synthetic oligonucleotide
  Target: SCN9A; (+) strand; PAM type: YTN; PAM sequence: TTT
ctctattaaatgtcaaatat

SEQ ID NO: 110749 - DNA, 20 bp, Artificial Sequence
  Description of Artificial Sequence: Synthetic oligonucleotide
  Target: SCN9A; (+) strand; PAM type: YTN; PAM sequence: TTC
tctattaaatgtcaaatatt

SEQ ID NO: 110750 - DNA, 20 bp, Artificial Sequence
  Description of Artificial Sequence: Synthetic oligonucleotide
  Target: SCN9A; (+) strand; PAM type: YTN; PAM sequence: CTC
tattaaatgtcaaatattag

SEQ ID NO: 110751 - DNA, 20 bp, Artificial Sequence
  Description of Artificial Sequence: Synthetic oligonucleotide
  Target: SCN9A; (+) strand; PAM type: YTN; PAM sequence: CTA
ttaaatgtcaaatattagaa

SEQ ID NO: 110752 - DNA, 20 bp, Artificial Sequence
  Description of Artificial Sequence: Synthetic oligonucleotide
  Target: SCN9A; (+) strand; PAM type: YTN; PAM sequence: TTA
aatgtcaaatattagaaaaa

SEQ ID NO: 110753 - DNA, 20 bp, Artificial Sequence
  Description of Artificial Sequence: Synthetic oligonucleotide
  Target: SCN9A; (+) strand; PAM type: YTN; PAM sequence: TTA
gaaaaacaggaggaagagaa

SEQ ID NO: 110754 - DNA, 20 bp, Artificial Sequence
  Description of Artificial Sequence: Synthetic oligonucleotide
  Target: SCN9A; (+) strand; PAM type: YTN; PAM sequence: CTG
ttttagcccaatataaccac

SEQ ID NO: 110755 - DNA, 20 bp, Artificial Sequence
  Description of Artificial Sequence: Synthetic oligonucleotide
  Target: SCN9A; (+) strand; PAM type: YTN; PAM sequence: TTT
tagcccaatataaccacagt

SEQ ID NO: 110756 - DNA, 20 bp, Artificial Sequence
  Description of Artificial Sequence: Synthetic oligonucleotide
  Target: SCN9A; (+) strand; PAM type: YTN; PAM sequence: TTT
agcccaatataaccacagta

SEQ ID NO: 110757 - DNA, 20 bp, Artificial Sequence
  Description of Artificial Sequence: Synthetic oligonucleotide
  Target: SCN9A; (+) strand; PAM type: YTN; PAM sequence: TTA
gcccaatataaccacagtat

SEQ ID NO: 110758 - DNA, 20 bp, Artificial Sequence
  Description of Artificial Sequence: Synthetic oligonucleotide
  Target: SCN9A; (+) strand; PAM type: YTN; PAM sequence: TTT
ctccataatactgcacattt

SEQ ID NO: 110759 - DNA, 20 bp, Artificial Sequence
  Description of Artificial Sequence: Synthetic oligonucleotide
  Target: SCN9A; (+) strand; PAM type: YTN; PAM sequence: TTC
tccataatactgcacattta

SEQ ID NO: 110760 - DNA, 20 bp, Artificial Sequence
  Description of Artificial Sequence: Synthetic oligonucleotide
  Target: SCN9A; (+) strand; PAM type: YTN; PAM sequence: CTC
cataatactgcacatttagc

SEQ ID NO: 110761 - DNA, 20 bp, Artificial Sequence
  Description of Artificial Sequence: Synthetic oligonucleotide
  Target: SCN9A; (+) strand; PAM type: YTN; PAM sequence: CTG
cacatttagctacacactgt

SEQ ID NO: 110762 - DNA, 20 bp, Artificial Sequence
  Description of Artificial Sequence: Synthetic oligonucleotide
  Target: SCN9A; (+) strand; PAM type: YTN; PAM sequence: TTT
agctacacactgtgcacatg

SEQ ID NO: 110763 - DNA, 20 bp, Artificial Sequence
  Description of Artificial Sequence: Synthetic oligonucleotide
  Target: SCN9A; (+) strand; PAM type: YTN; PAM sequence: TTA
gctacacactgtgcacatga

SEQ ID NO: 110764 - DNA, 20 bp, Artificial Sequence
  Description of Artificial Sequence: Synthetic oligonucleotide
  Target: SCN9A; (+) strand; PAM type: YTN; PAM sequence: CTA
cacactgtgcacatgaaccc

SEQ ID NO: 110765 - DNA, 20 bp, Artificial Sequence
  Description of Artificial Sequence: Synthetic oligonucleotide
  Target: SCN9A; (+) strand; PAM type: YTN; PAM sequence: CTG
tgcacatgaaccccactttc

SEQ ID NO: 110766 - DNA, 20 bp, Artificial Sequence
  Description of Artificial Sequence: Synthetic oligonucleotide
  Target: SCN9A; (+) strand; PAM type: YTN; PAM sequence: CTT
tcatctgtagcagcataaaa

SEQ ID NO: 110767 - DNA, 20 bp, Artificial Sequence
  Description of Artificial Sequence: Synthetic oligonucleotide
  Target: SCN9A; (+) strand; PAM type: YTN; PAM sequence: TTT
catctgtagcagcataaaaa

SEQ ID NO: 110768 - DNA, 20 bp, Artificial Sequence
  Description of Artificial Sequence: Synthetic oligonucleotide
  Target: SCN9A; (+) strand; PAM type: YTN; PAM sequence: TTC
atctgtagcagcataaaaaa

SEQ ID NO: 110769 - DNA, 20 bp, Artificial Sequence
  Description of Artificial Sequence: Synthetic oligonucleotide
  Target: SCN9A; (+) strand; PAM type: YTN; PAM sequence: CTG
tagcagcataaaaaagtgtt

SEQ ID NO: 110770 - DNA, 20 bp, Artificial Sequence
  Description of Artificial Sequence: Synthetic oligonucleotide
  Target: SCN9A; (+) strand; PAM type: YTN; PAM sequence: TTT
gatgagcatcaaagtagaca

SEQ ID NO: 110771 - DNA, 20 bp, Artificial Sequence
  Description of Artificial Sequence: Synthetic oligonucleotide
  Target: SCN9A; (+) strand; PAM type: YTN; PAM sequence: TTG
atgagcatcaaagtagacag

SEQ ID NO: 110772 - DNA, 20 bp, Artificial Sequence
  Description of Artificial Sequence: Synthetic oligonucleotide
  Target: SCN9A; (+) strand; PAM type: YTN; PAM sequence: CTA
caaattgtatgtttttcagc

SEQ ID NO: 110773 - DNA, 20 bp, Artificial Sequence
  Description of Artificial Sequence: Synthetic oligonucleotide
  Target: SCN9A; (+) strand; PAM type: YTN; PAM sequence: TTG
tatgtttttcagcaggaggt

SEQ ID NO: 110774 - DNA, 20 bp, Artificial Sequence
  Description of Artificial Sequence: Synthetic oligonucleotide
  Target: SCN9A; (+) strand; PAM type: YTN; PAM sequence: TTT
ttcagcaggaggtgagacag

SEQ ID NO: 110775 - DNA, 20 bp, Artificial Sequence
  Description of Artificial Sequence: Synthetic oligonucleotide
  Target: SCN9A; (+) strand; PAM type: YTN; PAM sequence: TTT
tcagcaggaggtgagacagt

SEQ ID NO: 110776 - DNA, 20 bp, Artificial Sequence
  Description of Artificial Sequence: Synthetic oligonucleotide
  Target: SCN9A; (+) strand; PAM type: YTN; PAM sequence: TTT
cagcaggaggtgagacagtg

SEQ ID NO: 110777 - DNA, 20 bp, Artificial Sequence
  Description of Artificial Sequence: Synthetic oligonucleotide
  Target: SCN9A; (+) strand; PAM type: YTN; PAM sequence: TTC
agcaggaggtgagacagtgg

SEQ ID NO: 110778 - DNA, 20 bp, Artificial Sequence
  Description of Artificial Sequence: Synthetic oligonucleotide
  Target: SCN9A; (+) strand; PAM type: YTN; PAM sequence: TTA
atttatttgattgtgaattt

SEQ ID NO: 110779 - DNA, 20 bp, Artificial Sequence
  Description of Artificial Sequence: Synthetic oligonucleotide
  Target: SCN9A; (+) strand; PAM type: YTN; PAM sequence: TTT
atttgattgtgaatttggaa

SEQ ID NO: 110780 - DNA, 20 bp, Artificial Sequence
  Description of Artificial Sequence: Synthetic oligonucleotide
  Target: SCN9A; (+) strand; PAM type: YTN; PAM sequence: TTA
tttgattgtgaatttggaaa

SEQ ID NO: 110781 - DNA, 20 bp, Artificial Sequence
  Description of Artificial Sequence: Synthetic oligonucleotide
  Target: SCN9A; (+) strand; PAM type: YTN; PAM sequence: TTT
gattgtgaatttggaaaggc

SEQ ID NO: 110782 - DNA, 20 bp, Artificial Sequence
  Description of Artificial Sequence: Synthetic oligonucleotide
  Target: SCN9A; (+) strand; PAM type: YTN; PAM sequence: TTG
attgtgaatttggaaaggca

SEQ ID NO: 110783 - DNA, 20 bp, Artificial Sequence
  Description of Artificial Sequence: Synthetic oligonucleotide
  Target: SCN9A; (+) strand; PAM type: YTN; PAM sequence: TTG
tgaatttggaaaggcatttc

SEQ ID NO: 110784 - DNA, 20 bp, Artificial Sequence
  Description of Artificial Sequence: Synthetic oligonucleotide
  Target: SCN9A; (+) strand; PAM type: YTN; PAM sequence: TTT
ggaaaggcatttcggaaaat

SEQ ID NO: 110785 - DNA, 20 bp, Artificial Sequence
  Description of Artificial Sequence: Synthetic oligonucleotide
  Target: SCN9A; (+) strand; PAM type: YTN; PAM sequence: TTG
gaaaggcatttcggaaaata

SEQ ID NO: 110786 - DNA, 20 bp, Artificial Sequence
  Description of Artificial Sequence: Synthetic oligonucleotide
  Target: SCN9A; (+) strand; PAM type: YTN; PAM sequence: TTT
cggaaaatactttgctatag

SEQ ID NO: 110787 - DNA, 20 bp, Artificial Sequence
  Description of Artificial Sequence: Synthetic oligonucleotide
  Target: SCN9A; (+) strand; PAM type: YTN; PAM sequence: TTC
ggaaaatactttgctatagg

SEQ ID NO: 110788 - DNA, 20 bp, Artificial Sequence
  Description of Artificial Sequence: Synthetic oligonucleotide
  Target: SCN9A; (+) strand; PAM type: YTN; PAM sequence: CTT
tgctataggcaccagaaaat

SEQ ID NO: 110789 - DNA, 20 bp, Artificial Sequence
  Description of Artificial Sequence: Synthetic oligonucleotide
  Target: SCN9A; (+) strand; PAM type: YTN; PAM sequence: TTT
gctataggcaccagaaaatg

SEQ ID NO: 110790 - DNA, 20 bp, Artificial Sequence
  Description of Artificial Sequence: Synthetic oligonucleotide
  Target: SCN9A; (+) strand; PAM type: YTN; PAM sequence: TTG
ctataggcaccagaaaatgc

SEQ ID NO: 110791 - DNA, 20 bp, Artificial Sequence
  Description of Artificial Sequence: Synthetic oligonucleotide
  Target: SCN9A; (+) strand; PAM type: YTN; PAM sequence: CTA
taggcaccagaaaatgcttt

SEQ ID NO: 110792 - DNA, 20 bp, Artificial Sequence
  Description of Artificial Sequence: Synthetic oligonucleotide
  Target: SCN9A; (+) strand; PAM type: YTN; PAM sequence: CTT
ttagattatgctcaggttct

SEQ ID NO: 110793 - DNA, 20 bp, Artificial Sequence
  Description of Artificial Sequence: Synthetic oligonucleotide
  Target: SCN9A; (+) strand; PAM type: YTN; PAM sequence: TTT
tagattatgctcaggttctc

SEQ ID NO: 110794 - DNA, 20 bp, Artificial Sequence
  Description of Artificial Sequence: Synthetic oligonucleotide
  Target: SCN9A; (+) strand; PAM type: YTN; PAM sequence: TTT
agattatgctcaggttctct

SEQ ID NO: 110795 - DNA, 20 bp, Artificial Sequence
  Description of Artificial Sequence: Synthetic oligonucleotide
  Target: SCN9A; (+) strand; PAM type: YTN; PAM sequence: TTA
gattatgctcaggttctctg

SEQ ID NO: 110796 - DNA, 20 bp, Artificial Sequence
  Description of Artificial Sequence: Synthetic oligonucleotide
  Target: SCN9A; (+) strand; PAM type: YTN; PAM sequence: TTA
tgctcaggttctctgtgtag

SEQ ID NO: 110797 - DNA, 20 bp, Artificial Sequence
  Description of Artificial Sequence: Synthetic oligonucleotide
  Target: SCN9A; (+) strand; PAM type: YTN; PAM sequence: CTC
aggttctctgtgtagattgc

SEQ ID NO: 110798 - DNA, 20 bp, Artificial Sequence
  Description of Artificial Sequence: Synthetic oligonucleotide
  Target: SCN9A; (+) strand; PAM type: YTN; PAM sequence: TTC
tctgtgtagattgcctttac

SEQ ID NO: 110799 - DNA, 20 bp, Artificial Sequence
  Description of Artificial Sequence: Synthetic oligonucleotide
  Target: SCN9A; (+) strand; PAM type: YTN; PAM sequence: CTC
tgtgtagattgcctttacca

SEQ ID NO: 110800 - DNA, 20 bp, Artificial Sequence
  Description of Artificial Sequence: Synthetic oligonucleotide
  Target: SCN9A; (+) strand; PAM type: YTN; PAM sequence: CTG
tgtagattgcctttaccatt

SEQ ID NO: 110801 - DNA, 20 bp, Artificial Sequence
  Description of Artificial Sequence: Synthetic oligonucleotide
  Target: SCN9A; (+) strand; PAM type: YTN; PAM sequence: TTG
cctttaccattataattcct

SEQ ID NO: 110802 - DNA, 20 bp, Artificial Sequence
  Description of Artificial Sequence: Synthetic oligonucleotide
  Target: SCN9A; (+) strand; PAM type: YTN; PAM sequence: CTT
taccattataattccttgat

SEQ ID NO: 110803 - DNA, 20 bp, Artificial Sequence
  Description of Artificial Sequence: Synthetic oligonucleotide
  Target: SCN9A; (+) strand; PAM type: YTN; PAM sequence: TTT
accattataattccttgatc

SEQ ID NO: 110804 - DNA, 20 bp, Artificial Sequence
  Description of Artificial Sequence: Synthetic oligonucleotide
  Target: SCN9A; (+) strand; PAM type: YTN; PAM sequence: TTA
ccattataattccttgatct

SEQ ID NO: 110805 - DNA, 20 bp, Artificial Sequence
  Description of Artificial Sequence: Synthetic oligonucleotide
  Target: SCN9A; (+) strand; PAM type: YTN; PAM sequence: TTA
taattccttgatcttttaaa

SEQ ID NO: 110806 - DNA, 20 bp, Artificial Sequence
  Description of Artificial Sequence: Synthetic oligonucleotide
  Target: SCN9A; (+) strand; PAM type: YTN; PAM sequence: TTC
cttgatcttttaaatattgc

SEQ ID NO: 110807 - DNA, 20 bp, Artificial Sequence
  Description of Artificial Sequence: Synthetic oligonucleotide
  Target: SCN9A; (+) strand; PAM type: YTN; PAM sequence: CTT
gatcttttaaatattgccaa

SEQ ID NO: 110808 - DNA, 20 bp, Artificial Sequence
  Description of Artificial Sequence: Synthetic oligonucleotide
  Target: SCN9A; (+) strand; PAM type: YTN; PAM sequence: TTG
atcttttaaatattgccaat

SEQ ID NO: 110809 - DNA, 20 bp, Artificial Sequence
  Description of Artificial Sequence: Synthetic oligonucleotide
  Target: SCN9A; (+) strand; PAM type: YTN; PAM sequence: CTT
ttaaatattgccaattcatt

SEQ ID NO: 110810 - DNA, 20 bp, Artificial Sequence
  Description of Artificial Sequence: Synthetic oligonucleotide
  Target: SCN9A; (+) strand; PAM type: YTN; PAM sequence: TTT
taaatattgccaattcattt

SEQ ID NO: 110811 - DNA, 20 bp, Artificial Sequence
  Description of Artificial Sequence: Synthetic oligonucleotide
  Target: SCN9A; (+) strand; PAM type: YTN; PAM sequence: TTT
aaatattgccaattcatttg

SEQ ID NO: 110812 - DNA, 20 bp, Artificial Sequence
  Description of Artificial Sequence: Synthetic oligonucleotide
  Target: SCN9A; (+) strand; PAM type: YTN; PAM sequence: TTA
aatattgccaattcatttgc

SEQ ID NO: 110813 - DNA, 20 bp, Artificial Sequence
  Description of Artificial Sequence: Synthetic oligonucleotide
  Target: SCN9A; (+) strand; PAM type: YTN; PAM sequence: TTG
ccaattcatttgccttagca

SEQ ID NO: 110814 - DNA, 20 bp, Artificial Sequence
  Description of Artificial Sequence: Synthetic oligonucleotide
  Target: SCN9A; (+) strand; PAM type: YTN; PAM sequence: TTC
atttgccttagcactttctc

SEQ ID NO: 110815 - DNA, 20 bp, Artificial Sequence
  Description of Artificial Sequence: Synthetic oligonucleotide
  Target: SCN9A; (+) strand; PAM type: YTN; PAM sequence: TTT
gccttagcactttctcatga

SEQ ID NO: 110816 - DNA, 20 bp, Artificial Sequence
  Description of Artificial Sequence: Synthetic oligonucleotide
  Target: SCN9A; (+) strand; PAM type: YTN; PAM sequence: TTG
ccttagcactttctcatgat

SEQ ID NO: 110817 - DNA, 20 bp, Artificial Sequence
  Description of Artificial Sequence: Synthetic oligonucleotide
  Target: SCN9A; (+) strand; PAM type: YTN; PAM sequence: CTT
agcactttctcatgatctat

SEQ ID NO: 110818 - DNA, 20 bp, Artificial Sequence
  Description of Artificial Sequence: Synthetic oligonucleotide
  Target: SCN9A; (+) strand; PAM type: YTN; PAM sequence: TTA
gcactttctcatgatctatc

SEQ ID NO: 110819 - DNA, 20 bp, Artificial Sequence
  Description of Artificial Sequence: Synthetic oligonucleotide
  Target: SCN9A; (+) strand; PAM type: YTN; PAM sequence: CTT
tctcatgatctatcaaccaa

SEQ ID NO: 110820 - DNA, 20 bp, Artificial Sequence
  Description of Artificial Sequence: Synthetic oligonucleotide
  Target: SCN9A; (+) strand; PAM type: YTN; PAM sequence: TTT
ctcatgatctatcaaccaag

SEQ ID NO: 110821 - DNA, 20 bp, Artificial Sequence
  Description of Artificial Sequence: Synthetic oligonucleotide
  Target: SCN9A; (+) strand; PAM type: YTN; PAM sequence: TTC
tcatgatctatcaaccaagt

SEQ ID NO: 110822 - DNA, 20 bp, Artificial Sequence
  Description of Artificial Sequence: Synthetic oligonucleotide
  Target: SCN9A; (+) strand; PAM type: YTN; PAM sequence: CTC
atgatctatcaaccaagttc

SEQ ID NO: 110823 - DNA, 20 bp, Artificial Sequence
  Description of Artificial Sequence: Synthetic oligonucleotide
  Target: SCN9A; (+) strand; PAM type: YTN; PAM sequence: CTA
tcaaccaagttcttgtcact

SEQ ID NO: 110824 - DNA, 20 bp, Artificial Sequence
  Description of Artificial Sequence: Synthetic oligonucleotide
  Target: SCN9A; (+) strand; PAM type: YTN; PAM sequence: TTC
ttgtcactctttgtacagct

SEQ ID NO: 110825 - DNA, 20 bp, Artificial Sequence
  Description of Artificial Sequence: Synthetic oligonucleotide
  Target: SCN9A; (+) strand; PAM type: YTN; PAM sequence: CTT
gtcactctttgtacagctta

SEQ ID NO: 110826 - DNA, 20 bp, Artificial Sequence
  Description of Artificial Sequence: Synthetic oligonucleotide
  Target: SCN9A; (+) strand; PAM type: YTN; PAM sequence: TTG
tcactctttgtacagcttaa

SEQ ID NO: 110827 - DNA, 20 bp, Artificial Sequence
  Description of Artificial Sequence: Synthetic oligonucleotide
  Target: SCN9A; (+) strand; PAM type: YTN; PAM sequence: CTC
tttgtacagcttaaatccat

SEQ ID NO: 110828 - DNA, 20 bp, Artificial Sequence
  Description of Artificial Sequence: Synthetic oligonucleotide
  Target: SCN9A; (+) strand; PAM type: YTN; PAM sequence: CTT
tgtacagcttaaatccatgg

SEQ ID NO: 110829 - DNA, 20 bp, Artificial Sequence
  Description of Artificial Sequence: Synthetic oligonucleotide
  Target: SCN9A; (+) strand; PAM type: YTN; PAM sequence: TTT
gtacagcttaaatccatggg

SEQ ID NO: 110830 - DNA, 20 bp, Artificial Sequence
  Description of Artificial Sequence: Synthetic oligonucleotide
  Target: SCN9A; (+) strand; PAM type: YTN; PAM sequence: TTG
tacagcttaaatccatgggc

SEQ ID NO: 110831 - DNA, 20 bp, Artificial Sequence
  Description of Artificial Sequence: Synthetic oligonucleotide
  Target: SCN9A; (+) strand; PAM type: YTN; PAM sequence: CTT
aaatccatgggcattcatta

SEQ ID NO: 110832 - DNA, 20 bp, Artificial Sequence
  Description of Artificial Sequence: Synthetic oligonucleotide
  Target: SCN9A; (+) strand; PAM type: YTN; PAM sequence: TTA
aatccatgggcattcattat

SEQ ID NO: 110833 - DNA, 20 bp, Artificial Sequence
  Description of Artificial Sequence: Synthetic oligonucleotide
  Target: SCN9A; (+) strand; PAM type: YTN; PAM sequence: TTC
attatcatcagtgcctaacc

SEQ ID NO: 110834 - DNA, 20 bp, Artificial Sequence
  Description of Artificial Sequence: Synthetic oligonucleotide
  Target: SCN9A; (+) strand; PAM type: YTN; PAM sequence: TTA
tcatcagtgcctaacctggc

SEQ ID NO: 110835 - DNA, 20 bp, Artificial Sequence
  Description of Artificial Sequence: Synthetic oligonucleotide
  Target: SCN9A; (+) strand; PAM type: YTN; PAM sequence: CTA
acctggcagaaccacagtct

SEQ ID NO: 110836 - DNA, 20 bp, Artificial Sequence
  Description of Artificial Sequence: Synthetic oligonucleotide
  Target: SCN9A; (+) strand; PAM type: YTN; PAM sequence: CTG
gcagaaccacagtctacaca

SEQ ID NO: 110837 - DNA, 20 bp, Artificial Sequence
  Description of Artificial Sequence: Synthetic oligonucleotide
  Target: SCN9A; (+) strand; PAM type: YTN; PAM sequence: CTA
cacataatctggcatctgtc

SEQ ID NO: 110838 - DNA, 20 bp, Artificial Sequence
  Description of Artificial Sequence: Synthetic oligonucleotide
  Target: SCN9A; (+) strand; PAM type: YTN; PAM sequence: CTG
gcatctgtcttttccatgct

SEQ ID NO: 110839 - DNA, 20 bp, Artificial Sequence
  Description of Artificial Sequence: Synthetic oligonucleotide
  Target: SCN9A; (+) strand; PAM type: YTN; PAM sequence: CTG
tcttttccatgctggctacc

SEQ ID NO: 110840 - DNA, 20 bp, Artificial Sequence
  Description of Artificial Sequence: Synthetic oligonucleotide
  Target: SCN9A; (+) strand; PAM type: YTN; PAM sequence: CTT
ttccatgctggctaccaaat

SEQ ID NO: 110841 - DNA, 20 bp, Artificial Sequence
  Description of Artificial Sequence: Synthetic oligonucleotide
  Target: SCN9A; (+) strand; PAM type: YTN; PAM sequence: TTT
tccatgctggctaccaaatg

SEQ ID NO: 110842 - DNA, 20 bp, Artificial Sequence
  Description of Artificial Sequence: Synthetic oligonucleotide
  Target: SCN9A; (+) strand; PAM type: YTN; PAM sequence: TTT
ccatgctggctaccaaatgg

SEQ ID NO: 110843 - DNA, 20 bp, Artificial Sequence
  Description of Artificial Sequence: Synthetic oligonucleotide
  Target: SCN9A; (+) strand; PAM type: YTN; PAM sequence: TTC
catgctggctaccaaatggc

SEQ ID NO: 110844 - DNA, 20 bp, Artificial Sequence
  Description of Artificial Sequence: Synthetic oligonucleotide
  Target: SCN9A; (+) strand; PAM type: YTN; PAM sequence: CTG
gctaccaaatggctgaatgt

SEQ ID NO: 110845 - DNA, 20 bp, Artificial Sequence
  Description of Artificial Sequence: Synthetic oligonucleotide
  Target: SCN9A; (+) strand; PAM type: YTN; PAM sequence: CTA
ccaaatggctgaatgttggt

SEQ ID NO: 110846 - DNA, 20 bp, Artificial Sequence
  Description of Artificial Sequence: Synthetic oligonucleotide
  Target: SCN9A; (+) strand; PAM type: YTN; PAM sequence: CTG
aatgttggtggagaaactct

SEQ ID NO: 110847 - DNA, 20 bp, Artificial Sequence
  Description of Artificial Sequence: Synthetic oligonucleotide
  Target: SCN9A; (+) strand; PAM type: YTN; PAM sequence: TTG
gtggagaaactctcacaacc

SEQ ID NO: 110848 - DNA, 20 bp, Artificial Sequence
  Description of Artificial Sequence: Synthetic oligonucleotide
  Target: SCN9A; (+) strand; PAM type: YTN; PAM sequence: CTC
tcacaaccaagtgaatggtt

SEQ ID NO: 110849 - DNA, 20 bp, Artificial Sequence
  Description of Artificial Sequence: Synthetic oligonucleotide
  Target: SCN9A; (+) strand; PAM type: YTN; PAM sequence: CTC
acaaccaagtgaatggttat

SEQ ID NO: 110850 - DNA, 20 bp, Artificial Sequence
  Description of Artificial Sequence: Synthetic oligonucleotide
  Target: SCN9A; (+) strand; PAM type: YTN; PAM sequence: TTA
tattttaagtaagtaatctc

SEQ ID NO: 110851 - DNA, 20 bp, Artificial Sequence
  Description of Artificial Sequence: Synthetic oligonucleotide
  Target: SCN9A; (+) strand; PAM type: YTN; PAM sequence: TTT
taagtaagtaatctccaaca

SEQ ID NO: 110852 - DNA, 20 bp, Artificial Sequence
  Description of Artificial Sequence: Synthetic oligonucleotide
  Target: SCN9A; (+) strand; PAM type: YTN; PAM sequence: TTT
aagtaagtaatctccaacat

SEQ ID NO: 110853 - DNA, 20 bp, Artificial Sequence
  Description of Artificial Sequence: Synthetic oligonucleotide
  Target: SCN9A; (+) strand; PAM type: YTN; PAM sequence: TTA
agtaagtaatctccaacatc

SEQ ID NO: 110854 - DNA, 20 bp, Artificial Sequence
  Description of Artificial Sequence: Synthetic oligonucleotide
  Target: SCN9A; (+) strand; PAM type: YTN; PAM sequence: CTC
caacatcaaatttgcactca

SEQ ID NO: 110855 - DNA, 20 bp, Artificial Sequence
  Description of Artificial Sequence: Synthetic oligonucleotide
  Target: SCN9A; (+) strand; PAM type: YTN; PAM sequence: TTT
gcactcaaaatacactaaat

SEQ ID NO: 110856 - DNA, 20 bp, Artificial Sequence
  Description of Artificial Sequence: Synthetic oligonucleotide
  Target: SCN9A; (+) strand; PAM type: YTN; PAM sequence: TTG
cactcaaaatacactaaatt

SEQ ID NO: 110857 - DNA, 20 bp, Artificial Sequence
  Description of Artificial Sequence: Synthetic oligonucleotide
  Target: SCN9A; (+) strand; PAM type: YTN; PAM sequence: CTC
aaaatacactaaatttctca

SEQ ID NO: 110858 - DNA, 20 bp, Artificial Sequence
  Description of Artificial Sequence: Synthetic oligonucleotide
  Target: SCN9A; (+) strand; PAM type: YTN; PAM sequence: CTA
aatttctcatgccctgatat

SEQ ID NO: 110859 - DNA, 20 bp, Artificial Sequence
  Description of Artificial Sequence: Synthetic oligonucleotide
  Target: SCN9A; (+) strand; PAM type: YTN; PAM sequence: TTT
ctcatgccctgatatgacca

SEQ ID NO: 110860 - DNA, 20 bp, Artificial Sequence
  Description of Artificial Sequence: Synthetic oligonucleotide
  Target: SCN9A; (+) strand; PAM type: YTN; PAM sequence: TTC
tcatgccctgatatgaccat

SEQ ID NO: 110861 - DNA, 20 bp, Artificial Sequence
  Description of Artificial Sequence: Synthetic oligonucleotide
  Target: SCN9A; (+) strand; PAM type: YTN; PAM sequence: CTC
atgccctgatatgaccatat

SEQ ID NO: 110862 - DNA, 20 bp, Artificial Sequence
  Description of Artificial Sequence: Synthetic oligonucleotide
  Target: SCN9A; (+) strand; PAM type: YTN; PAM sequence: CTG
atatgaccatatatataatg

SEQ ID NO: 110863 - DNA, 20 bp, Artificial Sequence
  Description of Artificial Sequence: Synthetic oligonucleotide
  Target: SCN9A; (+) strand; PAM type: YTN; PAM sequence: TTC
tcatcaaatcatctgtagaa

SEQ ID NO: 110864 - DNA, 20 bp, Artificial Sequence
  Description of Artificial Sequence: Synthetic oligonucleotide
  Target: SCN9A; (+) strand; PAM type: YTN; PAM sequence: CTC
atcaaatcatctgtagaatt

SEQ ID NO: 110865 - DNA, 20 bp, Artificial Sequence
  Description of Artificial Sequence: Synthetic oligonucleotide
  Target: SCN9A; (+) strand; PAM type: YTN; PAM sequence: CTG
tagaattttctcttcctcat

SEQ ID NO: 110866 - DNA, 20 bp, Artificial Sequence
  Description of Artificial Sequence: Synthetic oligonucleotide
  Target: SCN9A; (+) strand; PAM type: YTN; PAM sequence: TTT
tctcttcctcatttgcactc

SEQ ID NO: 110867 - DNA, 20 bp, Artificial Sequence
  Description of Artificial Sequence: Synthetic oligonucleotide
  Target: SCN9A; (+) strand; PAM type: YTN; PAM sequence: TTT
ctcttcctcatttgcactct

SEQ ID NO: 110868 - DNA, 20 bp, Artificial Sequence
  Description of Artificial Sequence: Synthetic oligonucleotide
  Target: SCN9A; (+) strand; PAM type: YTN; PAM sequence: TTC
tcttcctcatttgcactctc

SEQ ID NO: 110869 - DNA, 20 bp, Artificial Sequence
  Description of Artificial Sequence: Synthetic oligonucleotide
  Target: SCN9A; (+) strand; PAM type: YTN; PAM sequence: CTC
ttcctcatttgcactctcag

SEQ ID NO: 110870 - DNA, 20 bp, Artificial Sequence
  Description of Artificial Sequence: Synthetic oligonucleotide
  Target: SCN9A; (+) strand; PAM type: YTN; PAM sequence: CTT
cctcatttgcactctcaggc

SEQ ID NO: 110871 - DNA, 20 bp, Artificial Sequence
  Description of Artificial Sequence: Synthetic oligonucleotide
  Target: SCN9A; (+) strand; PAM type: YTN; PAM sequence: TTC
ctcatttgcactctcaggca

SEQ ID NO: 110872 - DNA, 20 bp, Artificial Sequence
  Description of Artificial Sequence: Synthetic oligonucleotide
  Target: SCN9A; (+) strand; PAM type: YTN; PAM sequence: CTC
atttgcactctcaggcaatg

SEQ ID NO: 110873 - DNA, 20 bp, Artificial Sequence
  Description of Artificial Sequence: Synthetic oligonucleotide
  Target: SCN9A; (+) strand; PAM type: YTN; PAM sequence: TTT
gcactctcaggcaatgatcc

SEQ ID NO: 110874 - DNA, 20 bp, Artificial Sequence
  Description of Artificial Sequence: Synthetic oligonucleotide
  Target: SCN9A; (+) strand; PAM type: YTN; PAM sequence: TTG
cactctcaggcaatgatccc

SEQ ID NO: 110875 - DNA, 20 bp, Artificial Sequence
  Description of Artificial Sequence: Synthetic oligonucleotide
  Target: SCN9A; (+) strand; PAM type: YTN; PAM sequence: CTC
tcaggcaatgatcccatctt

SEQ ID NO: 110876 - DNA, 20 bp, Artificial Sequence
  Description of Artificial Sequence: Synthetic oligonucleotide
  Target: SCN9A; (+) strand; PAM type: YTN; PAM sequence: CTC
aggcaatgatcccatcttat

SEQ ID NO: 110877 - DNA, 20 bp, Artificial Sequence
  Description of Artificial Sequence: Synthetic oligonucleotide
  Target: SCN9A; (+) strand; PAM type: YTN; PAM sequence: CTT
atactttgaggaaataaaaa

SEQ ID NO: 110878 - DNA, 20 bp, Artificial Sequence
  Description of Artificial Sequence: Synthetic oligonucleotide
  Target: SCN9A; (+) strand; PAM type: YTN; PAM sequence: TTA
tactttgaggaaataaaaac

SEQ ID NO: 110879 - DNA, 20 bp, Artificial Sequence
  Description of Artificial Sequence: Synthetic oligonucleotide
  Target: SCN9A; (+) strand; PAM type: YTN; PAM sequence: CTT
tgaggaaataaaaaccattg

SEQ ID NO: 110880 - DNA, 20 bp, Artificial Sequence
  Description of Artificial Sequence: Synthetic oligonucleotide
  Target: SCN9A; (+) strand; PAM type: YTN; PAM sequence: TTT
gaggaaataaaaaccattgg

SEQ ID NO: 110881 - DNA, 20 bp, Artificial Sequence
  Description of Artificial Sequence: Synthetic oligonucleotide
  Target: SCN9A; (+) strand; PAM type: YTN; PAM sequence: TTG
aggaaataaaaaccattggg

SEQ ID NO: 110882 - DNA, 20 bp, Artificial Sequence
  Description of Artificial Sequence: Synthetic oligonucleotide
  Target: SCN9A; (+) strand; PAM type: YTN; PAM sequence: TTG
ggtttgaactcaatcatctt

SEQ ID NO: 110883 - DNA, 20 bp, Artificial Sequence
  Description of Artificial Sequence: Synthetic oligonucleotide
  Target: SCN9A; (+) strand; PAM type: YTN; PAM sequence: TTT
gaactcaatcatcttttgat

SEQ ID NO: 110884 - DNA, 20 bp, Artificial Sequence
  Description of Artificial Sequence: Synthetic oligonucleotide
  Target: SCN9A; (+) strand; PAM type: YTN; PAM sequence: TTG
aactcaatcatcttttgata

SEQ ID NO: 110885 - DNA, 20 bp, Artificial Sequence
  Description of Artificial Sequence: Synthetic oligonucleotide
  Target: SCN9A; (+) strand; PAM type: YTN; PAM sequence: CTC
aatcatcttttgataactct

SEQ ID NO: 110886 - DNA, 20 bp, Artificial Sequence
  Description of Artificial Sequence: Synthetic oligonucleotide
  Target: SCN9A; (+) strand; PAM type: YTN; PAM sequence: CTT
ttgataactctgcagtcttc

SEQ ID NO: 110887 - DNA, 20 bp, Artificial Sequence
  Description of Artificial Sequence: Synthetic oligonucleotide
  Target: SCN9A; (+) strand; PAM type: YTN; PAM sequence: TTT
tgataactctgcagtcttct

SEQ ID NO: 110888 - DNA, 20 bp, Artificial Sequence
  Description of Artificial Sequence: Synthetic oligonucleotide
  Target: SCN9A; (+) strand; PAM type: YTN; PAM sequence: TTT
gataactctgcagtcttctc

SEQ ID NO: 110889 - DNA, 20 bp, Artificial Sequence
  Description of Artificial Sequence: Synthetic oligonucleotide
  Target: SCN9A; (+) strand; PAM type: YTN; PAM sequence: TTG
ataactctgcagtcttctct

SEQ ID NO: 110890 - DNA, 20 bp, Artificial Sequence
  Description of Artificial Sequence: Synthetic oligonucleotide
  Target: SCN9A; (+) strand; PAM type: YTN; PAM sequence: CTC
tgcagtcttctcttctatct

SEQ ID NO: 110891 - DNA, 20 bp, Artificial Sequence
  Description of Artificial Sequence: Synthetic oligonucleotide
  Target: SCN9A; (+) strand; PAM type: YTN; PAM sequence: CTG
cagtcttctcttctatcttt

SEQ ID NO: 110892 - DNA, 20 bp, Artificial Sequence
  Description of Artificial Sequence: Synthetic oligonucleotide
  Target: SCN9A; (+) strand; PAM type: YTN; PAM sequence: CTT
ctcttctatctttcctcctg

SEQ ID NO: 110893 - DNA, 20 bp, Artificial Sequence
  Description of Artificial Sequence: Synthetic oligonucleotide
  Target: SCN9A; (+) strand; PAM type: YTN; PAM sequence: TTC
tcttctatctttcctcctgt

SEQ ID NO: 110894 - DNA, 20 bp, Artificial Sequence
  Description of Artificial Sequence: Synthetic oligonucleotide
  Target: SCN9A; (+) strand; PAM type: YTN; PAM sequence: CTC
ttctatctttcctcctgttt

SEQ ID NO: 110895 - DNA, 20 bp, Artificial Sequence
  Description of Artificial Sequence: Synthetic oligonucleotide
  Target: SCN9A; (+) strand; PAM type: YTN; PAM sequence: CTT
ctatctttcctcctgtttcg

SEQ ID NO: 110896 - DNA, 20 bp, Artificial Sequence
  Description of Artificial Sequence: Synthetic oligonucleotide
  Target: SCN9A; (+) strand; PAM type: YTN; PAM sequence: TTC
tatctttcctcctgtttcgg

SEQ ID NO: 110897 - DNA, 20 bp, Artificial Sequence
  Description of Artificial Sequence: Synthetic oligonucleotide
  Target: SCN9A; (+) strand; PAM type: YTN; PAM sequence: CTA
tctttcctcctgtttcggtg

SEQ ID NO: 110898 - DNA, 20 bp, Artificial Sequence
  Description of Artificial Sequence: Synthetic oligonucleotide
  Target: SCN9A; (+) strand; PAM type: YTN; PAM sequence: CTT
tcctcctgtttcggtggagc

SEQ ID NO: 110899 - DNA, 20 bp, Artificial Sequence
  Description of Artificial Sequence: Synthetic oligonucleotide
  Target: SCN9A; (+) strand; PAM type: YTN; PAM sequence: TTT
cctcctgtttcggtggagct

SEQ ID NO: 110900 - DNA, 20 bp, Artificial Sequence
  Description of Artificial Sequence: Synthetic oligonucleotide
  Target: SCN9A; (+) strand; PAM type: YTN; PAM sequence: TTC
ctcctgtttcggtggagctg

SEQ ID NO: 110901 - DNA, 20 bp, Artificial Sequence
  Description of Artificial Sequence: Synthetic oligonucleotide
  Target: SCN9A; (+) strand; PAM type: YTN; PAM sequence: CTC
ctgtttcggtggagctgtcg

SEQ ID NO: 110902 - DNA, 20 bp, Artificial Sequence
  Description of Artificial Sequence: Synthetic oligonucleotide
  Target: SCN9A; (+) strand; PAM type: YTN; PAM sequence: CTG
tttcggtggagctgtcgctc

SEQ ID NO: 110903 - DNA, 20 bp, Artificial Sequence
  Description of Artificial Sequence: Synthetic oligonucleotide
  Target: SCN9A; (+) strand; PAM type: YTN; PAM sequence: TTT
cggtggagctgtcgctcccc

SEQ ID NO: 110904 - DNA, 20 bp, Artificial Sequence
  Description of Artificial Sequence: Synthetic oligonucleotide
  Target: SCN9A; (+) strand; PAM type: YTN; PAM sequence: TTC
ggtggagctgtcgctcccct

SEQ ID NO: 110905 - DNA, 20 bp, Artificial Sequence
  Description of Artificial Sequence: Synthetic oligonucleotide
  Target: SCN9A; (+) strand; PAM type: YTN; PAM sequence: CTG
tcgctcccctttactctttc

SEQ ID NO: 110906 - DNA, 20 bp, Artificial Sequence
  Description of Artificial Sequence: Synthetic oligonucleotide
  Target: SCN9A; (+) strand; PAM type: YTN; PAM sequence: CTC
ccctttactctttcactttc

SEQ ID NO: 110907 - DNA, 20 bp, Artificial Sequence
  Description of Artificial Sequence: Synthetic oligonucleotide
  Target: SCN9A; (+) strand; PAM type: YTN; PAM sequence: CTT
tactctttcactttcacgag

SEQ ID NO: 110908 - DNA, 20 bp, Artificial Sequence
  Description of Artificial Sequence: Synthetic oligonucleotide
  Target: SCN9A; (+) strand; PAM type: YTN; PAM sequence: TTT
actctttcactttcacgagg

SEQ ID NO: 110909 - DNA, 20 bp, Artificial Sequence
  Description of Artificial Sequence: Synthetic oligonucleotide
  Target: SCN9A; (+) strand; PAM type: YTN; PAM sequence: TTA
ctctttcactttcacgagga

SEQ ID NO: 110910 - DNA, 20 bp, Artificial Sequence
  Description of Artificial Sequence: Synthetic oligonucleotide
  Target: SCN9A; (+) strand; PAM type: YTN; PAM sequence: CTC
tttcactttcacgaggactt

SEQ ID NO: 110911 - DNA, 20 bp, Artificial Sequence
  Description of Artificial Sequence: Synthetic oligonucleotide
  Target: SCN9A; (+) strand; PAM type: YTN; PAM sequence: CTT
tcactttcacgaggacttga

SEQ ID NO: 110912 - DNA, 20 bp, Artificial Sequence
  Description of Artificial Sequence: Synthetic oligonucleotide
  Target: SCN9A; (+) strand; PAM type: YTN; PAM sequence: TTT
cactttcacgaggacttgac

SEQ ID NO: 110913 - DNA, 20 bp, Artificial Sequence
  Description of Artificial Sequence: Synthetic oligonucleotide
  Target: SCN9A; (+) strand; PAM type: YTN; PAM sequence: TTC
actttcacgaggacttgact

SEQ ID NO: 110914 - DNA, 20 bp, Artificial Sequence
  Description of Artificial Sequence: Synthetic oligonucleotide
  Target: SCN9A; (+) strand; PAM type: YTN; PAM sequence: CTT
tcacgaggacttgacttctc

SEQ ID NO: 110915 - DNA, 20 bp, Artificial Sequence
  Description of Artificial Sequence: Synthetic oligonucleotide
  Target: SCN9A; (+) strand; PAM type: YTN; PAM sequence: TTT
cacgaggacttgacttctcc

SEQ ID NO: 110916 - DNA, 20 bp, Artificial Sequence
  Description of Artificial Sequence: Synthetic oligonucleotide
  Target: SCN9A; (+) strand; PAM type: YTN; PAM sequence: TTC
acgaggacttgacttctccc

SEQ ID NO: 110917 - DNA, 20 bp, Artificial Sequence
  Description of Artificial Sequence: Synthetic oligonucleotide
  Target: SCN9A; (+) strand; PAM type: YTN; PAM sequence: CTT
gacttctccctctctctcct

SEQ ID NO: 110918 - DNA, 20 bp, Artificial Sequence
  Description of Artificial Sequence: Synthetic oligonucleotide
  Target: SCN9A; (+) strand; PAM type: YTN; PAM sequence: TTG
acttctccctctctctcctg

SEQ ID NO: 110919 - DNA, 20 bp, Artificial Sequence
  Description of Artificial Sequence: Synthetic oligonucleotide
  Target: SCN9A; (+) strand; PAM type: YTN; PAM sequence: CTT
ctccctctctctcctgaatt

SEQ ID NO: 110920 - DNA, 20 bp, Artificial Sequence
  Description of Artificial Sequence: Synthetic oligonucleotide
  Target: SCN9A; (+) strand; PAM type: YTN; PAM sequence: TTC
tccctctctctcctgaattg

SEQ ID NO: 110921 - DNA, 20 bp, Artificial Sequence
  Description of Artificial Sequence: Synthetic oligonucleotide
  Target: SCN9A; (+) strand; PAM type: YTN; PAM sequence: CTC
cctctctctcctgaattgat

SEQ ID NO: 110922 - DNA, 20 bp, Artificial Sequence
  Description of Artificial Sequence: Synthetic oligonucleotide
  Target: SCN9A; (+) strand; PAM type: YTN; PAM sequence: CTC
tctctcctgaattgattcat

SEQ ID NO: 110923 - DNA, 20 bp, Artificial Sequence
  Description of Artificial Sequence: Synthetic oligonucleotide
  Target: SCN9A; (+) strand; PAM type: YTN; PAM sequence: CTC
tctcctgaattgattcatat

SEQ ID NO: 110924 - DNA, 20 bp, Artificial Sequence
  Description of Artificial Sequence: Synthetic oligonucleotide
  Target: SCN9A; (+) strand; PAM type: YTN; PAM sequence: CTC
tcctgaattgattcatatat

SEQ ID NO: 110925 - DNA, 20 bp, Artificial Sequence
  Description of Artificial Sequence: Synthetic oligonucleotide
  Target: SCN9A; (+) strand; PAM type: YTN; PAM sequence: CTC
ctgaattgattcatatataa

SEQ ID NO: 110926 - DNA, 20 bp, Artificial Sequence
  Description of Artificial Sequence: Synthetic oligonucleotide
  Target: SCN9A; (+) strand; PAM type: YTN; PAM sequence: CTG
aattgattcatatataacta

SEQ ID NO: 110927 - DNA, 20 bp, Artificial Sequence
  Description of Artificial Sequence: Synthetic oligonucleotide
  Target: SCN9A; (+) strand; PAM type: YTN; PAM sequence: TTG
attcatatataactactcat

SEQ ID NO: 110928 - DNA, 20 bp, Artificial Sequence
  Description of Artificial Sequence: Synthetic oligonucleotide
  Target: SCN9A; (+) strand; PAM type: YTN; PAM sequence: TTC
atatataactactcattcat

SEQ ID NO: 110929 - DNA, 20 bp, Artificial Sequence
  Description of Artificial Sequence: Synthetic oligonucleotide
  Target: SCN9A; (+) strand; PAM type: YTN; PAM sequence: CTA
ctcattcattatcactagca

SEQ ID NO: 110930 - DNA, 20 bp, Artificial Sequence
  Description of Artificial Sequence: Synthetic oligonucleotide
  Target: SCN9A; (+) strand; PAM type: YTN; PAM sequence: CTC
attcattatcactagcaaaa

SEQ ID NO: 110931 - DNA, 20 bp, Artificial Sequence
  Description of Artificial Sequence: Synthetic oligonucleotide
  Target: SCN9A; (+) strand; PAM type: YTN; PAM sequence: TTC
attatcactagcaaaacatc

SEQ ID NO: 110932 - DNA, 20 bp, Artificial Sequence
  Description of Artificial Sequence: Synthetic oligonucleotide
  Target: SCN9A; (+) strand; PAM type: YTN; PAM sequence: TTA
tcactagcaaaacatccata

SEQ ID NO: 110933 - DNA, 20 bp, Artificial Sequence
  Description of Artificial Sequence: Synthetic oligonucleotide
  Target: SCN9A; (+) strand; PAM type: YTN; PAM sequence: CTA
gcaaaacatccatacaaaaa

SEQ ID NO: 110934 - DNA, 20 bp, Artificial Sequence
  Description of Artificial Sequence: Synthetic oligonucleotide
  Target: SCN9A; (+) strand; PAM type: YTN; PAM sequence: TTT
ttttaaatgccagccatttg

SEQ ID NO: 110935 - DNA, 20 bp, Artificial Sequence
  Description of Artificial Sequence: Synthetic oligonucleotide
  Target: SCN9A; (+) strand; PAM type: YTN; PAM sequence: TTT
tttaaatgccagccatttgc

SEQ ID NO: 110936 - DNA, 20 bp, Artificial Sequence
  Description of Artificial Sequence: Synthetic oligonucleotide
  Target: SCN9A; (+) strand; PAM type: YTN; PAM sequence: TTT
ttaaatgccagccatttgcc

SEQ ID NO: 110937 - DNA, 20 bp, Artificial Sequence
  Description of Artificial Sequence: Synthetic oligonucleotide
  Target: SCN9A; (+) strand; PAM type: YTN; PAM sequence: TTT
taaatgccagccatttgccc

SEQ ID NO: 110938 - DNA, 20 bp, Artificial Sequence
  Description of Artificial Sequence: Synthetic oligonucleotide
  Target: SCN9A; (+) strand; PAM type: YTN; PAM sequence: TTT
aaatgccagccatttgcccc

SEQ ID NO: 110939 - DNA, 20 bp, Artificial Sequence
  Description of Artificial Sequence: Synthetic oligonucleotide
  Target: SCN9A; (+) strand; PAM type: YTN; PAM sequence: TTA
aatgccagccatttgcccca

SEQ ID NO: 110940 - DNA, 20 bp, Artificial Sequence
  Description of Artificial Sequence: Synthetic oligonucleotide
  Target: SCN9A; (+) strand; PAM type: YTN; PAM sequence: TTT
gccccattattctgcttccc

SEQ ID NO: 110941 - DNA, 20 bp, Artificial Sequence
  Description of Artificial Sequence: Synthetic oligonucleotide
  Target: SCN9A; (+) strand; PAM type: YTN; PAM sequence: TTG
ccccattattctgcttccct

SEQ ID NO: 110942 - DNA, 20 bp, Artificial Sequence
  Description of Artificial Sequence: Synthetic oligonucleotide
  Target: SCN9A; (+) strand; PAM type: YTN; PAM sequence: TTA
ttctgcttccctttatagcc

SEQ ID NO: 110943 - DNA, 20 bp, Artificial Sequence
  Description of Artificial Sequence: Synthetic oligonucleotide
  Target: SCN9A; (+) strand; PAM type: YTN; PAM sequence: TTC
tgcttccctttatagccaaa

SEQ ID NO: 110944 - DNA, 20 bp, Artificial Sequence
  Description of Artificial Sequence: Synthetic oligonucleotide
  Target: SCN9A; (+) strand; PAM type: YTN; PAM sequence: CTG
cttccctttatagccaaatt

SEQ ID NO: 110945 - DNA, 20 bp, Artificial Sequence
  Description of Artificial Sequence: Synthetic oligonucleotide
  Target: SCN9A; (+) strand; PAM type: YTN; PAM sequence: CTT
ccctttatagccaaatttct

SEQ ID NO: 110946 - DNA, 20 bp, Artificial Sequence
  Description of Artificial Sequence: Synthetic oligonucleotide
  Target: SCN9A; (+) strand; PAM type: YTN; PAM sequence: TTC
cctttatagccaaatttctt

SEQ ID NO: 110947 - DNA, 20 bp, Artificial Sequence
  Description of Artificial Sequence: Synthetic oligonucleotide
  Target: SCN9A; (+) strand; PAM type: YTN; PAM sequence: CTT
tatagccaaatttcttggga

SEQ ID NO: 110948 - DNA, 20 bp, Artificial Sequence
  Description of Artificial Sequence: Synthetic oligonucleotide
  Target: SCN9A; (+) strand; PAM type: YTN; PAM sequence: TTT
atagccaaatttcttgggag

SEQ ID NO: 110949 - DNA, 20 bp, Artificial Sequence
  Description of Artificial Sequence: Synthetic oligonucleotide
  Target: SCN9A; (+) strand; PAM type: YTN; PAM sequence: TTA
tagccaaatttcttgggaga

SEQ ID NO: 110950 - DNA, 20 bp, Artificial Sequence
  Description of Artificial Sequence: Synthetic oligonucleotide
  Target: SCN9A; (+) strand; PAM type: YTN; PAM sequence: TTT
cttgggagaattgtctacac

SEQ ID NO: 110951 - DNA, 20 bp, Artificial Sequence
  Description of Artificial Sequence: Synthetic oligonucleotide
  Target: SCN9A; (+) strand; PAM type: YTN; PAM sequence: TTC
ttgggagaattgtctacaca

SEQ ID NO: 110952 - DNA, 20 bp, Artificial Sequence
  Description of Artificial Sequence: Synthetic oligonucleotide
  Target: SCN9A; (+) strand; PAM type: YTN; PAM sequence: CTT
gggagaattgtctacacata

SEQ ID NO: 110953 - DNA, 20 bp, Artificial Sequence
  Description of Artificial Sequence: Synthetic oligonucleotide
  Target: SCN9A; (+) strand; PAM type: YTN; PAM sequence: TTG
ggagaattgtctacacatat

SEQ ID NO: 110954 - DNA, 20 bp, Artificial Sequence
  Description of Artificial Sequence: Synthetic oligonucleotide
  Target: SCN9A; (+) strand; PAM type: YTN; PAM sequence: TTG
tctacacatattaccttctt

SEQ ID NO: 110955 - DNA, 20 bp, Artificial Sequence
  Description of Artificial Sequence: Synthetic oligonucleotide
  Target: SCN9A; (+) strand; PAM type: YTN; PAM sequence: CTA
cacatattaccttctttctg

SEQ ID NO: 110956 - DNA, 20 bp, Artificial Sequence
  Description of Artificial Sequence: Synthetic oligonucleotide
  Target: SCN9A; (+) strand; PAM type: YTN; PAM sequence: TTA
ccttctttctgacctcttct

SEQ ID NO: 110957 - DNA, 20 bp, Artificial Sequence
  Description of Artificial Sequence: Synthetic oligonucleotide
  Target: SCN9A; (+) strand; PAM type: YTN; PAM sequence: CTT
ctttctgacctcttcttttc

SEQ ID NO: 110958 - DNA, 20 bp, Artificial Sequence
  Description of Artificial Sequence: Synthetic oligonucleotide
  Target: SCN9A; (+) strand; PAM type: YTN; PAM sequence: TTC
tttctgacctcttcttttca

SEQ ID NO: 110959 - DNA, 20 bp, Artificial Sequence
  Description of Artificial Sequence: Synthetic oligonucleotide
  Target: SCN9A; (+) strand; PAM type: YTN; PAM sequence: CTT
tctgacctcttcttttcacc

SEQ ID NO: 110960 - DNA, 20 bp, Artificial Sequence
  Description of Artificial Sequence: Synthetic oligonucleotide
  Target: SCN9A; (+) strand; PAM type: YTN; PAM sequence: TTT
ctgacctcttcttttcaccc
